US012644137B2

(12) United States Patent
Chakraborty et al.

(10) Patent No.: US 12,644,137 B2
(45) Date of Patent: Jun. 2, 2026

(54) MATERIALS AND METHODS FOR TREATMENT OF HEMOGLOBINOPATHIES

(71) Applicant: Vertex Pharmaceuticals Incorporated, Boston, MA (US)

(72) Inventors: Tirtha Chakraborty, Cambridge, MA (US); Bibhu Prasad Mishra, Cambridge, MA (US); Chad Albert Cowan, Cambridge, MA (US); Ante Sven Lundberg, Cambridge, MA (US); Samarth Kulkarni, Cambridge, MA (US); Todd Douglass Borland, Cambridge, MA (US)

(73) Assignee: Vertex Pharmaceuticals Incorporated, Boston, MA (US)

( * ) Notice: Subject to any disclaimer, the term of this patent is extended or adjusted under 35 U.S.C. 154(b) by 785 days.

(21) Appl. No.: 16/758,990

(22) PCT Filed: Oct. 26, 2018

(86) PCT No.: PCT/IB2018/001338
§ 371 (c)(1),
(2) Date: Apr. 24, 2020

(87) PCT Pub. No.: WO2019/081982
PCT Pub. Date: May 2, 2019

(65) Prior Publication Data
US 2021/0180091 A1 Jun. 17, 2021

Related U.S. Application Data

(60) Provisional application No. 62/577,434, filed on Oct. 26, 2017, provisional application No. 62/583,146, filed on Nov. 8, 2017.

(51) Int. Cl.
| | |
|---|---|
| *C12N 5/078* | (2010.01) |
| *A61K 9/51* | (2006.01) |
| *A61K 31/395* | (2006.01) |
| *A61K 31/70* | (2006.01) |
| *A61K 35/28* | (2015.01) |
| *A61K 38/19* | (2006.01) |
| *A61K 38/46* | (2006.01) |
| *C12N 5/074* | (2010.01) |
| *C12N 15/11* | (2006.01) |
| *C12N 15/113* | (2010.01) |
| *C12N 15/90* | (2006.01) |
| *A61K 35/12* | (2015.01) |

(52) U.S. Cl.
CPC .......... *C12N 15/907* (2013.01); *A61K 9/5123* (2013.01); *A61K 31/395* (2013.01); *A61K 31/70* (2013.01); *A61K 35/28* (2013.01); *A61K 38/193* (2013.01); *A61K 38/465* (2013.01); *C12N 5/0696* (2013.01); *C12N 15/11* (2013.01); *A61K 2035/124* (2013.01); *C12N 2310/20* (2017.05); *C12N 2506/1353*

(2013.01); *C12N 2506/27* (2013.01); *C12N 2510/00* (2013.01); *C12N 2800/80* (2013.01)

(58) Field of Classification Search
None
See application file for complete search history.

(56) References Cited

U.S. PATENT DOCUMENTS

| | | | |
|---|---|---|---|
| 9,738,693 | B2 | 8/2017 | Telford et al. |
| 9,840,538 | B2 | 12/2017 | Telford et al. |
| 10,738,305 | B2 | 8/2020 | Porteus |
| 11,268,077 | B2 | 3/2022 | Chakraborty et al. |
| 11,566,236 | B2 | 1/2023 | Chakraborty et al. |
| 2014/0093913 | A1 | 4/2014 | Cost et al. |
| 2015/0044772 | A1 | 2/2015 | Zhao |
| 2015/0132269 | A1 | 5/2015 | Orkin et al. |
| 2015/0166969 | A1 | 6/2015 | Takeuchi et al. |
| 2015/0168547 | A1 | 6/2015 | Lee et al. |
| 2015/0183025 | A1 | 7/2015 | Aoki |
| 2015/0307867 | A1 | 10/2015 | Orkin et al. |
| 2016/0029604 | A1 | 2/2016 | Fahrenkrug et al. |
| 2016/0168594 | A1 | 6/2016 | Zhang et al. |
| 2016/0289675 | A1 | 10/2016 | Ryan et al. |
| 2017/0191123 | A1 | 7/2017 | Kim et al. |
| 2018/0016589 | A1 | 1/2018 | Gao et al. |

(Continued)

FOREIGN PATENT DOCUMENTS

| | | |
|---|---|---|
| CN | 104284669 A | 1/2015 |
| CN | 104955943 A | 9/2015 |

(Continued)

OTHER PUBLICATIONS

Huang et al, In vivo delivery of CRISPR-Cas9 genome editing components for therapeutic applications, Biomaterials, 2022, pp. 1-20.*

(Continued)

*Primary Examiner* — Maria Marvich

(74) *Attorney, Agent, or Firm* — McNeill PLLC

(57) ABSTRACT

Provided are materials and methods for treating patients with hemoglobinopathies, either ex vivo or in vivo. Also provided are materials and methods for deleting and/or mutating a portion of a human beta globin locus on chromosome 11 and one or more of: a BCL11 A gene on chromosome 2, and a DNA sequence that encodes a transcriptional control region of the BCL11 A gene on chromosome 2, in a human cell by genome editing and thereby increasing the production of fetal hemoglobin (HbF) in the genome-edited human cells.

18 Claims, 79 Drawing Sheets

Specification includes a Sequence Listing.

(56) References Cited

U.S. PATENT DOCUMENTS

| | | | |
|---|---|---|---|
| 2018/0021413 A1 | 1/2018 | Porteus | |
| 2018/0030438 A1 | 2/2018 | Porteus et al. | |
| 2018/0094033 A1 | 4/2018 | Telford et al. | |
| 2018/0112213 A1 | 4/2018 | Welstead et al. | |
| 2018/0119138 A1 | 5/2018 | Bauer et al. | |
| 2018/0119140 A1 | 5/2018 | Porteus et al. | |
| 2018/0179521 A1 | 6/2018 | Rahdar et al. | |
| 2018/0200387 A1 | 7/2018 | Porteus | |
| 2018/0273609 A1 | 9/2018 | Porteus | |
| 2019/0201553 A1 | 7/2019 | Cowan et al. | |
| 2019/0256829 A1 | 8/2019 | Chakraborty et al. | |
| 2019/0284542 A1 | 9/2019 | Chakraborty et al. | |
| 2020/0157515 A1* | 5/2020 | Gori | A61K 38/465 |
| 2020/0330609 A1* | 10/2020 | Cowan | A61K 31/395 |
| 2020/0384033 A1 | 12/2020 | Morawa et al. | |
| 2021/0009998 A1 | 1/2021 | Porteus | |
| 2021/0317450 A9 | 10/2021 | Chakraborty et al. | |
| 2022/0211874 A1 | 7/2022 | Cowan et al. | |
| 2022/0259578 A1 | 8/2022 | Chakraborty et al. | |

FOREIGN PATENT DOCUMENTS

| | | | | |
|---|---|---|---|---|
| JP | 2000201672 A | 7/2000 | | |
| JP | 2019-500043 A | 1/2019 | | |
| JP | 2019-513407 A | 5/2019 | | |
| WO | WO 2013/126794 A1 | 8/2013 | | |
| WO | WO 2013/169398 A2 | 11/2013 | | |
| WO | WO 2013/176772 A1 | 11/2013 | | |
| WO | WO 2014/036219 A2 | 3/2014 | | |
| WO | WO 2015/183026 A1 | 5/2014 | | |
| WO | WO 2014/085593 A1 | 6/2014 | | |
| WO | WO 2014/093712 A1 | 6/2014 | | |
| WO | WO 2014/186585 A2 | 11/2014 | | |
| WO | WO 2014/197748 A2 | 12/2014 | | |
| WO | WO 2014/204723 A1 | 12/2014 | | |
| WO | WO 2015/006498 A2 | 1/2015 | | |
| WO | WO 2015/006747 A2 | 1/2015 | | |
| WO | WO 2015/026885 A1 | 2/2015 | | |
| WO | WO 2015/073683 A2 | 5/2015 | | |
| WO | WO 2015/113063 A1 | 7/2015 | | |
| WO | WO 2015/148860 A1 | 10/2015 | | |
| WO | WO 2015/148863 A2 | 10/2015 | | |
| WO | WO 2015/168547 A2 | 11/2015 | | |
| WO | WO 2015/183025 A1 | 12/2015 | | |
| WO | WO 2016/135557 A2 | 9/2016 | | |
| WO | WO 2016/135558 A2 | 9/2016 | | |
| WO | WO 2016/135559 A2 | 9/2016 | | |
| WO | WO 2016/164356 A1 | 10/2016 | | |
| WO | WO 2016/182917 A1 | 11/2016 | | |
| WO | WO 2016/183298 A2 | 11/2016 | | |
| WO | WO 2017/077394 A2 | 5/2017 | | |
| WO | WO2017115268 A1* | 7/2017 | C12N 15/113 | |
| WO | WO 2017/160890 A1 | 9/2017 | | |
| WO | WO 2017/182881 A2 | 10/2017 | | |
| WO | WO 2017/191503 A1 | 11/2017 | | |
| WO | WO 2018/081470 A1 | 5/2018 | | |
| WO | WO 2018/218135 A1 | 11/2018 | | |
| WO | WO 2019/081982 A1 | 5/2019 | | |
| WO | 110832075 * | 2/2020 | | |

OTHER PUBLICATIONS

Li et al, Application of induced pluripotent stem cell transplants: Autologous or allogeneic? Life Sciences vol. 212, Nov. 1, 2018, pp. 145-149.*
Ortuno et al, The Challenge of Bringing iPSCs to the Patient, International Journal of Molecular Sciences, 2019, pp. 1-16.*
Huang et a., iPSC-based Gene Therapy: Applications And Challenges, cell &gene, 2024, pp. 1-4.*
Ye et al, Genome editing using CRISPR-Cas9 to create the HPFH genotype in HSPCs: An approach for treating sickle cell disease and B-thalassemia, PNAS< 2016, pp. 10661-10665.*

[No Author Listed], Addgene, lentiGuide-Puro, plasmid #52963. Retrieved Sep. 4, 2020 from https://www.addgene.org/52963/. 22 pages.
Boulad et al., Safe mobilization of CD34+ cells in adults with ?-thalassemia and validation of effective globin gene transfer for clinical investigation. Blood. Mar. 6, 2014;123(10):1483-86.
Cong et al., Multiplex genome engineering using CRISPR/Cas systems. Sci. Feb. 15, 2013;339:819-23.
Costa et al., Genome Editing Using Engineered Nucleases and Their Use in Genomic Screening. Assay Guidance Manual. Nov. 20, 2017:1-24.
Hendel et al., Chemically modified guide RNAs enhance CRISPR-Cas genome editing in human primary cells. Nat Biotechnol. Sep. 1, 2015;33(9):985-9. Epub Jun. 29, 2015. Author manuscript provided, available in PMC Sep. 1, 2016:14 pages. doi: 10.1038/nbt. 3290.
Koonin et al., Diversity, classification and evolution of CRISPR-Cas systems. Curr Opin Microbiol. Jun. 2017;37:67-78. Author manuscript, available Jun. 9, 2018: 20 pages. Epub Jun. 9, 2017. doi: 10.1016/j.mib.2017.05.008.
International Search Report and Written Opinion mailed Apr. 15, 2019 for International Application No. PCT/IB2018/001338.
International Preliminary Report on Patentability mailed May 7, 2020 for International Application No. PCT/IB2018/001338.
[No Author Listed] Endonuclease. Wikipedia. Accessed Aug. 9, 2019. 6 pages.
[No Author Listed] Geneseq Submission; GSN, Database Accession No. GS_NUC_ALERT:WO2016161380.324727. Oct. 6, 2016. 1 page.
[No Author Listed], CRISPR Therapeutics and Vertex Announce New Clinical Data for Investigational Gene-Editing Therapy CTX001™ in Severe Hemoglobinopathies at the 25th Annual European Hematology Association (EHA) Congress. Vertex. Retrieved from: <https://news.vrtx.com/press-release/crispr-therapeutics-and-vertex-announce-new-clinical-data-investigational-gene>. Accessed on Jun. 25, 2020. 11 pages.
Bauer et al., An Erythroid Enhancer of BCL11A Subject to Genetuc Variation Determines Fetal Hemoglobin Level. Science. Oct. 11, 2013;342(6155):253-257.
Bauer et al., Crispr-Cas9 Saturating Mutagenesis Reveals an Achilles Heel in the BCL11A Erythroid Enhancer for Fetal Hemoglobin Induction (by Genome Editing). Blood. Dec. 2015;126(23): 638 pages.
Bauer et al., Fine-Mapping and Genome Editing Reveal An Essential Erythroid Enhancer At The HbF-Associated BCL11A Locus. Blood. Nov. 15, 2013;122(21):437, 1 page.
Bauer et al., Hemoglobin switching's surprise: the versatile transcription factor BCL11A is a master repressor of fetal hemoglobin. Curr Opin Genet Dev. Aug. 2015;33:62-70.
Blobel et al., An international effort to cure a global health problem: A report on the 19th Hemoglobin Switching Conference. Exp Hematol. Oct. 2015;43(10):1-30.
Brinkman et al., Easy quantification of template-directed CRISPR/Cas9 editing. Nucleic Acids Res. Jun. 1, 2018;46(10):e58. Doi: 10.1093/nar/gky164.
Brinkman et al., Easy quantitative assessment of genome editing by sequence trace decomposition. Nucleic Acids Res. Dec. 16, 2014;42(22):e168. Doi: 10.1093/nar/gku936. Epub Oct. 9, 2014.
Camaschella et al., A New Hereditary Persistence of Fetal Hemoglobin Deletion Has the Breakpoint Within the 3' β-Globin Gene Enhancer.Blood. 1990;75(4):1000-1005.
Canver et al., BCL11A enhancer dissection by Cas9-mediated in situ saturating mutagenesis. Nature. Nov. 12, 2015;527(7577):192-7.
Canver et al., Customizing the genome as therapy for the beta-hemoglobinopathies. Blood. Apr. 6, 2016;127(21):2536-45.
Chandrakasan et al., Gene Therapy for Hemoglobinopathies: The State of the Field and the Future. Hematol Oncol Clin North Am. Apr. 2014;28(2):1-23.
Cottle et al., Controlled delivery of beta-globin-targeting TALENs and CRISPR/Cas9 into mammalian cells for genome editing using microinjection. Sci Rep. Nov. 12, 2015;5:16031,13pages.

(56) References Cited

OTHER PUBLICATIONS

Cradick et al., CRISPR/Cas9 systems targeting β-globin and CCR5 genes have substantial off-target activity.Nucleic Acids Research. 2013;41(20):9584-9592.

De Montalembert, Management of Sickle Cell Disease. BMJ. Sep. 8, 2008;337:a1397. doi: 10.1136/bmj.a1397.

Deltcheva et al., CRISPR RNA maturation by trans-encoded small RNA and host factor Rnase III. Nature. Mar. 31, 2011;471(7340):602-7. Doi: 10.1038/nature09886.

Dever et al., CRISPR/Cas9 beta-globin gene targeting in human haematopoietic stem cells. Nature. Nov. 17, 2016;539(7629):384-389.

Dipersio et al., Plerixafor and G-CSF versus placebo and G-CSF to mobilixe hematopoietic stem cells for autologous stem cell transplantation in patients with multiple myeloma. Blood. Jun. 4, 2009;113(23):5720-6.

Ferrari et al., Gene Therapy Approaches to Hemoglobinopathies. Hematology-Oncology Clinics of North America. Sep. 9, 2019;31(5):835-852.

Flomenberg et al., The use of AMD3100 plus G-CSF for autologous hematopoietic progenitor cell mobilization is superior to G-CSF alone. Blood. Sep. 1, 2005;106(5):1867-74. Epub May 12, 2005.

Fonfara et al., Phylogeny of Cas9 determines functional exchange-ability of dual-RNA and Cas9 among orthologous type II CRISPR-Cas systems. Nucleic Acids Res. Feb. 2014;42(4):2577-90. Doi: 10.1093/nar/gkt1074. Epub Nov. 22, 2013.

Haridy, More early data revealed from landmark CRISPR gene editing human trial. New Atlas.Jun. 16, 2020. Retrieved from: <https://newatlas.com/medical/early-data-ctx001-crispr-gene-editing-human-trial/>. 6 pages.

Hendel et al., Chemically modified guide RNAs enhance CRISPR-Cas genome editing in human primary cells. Nat Biotechnol. Sep. 2015;33(9):985-89. Author manuscript provided. Available in PMC Sep. 1, 2016, 14 pages. doi: 10.1038/nbt.3290.

Henthorn et al., (A gamma delta beta)0-Thalassaemia in Blacks is due to a deletion of 34 kbp of DNA.British Journal of Haematology. 1985;59(2):343-356.

Howden et al., CRISPR gene editing causes hundreds of unintended, off-target mutations. Cosmos. 2017. 3 pages.

Huang et al., Abstract:Production of Gene-Corrected Adult Beta Globin Protein in Human Erythrocytes Differentiated from Patient iPSCs After Genome Editing of the Sickle Point Mutation. Stem Cells.2015;33(5):3.

Huang et al., Production of Gene-Corrected Adult Beta Globin Protein in Human Erythrocytes Differentiated from Patient iPSCs After Genome Editing of the Sickle Point Mutation. Stem Cells. May 2015;33(5):1470-9. doi: 10.1002/stem.1969.

Jinek et al., A programmable dual-RNA-guided DNA endonuclease in adaptive bacterial immunity. Science. Aug. 17, 2012;337(6096):816-21. Doi: 10.1126/science.1225829. Epub Jun. 28, 2012.

Joly et al., Identification and molecular characterization of four new large deletions in the β-globin gene cluster.Blood Cells, Molecules, and Diseases.2009;43:53-57.

Kuchler, Crispr puts first human in-body gene editing to test. Financial Times. Jan. 7, 2020. 6 pages.

Le Page, Three people with inherited diseases successfully treated with CRISPR. NewScientist. Jun. 12, 2020. Retrieved from: <https://www.newscientist.com/article/2246020-three-people-with-inherited-diseases-successfully-treated-with-crispr/>. 6 pages.

Li et al., Efficient CRISPR-Cas9 mediated gene disruption in primary erythroid progenitor cells. Haematologica. Jun. 2016;101(6):e216-9.

Li et al., Genome Editing in Erythroid Progenitor Cells Mediated By Crispr/Cas9. Blood. Dec. 2014; 124(21): 1345 pages.

Lin et al., Enhanced homology-directed human genome engineering by controlled timing of CRISPR/Cas9 delivery. eLIFE. Dec. 15, 2014;3:e04766, 13pages. doi: 10.7554/eLife.04766.

Maeder et al., Genome-editing Technologies for Geneand Cell Therapy. Mol Ther. Mar. 2016;24(3):430-446.

Mansilla-Soto et al., Cell and Gene Therapy for the Beta-Thalassemias: Advances and Prospects. Hum Gene Ther. Apr. 2016;27(4):295-304. doi: 10.1089/hum.2016.037.

Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.

Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.

Mullin, CRISPR eliminated symptoms of genetic disease in 2 patients. One Zero. Nov. 20, 2019. 5 pages.

Orkin et al., Recent advances in globin research using genome-wide association studies and gene editing. Ann N Y Acad Sci. Mar. 2016;1368(1):1-11.

Parsons, Vertex reveals promising data from first CRISPR-treated patients. PMLive. Nov. 20, 2020. Retrieved from: <http://www.pmlive.com/pharma_news/vertex_reveals_promising_data_from_first_crispr-treated_patients_1317564>. 2 pages.

Roosjen et al., Transcriptional regulators Myb and BCL11A interplay with DNA methyltransferase 1 in developmental silencing of embryonic and fetal β-like globin genes. FASEB J. Apr. 2014;28(4):1610-20. Epub Dec. 26, 2013.

Saglio et al., Italian Type of Deletional Hereditary Persistence of Fetal Hemoglobin.Blood.1986;686(3):646-651.

Sanjana et al., Improved vectors and genome-wide libraries for CRISPR screening. Nat Methods. Aug. 2014;11(8):783-4. doi: 10.1038/nmeth.3047.

Sanjana et al., Supplementary Materials: Improved vectors and genome-wide libraries for CRISPR screening. Nat Methods. Aug. 2014;11(8):22 pages. doi: 10.1038/nmeth.3047.

Sebastiano et al., In Situ Genetic Correction of the Sickle Cell Anemia Mutation in Human Induced Pluripotent Stem Cells Using Engineered Zinc Finger Nucleases.Stem Cells.2011;29:1717-1726.

Sheth et al., Sickle cell disease: time for a closer look at treatment options? BJH. Aug. 2013;162(4):455-64.

Song et al., Improved hematopoietic differentiation efficiency of gene-corrected beta-thalassemia induced pluripotent stem cells by CRISPR/Cas9 system. Stem Cells Dev. May 1, 2015;24(9):1053-65. doi: 10.1089/scd.2014.0347. Epub Feb. 5, 2015.

Stein et al., Compilation of Press Releases. Vertex, CRISPR Therapeutics. Nov. 19, 2019. 40 pages.

Stein, A Year In, 1st Patient To Get Gene Editing For Sickle Cell Disease Is Thriving. NPR. Jun. 23, 2020. Retrieved from: <https://www.npr.org/sections/health-shots/2020/06/23/877543610/a-year-in-1st-patient-to-get-gene-editing-for-sickle-cell-disease-is-thriving>. 26 pages.

Suzuki et al., Fetal globin gene repressors as drug targets for molecular therapies to treat the β-globinopathies. Mol Cell Biol. Oct. 1, 2014;34(19):3560-9. Epub Jul. 14, 2014.

Townes et al., Modified IPS Cells for Hemoglobinopathies. Blood. Dec. 2015;126(23):SCI-17.

Traxler et al., Genome Editing Recreates Hereditary Persistence of Fetal Hemoglobin in Primary Human Erythroblasts. Blood. Dec. 3, 2015;126(23):4 pages.

Urnov et al., Genome editing with engineered zinc finger nucleases. Nat Rev Genet. Sep. 2010;11:636-46. doi: 10.1038/nrg2842.

Wartiovaara et al., CRISPR-Cas9 gene editing of CD34+cells to increase fetal hemoglobin (HbF) production. Collaborative Congress of the European-Society-of-Gene-and-Cell-Therapy. Oct. 2015;26.

Xie et al., Seamless gene correction of [beta]-thalassemia mutation in patient-specific iPSCs using CRISPR/Cas9 and piggyBac. Genome Res. Aug. 5, 2014;24(9):1526-1533.

Xu et al., Both TALENs and CRISPR/Cas9 directly target the HBB IVS2-654 (C>T) mutation in [beta]-thalassemia-derived iPSCs. Scientific Reports. Jul. 9, 2015;5(12065):1-12.

Ye et al., Genome editing using CRISPR-Cas9 to create the HPFH genotype in HSPCs: An approach for treating sickle cell disease and β-thalassemia. Proc Natl Acad Sci U S A. Sep. 20, 2016;113(38):10661-5. doi: 10.1073/pnas.1612075113. Epub Sep. 6, 2016.

Zhu, Overview of guide RNA design tools for CRISPR-Cas9 genome editing technology. Front Biol. Aug. 2015;10(4):289-296. doi: 10.1007/s11515-015-1366-y.

(56)     References Cited

OTHER PUBLICATIONS

Zipkin, CRISPR's "magnificent moment" in the clinic. Nat Biotechnol. Dec. 6, 2019. 4 pages.

[No Author Listed] Endonuclease. Wikipedia. Accessed Jun. 3, 2021. 6 pages.

[No Author Listed]. Synth-a-Freeze, Product Manual. GIBCO. 2010;1-2.

Sun et al., Seamless correction of the sickle cell disease mutation of the HBB gene in human induced pluripotent stem cells using TALENs. Biotechnol Bioeng. May 2014;111(5):1048-53. doi: 10.1002/bit.25018. Epub Aug. 26, 2013.

Thein et al., Control of fetal hemoglobin: new insights emerging from genomics and clinical implications. Hum Mol Genet. Oct. 15, 2009:18(R2):R216-23. doi: 10.1093/hmg/ddp401.

Tuan et al., Different 3' end points of deletions causing delta beta-thalassemia and hereditary persistence of fetal hemoglobin: implications for the control of gamma-globin gene expression in man. Proc Natl Acad Sci U S A. Nov. 1983;80(22):6937-41. doi: 10.1073/pnas.80.22.6937.

Zhang et al., Optimization of genome editing through CRISPR-Cas9 engineering. Bioengineered. Apr. 2016;7(3):166-74. doi: 10.1080/21655979.2016.1189039.

[No Author Listed], Addgene, lentiCas9-Blast, plasmid #52962. Retrieved Apr. 2, 2023 from https://www.addgene.org/52963/. 2 pages.

Brendel et al., Lineage-specific BCL11A knockdown circumvents toxicities and reverses sickle phenotype. J Clin Invest. Oct. 3, 2016;126(10):3868-3878. doi: 10.1172/JCI87885. Epub Sep. 6, 2016.

Frangoul et al., CRISPR-Cas9 gene editing for sickle cell disease and β-thalassemia. New England Journal of Medicine. Jan. 21, 2021;384(3):252-60.

Hsu et al., Development and applications of CRISPR-Cas9 for genome engineering. Cell. Jun. 5, 2014;157(6):1262-78.

Kim et al., Highly efficient RNA-guided genome editing in human cells via delivery of purified Cas9 ribonucleoproteins. Genome research. Jun. 1, 2014;24(6):1012-9.

Leake et al., Gene therapy cures patient with sickle cell disease. Article Image. The Sunday Times. Dec. 1, 2019. Accessed Jun. 2020. 1 page.

Staahl et al., Efficient genome editing in the mouse brain by local delivery of engineered Cas9 ribonucleoprotein complexes. Nat Biotechnol. May 2017;35(5):431-434. doi: 10.1038/nbt.3806. Epub Feb. 13, 2017.

Svalgaard et al., Low-molecular-weight carbohydrate Pentaisomaltose may replace dimethyl sulfoxide as a safer cryoprotectant for cryopreservation of peripheral blood stem cells. Transfusion. May 2016;56(5):1088-95. doi: 10.1111/trf.13543. Epub Mar. 15, 2016.

Yannaki et al., Hematopoietic stem cell mobilization for gene therapy: superior mobilization by the combination of granulocyte-colony stimulating factor plus plerixafor in patients with β-thalassemia major. Human gene therapy. Oct. 1, 2013;24(10):852-60.

* cited by examiner

FIG. 5B ggggcccccttcactatctcaatgcaaataggccgaacgaccgggctaaactcccctgggttgg   SEQ ID NO: 228,309

BCL11A_58+ Region Indel Freq in K562

BCL11A_58+ Region Indel Freq in K562

FIG. 10B

| | gRNA Combination | | | | |
|---|---|---|---|---|---|
| sample | left gRNA | position | right gRNA | position | deletion size |
| 1 | BCL11A_74F | 1340bp | BCL11A_19 | 1490bp | 150bp |
| 2 | BCL11A_74F | 1340bp | BCL11A_24 | 1580bp | 240bp |
| 3 | BCL11A_74F | 1340bp | BCL11A_51 | 1510bp | 170bp |
| 4 | BCL11A_74F | 1340bp | BCL11A_26 | 2470bp | 1130bp |
| 5 | BCL11A_74F | 1340bp | BCL11A_83 | 2430bp | 1090bp |
| 6 | BCL11A_74F | 1340bp | BCL11A_86 | 2360bp | 1010bp |
| 7 | BCL11A_74F | 1340bp | BCL11A_45 | 2350bp | 1020bp |
| 8 | BCL11A_74F | 1340bp | BCL11A_90 | 2220bp | 880bp |
| 9 | BCL11A_74F | 1340bp | BCL11A_74R | 2170bp | 830bp |
| 10 | BCL11A_74F | 1340bp | BCL11A_57 | 2100bp | 760bp |
| 11 | BCL11A_62 | 1400bp | NA | 1400bp | NA |
| 12 | BCL11A_74 | 1340bp | NA | 1340bp | NA |
| 13 | BCL11A_19 | 1490bp | NA | 1490bp | NA |
| 14 | BCL11A_24 | 1580bp | NA | 1580bp | NA |
| 15 | BCL11A_51 | 1510bp | NA | 1510bp | NA |
| 16 | BCL11A_26 | 2470bp | NA | 2470bp | NA |
| 17 | BCL11A_83 | 2430bp | NA | 2430bp | NA |
| 18 | BCL11A_86 | 2360bp | NA | 2360bp | NA |
| 19 | BCL11A_45 | 2350bp | NA | 2350bp | NA |
| 20 | BCL11A_90 | 2220bp | NA | 2220bp | NA |
| 21 | BCL11A_74 | 2170bp | NA | 2170bp | NA |
| 22 | BCL11A_57 | 2100bp | NA | 2100bp | NA |
| 23 | CL01 | controls | NA | controls | NA |
| 24 | CL08 | controls | NA | controls | NA |
| 25 | CL01 | controls | CL08 | controls | 7200bp |
| 26 | IL2RG | controls | NA | controls | NA |
| 27 | hEMX1 | controls | NA | controls | NA |

FIG. 11A

| COSMID gRNA NAME | CTX gRNA name | gRNA Seq (20nt) without PAM | gRNA |
|---|---|---|---|
| BCL11A_26 | R1 | AATACATCCTTGAGCTACAC | R1 |
| BCL11A_83 | R2 | GTGATGCTGACAGGCCACAT | R2 |
| BCL11A_30 | R3 | CATGGGAGAGTGGGAAGACG | R3 |
| BCL11A_85 | R4 | ATGGGAGAGTGGGAAGACGT | R4 |
| BCL11A_60 | R5 | AGAGTGGGAAGACGTGGGCT | R5 |
| BCL11A_50 | R6 | TCTGTGCATGGCCTCTAAAC | R6 |
| BCL11A_86 | R7 | CTGTGCATGGCCTCTAAACT | R7 |
| BCL11A_45 | R8 | TCTAAACTGGGCAGTGACCA | R8 |
| BCL11A_49 | R9 | ACTGGGCAGTGACCATGGCC | R9 |
| BCL11A_84 | R10 | TTGCCCCTCTGTAAACAAGG | R10 |
| BCL11A_92 | R11 | TTTTGCCAAGATGGGAGTAT | R11 |
| BCL11A_90 | R12 | TTTGCCAAGATGGGAGTATG | R12 |
| BCL11A_74 | R13 | AGTGAGATGAGATATCAAAG | R13 |
| BCL11A_42 | R14 | CCATCTCCCTAATCTCCAAT | R14 |
| BCL11A_31 | R15 | AATTGGCAAAGCCAGACTTG | R15 |
| BCL11A_57 | R16 | AGACTTGGGGCAATACAGAC | R16 |
| BCL11A_54 | R17 | TGAACTAAAATGCTGCCTCC | R17 |
| BCL11A_52 | R18 | CCTTTCCCCAATTCCTAGTT | R18 |
| BCL11A_20 | R19 | AAGGAAAGAATATGACGTC | R19 |
| BCL11A_65 | R20 | AGGAAAGAATATGACGTCA | R20 |
| BCL11A_1 | R21 | GAAAAGAATATGACGTCAGG | R21 |
| BCL11A_16 | R22 | AAGAATATGACGTCAGGGGG | R22 |
| BCL11A_41 | R23 | TCAGGGGGAGGCAAGTCAGT | R23 |
| BCL11A_38 | R24 | ACAGATCCTAACACAGTAGC | R24 |
| BCL11A_10 | R25 | CACAGTAGCTGGTACCTGAT | R25 |
| BCL11A_61 | R26 | TGATAGGTGCCTATATGTGA | R26 |
| BCL11A_70 | R27 | AGGTGCCTATATGTGATGGA | R27 |
| BCL11A_76 | R28 | GGTGCCTATATGTGATGGAT | R28 |
| BCL11A_21 | R29 | GAGGAGGGGAGAGTGCAGAC | R29 |
| BCL11A_66 | R30 | AGGAGGGGAGAGTGCAGACA | R30 |
| BCL11A_93 | R31 | TTTTGGGAGTCCACACGGCA | R31 |
| BCL11A_34 | R32 | CCAAGAGAGCCTTCCGAAAG | R32 |
| BCL11A_51 | R33 | CCTTCCGAAAGAGGCCCCCC | R33 |
| BCL11A_89 | R34 | CTTCCGAAAGAGGCCCCCCT | R34 |
| BCL11A_48 | R35 | CCTGGGCAAACGGCCACCGA | R35 |
| BCL11A_14 | R36 | CACGCCCCCACCCTAATCAG | R36 |
| BCL11A_81 | R37 | ATCAGAGGCCAAACCCTTCC | R37 |
| BCL11A_87 | R38 | CTTCAAAGTTGTATTGACCC | R38 |
| BCL11A_62 | R39 | GGCCTATGTTATTACCTGTA | R39 |
| BCL11A_13 | R40 | TACCTGTATGGACTTTGCAC | R40 |
| BCL11A_64 | R41 | TGCTCTTACTTATGCACACC | R41 |
| BCL11A_78 | R42 | CTAGCTGCCTTCCTTATCAC | R42 |
| BCL11A_27 | R43 | TATCACAGGAATAGCACCCA | R43 |
| BCL11A_3 | R44 | GAACCCCCTATAAACTAGTC | R44 |
| BCL11A_15 | R45 | AACTAGTCTGGTTTGCCCAT | R45 |

FIG. 11B

| | | | | |
|---|---|---|---|---|
| BCL11A_46 | R46 | ACTAGTCTGGTTTGCCCATG | | R46 |
| BCL11A_82 | R47 | GTCAGGCTGTTTTCCAGGGT | | R47 |
| BCL11A_81 | F1 | ATGGTCACTGCCCAGTTTAG | | F1 |
| BCL11A_51 | F2 | GGGCAACCCAGGTCCAGAGT | | F2 |
| BCL11A_60 | F3 | TGTTTACAGAGGGGCAACCC | | F3 |
| BCL11A_7 | F4 | TACAACCTCCTTGTTTACAG | | F4 |
| BCL11A_84 | F5 | TTTATAAGACATTAGGGTAT | | F5 |
| BCL11A_49 | F6 | GGCTTTGCCAATTGGAGATT | | F6 |
| BCL11A_58 | F7 | AGTCTGTATTGCCCCAAGTC | | F7 |
| BCL11A_56 | F8 | AGGTGTAACTAATAAATACC | | F8 |
| BCL11A_39 | F9 | TCTGACCCAAACTAGGAATT | | F9 |
| BCL11A_72 | F10 | TTCTGACCCAAACTAGGAAT | | F10 |
| BCL11A_92 | F11 | CTTTTCTTCTGACCCAAACT | | F11 |
| BCL11A_65 | F12 | ATCACATATAGGCACCTATC | | F12 |
| BCL11A_11 | F13 | GACTCCCAAAATTGTAAAGG | | F13 |
| BCL11A_78 | F14 | GTGGACTCCCAAAATTGTAA | | F14 |
| BCL11A_24 | F15 | AATTTGTATGCCATGCCGTG | | F15 |
| BCL11A_34 | F16 | TCGGAAGGCTCTCTTGGTGA | | F16 |
| BCL11A_37 | F17 | CCTCTTTCGGAAGGCTCTCT | | F17 |
| BCL11A_30 | F18 | CCAGGGGGGCCTCTTTCGGA | | F18 |
| BCL11A_55 | F19 | CGGTGGCCGTTTGCCCAGGG | | F19 |
| BCL11A_35 | F20 | TCGGTGGCCGTTTGCCCAGG | | F20 |
| BCL11A_68 | F21 | ATCGGTGGCCGTTTGCCCAG | | F21 |
| BCL11A_19 | F22 | CATCGGTGGCCGTTTGCCCA | | F22 |
| BCL11A_31 | F23 | CCATCGGTGGCCGTTTGCCC | | F23 |
| BCL11A_79 | F24 | CTGGCAGACCTCTCCATCGG | | F24 |
| BCL11A_43 | F25 | GGACTGGCAGACCTCTCCAT | | F25 |
| BCL11A_91 | F26 | GTTTGGCCTCTGATTAGGGT | | F26 |
| BCL11A_61 | F27 | GGTTTGGCCTCTGATTAGGG | | F27 |
| BCL11A_14 | F28 | AAGGGTTTGGCCTCTGATTA | | F28 |
| BCL11A_62 | F29 | CTAACAGTTGCTTTTATCAC | Spy101 | F29 |
| BCL11A_74 | F30 | CTCTTAGACATAACACACCA | | F30 |
| BCL11A_36 | F31 | ACTCTTAGACATAACACACC | | F31 |
| BCL11A_67 | F32 | GTCCATACAGGTAATAACAT | | F32 |
| BCL11A_66 | F33 | TTCCAGTGCAAAGTCCATAC | | F33 |
| BCL11A_38 | F34 | GCTGAAAAGCGATACAGGGC | | F34 |
| BCL11A_21 | F35 | GATGGCTGAAAAGCGATACA | | F35 |
| BCL11A_45 | F36 | AGATGGCTGAAAAGCGATAC | | F36 |
| BCL11A_12 | F37 | AAGGCAGCTAGACAGGACTT | | F37 |
| BCL11A_5 | F38 | GAAGGCAGCTAGACAGGACT | | F38 |
| BCL11A_17 | F39 | GATAAGGAAGGCAGCTAGAC | | F39 |
| BCL11A_53 | F40 | TGGGTGCTATTCCTGTGATA | | F40 |
| BCL11A_75 | F41 | CTGAGGTACTGATGGACCTT | | F41 |
| BCL11A_40 | F42 | TCTGAGGTACTGATGGACCT | | F42 |
| BCL11A_64 | F43 | TTATGGGGGTTCTACTCTG | | F43 |
| BCL11A_4 | F44 | AAACCAGACTAGTTTATGG | | F44 |
| BCL11A_1 | F45 | CAAACCAGACTAGTTTATAG | | F45 |

FIG. 11C

| BCL11A_46 | F46 | GGCAAACCAGACTAGTTTAT | F46 |
| BCL11A_28 | F47 | ACAGCCTGACTGTGCCCCAT | F47 |
| IL2RG | ctrl | TGGTAATGATGGCTTCAACA | IL2RG |
| hEMX1 | ctrl | GAGTCCGAGCAGAAGAAGAA | hEMX1 |

FIG. 12

Donor LKP06B:
144hrs Thaw to Differentiation

Donor LKP06B:
144hrs Thaw to Differentiation

| RXN | Guides | Electroporated (ug) |
|---|---|---|
| 1 | SPY101 then SD2 | 1.5/1.5 |
| 2 | SD2 then SPY101 | 1.5/1.5 |
| 3 | SPY101 and SD2 | 1.5&1.5 |
| 4 | SPY101 | 3 |
| 5 | SD2 | 3 |
| 6 | EX2-2_EX2-3 | 1.5/1.5 |
| 7 | Mock | |
| 8 | Untreated | |

- Reaction 1
- Reaction 2
- Reaction 3
- Reaction 4
- Reaction 5
- Reaction 6
- Reaction 7
- Reaction 8

Fred Hutch Donor 304:
168hrs Thaw to Differentiation

Donor LKP06B:
144hrs Thaw to Differentiation

| | Guides | Electroporated (ug) |
|---|---|---|
| 1 | SPY101 then SD2 | 1.5/1.5 |
| 2 | SD2 then SPY101 | 1.5/1.5 |
| 3 | SPY101 and SD2 | 1.5&1.5 |
| 4 | SPY101 alone | 3 |
| 5 | SD2 alone | 3 |

Donor LKP06B:
144hrs Thaw to Differentiation

Donor LKP06B:
144hrs Thaw to Differentiation

| Reaction | Guides | Electroporated |
|---|---|---|
| 1 | SPY101 then SD2 | 1.5/1.5 |
| 2 | SD2 then SPY101 | 1.5/1.5 |
| 3 | SPY101 and SD2 | 1.5&1.5 |
| 4 | SPY101 | 3 |
| 5 | SD2 | 3 |
| 6 | EX2-2_EX2-3 | 1.5/1.5 |
| 7 | Mock | |
| 8 | Untreated | |

FIG. 16
Donor LKP06B:
144hrs Thaw to Differentiation

| Reaction | Guides | Electroporated |
|---|---|---|
| 1 | SPY101 then SD2 | 1.5/1.5 |
| 2 | SD2 then SPY101 | 1.5/1.5 |
| 3 | SPY101 and SD2 | 1.5&1.5 |
| 4 | SPY101 | 3 |
| 5 | SD2 | 3 |
| 6 | EX2-2_EX2-3 | 1.5/1.5 |
| 7 | Mock | |
| 8 | Untreated | |

Donor LKP06B:
*144hrs Thaw to Differentiation*

Fred Hutch Donor 304:
*168hrs Thaw to Differentiation*

| Reaction | Guides | Electroporated |
|---|---|---|
| 1 | SPY101 then SD2 | 1.5/1.5 |
| 2 | SD2 then SPY101 | 1.5/1.5 |
| 3 | SPY101 and SD2 | 1.5&1.5 |
| 4 | SPY101 | 3 |
| 5 | SD2 | 3 |
| 6 | EX2-2_EX2-3 | 1.5/1.5 |
| 7 | Mock | |
| 8 | Untreated | |

Donor LKP06B:
144hrs Thaw to Differentiation

Fred Hutch Donor 304:
168hrs Thaw to Differentiation

| Reaction | Guides | Electroporated |
|---|---|---|
| 1 | SPY101 then SD2 | 1.5/1.5 |
| 2 | SD2 then SPY101 | 1.5/1.5 |
| 3 | SPY101 and SD2 | 1.5&1.5 |
| 4 | SPY101 | 3 |
| 5 | SD2 | 3 |
| 6 | EX2-2_EX2-3 | 1.5/1.5 |
| 7 | Mock | |
| 8 | Untreated | |

Donor LKP06B:
*144hrs Thaw to Differentiation*

Fred Hutch Donor 304:
*168hrs Thaw to Differentiation*

| Reaction | Guides | Electroporated |
|---|---|---|
| 1 | SPY101 then SD2 | 1.5/1.5 |
| 2 | SD2 then SPY101 | 1.5/1.5 |
| 3 | SPY101 and SD2 | 1.5&1.5 |
| 4 | SPY101 | 3 |
| 5 | SD2 | 3 |
| 6 | EX2-2_EX2-3 | 1.5/1.5 |
| 7 | Mock | |
| 8 | Untreated | |

FIG. 20

Donor LKP06B:
144hrs Thaw to Differentiation

% HbF Expression
HbF/(HbF+HbA)

Reaction

| Reaction | Guides | Electroporated |
|---|---|---|
| 1 | SPY101 then SD2 | 1.5/1.5 |
| 2 | SD2 then SPY101 | 1.5/1.5 |
| 3 | SPY101 and SD2 | 1.5&1.5 |
| 4 | SPY101 | 3 |
| 5 | SD2 | 3 |
| 6 | EX2-2_EX2-3 | 1.5/1.5 |
| 7 | Mock | |
| 8 | Untreated | |

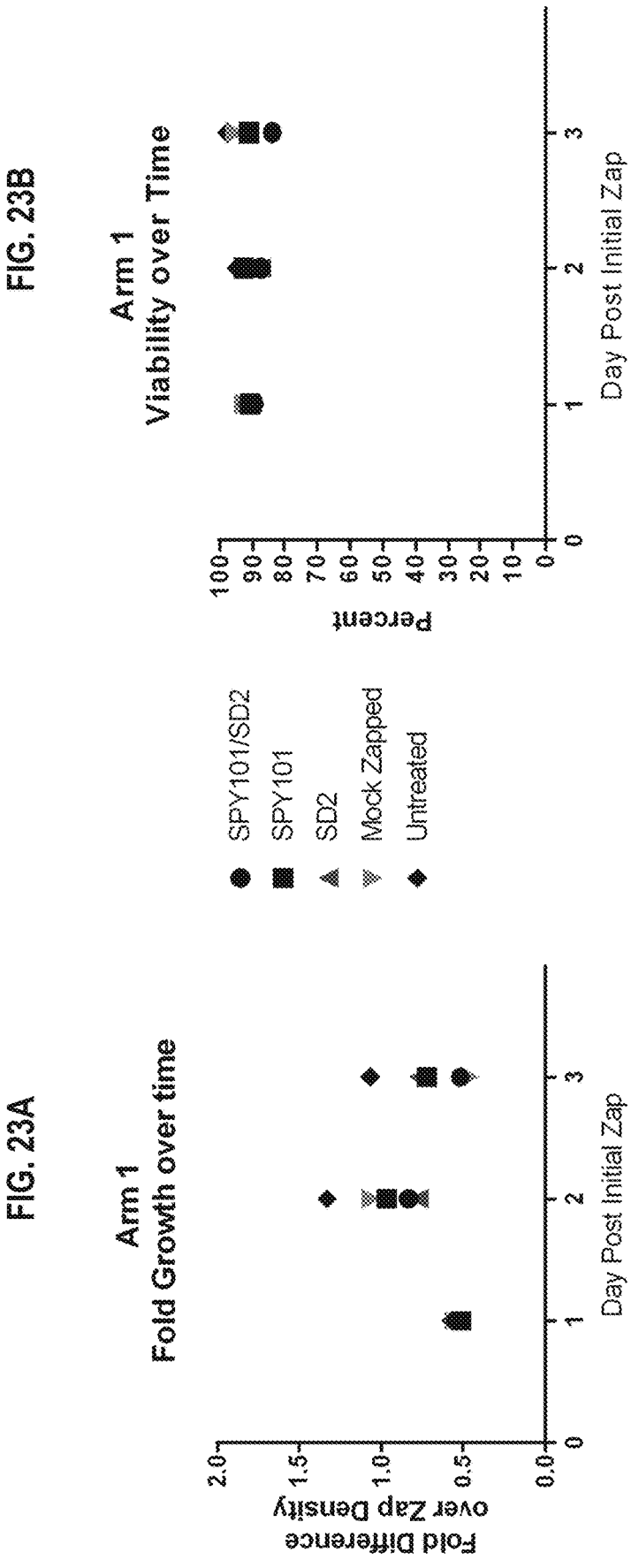

Arm 2
Viability over Time

SPY101/SD2
SPY101
SD2
Mock Zapped
Untreated

Arm 2
Fold Growth over time

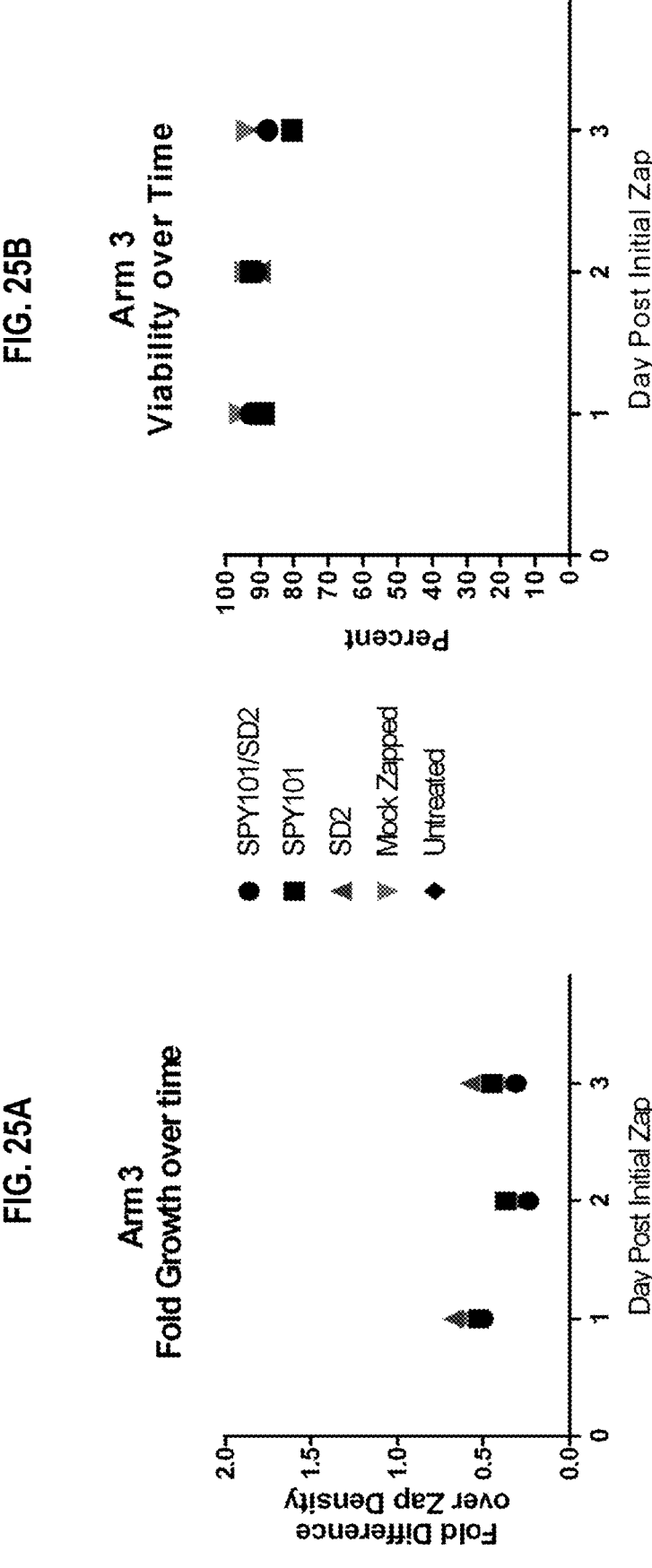

Donor LKP06B:
*96hrs Thaw to Differentiation*

Donor LKP06B:
*96hrs Thaw to Differentiation*

⁎ Arm 1/Reaction 1
⁎ Arm 2/Reaction 1
⁎ Arm 3/Reaction 1
⁑ Arm 1/Reaction 2
⁑ Arm 1/Reaction 3
⁑ Arm1/Reaction 4
⁑ Arm 1/Reaction 5

| Reaction | Guides | Electroporated (ug) |
|---|---|---|
| 1 | SPY101 then SD2 | 1.5/1.5 |
| 2 | SPY101 | 3 |
| 3 | SD2 | 3 |
| 4 | Mock | |
| 5 | Untreated | |

FIG. 27

Donor LKP06B:
96hrs Thaw to Differentiation

| Reaction | Guides | Electroporated (ug) |
|---|---|---|
| 1 | SPY101 then SD2 | 1.5/1.5 |
| 2 | SPY101 | 3 |
| 3 | SD2 | 3 |
| 4 | Mock | |
| 5 | Untreated | |

FIG. 28B (cont.)

Arm 2

Arm 2

| Reaction | Guides | Electroporated (ug) |
|---|---|---|
| 1 | SPY101 then SD2 | 1.5/1.5 |
| 2 | SPY101 | 3 |
| 3 | SD2 | 3 |
| 4 | Mock | |
| 5 | Untreated | |

Donor LKP06B:
96hrs Thaw to Differentiation

FIG. 33B

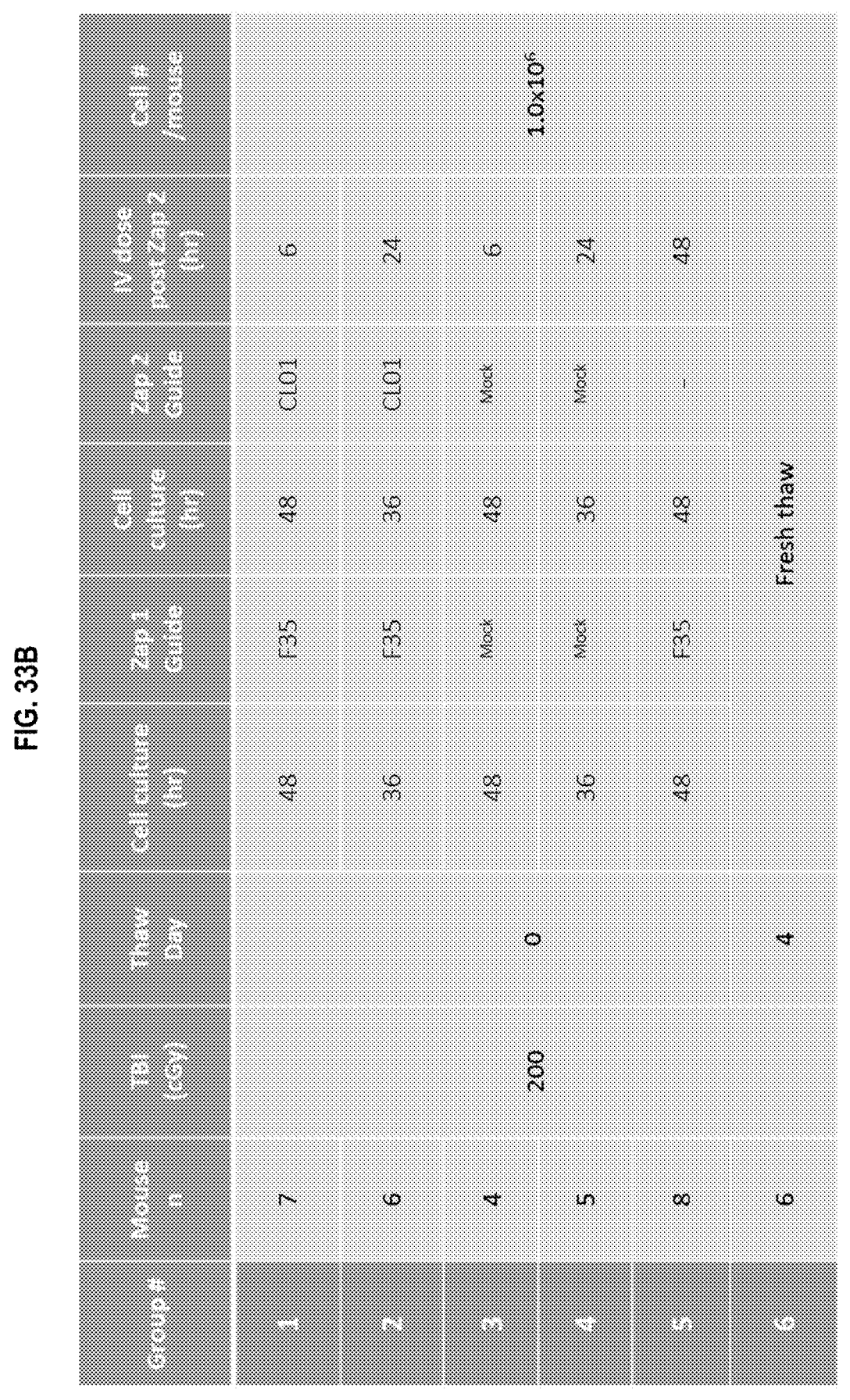

| Group# | Mouse ID | TBI TBD (cGy) | TBI calculation Day | Cell calculation (h) | Zap1 Guide | Cell culture (h) | Zap2 Guide | M-dose Day 2/Zap2 (h) | Cells /mouse |
|---|---|---|---|---|---|---|---|---|---|
| 1 | 7 | | | 48 | F35 | 48 | CI01 | 6 | |
| 2 | 6 | | | 36 | F35 | 36 | CI01 | 24 | |
| 3 | 4 | 200 | 0 | 48 | Mock | 48 | Mock | 6 | $1.0 \times 10^6$ |
| 4 | 5 | | | 36 | Mock | 36 | Mock | 24 | |
| 5 | 8 | | | 48 | F35 | 48 | – | 48 | |
| 6 | 6 | | 4 | | Fresh thaw | | | | |

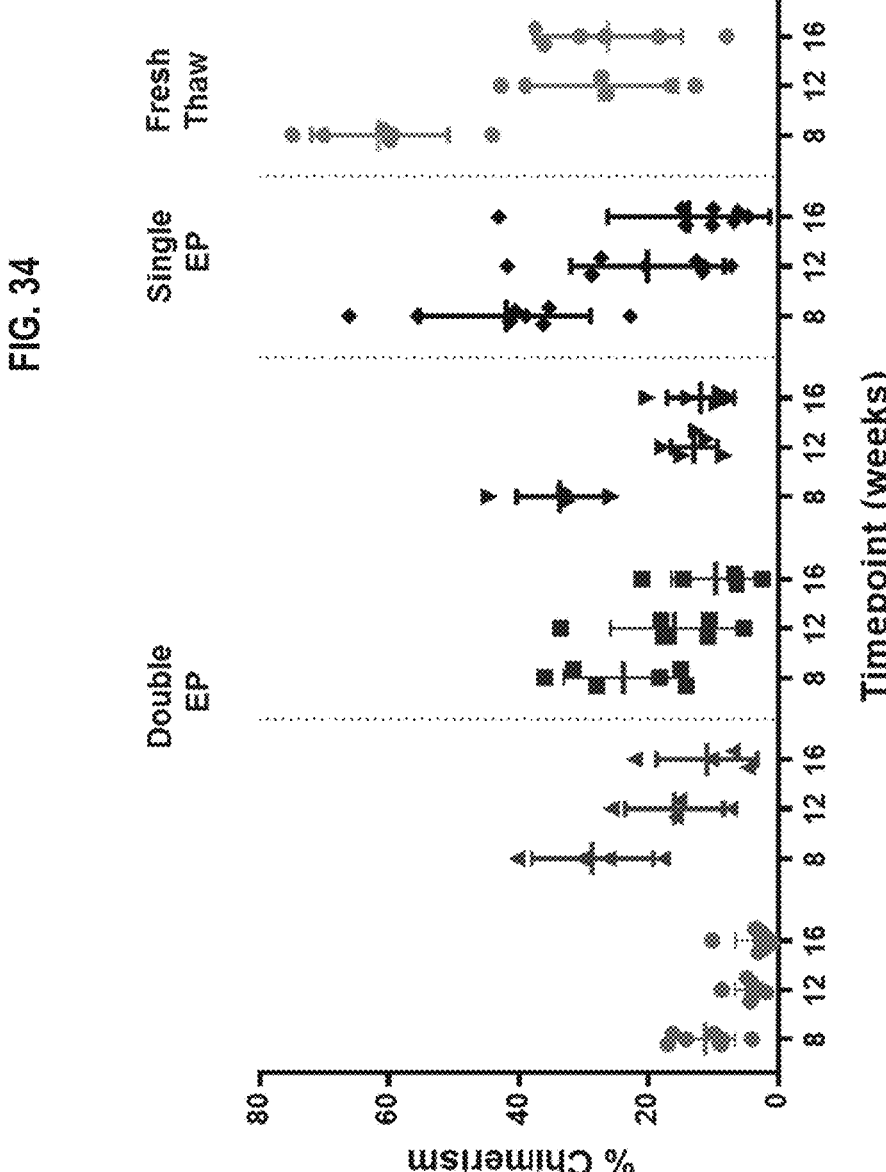
FIG. 34

FIG. 36
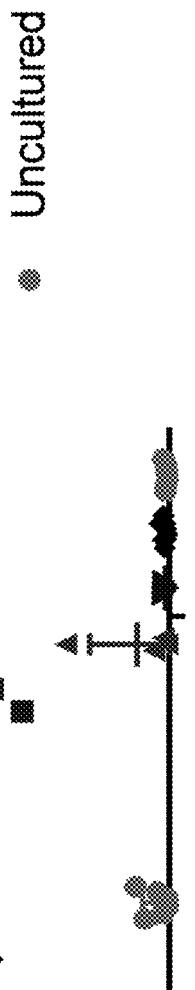
● 48/48/6 with Guides
■ 36/36/24 with Guides
▲ 48/48/6 Mock EP
▼ 36/36/24 Mock EP
◆ 48/48 Single EP with Guide
● Uncultured CD34 cells
Editing Persistance in Bone Marrow at Week 16
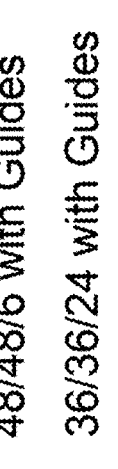
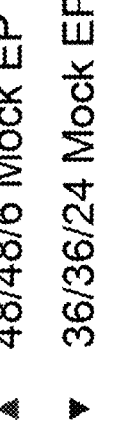
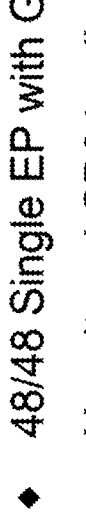

FIG. 37

Timeline: Thaw D-5, D-3.5, D-2, D0 (1st gDNA harvest), Phase I, D3, D5, D7 (2nd gDNA harvest), Phase II, D10, D12, D14 (Differentiation/Enucleation FACS), Phase III, D18, RNA/HPLC

| Reaction | Electroporation #1 Day 3.5 | Electroporation #2 Day 2 |
| --- | --- | --- |
| 1 | SPY101 (1.5ug) | HPFH5_1 And HPFH5_D (0.75ug each) |
| 2 | 1450 (1.5ug) | HPFH5_1 And HPFH5_D (0.75ug each) |
| 3 | SPY101 (1.5ug) | Kenya (K5 And K17) (1ug&2ug) |
| 4 | 1450 (1.5ug) | Kenya (K5 And K17) (1ug&2ug) |
| 5 | HFPH5_T7 And HPFH5_D (0.75ug each) | HFPH5_1 And HPFH5_T5 (0.75ug each) |
| 6 | SPY101 (3ug) | - |
| 7 | 1450 (3ug) | - |
| 8 | HFPH5_T7 And HPFH5_D (0.75ug each) | - |
| 9 | HPFH5_1 And HPFH5_T5 (0.75ug each) | - |
| 10 | HFPH5_T7, HPFH5_D, HPFH5_1 And HPFH5_T5 (0.75ug each) | - |
| 11 | Kenya (K5 And K17) (1ug&2ug) | - |
| 12 | Exon 2-2/2-3 | - |
| 13 | Mock EP | Mock EP |
| 14 | Untreated | |

FIG. 38

| Guide Combinations | Electroporation #1 | Electroporation #2 | Average Fold Growth during Diff Relative to Mock EP | Chr2 Editing Analysis (Done 4 Days Post 2nd Zap) | Chr11 Deletion Analysis (Done 4 Days Post 2nd Zap) | %HbF/(HbF+HbA) |
|---|---|---|---|---|---|---|
| SPY Alone | SPY101 | - | 0.90±0.01 | 88±0 | - | 38±7 |
| SPY Then HPFH5_1&D | SPY101 | HPFH5_1 HPFH5_D | 0.83±0.02 | 88±0 | 46±6 | 64±2 |
| SPY Then Kenya | SPY101 | K05 K17 | 0.77±0.02 | 90±2 | 28±3 | 53±3 |
| 1450 Alone | 1450 | - | 0.93±0.05 | 93±0 | - | 40±5 |
| 1450 Then HPFH5_1&D | 1450 | HPFH5_1 HPFH5_D | 0.82±0.02 | 91±3 | 41±8 | 62±5 |
| 1450 Then Kenya | 1450 | K05 K17 | 0.80±0.04 | 92±1 | 30±3 | 59±2 |
| HPFH5_T7&D | HPFH5_T7 HPFH5_D | - | 0.96±0.01 | - | 39±4 | 37±8 |
| HPFH5_1&T5 | HPFH5_1 HPFH5_T5 | - | 0.96±0.08 | - | 39±5 | 40±3 |
| HPFH5_T7&D Then HPFH5_1&T5 | HPFH5_T7 HPFH5_D | HPFH5_1 HPFH5_T5 | 0.88±0.01 | - | 61±1 | 53±5 |
| HPFH5_T7,D,1 &T5 | HPFH5_T7,D,1 &T5 | - | 0.99±0.03 | - | 33±1 | 32±8 |
| Kenya (K17&K05) | K05 K17 | - | 0.94±0.03 | - | 30±3 | 24±11 |
| Exon 2-2/2-3 | Exon 2-2/2-3 | - | 0.65±0.01 | - | 63±2 | 42±9 |
| Mock EP | Cas9 alone | Cas9 alone | 1 | - | - | 11±3 |

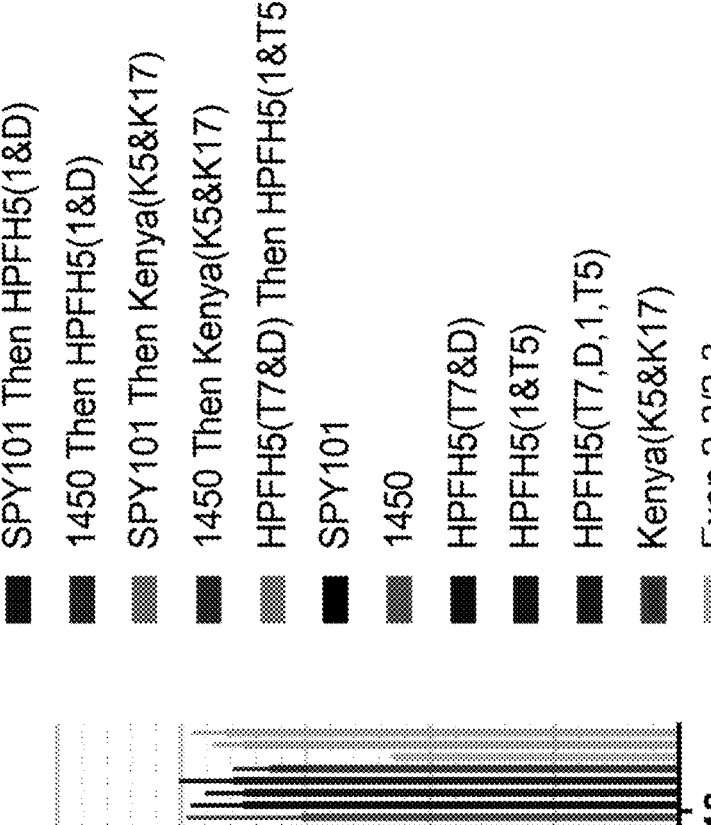
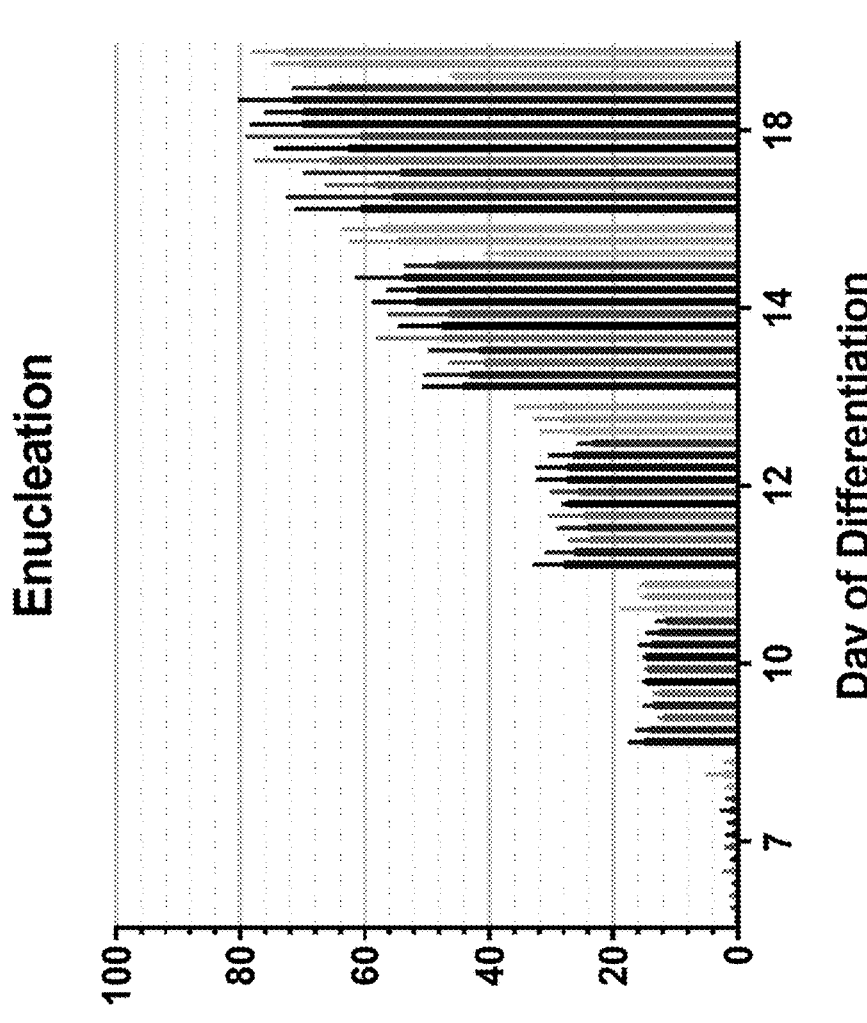
FIG. 41

FIG. 42B

γ/(γ+β) globin
mRNA Expression

HbF via HPLC
Day 18 of In-vitro Differentiation

| EP#1: 1.5ug 1450 | EP#2: 0.75ug HPFH5(s) | Chr2 Editing | Chr1 Deletion |
|---|---|---|---|
| 0.375ug Cas9 | 1.5ug Cas9 | 88% | 44% |
|  | 0.75ug Cas9 | 87% | 47% |
|  | 0.375ug Cas9 | 88% | 36% |
|  | Mock EP | 89% |  |
| 0.1875ug Cas9 | 1.5ug Cas9 | 69% | 44% |
|  | 0.75ug Cas9 | 69% | 43% |
|  | 0.375ug Cas9 | 70% | 29% |
|  | Mock EP | 71% |  |
| Mock EP | 1.5ug Cas9 |  | 35% |
|  | 0.75ug Cas9 |  | 44% |
|  | 0.375ug Cas9 |  | 36% |
|  | Mock EP |  |  |

| EP#1: 1.5ug 1450 | EP#2: 0.75ug HPFH5(s) | Chr2 Editing | Chr1 Deletion |
|---|---|---|---|
| 3ug Cas9 | 1.5ug Cas9 | 88% | 46% |
|  | 0.75ug Cas9 | 89% | 46% |
|  | 0.375ug Cas9 | 89% | 41% |
|  | Mock EP | 89% |  |
| 1.5ug Cas9 | 1.5ug Cas9 | 94% | 44% |
|  | 0.75ug Cas9 | 92% | 43% |
|  | 0.375ug Cas9 | 94% | 32% |
|  | Mock EP | 93% |  |
| 0.75ug Cas9 | 1.5ug Cas9 | 91% | 43% |
|  | 0.75ug Cas9 | 91% | 40% |
|  | 0.375ug Cas9 | 90% | 29% |
|  | Mock EP | 91% |  |

FIG. 45

| EP#1: 1.5ug 1450 | EP#2: 0.75ug HPFH5(s) | V/α mRNA Ratio | V/(γ+β) mRNA Ratio |
|---|---|---|---|
| 3ug Cas9 | 1.5ug Cas9 | 1.36 | 0.87 |
| | 0.75ug Cas9 | 1.40 | 0.87 |
| | 0.375ug Cas9 | 1.43 | 0.83 |
| | Mock EP | 1.04 | 0.66 |
| 1.5ug Cas9 | 1.5ug Cas9 | 1.58 | 0.88 |
| | 0.75ug Cas9 | 1.41 | 0.85 |
| | 0.375ug Cas9 | 1.34 | 0.80 |
| | Mock EP | 1.10 | 0.66 |
| 0.75ug Cas9 | 1.5ug Cas9 | 1.36 | 0.83 |
| | 0.75ug Cas9 | 1.44 | 0.84 |
| | 0.375ug Cas9 | 1.30 | 0.78 |
| | Mock EP | 1.04 | 0.66 |

| EP#1: 1.5ug 1450 | EP#2: 0.75ug HPFH5(s) | V/α mRNA Ratio | V/(γ+β) mRNA Ratio |
|---|---|---|---|
| 0.375ug Cas9 | 1.5ug Cas9 | 0.52 | 0.87 |
| | 0.75ug Cas9 | 0.50 | 0.87 |
| | 0.375ug Cas9 | 0.47 | 0.84 |
| | Mock EP | 0.34 | 0.66 |
| 0.1875ug Cas9 | 1.5ug Cas9 | 0.41 | 0.81 |
| | 0.75ug Cas9 | 0.40 | 0.81 |
| | 0.375ug Cas9 | 0.34 | 0.72 |
| | Mock EP | 0.28 | 0.57 |
| Mock EP | 1.5ug Cas9 | 0.20 | 0.56 |
| | 0.75ug Cas9 | 0.25 | 0.67 |
| | 0.375ug Cas9 | 0.21 | 0.60 |
| | Mock EP | 0.22 | 0.67 |

FIG. 46

| EP#1: 1.5ug 1450 | EP#2: 0.75ug HPFH5(s) | %HbF/(HbF+ HbA) |
|---|---|---|
| 0.375ug Cas9 | 1.5ug Cas9 | 75% |
| | 0.75ug Cas9 | 74% |
| | 0.375ug Cas9 | 67% |
| | Mock EP | 43% |
| 0.1875ug Cas9 | 1.5ug Cas9 | 66% |
| | 0.75ug Cas9 | 70% |
| | 0.375ug Cas9 | 60% |
| | Mock EP | 38% |
| Mock EP | 1.5ug Cas9 | 45% |
| | 0.75ug Cas9 | 55% |
| | 0.375ug Cas9 | 43% |
| | Mock EP | 53% |

| EP#1: 1.5ug 1450 | EP#2: 0.75ug HPFH5(s) | %HbF/(HbF+ HbA) |
|---|---|---|
| 3ug Cas9 | 1.5ug Cas9 | 81% |
| | 0.75ug Cas9 | 79% |
| | 0.375ug Cas9 | 71% |
| | Mock EP | 48% |
| 1.5ug Cas9 | 1.5ug Cas9 | 76% |
| | 0.75ug Cas9 | 77% |
| | 0.375ug Cas9 | 69% |
| | Mock EP | 50% |
| 0.75ug Cas9 | 1.5ug Cas9 | 74% |
| | 0.75ug Cas9 | 75% |
| | 0.375ug Cas9 | 66% |
| | Mock EP | 45% |

FIG. 47

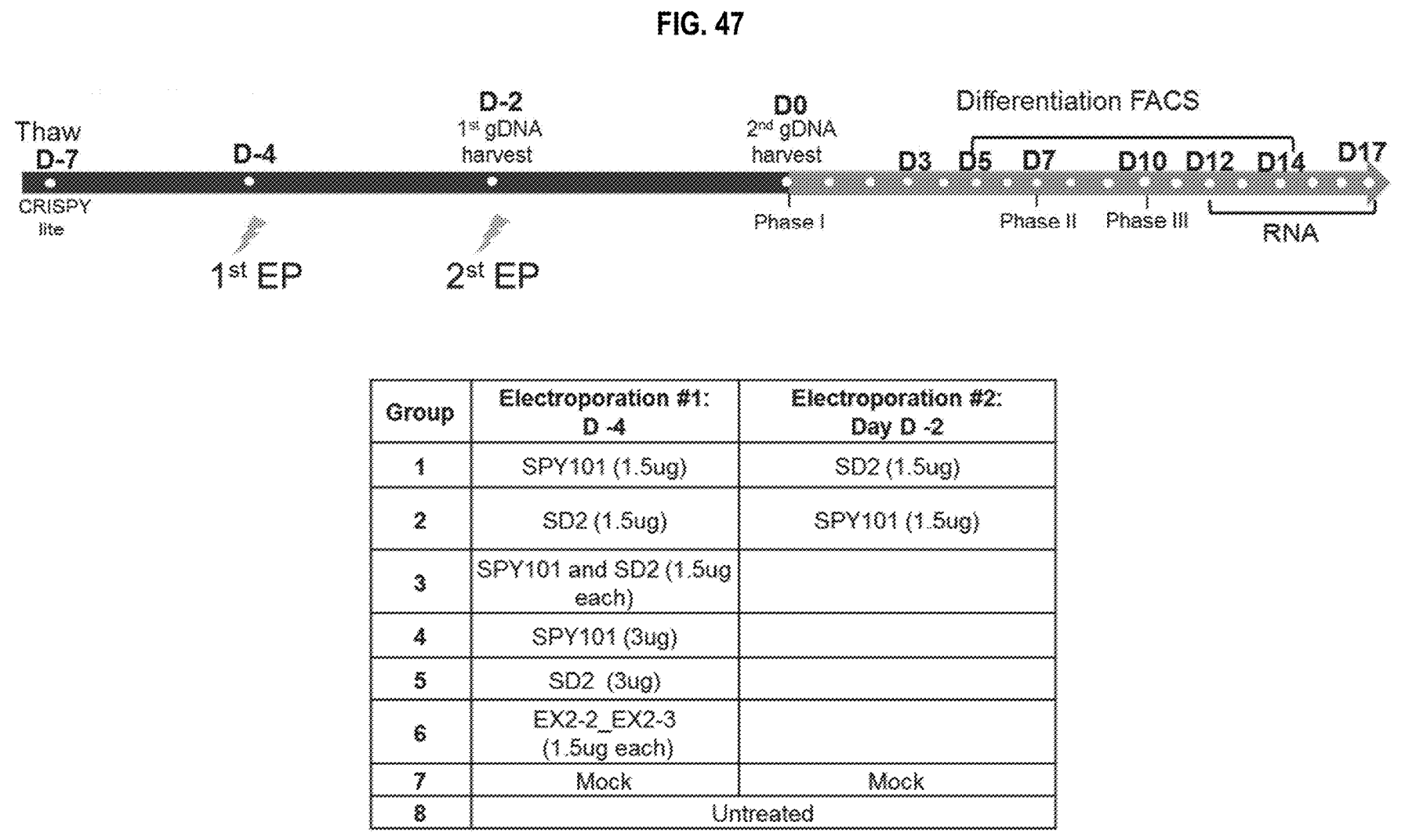

| Group | Electroporation #1: D -4 | Electroporation #2: Day D -2 |
|---|---|---|
| 1 | SPY101 (1.5ug) | SD2 (1.5ug) |
| 2 | SD2 (1.5ug) | SPY101 (1.5ug) |
| 3 | SPY101 and SD2 (1.5ug each) | |
| 4 | SPY101 (3ug) | |
| 5 | SD2 (3ug) | |
| 6 | EX2.2_EX2-3 (1.5ug each) | |
| 7 | Mock | Mock |
| 8 | Untreated | |

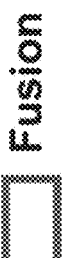
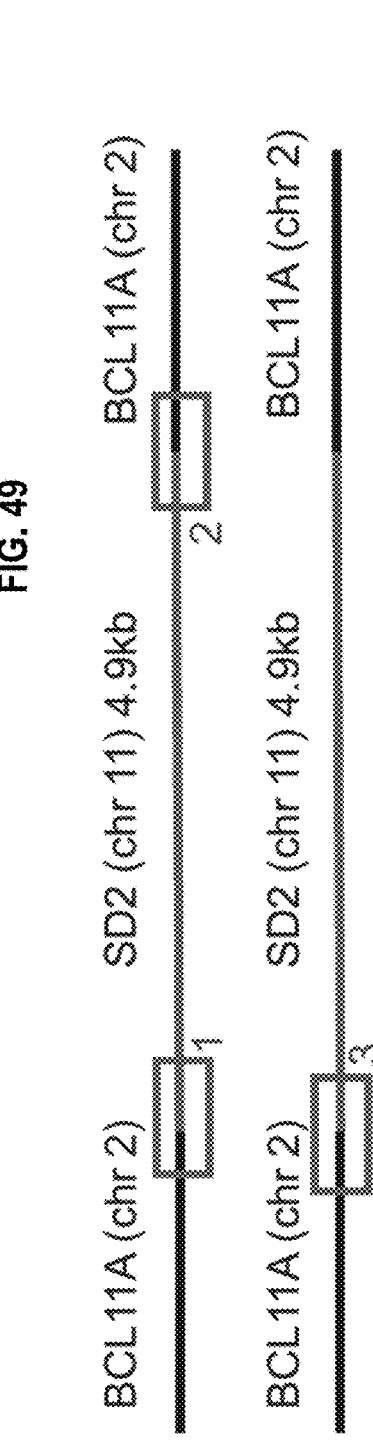
FIG. 49

FIG. 50
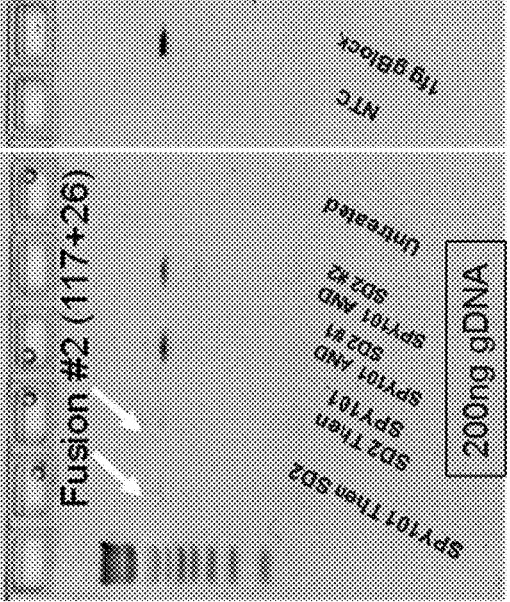
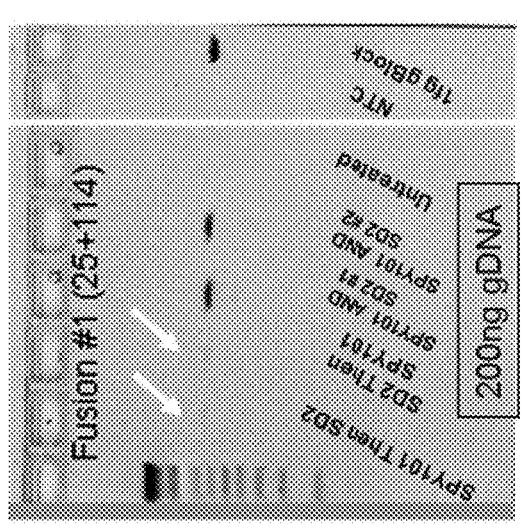

FIG. 51

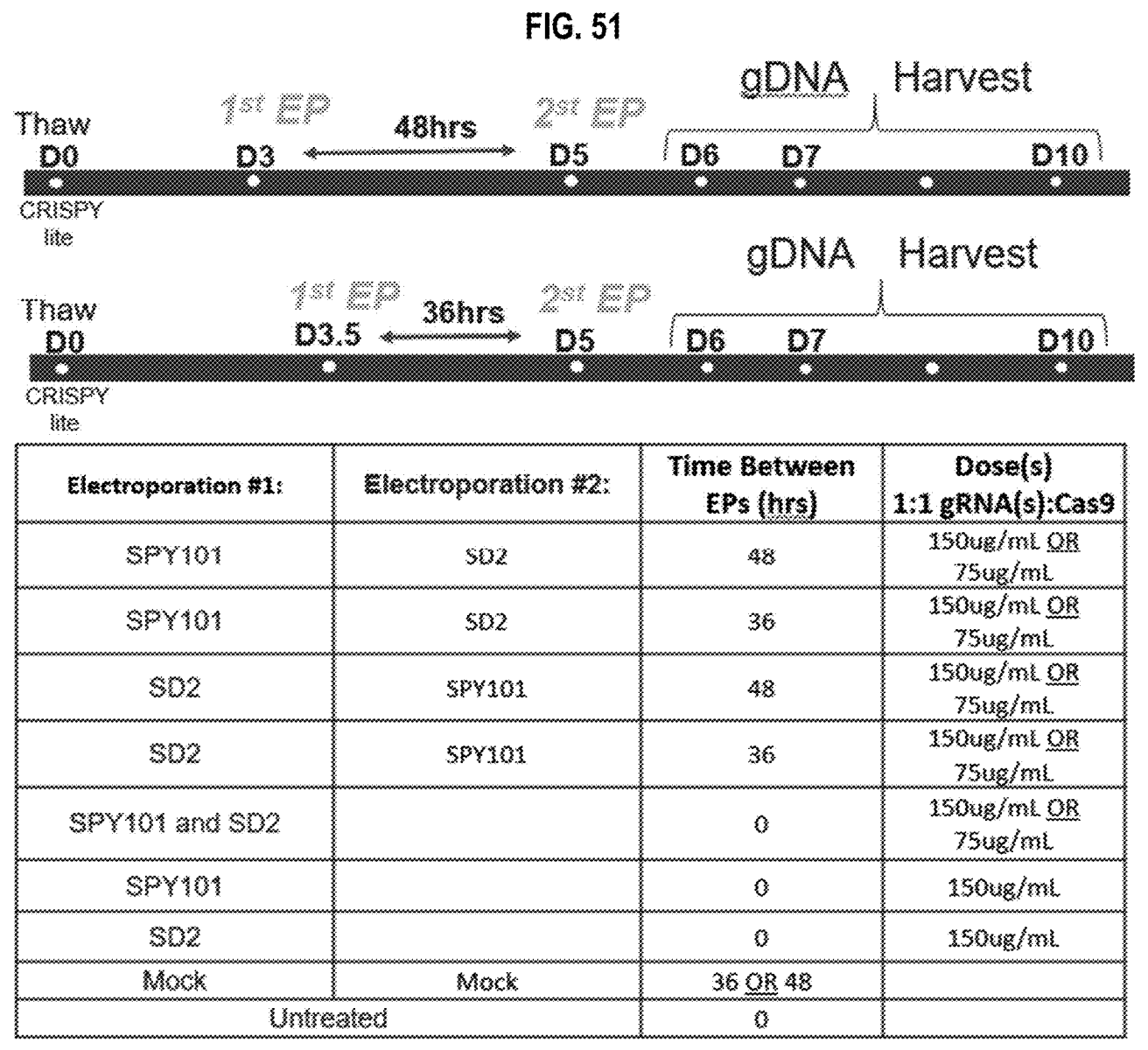

| Electroporation #1: | Electroporation #2: | Time Between EPs (hrs) | Dose(s) 1:1 gRNA(s):Cas9 |
|---|---|---|---|
| SPY101 | SD2 | 48 | 150ug/mL OR 75ug/mL |
| SPY101 | SD2 | 36 | 150ug/mL OR 75ug/mL |
| SD2 | SPY101 | 48 | 150ug/mL OR 75ug/mL |
| SD2 | SPY101 | 36 | 150ug/mL OR 75ug/mL |
| SPY101 and SD2 | | 0 | 150ug/mL OR 75ug/mL |
| SPY101 | | 0 | 150ug/mL |
| SD2 | | 0 | 150ug/mL |
| Mock | Mock | 36 OR 48 | |
| Untreated | | 0 | |

| Group | Electroporation #1 | Electroporation #2 |
|---|---|---|
| 1 | SPY101 | SD2 |
| 2 | SD2 | SPY101 |
| 3 | SPY101 and SD2 | |
| 4 | SPY101 | |
| 5 | SD2 | |
| 7 | Mock | Mock |
| 8 | Untreated | |

FIG. 55

| Guide(s) | Time Between EPs | Translocation A:E Primer Set #1 | | Translocation A:E Primer Set #2 | | Translocation A:F Primer Set #3 | | Translocation A:F Primer Set #4 | |
|---|---|---|---|---|---|---|---|---|---|
| | | Translocation Events | Reference Events | Translocation Events | Reference Events | Translocation Events | Reference Events | Translocation Events | Reference Events |
| SPY101 Then SD2 | 48hrs | 5 | 7040 | 0 | 6626 | 0 | 5997 | 1 | 6717 |
| SD2 Then SPY101 | 48hrs | 1 | 5383 | 0 | 5490 | 0 | 4865 | 0 | 5311 |
| SPY101 Then SD2 | 36hrs | 2 | 3813 | 1 | 3589 | 1 | 3520 | 1 | 3767 |
| SD2 Then SPY101 | 36hrs | 6 | 5456 | 0 | 4708 | 3 | 4336 | 3 | 4270 |
| SPY101 | 0hrs | 1 | 5141 | 0 | 4433 | 1 | 4555 | 0 | 4846 |
| SD2 | 0hrs | 1 | 3990 | 0 | 4150 | 0 | 3684 | 1 | 4277 |
| Mock EP | 0hrs | 1 | 5650 | 0 | 4609 | 7 | 5366 | 0 | 4981 |
| SPY101 And SD2 | 0hrs | 28 | 5885 | 23 | 5921 | 32 | 5153 | 21 | 6070 |

FIG. 56A

| RXN | Guides |
|---|---|
| 1 | SPY101 then SD2 |
| 2 | SD2 then SPY101 |
| 3 | SPY101 and SD2 |
| 4 | SPY101 and SD2 |
| 5 | SPY101 |
| 6 | SD2 |
| 7 | SPY101 |
| 8 | SD2 |
| 9 | EX2-2 |
| 10 | EX2-3 |
| 11 | EX2-2_EX2-3 |
| 12 | Mock |
| 13 | Untreated |

| % indel | Rxn 1 | Rxn 2 | Rxn 3 | Rxn 4 | Rxn 5 | Rxn 6 | Rxn 7 | Rxn 8 |
|---|---|---|---|---|---|---|---|---|
| SPY101 editing | 86.4 | 49.8 | 77.3 | 48.6 | 79.5 | 1 | 69.1 | 1.2 |
| SD2 editing | 65.9 | 91.9 | 70.7 | 46.4 | 0.7 | 90.4 | - | 58.3 |

| | Rxn 1 | Rxn 2 | Rxn 3 | Rxn 4 | Rxn 5 | Rxn 6 | Rxn 7 | Rxn 8 |
|---|---|---|---|---|---|---|---|---|
| | | | | | % indel | | | |
| SPY101 editing | 86.4 | 49.8 | 77.3 | 48.6 | 79.5 | 1 | 69.1 | 1.2 |
| SD2 editing | 65.9 | 91.9 | 70.7 | 46.4 | 0.7 | 90.4 | - | 58.3 |

| RXN | Guides |
|---|---|
| 1 | SPY101 then SD2 |
| 2 | SD2 then SPY101 |
| 3 | SPY101 and SD2 |
| 4 | SPY101 and SD2 |
| 5 | SPY101 |
| 6 | SD2 |
| 7 | SPY101 |
| 8 | SD2 |
| 9 | EX2-2 |
| 10 | EX2-3 |
| 11 | EX2-2_EX2-3 |
| 12 | Mock |
| 13 | Untreated |

| RXN | Guides |
|---|---|
| 1 | SPY101 then SD2 |
| 2 | SD2 then SPY101 |
| 3 | SPY101 and SD2 |
| 4 | SPY101 and SD2 |
| 5 | SPY101 |
| 6 | SD2 |
| 7 | SPY101 |
| 8 | SD2 |
| 9 | EX2-2 |
| 10 | EX2-3 |
| 11 | EX2-2_EX2-3 |
| 12 | Mock |
| 13 | Untreated |

| % indel | Rxn 1 | Rxn 2 | Rxn 3 | Rxn 4 | Rxn 5 | Rxn 6 | Rxn 7 | Rxn 8 |
|---|---|---|---|---|---|---|---|---|
| SPY101 editing | 86.4 | 49.8 | 77.3 | 48.6 | 79.5 | 1 | 69.1 | 1.2 |
| SD2 editing | 65.9 | 91.9 | 70.7 | 46.4 | 0.7 | 90.4 | - | 58.3 |

MATERIALS AND METHODS FOR TREATMENT OF HEMOGLOBINOPATHIES

CROSS-REFERENCE TO RELATED APPLICATIONS

This Application is a national stage filing under 35 U.S.C. § 371 of international application number PCT/IB2018/001338, filed Oct. 26, 2018, and claims the benefit of priority under 35 U.S.C. § 119 (e) of U.S. provisional application No. 62/577,434, filed on Oct. 26, 2017 and U.S. provisional application No. 62/583,146, filed on Nov. 8, 2017; the contents of each of which are incorporated by reference herein in their entirety.

FIELD

The present application provides materials and methods for treating patients with hemoglobinopathies, both ex vivo and in vivo. In addition, the present application provides materials and methods for deleting and/or mutating a portion of a human beta globin locus on chromosome 11 and one or more of: a BCL11A gene on chromosome 2, and a DNA sequence that encodes a transcriptional control region of the BCL11A gene on chromosome 2, in a human cell by genome editing and thereby increasing the production of fetal hemoglobin (HbF) in the genome-edited human cells.

INCORPORATION BY REFERENCE OF SEQUENCE LISTING

This application contains a Sequence Listing which has been filed electronically in ASCII format and is hereby incorporated by reference in its entirety. Said ASCII copy, created on Jul. 25, 2023, is named C154270030US03-SUBSEQ-MSB.txt and is 706,400 bytes in size.

BACKGROUND

Hemoglobinopathies encompass a number of anemias that are associated with changes in the genetically determined structure or expression of hemoglobin. These include changes to the molecular structure of the hemoglobin chain, such as occur with sickle cell anemia, as well as changes in which synthesis of one or more chains is reduced or absent, such as occur in various thalassemias.

A potential treatment for patients diagnosed with hemoglobinopathies includes genome engineering. Genome engineering refers to the strategies and techniques for the targeted, specific modification of the genetic information of living organisms. Genome engineering is a very active field of research because of the wide range of possible applications, particularly in the areas of human health. Early genome engineering technologies developed to insert a transgene into a living cell were often limited by the random nature of the insertion of the new sequence into the genome. Random insertions into the genome can result in disrupting normal regulation of neighboring genes leading to severe unwanted effects. Furthermore, random integration technologies offer little reproducibility, as there is no guarantee that the sequence would be inserted at the same place in two different cells.

Recent genome engineering strategies, such as Zinc finger nucleases (ZFNs), Transcription Activator-Like Effector Nucleases (TALENs), Homing endonucleases (HEs) and MegaTALs, enable a specific area of the DNA to be modified, thereby increasing the precision of the correction or insertion compared to early technologies. These newer platforms offer a much larger degree of reproducibility, but still have their limitations.

Despite efforts from researchers and medical professionals worldwide who have been trying to address hemoglobinopathies, such as β-thalassemia and sickle cell disease, and despite the promise of gene therapy approaches, there still remains a critical need for developing safe and effective treatments for hemoglobinopathies.

SUMMARY

The present disclosure presents an approach to address the genetic basis of hemoglobinopathies. By using genome engineering tools to create permanent changes to the genome that can delete and/or mutate the human beta globin locus on chromosome 11 and BCL11A gene on chromosome 2, or a DNA sequence that encodes a transcriptional control region of the BCL11A gene on chromosome 2, with as few as a single treatment, the resulting therapy may ameliorate the effects of hemoglobinopathies.

Provided herein are cellular, ex vivo and in vivo methods to create permanent changes to the genome by deleting or mutating the human beta globin locus on chromosome 11 and BCL11A gene on chromosome 2, or a DNA sequence that encodes a transcriptional control region of the BCL11A gene on chromosome 2, which can be used to treat hemoglobinopathies. Also provided herein are components, kits, and compositions for performing such methods. Also provided are cells produced by such methods.

Provided herein is a method of increasing fetal hemoglobin (HbF) in a human cell by genome editing, the method comprises the step of introducing into the human cell one or more deoxyribonucleic acid (DNA) endonuclease to effect two or more single-strand break (SSB) or double-strand break (DSB). A first SSB or DSB can be within or near a human beta globin locus on chromosome 11. A second SSB or DSB can be within or near one or more of: a BCL11A gene on chromosome 2, and a DNA sequence that encodes a transcriptional control region of the BCL11A gene on chromosome 2. The first SSB or DSB can result in one or more of: a permanent deletion or inversion within or near the human beta globin locus on chromosome 11, and a mutation within or near the human beta globin locus on chromosome 11. The second SSB or DSB can result in one or more of: a permanent deletion or inversion within or near the BCL11A gene on chromosome 2, a mutation within or near the BCL11A gene on chromosome 2, a permanent deletion or inversion within or near the DNA sequence that encodes a transcriptional control region of the BCL11A gene on chromosome 2, and a mutation within or near the DNA sequence that encodes a transcriptional control region of the BCL11A gene on chromosome 2. The two or more permanent deletion, inversion, or mutation can result in an increased expression of γ-globin and an increase of HbF in the human cell.

The permanent deletion within or near the human beta globin locus on chromosome 11 can be a hereditary persistence of fetal hemoglobin (HPFH) deletion. The HPFH deletion can be selected from the group consisting of: a HPFH-4 deletion, a HPFH-5 deletion, a HPFH-Kenya deletion, a HPFH-Black deletion, a large Corfu deletion, a small Corfu deletion, a small deletion, and combinations thereof. The HPFH deletion can be a 7.2 Kb deletion. The HPFH deletion can be a 3.5 Kb deletion. The HPFH deletion can be a 12.9 Kb deletion. The HPFH deletion can be a 22 Kb deletion. The HPFH deletion can be a 13 bp deletion.

The HPFH deletion can be located downstream of a HBG1 gene and can result in a repositioning of a BCL11A enhancing region closer to the HBG1 gene. The HPFH deletion can be located downstream of a HBG2 gene and can result in a repositioning of a BCL11A enhancing region closer to the HBG2 gene. The HPFH deletion can be located downstream of a HBG1 gene and HBG2 gene and can result in a repositioning of a BCL11A enhancing region closer to the HBG1 gene and HBG2 gene. The HPFH deletion can include all or a portion of a β-globin gene. The HPFH deletion can include all or a portion of a 8-globin gene and all or a portion of a β-globin gene. The permanent deletion within or near the human beta globin locus on chromosome 11 can be in a region of the human beta globin locus comprising a HBG1 gene and a HBG2 gene.

The permanent deletion within or near the human beta globin locus on chromosome 11 can be a 13-base pair deletion located upstream of the HBG1 gene. The permanent deletion within or near the human beta globin locus on chromosome 11 can be a 4.9 Kb deletion located upstream of the HBG1 gene. The permanent deletion within or near the human beta globin locus on chromosome 11 can be a 13-base pair deletion located upstream of the HGB1 gene and a 4.9 Kb deletion located upstream of the HBG1 gene. The 4.9 Kb deletion can include the HBG2 gene. The DNA sequence that encodes a transcriptional control region of the BCL11A gene can be located within a second intron of the BCL11A gene on chromosome 2. The DNA sequence that encodes a transcriptional control region of the BCL11A gene can be located within a +58 DNA hypersensitive site (DHS) of the BCL11A gene on chromosome 2.

The one or more DNA endonuclease can be selected from the group consisting of a zinc finger nuclease, TAL effector nuclease, meganuclease, MegaTAL, Tev-m TALEN, Mega-Tev, homing endonuclease, FokI, StsI, Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease, a homolog thereof, a recombination of the naturally occurring molecule thereof, a codon-optimized thereof, modified versions thereof, and combinations thereof.

One or more guide ribonucleic acid (gRNA) can be introduced into the human cell. The one or more gRNA can be one or more single-molecule guide RNA (sgRNA).

The one or more gRNA can be a concatenated gRNA comprising a first gRNA and a second gRNA. The first gRNA and second gRNA can be attached via a linker. The linker can be a chemical linker or one or more nucleotides. The first gRNA can comprise a spacer sequence that is complementary to a segment of the human beta globin locus on chromosome 11, the BCL11A gene on chromosome 2, or the DNA sequence that encodes a transcriptional control region of the BCL11A gene on chromosome 2. The second gRNA can comprise a spacer sequence that is complementary to a segment of the human beta globin locus on chromosome 11, the BCL11A gene on chromosome 2, or the DNA sequence that encodes a transcriptional control region of the BCL11A gene on chromosome 2.

The one or more gRNA can be a concatenated gRNA comprising a first gRNA, a second gRNA, and a third gRNA. The first gRNA and second gRNA are attached via a first linker and the second gRNA and third gRNA are attached via a second linker. The first linker and second linker can be chemical linkers or one or more nucleotides. The first gRNA can comprise a spacer sequence that is complementary to a segment of the human beta globin locus on chromosome 11, the BCL11A gene on chromosome 2, or the DNA sequence that encodes a transcriptional control region of the BCL11A gene on chromosome 2. The second gRNA can comprise a spacer sequence that is complementary to a segment of the human beta globin locus on chromosome 11, the BCL11A gene on chromosome 2, or the DNA sequence that encodes a transcriptional control region of the BCL11A gene on chromosome 2. The third gRNA can comprise a spacer sequence that is complementary to a segment of a human beta globin locus on chromosome 11, the BCL11A gene on chromosome 2, or the DNA sequence that encodes a transcriptional control region of the BCL11A gene on chromosome 2.

The increase of fetal hemoglobin (HbF) in the genome-edited human cells can be compared to HbF levels in wild-type human cells.

Also provided herein is an ex vivo method for treating a patient (e.g., a human) with a hemoglobinopathy, the method comprises: creating a patient specific induced pluripotent stem cell (iPSC); editing within or near a human beta globin locus on chromosome 11 and one or more of: a BCL11A gene on chromosome 2 and a DNA sequence that encodes a transcriptional control region of the BCL11A gene on chromosome 2 of the iPSC; differentiating the genome-edited iPSC into a hematopoietic progenitor cell; and implanting the hematopoietic progenitor cell into the patient.

The step of creating a patient specific iPSC can comprise: isolating a somatic cell from the patient; and introducing a set of pluripotency-associated genes into the somatic cell to induce the somatic cell to become a pluripotent stem cell. The somatic cell can be a fibroblast. The set of pluripotency-associated genes can be one or more of the genes selected from the group consisting of OCT4, SOX2, KLF4, Lin28, NANOG and cMYC.

The step of editing within or near a human beta globin locus on chromosome 11, and within or near one or more of: a BCL11A gene on chromosome 2, and a DNA sequence that encodes a transcriptional control region of the BCL11A gene on chromosome 2 can comprise: introducing into the iPSC one or more DNA endonuclease to effect two or more SSB or DSB, a first SSB or DSB within or near a human beta globin locus on chromosome 11, and a second SSB or DSB within or near one or more of: a BCL11A gene on chromosome 2, and a DNA sequence that encodes a transcriptional control region of the BCL11A gene on chromosome 2. The first SSB or DSB can result in one or more of: a permanent deletion or inversion within or near the human beta globin locus on chromosome 11, and a mutation within or near the human beta globin locus on chromosome 11. The second SSB or DSB can result in one or more of: a permanent deletion or inversion within or near the BCL11A gene on chromosome 2, a mutation within or near the BCL11A gene on chromosome 2, a permanent deletion or inversion within or near the DNA sequence that encodes a transcriptional control region of the BCL11A gene on chromosome 2, and a mutation within or near the DNA sequence that encodes a transcriptional control region of the BCL11A gene on chromosome 2. The two permanent deletion, inversion, or mutation can result in an increased expression of γ-globin and an increase of HbF in the iPSC.

The step of differentiating the genome-edited iPSC into a hematopoietic progenitor cell can comprise: treatment with a combination of small molecules, delivery of master transcription factors, delivery of mRNA encoding master transcription factors, and delivery of mRNA encoding transcription factors.

The step of implanting the hematopoietic progenitor cell into the patient can comprise implanting the hematopoietic progenitor cell by transplantation, local injection, systemic infusion, and combinations thereof.

Also provided herein is an ex vivo method for treating a patient (e.g., a human) with a hemoglobinopathy, the method comprising the steps of: isolating a mesenchymal stem cell from the patient; editing within or near a human beta globin locus on chromosome 11 and one or more of: a BCL11A gene on chromosome 2, and a DNA sequence that encodes a transcriptional control region of the BCL11A gene on chromosome 2 of the mesenchymal stem cell; differentiating the genome-edited mesenchymal stem cell into a hematopoietic progenitor cell; and implanting the hematopoietic progenitor cell into the patient.

The mesenchymal stem cell can be isolated from the patient's bone marrow by performing a biopsy of the patient's bone marrow or the mesenchymal stem cell can be isolated from peripheral blood. The step of isolating a mesenchymal stem cell from the patient can comprise aspiration of bone marrow and isolation of mesenchymal cells by density gradient centrifugation.

The step of editing within or near a human beta globin locus on chromosome 11, and within or near one or more of: a BCL11A gene on chromosome 2, and a DNA sequence that encodes a transcriptional control region of the BCL11A gene on chromosome 2 can comprise: introducing into the mesenchymal stem cell one or more DNA endonuclease to effect two or more SSB or DSB, a first SSB or DSB within or near a human beta globin locus on chromosome 11, and a second SSB or DSB within or near one or more of: a BCL11A gene on chromosome 2 and a DNA sequence that encodes a transcriptional control region of the BCL11A gene on chromosome 2. The first SSB or DSB can result in one or more of: a permanent deletion or inversion within or near the human beta globin locus on chromosome 11, and a mutation within or near the human beta globin locus on chromosome 11. The second SSB or DSB can result in one or more of: a permanent deletion or inversion within or near the BCL11A gene on chromosome 2, a mutation within or near the BCL11A gene on chromosome 2, a permanent deletion or inversion within or near the DNA sequence that encodes a transcriptional control region of the BCL11A gene on chromosome 2, and a mutation within or near the DNA sequence that encodes a transcriptional control region of the BCL11A gene on chromosome 2. The two or more permanent deletion, inversion, or mutation can result in an increased expression of γ-globin and an increase of fetal hemoglobin (HbF) in the mesenchymal stem cell.

The step of differentiating the genome-edited mesenchymal stem cell into a hematopoietic progenitor cell can comprise one or more of the following: treatment with a combination of small molecules, delivery of master transcription factors, delivery of mRNA encoding master transcription factors, and delivery of mRNA encoding transcription factors.

The step of implanting the hematopoietic progenitor cell into the patient can comprise implanting the hematopoietic progenitor cell into the patient by transplantation, local injection, systemic infusion, or combinations thereof.

Also provided herein is an ex vivo method for treating a patient (e.g., a human) with a hemoglobinopathy, the method comprising the steps of: isolating a hematopoietic progenitor cell from the patient; editing within or near a human beta globin locus on chromosome 11 and one or more of: a BCL11A gene on chromosome 2 and a DNA sequence that encodes a transcriptional control region of the BCL11A gene on chromosome 2 of the hematopoietic progenitor cell; and implanting the genome-edited hematopoietic progenitor cell into the patient.

The method can further comprise treating the patient with granulocyte colony stimulating factor (GCSF) prior to the step of isolating a hematopoietic progenitor cell from the patient. The step of treating the patient with GCSF can be performed in combination with Plerixaflor.

The step of isolating a hematopoietic progenitor cell from the patient can comprise isolating CD34+ cells.

The step of editing within or near a human beta globin locus on chromosome 11, and within or near one or more of: a BCL11A gene on chromosome 2, and a DNA sequence that encodes a transcriptional control region of the BCL11A gene on chromosome 2 can comprise: introducing into the hematopoietic progenitor cell one or more DNA endonuclease to effect two or more SSB or DSB, a first SSB or DSB within or near a human beta globin locus on chromosome 11, and a second SSB or DSB within or near one or more of: a BCL11A gene on chromosome 2 and a DNA sequence that encodes a transcriptional control region of the BCL11A gene on chromosome 2. The first SSB or DSB can result in one or more of: a permanent deletion within or near the human beta globin locus on chromosome 11, and a mutation within or near the human beta globin locus on chromosome 11. The second SSB or DSB can result in one or more of: a permanent deletion within or near the BCL11A gene on chromosome 2, a mutation within or near the BCL11A gene on chromosome 2, a permanent deletion within or near the DNA sequence that encodes a transcriptional control region of the BCL11A gene on chromosome 2, and a mutation within or near the DNA sequence that encodes a transcriptional control region of the BCL11A gene on chromosome 2. The two or more permanent deletion, inversion, or mutation can result in an increased expression of γ-globin and a increase of fetal hemoglobin (HbF) in the hematopoietic progenitor cell.

The step of implanting the genome-edited hematopoietic progenitor cell into the patient can comprise implanting the genome-edited hematopoietic progenitor cell into the patient by transplantation, local injection, systemic infusion, or combinations thereof.

The hemoglobinopathy can be selected from a group consisting of sickle cell anemia and thalassemia. The hemoglobinopathy can be selected from the group consisting of sickle cell disease, sickle cell trait, hemoglobin C disease, hemoglobin C trait, hemoglobin S/C disease, hemoglobin D disease, hemoglobin E disease, a thalassemia, a condition associated with hemoglobin with increased oxygen affinity, a condition associated with hemoglobin with decreased oxygen affinity, unstable hemoglobin disease, methemoglobinemia, and combinations thereof.

Also provided herein is an in vivo method for treating a patient (e.g., a human) with a hemoglobinopathy, the method comprising the steps of: editing within or near a human beta globin locus on chromosome 11 and within or near one or more of: a BCL11A gene on chromosome 2, and a DNA sequence that encodes a transcriptional control region of the BCL11A gene on chromosome 2 in a cell of the patient. The cell can a bone marrow cell, a hematopoietic progenitor cell, or a CD34+ cell.

The step of editing within or near a human beta globin locus on chromosome 11, and within or near one or more of: a BCL11A gene on chromosome 2, and a DNA sequence that encodes a transcriptional control region of the BCL11A gene on chromosome 2 can comprise: introducing into the cell one or more DNA endonuclease to effect two or more SSB or DSB, a first SSB or DSB within or near a human beta globin locus on chromosome 11, and a second SSB or DSB within or near one or more of: a BCL11A gene on chromosome 2, and a DNA sequence that encodes a transcriptional control region of the BCL11A gene on chromosome 2. The first SSB or DSB can result in one or more of: a permanent deletion or inversion within or near the human beta globin locus on chromosome 11, and a mutation within or near the human beta globin locus on chromosome 11. The second SSB or DSB can result in one or more of: a permanent deletion or inversion within or near the BCL11A gene on chromosome 2, a mutation within or near the BCL11A gene on chromosome 2, a permanent deletion or inversion within or near the DNA sequence that encodes a transcriptional control region of the BCL11A gene on chromosome 2, and a mutation within or near the DNA sequence that encodes a transcriptional control region of the BCL11A gene on chromosome 2. The two or more permanent deletion, inversion, or mutation result in an increased expression of Y-globin and a increase of fetal hemoglobin (HbF) in the cell.

The one or more DNA endonuclease is selected from the group consisting of a zinc finger nuclease, TAL effector nuclease, meganuclease, MegaTAL, Tev-m TALEN, Mega-Tev, homing endonuclease, FokI, StsI, Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Cse1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease, a homolog thereof, a recombination of the naturally occurring molecule thereof, a codon-optimized thereof, modified versions thereof, and combinations thereof.

The method can comprise introducing into the cell one or more polynucleotide encoding the one or more DNA endonuclease. The method can comprise introducing into the cell one or more RNA encoding the one or more DNA endonuclease. The one or more polynucleotide or one or more RNA can be one or more modified polynucleotide or one or more modified RNA. The DNA endonuclease can be a protein or polypeptide.

The method can further comprise introducing into the cell one or more gRNA. The one or more gRNA can be sgRNA. The one or more gRNA or one or more sgRNA can be one or more modified gRNA, one or more modified sgRNA, or combinations thereof. The one or more DNA endonuclease can be pre-complexed with one or more gRNA, one or more sgRNA, or combinations thereof.

The method can further comprise: introducing into the cell one or more gRNA or one or more concatenated gRNA, and wherein the one or more DNA endonuclease is one or more Cas9 endonuclease that effect or create two or more pair of SSBs or DSBs, a first pair of SSB or DSB within or near a human beta globin locus on chromosome 11, and a second pair of SSB or DSB within or near one or more of: a BCL11A gene on chromosome 2 and a DNA sequence that encodes a transcriptional control region of the BCL11A gene on chromosome 2. The first pair of SSB or DSB can be a SSB or DSB at a 5' locus within or near the human beta globin locus on chromosome 11; and a SSB or DSB at a 3' locus within or near of the human beta globin locus on chromosome 11. The second pair of SSB or DSB can be a SSB or DSB at the 5' locus within or near the BCL11A gene on chromosome 2, or the DNA sequence that encodes a transcriptional control region of the BCL11A gene on chromosome 2; and a SSB or DSB at the 3' locus within or near the BCL11A gene on chromosome 2, or the DNA sequence that encodes a transcriptional control region of the BCL11A gene on chromosome 2. The SSB or DSB at the 5' locus and the SSB or DSB at the 3' locus can result in two or more permanent deletion of the chromosomal DNA between the 5' locus and the 3' locus within or near the human beta globin locus on chromosome 11, the BCL11A gene on chromosome 2, or the DNA sequence that encodes a transcriptional control region of the BCL11A gene on chromosome 2.

The SSB or DSB at the 5' locus within or near the human beta globin locus on chromosome 11 can be proximal to a 5' boundary of a HPFH deletion. The SSB or DSB at the 5' locus within or near the human beta globin locus on chromosome 11 can be proximal to a 5' boundary of a HPFH deletion selected from the group consisting of: a HPFH-4 deletion, a HPFH-5 deletion, a HPFH-Kenya deletion, a HPFH-Black deletion, a large Corfu deletion, a small deletion, and the small Corfu deletion.

The SSB or DSB at the 3'locus within or near the human beta globin locus on chromosome 11 can be proximal to a 3' boundary of a HPFH deletion.

The SSB or DSB at the 3' locus within or near the human beta globin locus on chromosome 11 can be proximal to a 3' boundary of a HPFH deletion selected from the group consisting of: a HPFH-4 deletion, a HPFH-5 deletion, a HPFH-Kenya deletion, a HPFH-Black deletion, the large Corfu deletion, and a small Corfu deletion.

The SSB or DSB at the 5' locus within or near the human beta globin locus on chromosome 11 can be proximal to a 5' boundary of a HPFH deletion and the SSB or DSB at the 3' locus within or near the human beta globin locus on chromosome 11 can be proximal to a 3' boundary of the HPFH deletion.

The SSB or DSB at the 5' locus within or near the human beta globin locus on chromosome 11 is proximal to a 5' boundary of a HPFH deletion and the SSB or DSB at the 3' locus within or near the human beta globin locus on chromosome 11 can be proximal to a 3' boundary of the HPFH deletion, wherein the HPFH deletion can be selected from the group consisting of: a HPFH-4 deletion, a HPFH-5 deletion, a HPFH-Kenya deletion, a HPFH-Black deletion, a large Corfu deletion, and a small Corfu deletion.

A 3' boundary of the deletion can be proximal to Chr11:5224779 and a 5' boundary of the deletion can be proximal to Chr11:5237723.

A 3' boundary of the deletion can be proximal to Chr11:5234665 and a 5' boundary of the deletion can be proximal to Chr11:5238138.

A 3' boundary of the deletion can be proximal to Chr11:5233055 and a 5' boundary of the deletion can be proximal to Chr11:5240389.

A 3' boundary of the deletion can be proximal to Chr11:5226631 and a 5' boundary of the deletion can be proximal to Chr11:5249422.

A 3' boundary of the deletion can be proximal to Chr11:5196709 and a 5' boundary of the deletion can be proximal to Chr11:5239223.

A 3' boundary of the deletion can be proximal to Chr11:5225700 and a 5' boundary of the deletion can be proximal to Chr11:5236750.

The deletion can include all or a portion of the 8-globin upstream region. The deletion can include all or a portion of the β-globin gene.

The permanent deletion of the chromosomal DNA between the 5' locus and the 3' locus can be in a region of the human beta globin locus comprising a HBG1 gene and a HBG2 gene. The permanent deletion of the chromosomal DNA between the 5' locus and the 3' locus can be a 13-base pair deletion located upstream of the HBG1 gene. The permanent deletion of the chromosomal DNA between the 5' locus and the 3' locus can be a 4.9 Kb deletion located upstream of the HBG1 gene. The permanent deletion of the chromosomal DNA between the 5' locus and the 3' locus can be a 13-base pair deletion located upstream of the HBG1 gene and a 4.9 Kb deletion located upstream of the HBG1 gene.

The permanent deletion of the chromosomal DNA between the 5' locus and the 3' locus can be located within a second intron of the BCL11A gene on chromosome 2. The permanent deletion of the chromosomal DNA between the 5' locus and the 3' locus can be located within a +58 DNA DHS of the BCL11A gene on chromosome 2.

The one or more DNA endonuclease can be selected from the group consisting of a zinc finger nuclease, TAL effector nuclease, meganuclease, MegaTAL, Tev-m TALEN, Mega-Tev, homing endonuclease, FokI, StsI, Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease, a homolog thereof, a recombination of the naturally occurring molecule thereof, a codon-optimized thereof, modified versions thereof, and combinations thereof.

The one or more gRNA or the one or more concatenated gRNA can comprise a spacer sequence that is complementary to either the 5' locus of the human beta globin locus on chromosome 11, 5' locus of the BCL11A gene on chromosome 2, 5' locus of the DNA sequence that encodes a transcriptional control region of the BCL11A gene on chromosome 2, 3' locus of the human beta globin locus on chromosome 11, 3' locus of the BCL11A gene on chromosome 2, or the 3' locus of the DNA sequence that encodes a transcriptional control region of the BCL11A gene on chromosome 2.

The one or more gRNA or the one or more concatenated gRNA can be one or more sgRNA or one or more concatenated sgRNA. The one or more gRNA or one or more concatenated gRNA can comprise one or more modified gRNA. The one or more sgRNA or one or more concatenated sgRNA can comprise one or more modified sgRNA. The one or more DNA endonuclease can be pre-complexed with one or more gRNA, one or more sgRNA, one or more concatenated gRNA, or one or more concatenated sgRNA.

The Cas9 mRNA, and gRNA or concatenated gRNA, can be either each formulated into separate lipid nanoparticles or all co-formulated into a lipid nanoparticle. The Cas9 mRNA can be formulated into a lipid nanoparticle, and the gRNA or concatenated gRNA can be delivered to the cell by an adeno-associated virus (AAV) vector. The Cas9 mRNA can be formulated into a lipid nanoparticle and the gRNA or concatenated gRNA can be delivered to the cell by electroporation.

The increase of HbF in the genome-edited human cells can be compared to HbF levels in wild-type human cells.

The hemoglobinopathy can be selected from a group consisting of sickle cell anemia and thalassemia. The hemoglobinopathy can be selected from the group consisting of sickle cell disease, sickle cell trait, hemoglobin C disease, hemoglobin C trait, hemoglobin S/C disease, hemoglobin D disease, hemoglobin E disease, a thalassemia, a condition associated with hemoglobin with increased oxygen affinity, a condition associated with hemoglobin with decreased oxygen affinity, unstable hemoglobin disease, methemoglobinemia, and combinations thereof.

Also provided herein is one or more gRNA for editing within or near a human beta globin locus on chromosome 11 and within or near one or more of: a BCL11A gene on chromosome 2, and a DNA sequence that encodes a transcriptional control region of the BCL11A gene on chromosome 2, in a cell from a patient with a hemoglobinopathy. The one or more gRNA can comprise a spacer sequence selected from a Sequence Listing disclosed herein. The one or more gRNA can be one or more sgRNA. The one or more gRNA or one or more sgRNA can be one or more modified gRNA or one or more modified sgRNA.

Also provided herein is a concatenated gRNA for editing within or near a human beta globin locus on chromosome 11 and within or near one or more of: a BCL11A gene on chromosome 2 and a DNA sequence that encodes a transcriptional control region of the BCL11A gene on chromosome 2, in a cell from a patient with a hemoglobinopathy. The concatenated gRNA can comprise one or more gRNA and the one or more gRNA comprise a spacer sequence selected from a Sequence Listing disclosed herein. The one or more gRNA of the concatenated gRNA can be one or more single-molecule guide RNA (sgRNA). The one or more gRNA or one or more sgRNA of the concatenated gRNA is one or more modified gRNA or one or more modified sgRNA.

The hemoglobinopathy can be selected from a group consisting of sickle cell anemia and thalassemia.

Also provided herein is a method of increasing fetal hemoglobin (HbF) in a human cell by genome editing. The method comprises: introducing a first guide RNA into the human cell using a first electroporation wherein the first guide RNA targets a human beta globin locus on chromosome 11; introducing a second guide RNA into the human cell using a second electroporation wherein the second guide RNA targets one or more of: a BCL11A gene on chromosome 2, and a DNA sequence that encodes a transcriptional control region of the BCL11A gene on chromosome 2; wherein two or more permanent deletion, inversion, or mutation result in an increased expression of γ-globin and an increase of fetal hemoglobin (HbF) in the human cell.

Also provided herein is a method of increasing fetal hemoglobin (HbF) in a human cell by genome editing. The method comprises: introducing a first guide RNA into the human cell using a first electroporation wherein the first guide RNA targets one or more of: a BCL11A gene on chromosome 2, and a DNA sequence that encodes a transcriptional control region of the BCL11A gene on chromosome 2; introducing a second guide RNA into the human cell using a second electroporation wherein the second guide RNA targets a human beta globin locus on chromosome 11; wherein two or more permanent deletion, inversion, or mutation result in an increased expression of γ-globin and an increase of fetal hemoglobin (HbF) in the human cell.

Also provided herein is a method of increasing fetal hemoglobin (HbF) in a human cell by genome editing. The method comprises: introducing a first guide RNA into the human cell using a first electroporation wherein the first guide RNA targets a human beta globin locus on chromosome 11; introducing a second guide RNA into the human cell using a second electroporation wherein the second guide RNA targets the human beta globin locus on chromosome 11; wherein two or more permanent deletion, inversion, or mutation result in an increased expression of Y-globin and an increase of fetal hemoglobin (HbF) in the human cell.

Also provided herein is a method of increasing fetal hemoglobin (HbF) in a human cell by genome editing. The method comprises: introducing a first guide RNA into the human cell using a first electroporation wherein the first guide RNA targets one or more of: a BCL11A gene on chromosome 2, and a DNA sequence that encodes a transcriptional control region of the BCL11A gene on chromosome 2; introducing a second guide RNA into the human cell using a second electroporation wherein the second guide RNA targets one or more of: a BCL11A gene on chromosome 2, and a DNA sequence that encodes a transcriptional control region of the BCL11A gene on chromosome 2; wherein two or more permanent deletion, inversion, or mutation result in an increased expression of γ-globin and an increase of fetal hemoglobin (HbF) in the human cell.

Also provided herein is a method of increasing fetal hemoglobin (HbF) in a human cell by genome editing. The method comprises: introducing a first guide RNA into the human cell using a first electroporation wherein the first guide RNA targets a human beta globin locus on chromosome 11; introducing one or more deoxyribonucleic acid (DNA) endonuclease into the human cell to effect one or more single-strand break (SSB) or double-strand break (DSB), a first SSB or DSB within or near the human beta globin locus on chromosome 11, wherein the first SSB or DSB results in one or more of: a permanent deletion or inversion within or near the human beta globin locus on chromosome 11, and a mutation within or near the human beta globin locus on chromosome 11; introducing a second guide RNA into the human cell using a second electroporation wherein the second guide RNA targets one or more of: a BCL11A gene on chromosome 2, and a DNA sequence that encodes a transcriptional control region of the BCL11A gene on chromosome 2; introducing one or more DNA endonuclease into the human cell to effect one or more SSB or DSB, a second SSB or DSB within or near one or more of: the BCL11A gene on chromosome 2, and the DNA sequence that encodes a transcriptional control region of the BCL11A gene on chromosome 2, wherein the second SSB or DSB results in one or more of: a permanent deletion or inversion within or near the BCL11A gene on chromosome 2, a mutation within or near the BCL11A gene on chromosome 2, a permanent deletion or inversion within or near the DNA sequence that encodes a transcriptional control region of the BCL11A gene on chromosome 2, and a mutation within or near the DNA sequence that encodes a transcriptional control region of the BCL11A gene on chromosome 2; wherein the two or more permanent deletion, inversion, or mutation results in an increased expression of γ-globin and an increase of fetal hemoglobin (HbF) in the human cell.

Also provided herein is a method of increasing fetal hemoglobin (HbF) in a human cell by genome editing. The method comprises: introducing a first guide RNA into the human cell using a first electroporation wherein the first guide RNA targets one or more of: a BCL11A gene on chromosome 2, and a DNA sequence that encodes a transcriptional control region of the BCL11A gene on chromosome 2; introducing into the human cell one or more deoxyribonucleic acid (DNA) endonuclease to effect one or more single-strand break (SSB) or double-strand break (DSB), a first SSB or DSB within or near one or more of: the BCL11A gene on chromosome 2, and the DNA sequence that encodes a transcriptional control region of the BCL11A gene on chromosome 2, wherein the first SSB or DSB results in one or more of: a permanent deletion or inversion within or near the BCL11A gene on chromosome 2, a mutation within or near the BCL11A gene on chromosome 2, a permanent deletion or inversion within or near the DNA sequence that encodes a transcriptional control region of the BCL11A gene on chromosome 2, and a mutation within or near the DNA sequence that encodes a transcriptional control region of the BCL11A gene on chromosome 2; introducing a second guide RNA into the human cell using a second electroporation wherein the second guide RNA targets a human beta globin locus on chromosome 11; introducing into the human cell one or more DNA endonuclease to effect one or more SSB or DSB, a second SSB or DSB within or near the human beta globin locus on chromosome 11, wherein the second SSB or DSB results in one or more of: a permanent deletion or inversion within or near the human beta globin locus on chromosome 11, and a mutation within or near the human beta globin locus on chromosome 11; wherein the two or more permanent deletion, inversion, or mutation results in an increased expression of γ-globin and an increase of fetal hemoglobin (HbF) in the human cell.

Also provided herein is a method of increasing fetal hemoglobin (HbF) in a human cell by genome editing. The method comprises: introducing a first guide RNA into the human cell using a first electroporation wherein the first guide RNA targets a human beta globin locus on chromosome 11; introducing one or more deoxyribonucleic acid (DNA) endonuclease into the human cell to effect one or more single-strand break (SSB) or double-strand break (DSB), a first SSB or DSB within or near the human beta globin locus on chromosome 11, wherein the first SSB or DSB results in one or more of: a permanent deletion or inversion within or near the human beta globin locus on chromosome 11, and a mutation within or near the human beta globin locus on chromosome 11; introducing a second guide RNA into the human cell using a second electroporation wherein the second guide RNA targets the human beta globin locus on chromosome 11; introducing one or more DNA endonuclease into the human cell to effect one or more SSB or DSB, a second SSB or DSB within or near the human beta globin locus on chromosome 11, wherein the second SSB or DSB results in one or more of: a permanent deletion or inversion within or near the human beta globin locus on chromosome 11, and a mutation within or near the human beta globin locus on chromosome 11; wherein the two or more permanent deletion, inversion, or mutation results in an increased expression of γ-globin and an increase of fetal hemoglobin (HbF) in the human cell.

Also provided herein is a method of increasing fetal hemoglobin (HbF) in a human cell by genome editing. The method comprises: introducing a first guide RNA into the human cell using a first electroporation wherein the first guide RNA targets one or more of: a BCL11A gene on chromosome 2, and a DNA sequence that encodes a transcriptional control region of the BCL11A gene on chromosome 2; introducing into the human cell one or more deoxyribonucleic acid (DNA) endonuclease to effect one or more single-strand break (SSB) or double-strand break (DSB), a first SSB or DSB within or near one or more of: a BCL11A gene on chromosome 2, and a DNA sequence that encodes a transcriptional control region of the BCL11A gene on chromosome 2, wherein the first SSB or DSB results in one or more of: a permanent deletion or inversion within or near the BCL11A gene on chromosome 2, a mutation within or near the BCL11A gene on chromosome 2, a permanent deletion or inversion within or near the DNA sequence that encodes a transcriptional control region of the BCL11A gene on chromosome 2, and a mutation within or near the DNA sequence that encodes a transcriptional control region of the BCL11A gene on chromosome 2; introducing a second guide RNA into the human cell using a second electroporation wherein the second guide RNA targets one or more of: a BCL11A gene on chromosome 2, and a DNA sequence that encodes a transcriptional control region of the BCL11A gene on chromosome 2; introducing into the human cell one or more DNA endonuclease to effect one or more SSB or DSB, a second SSB or DSB within or near one or more of: a BCL11A gene on chromosome 2, and a DNA sequence that encodes a transcriptional control region of the BCL11A gene on chromosome 2, wherein the second SSB or DSB results in one or more of: a permanent deletion or inversion within or near the BCL11A gene on chromosome 2, a mutation within or near the BCL11A gene on chromosome 2, a permanent deletion or inversion within or near the DNA sequence that encodes a transcriptional control region of the BCL11A gene on chromosome 2, and a mutation within or near the DNA sequence that encodes a transcriptional control region of the BCL11A gene on chromosome 2; wherein the two or more permanent deletion, inversion, or mutation results in an increased expression of γ-globin and an increase of fetal hemoglobin (HbF) in the human cell.

Also provided herein are edited cells (e.g., isolated edited cells, such as isolated edited human cells) obtained by or obtainable by any method provided herein.

It is understood that the inventions described in this specification are not limited to the examples summarized in this Summary. Various other aspects are described and exemplified herein.

BRIEF DESCRIPTION OF THE DRAWINGS

Various aspects of materials and methods for treatment of hemoglobinopathies disclosed and described in this specification can be better understood by reference to the accompanying figures, in which:

FIG. 1A shows a restriction map of the HPFH5 deletion variant (lower part) compared with wild type β-globin locus (upper part), as defined by Camaschella et al, *Haematologica*, 75 (Suppl 5): 26-30 (1990);

FIG. 1B shows a schematic of the human β-globin locus with hollow boxes highlighting illustrative HPFH5-like 5' and 3' target sites for CRISPR. The 12.9 kb deletion starts 3 kb 5' to the 8 gene and ends 1.7 kb 3' to the end of the β gene (690 bp downstream from the β polyA signal), as described by Camaschella et al., supra;

FIGS. 5A-5B show the location of the HPFH-SD 13 bp deletion;

FIG. 5A shows a sequence alignment of wild type and 13 bp deletion variant of human γ-globin locus (SEQ ID NOs: 228,305-228,308) from top to bottom;

FIG. 5B shows a sequence alignment of HBG1 and HBG2 genes showing the conserved target region (dotted box), along with the potential ~5 kb deletion arising from cleavage at the target site in both genes (lower panel);

FIG. 6A shows a schematic showing location of the HPFH-4 deletion (SEQ ID NO: 228,309);

FIG. 6B shows a schematic showing location of the HPFH Black deletion;

FIG. 6C shows a genomic sequence in the region of the $^{G}$γ-175 (T to C) mutation;

FIG. 7A is a plasmid (CTx-1) comprising a codon optimized gene for *S. pyogenes* Cas9 endonuclease. The CTx-1 plasmid also comprises a gRNA scaffold sequence, which includes a 20 bp spacer sequence from the sequences listed in the Sequence Listing;

FIG. 7B is a plasmid (CTx-2) comprising a different codon optimized gene for *S. pyogenes* Cas9 endonuclease. The CTx-2 plasmid also comprises a gRNA scaffold sequence, which includes a 20 bp spacer sequence from the sequences listed in the Sequence Listing;

FIG. 7C is a plasmid (CTx-3) comprising yet another different codon optimized gene for *S. pyogenes* Cas9 endonuclease. The CTx-3 plasmid also comprises a gRNA scaffold sequence, which includes a 20 bp spacer sequence from the sequences listed in the Sequence Listing;

FIG. 8A is a depiction of the type II CRISPR/Cas system including gRNA;

FIG. 8B is a depiction of the type II CRISPR/Cas system including sgRNA;

FIGS. 10A-10B show a depiction of gRNA combinations that can be used to delete a portion of the +58 DNA hypersensitive site (DHS) of the BCL11A gene and a table showing various gRNA combinations that can be used to delete a portion of the +58 DHS of the BCL11A gene;

FIG. 10A is a depiction of gRNA combinations that can be used to delete a portion of the +58 DHS of the BCL11A gene (SEQ ID NOs: 228,310-228,331 shown from top to bottom);

FIG. 10B is a table showing various gRNA combinations that can be used to delete a portion of the +58 DHS of the BCL11A gene and the deletion size resulting from each gRNA combination;

FIGS. 11A-11C refer to the +58 DHS gRNAs that are included in FIG. 9. FIG. 11A shows SEQ ID NOs: 228,332-228,376 from top to bottom. FIG. 11B shows SEQ ID NOs: 228,377-228,423 from top to bottom. FIG. 11C shows SEQ ID NOs: 228,424-228,427 from top to bottom;

FIG. 12 shows an experimental design that includes successive electroporations using dual guide RNAs;

FIG. 13A shows the viability of human mPB CD34+ cells from Donor LKP06B successively electroporated with dual guide RNA compared to human mPB CD34+ cells from Donor LKP06B electroporated with a single guide RNA;

FIG. 13B shows the growth kinetics of human mPB CD34+ cells from Donor LKP06B successively electroporated with dual guide RNA compared to human mPB CD34+ cells from Donor LKP06B electroporated with a single guide RNA;

FIG. 14A shows the rate of DNA editing (% indels) at the BCL11a locus and HBG2 locus in human mPB CD34+ cells from Fred Hutch Donor 304 successively electroporated with dual guide RNAs compared to human mPB CD34+ cells from Fred Hutch Donor 304 electroporated with a single guide RNA;

FIG. 14B shows the rate of DNA editing (% indels) at the BCL11a locus and HBG2 locus in human mPB CD34+ cells from Donor LKP06B successively electroporated with dual guide RNAs compared to human mPB CD34+ cells from Donor LKP06B electroporated with a single guide RNA;

FIG. 15A shows the differentiation of human mPB CD34+ cells from Donor LKP06B successively electroporated with dual guide RNAs compared to human mPB CD34+ cells from Donor LKP06B electroporated with a single guide RNA. Differentiation was determined by measuring the percentage of Band3 and Alpha4;

FIG. 15B shows the differentiation of human mPB CD34+ cells from Donor LKP06B successively electroporated with dual guide RNAs compared to human mPB CD34+ cells from Donor LKP06B electroporated with a single guide RNA. Differentiation was determined by measuring the percentage of GYPA, and CD71;

FIG. 16 shows the enucleation of human mPB CD34+ cells from Donor LKP06B successively electroporated with dual guide RNAs compared to human mPB CD34+ cells from Donor LKP06B electroporated with a single guide RNA;

FIG. 17A shows the γ/α globin mRNA ratio in human mPB CD34+ cells from Fred Hutch Donor 304 successively electroporated with dual guide RNAs compared to human mPB CD34+ cells from Fred Hutch Donor 304 electroporated with a single guide RNA;

FIG. 17B shows the γ/α globin mRNA ratio in human mPB CD34+ cells from Donor LKP06B successively electroporated with dual guide RNAs compared to human mPB CD34+ cells from Donor LKP06B electroporated with a single guide RNA;

FIG. 18A shows the globin mRNA ratio in human mPB CD34+ cells from Fred Hutch Donor 304 successively electroporated with dual guide RNAs compared to human mPB CD34+ cells from Fred Hutch Donor 304 electroporated with a single guide RNA;

FIG. 18B shows the globin mRNA ratio in human mPB CD34+ cells from Donor LKP06B successively electroporated with dual guide RNAs compared to human mPB CD34+ cells from Donor LKP06B electroporated with a single guide RNA;

FIG. 19A shows the γ/18S globin mRNA ratio in human mPB CD34+ cells from Fred Hutch Donor 304 successively electroporated with dual guide RNAs compared to human mPB CD34+ cells from Fred Hutch Donor 304 electroporated with a single guide RNA;

FIG. 19B shows the γ/18S globin mRNA ratio in human mPB CD34+ cells from Donor LKP06B successively electroporated with dual guide RNAs compared to human mPB CD34+ cells from Donor LKP06B electroporated with a single guide RNA;

FIG. 20 shows the percentage of HbF expression in human mPB CD34+ cells from Donor LKP06B successively electroporated with dual guide RNAs compared to human mPB CD34+ cells from Donor LKP06B electroporated with a single guide RNA;

FIG. 21A shows HbF expression in untreated human mPB CD34+ cells;

FIG. 21B shows HbF expression in human mPB CD34+ cells electroporated with SPY101;

FIG. 21C shows HbF expression in human mPB CD34+ cells electroporated with SD2;

FIG. 21D shows HbF expression in human mPB CD34+ cells successively electroporated with SPY101 and then SD2;

FIG. 21E shows HbF expression in human mPB CD34+ cells electroporated with two guide RNAs (Exon 2-2 and Exon 2-3) at the same time;

FIGS. 23A-23B show the growth kinetics and viability of human mPB CD34+ cells successively electroporated with dual guide RNAs under Arm 1 conditions compared to human mPB CD34+ cells electroporated with a single guide RNA under Arm 1 conditions;

FIG. 23A shows the growth kinetics of human mPB CD34+ cells successively electroporated with dual guide RNAs under Arm 1 conditions compared to human mPB CD34+ cells electroporated with a single guide RNA under Arm 1 conditions;

FIG. 23B shows the viability of human mPB CD34+ cells successively electroporated with dual guide RNAs under Arm 1 conditions compared to human mPB CD34+ cells electroporated with a single guide RNA under Arm 1 conditions;

FIG. 24A shows the growth kinetics of human mPB CD34+ cells successively electroporated with dual guide RNAs under Arm 2 conditions compared to human mPB CD34+ cells electroporated with a single guide RNA under Arm 2 conditions;

FIG. 24B shows the viability of human mPB CD34+ cells successively electroporated with dual guide RNAs under Arm 2 conditions compared to human mPB CD34+ cells electroporated with a single guide RNA under Arm 2 conditions;

FIGS. 25A-25B show the growth kinetics and viability of human mPB CD34+ cells successively electroporated with dual guide RNAs under Arm 3 conditions compared to human mPB CD34+ cells electroporated with a single guide RNA under Arm 3 conditions.

FIG. 25A shows the growth kinetics of human mPB CD34+ cells successively electroporated with dual guide RNAs under Arm 3 conditions compared to human mPB CD34+ cells electroporated with a single guide RNA under Arm 3 conditions;

FIG. 25B shows the viability of human mPB CD34+ cells successively electroporated with dual guide RNAs under Arm 3 conditions compared to single guide RNA electroporated human mPB CD34+ cells electroporated with a single guide RNA under Arm 3 conditions;

FIG. 26A shows the viability of human mPB CD34+ cells successively electroporated with dual guide RNAs under Arm conditions 1-3 compared to human mPB CD34+ cells electroporated with a single guide RNA under Arm conditions 1-3;

FIG. 26B shows the growth kinetics of human mPB CD34+ cells successively electroporated with dual guide RNAs under Arm conditions 1-3 compared to human mPB CD34+ cells electroporated with a single guide RNA under Arm conditions 1-3;

FIG. 27 shows the rate of DNA editing (% indels) at the BCL11a locus and HBG2 locus in human mPB CD34+ cells from Donor LKP06B successively electroporated with dual guide RNAs under Arm conditions 1-3 compared to human mPB CD34+ cells from Donor LKP06B electroporated with a single guide RNA under Arm conditions 1-3;

FIG. 28A shows the differentiation of human mPB CD34+ cells successively electroporated with dual guide RNAs under Arm conditions 1-3 compared to human mPB CD34+ cells electroporated with a single guide RNA under Arm conditions 1-3. Differentiation was determined by measuring the percentage of GYPA, and CD71;

FIG. 28B shows the differentiation of human mPB CD34+ cells successively electroporated with dual guide RNAs under Arm conditions 1-3 compared to human mPB CD34+ cells electroporated with a single guide RNA under Arm conditions 1-3. Differentiation was determined by measuring the percentage of Band3 and Alpha4;

Figure 31:
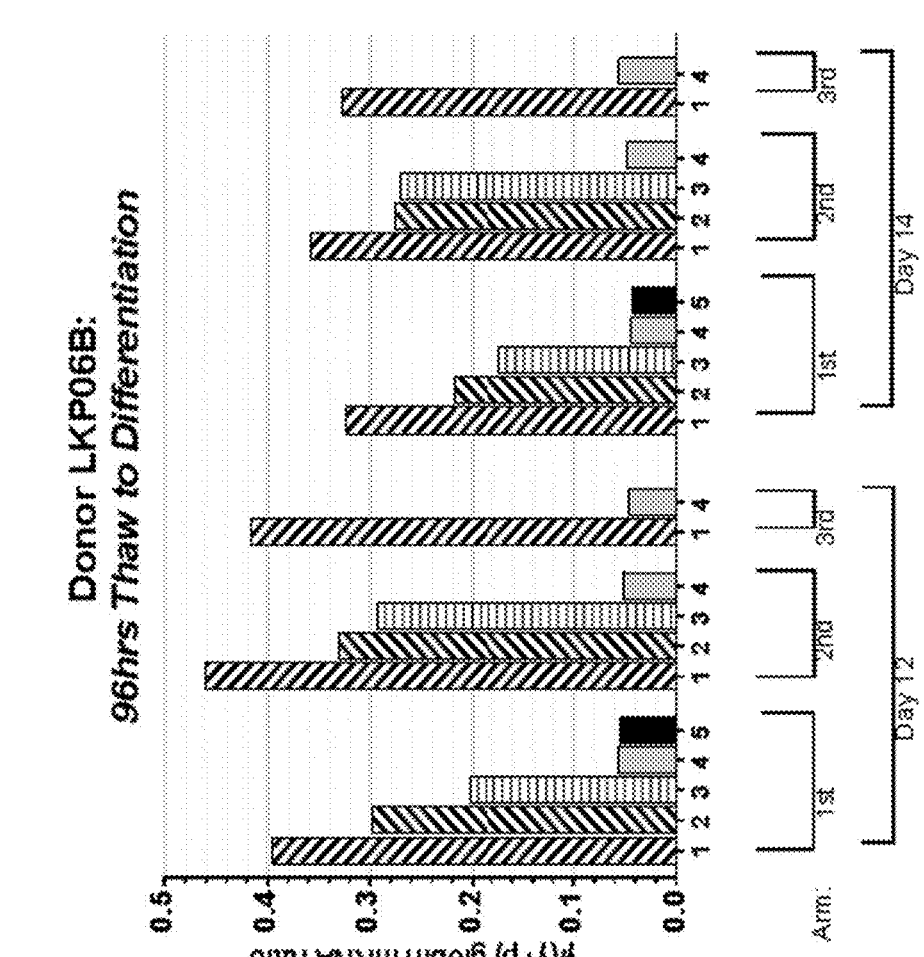
Figure 32:
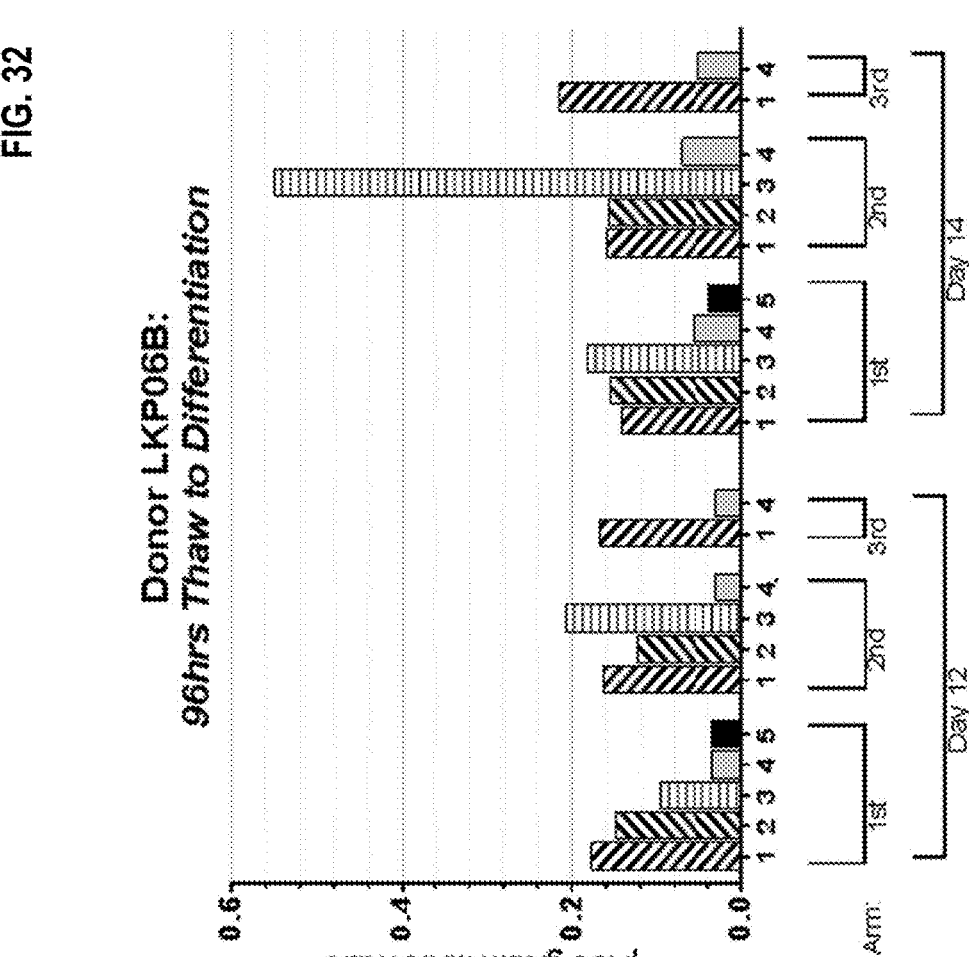
Figure 33A:
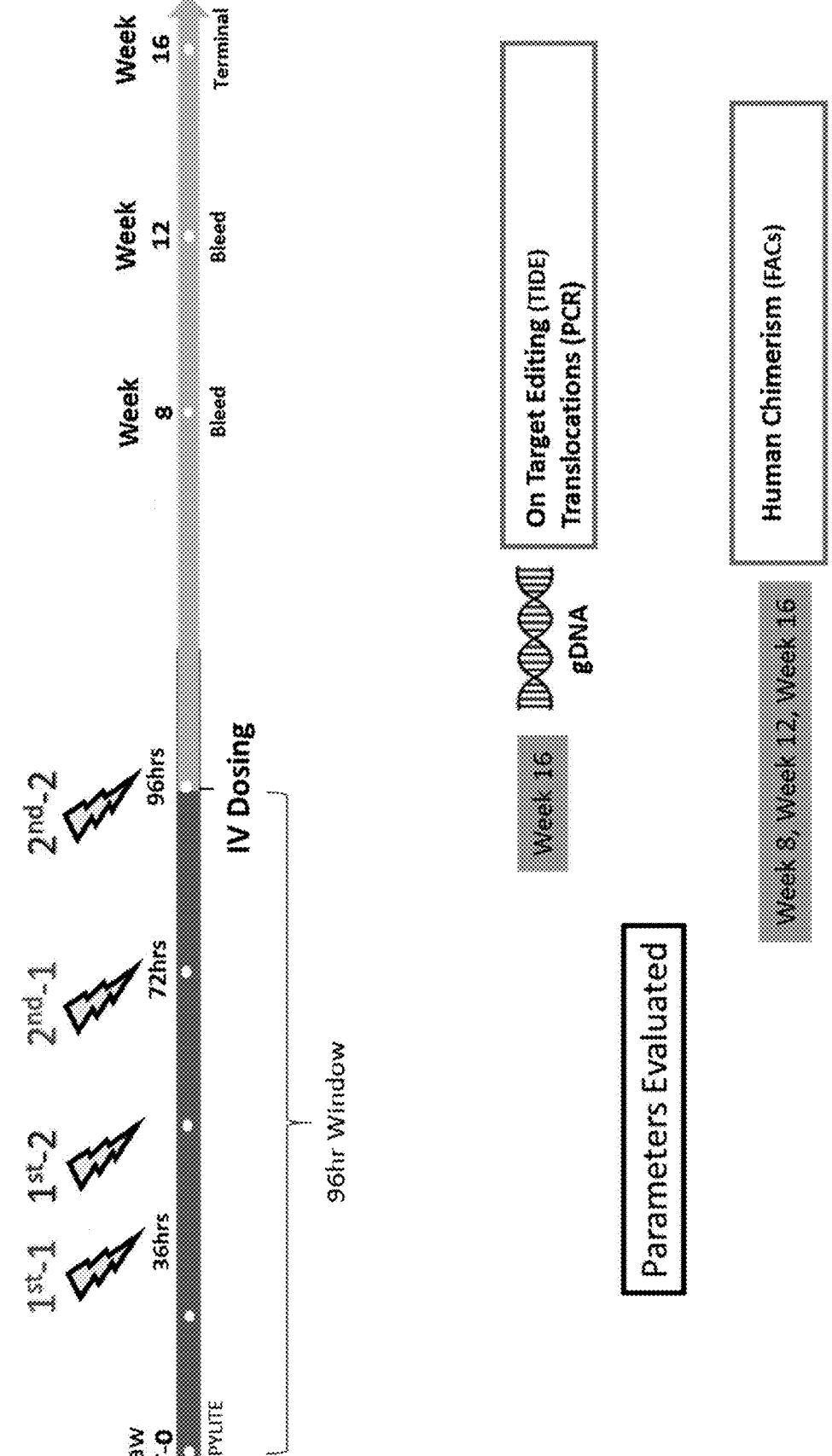
Figure 35:
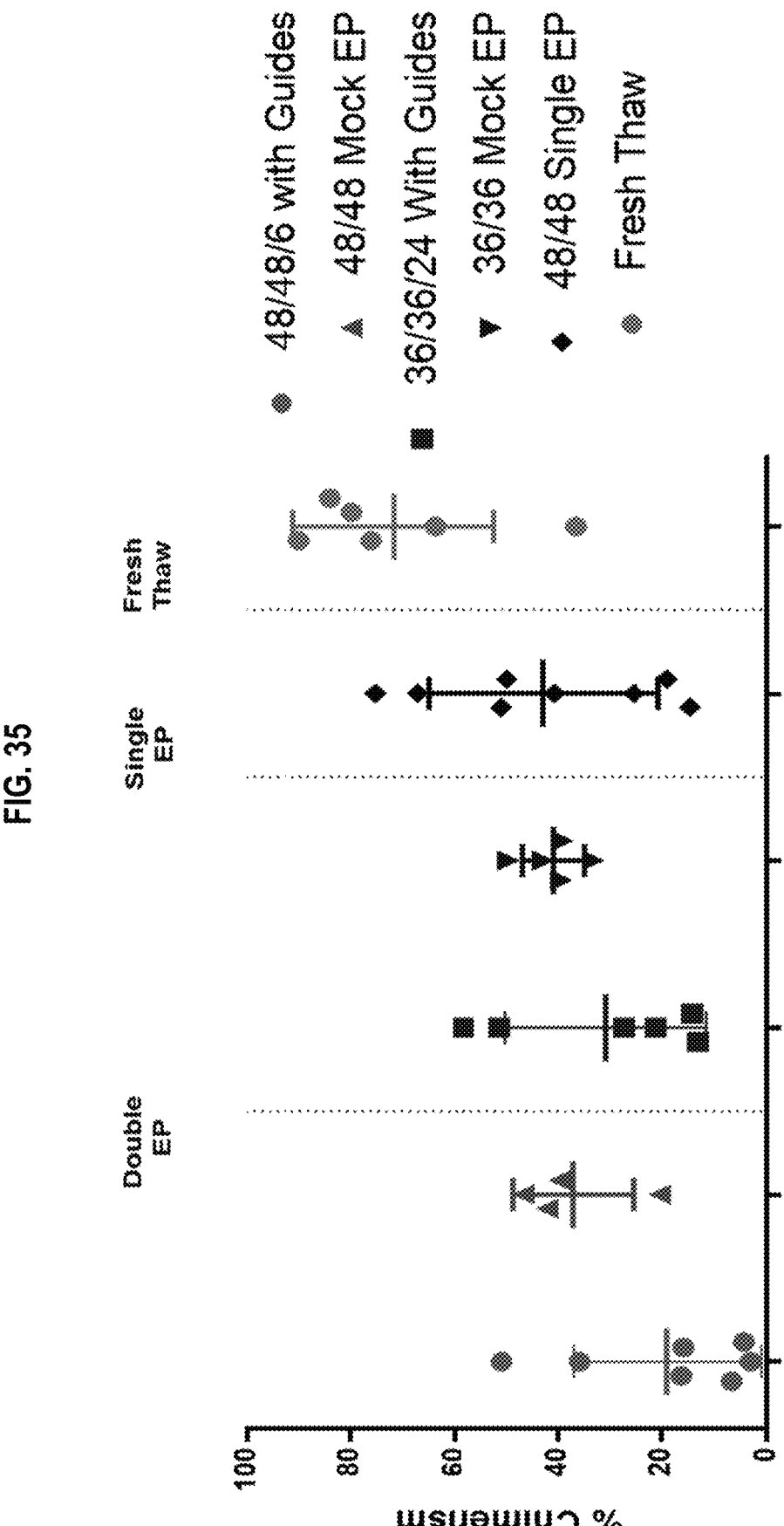
Figure 39:
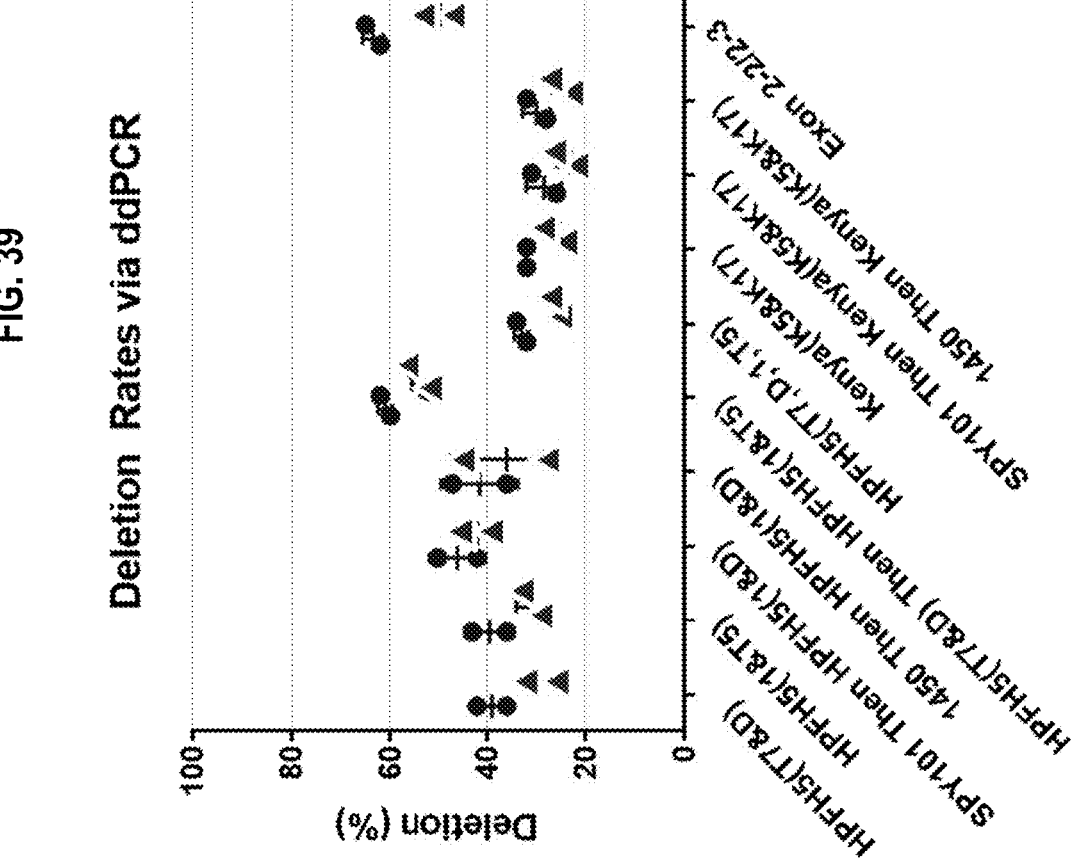
Figure 40:
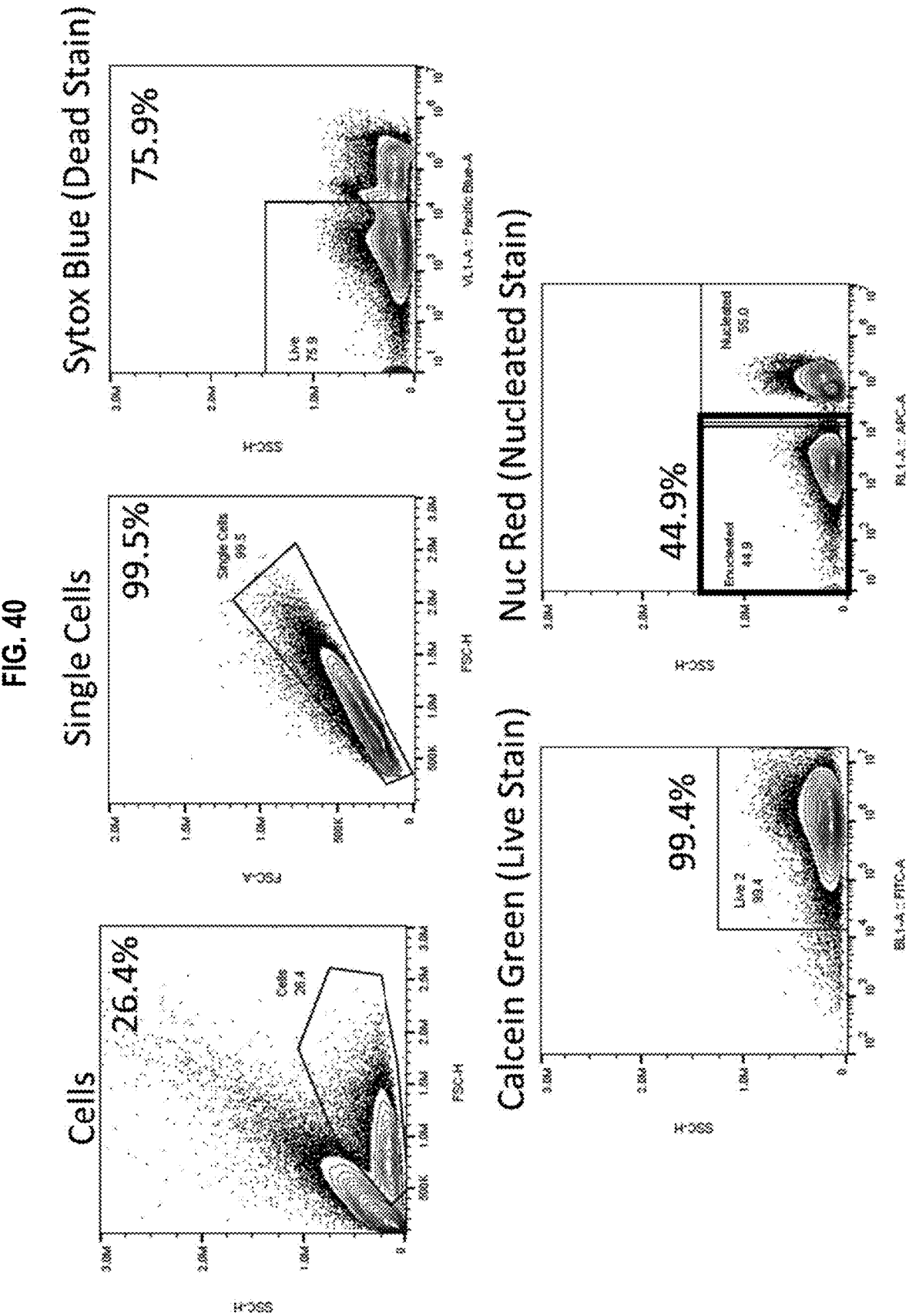

FIG. 31 shows the globin mRNA ratio in human mPB CD34+ cells from Donor LKP06B successively electroporated with dual guide RNAs under Arm conditions 1-3 compared to human mPB CD34+ cells from Donor LKP06B electroporated with a single guide RNA under Arm conditions 1-3;

FIG. 32 shows the γ/18S globin mRNA ratio in human mPB CD34+ cells from Donor LKP06B successively electroporated with dual guide RNAs under Arm conditions 1-3 compared to human mPB CD34+ cells from Donor LKP06B electroporated with a single guide RNA under Arm conditions 1-3;

FIGS. 33A-33B show an experimental design that includes successive electroporations using dual guide RNAs in a NSG mouse model system;

FIG. 33A shows the gene editing and transplantation schedules;

FIG. 33B shows a table of different experimental groups;

FIG. 34 shows human chimerism in peripheral blood samples of mice over a period of 16 weeks after gene editing and transplantation. Mice transplanted with cells edited using a successive electroporation method (e.g., 48/48/6 group with guides, e.g., first electroporation at hour 48, second electroporation at hour 96, transplantation at hour 102) show a reduction in % chimerism relative to the Mock EP group;

FIG. 35 shows human chimerism in bone marrow samples of mice at 16 weeks after gene editing and transplantation. Mice transplanted with cells edited using a successive electroporation method (e.g., 48/48/6 group with guides, e.g., first electroporation at hour 48, second electroporation at hour 96, transplantation at hour 102) show a reduction in % chimerism relative to the Mock EP group;

FIG. 36 shows genomic DNA analysis of bone marrow 16 weeks post transplant. Mice in the 48/48/6 group with guides, e.g., first electroporation at hour 48, second electroporation at hour 96, transplantation at hour 102, show high % indels;

FIG. 37 shows an experimental design that utilizes successive electroporations using dual guide RNAs to edit Chr2 and Chr11 in human mPB CD34+ cells from Donor LP06a and Donor LKP12;

FIG. 38 shows a table of experimental conditions that utilized successive electroporations using dual guide RNAs to edit Chr2 and Chr11 in human mPB CD34+ cells from Donor LP06a and Donor LKP12. Successive electroporation conditions provided increased HbF expression relative to single electroporation conditions;

FIG. 39 shows deletion rates (%) in experimental conditions that utilized successive electroporations using dual guide RNAs to edit Chr2 and Chr11 in human mPB CD34+ cells from Donor LP06a and Donor LKP12;

FIG. 40 shows an enucleation gating strategy of human mPB CD34+ cells from Donor LP06a and Donor LKP12 that had been successively electroporated with dual guide RNAs;

FIG. 41 shows enucleation over time for human mPB CD34+ cells from Donor LP06a and Donor LKP12 that had been edited using successive electroporations using dual guide RNAs to edit Chr2 and Chr11. The bars for each day of differentiation show, from left to right, SPY101 then HPFH5 (1&D), 1450 then HPFH5 (1&D), SPY101 then Kenya (K5&K17), 1450 then Kenya (K5&K17), HPFH5 (T7&D) then HPFH5 (1&T5), SPY101, 1450, HPFH5

Figure 42A:
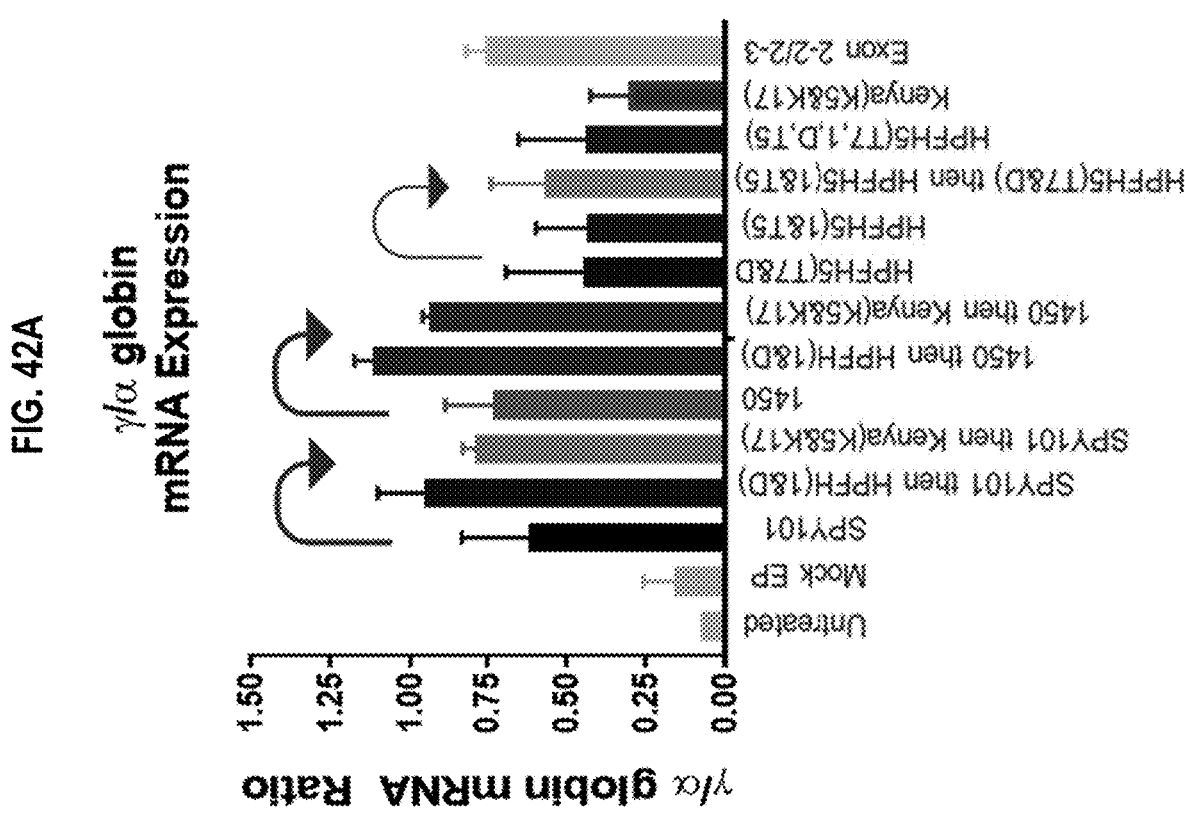
Figure 42C:
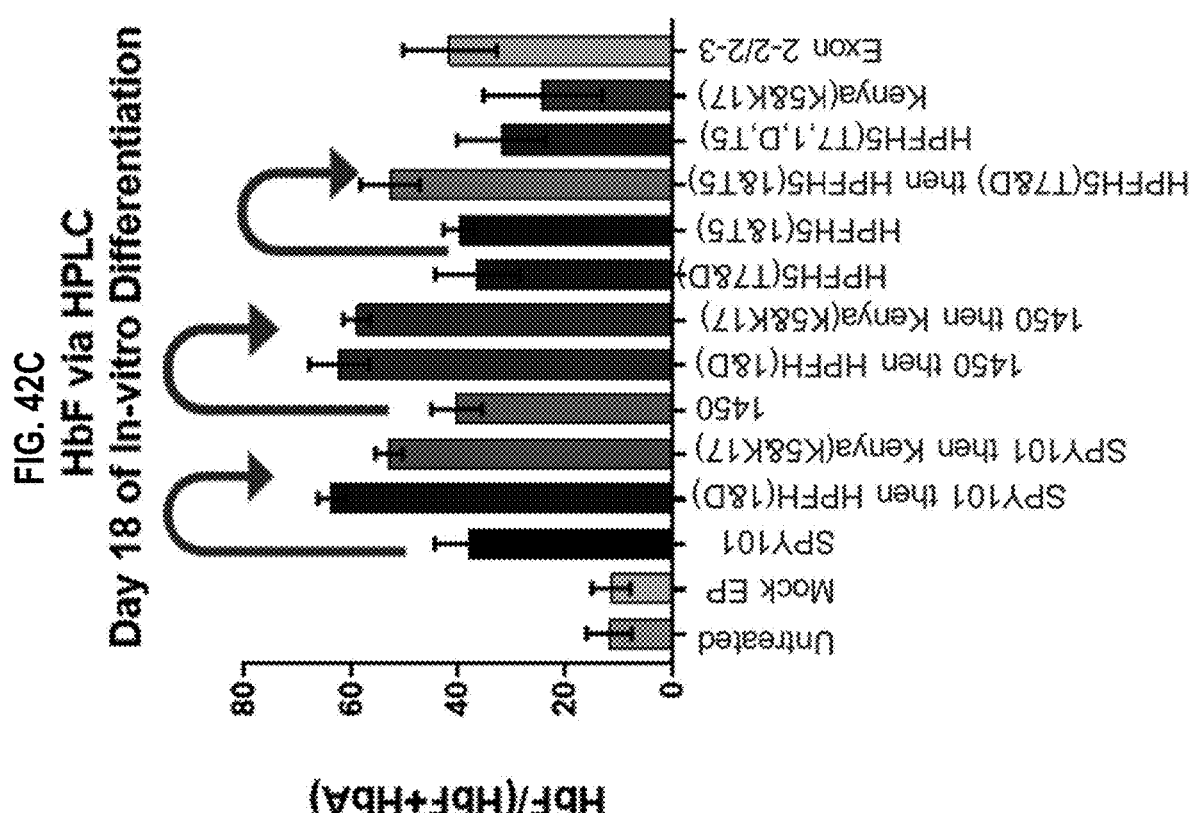
Figure 48:
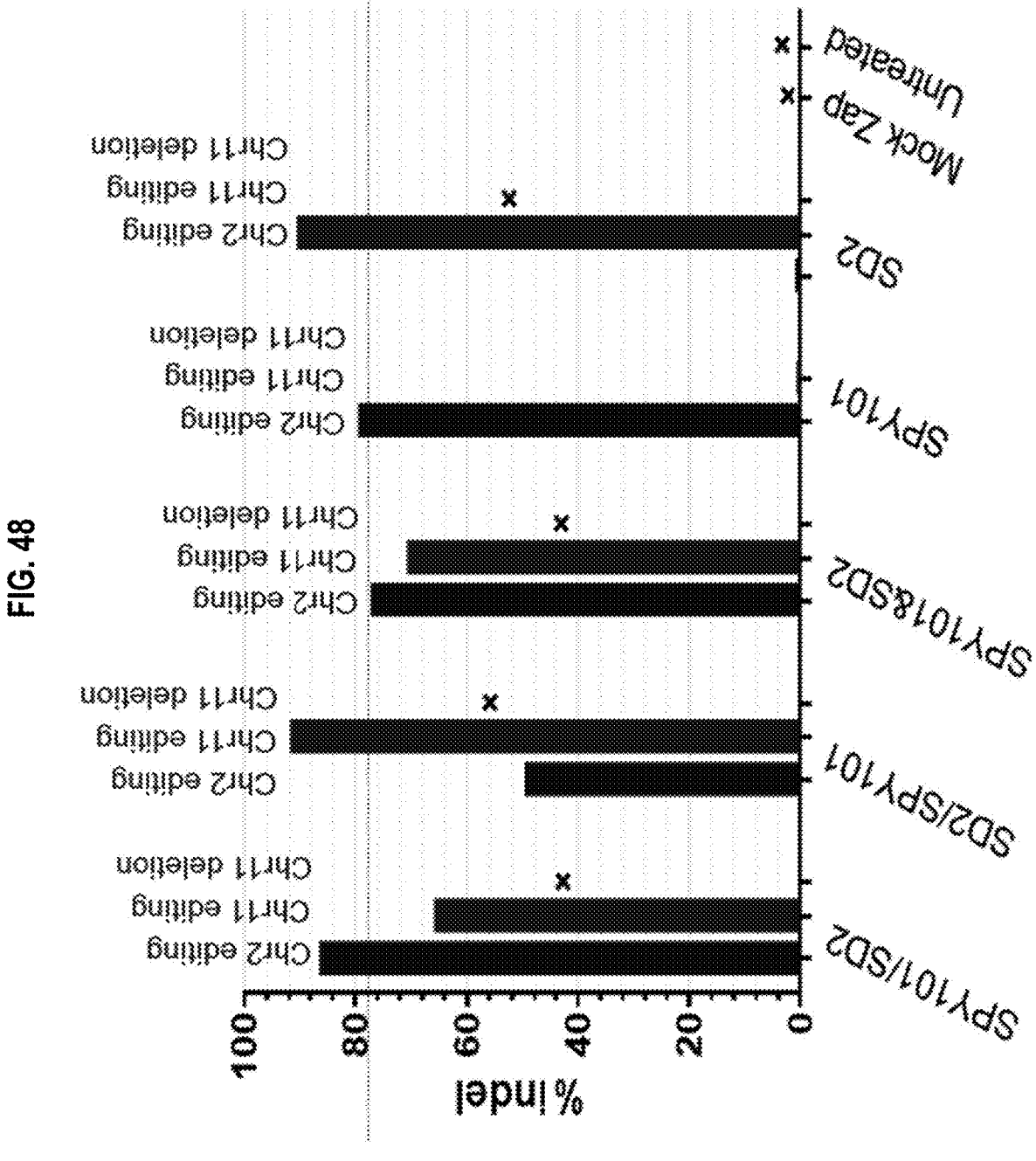
Figure 52:
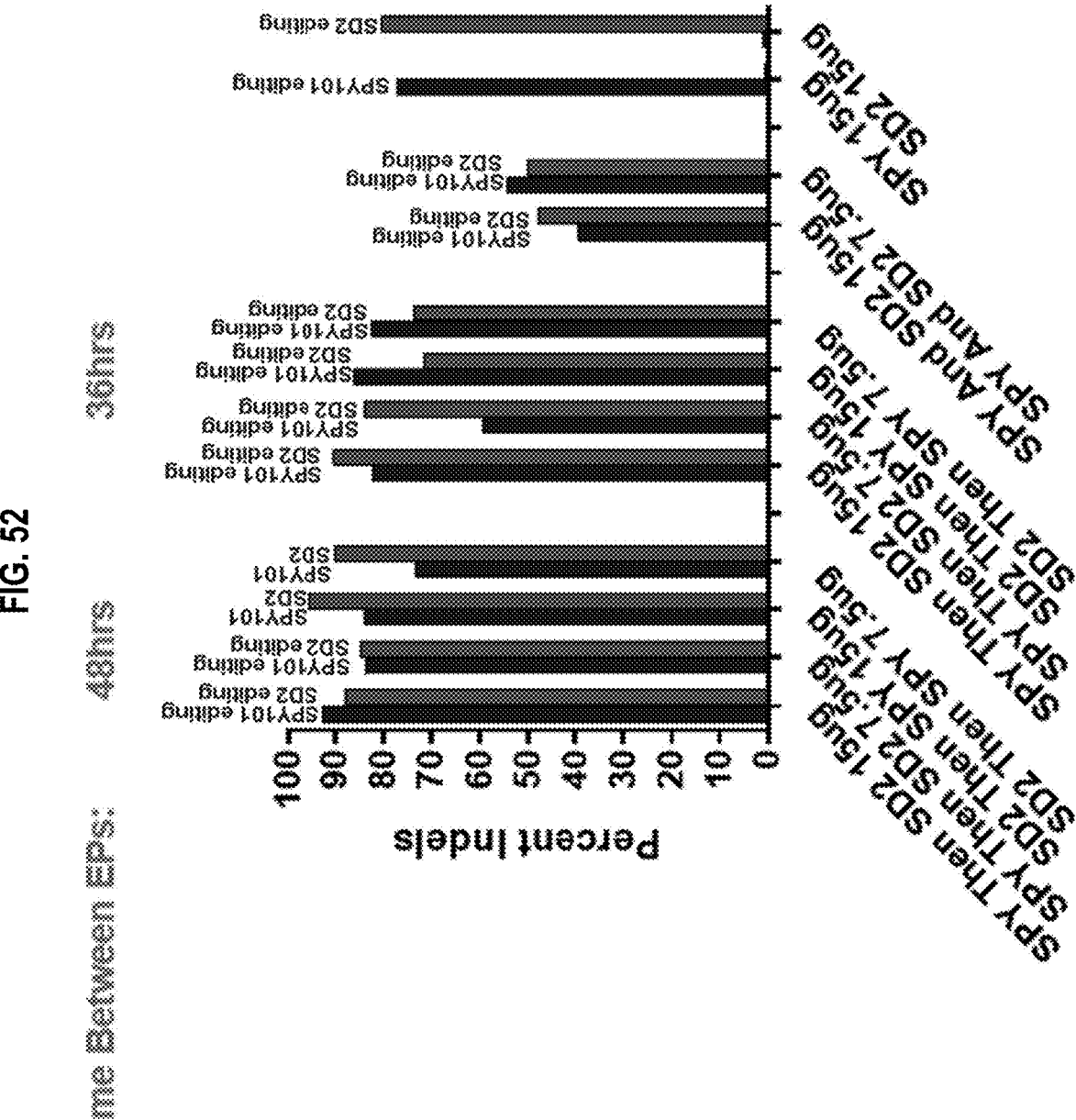
Figure 53A:
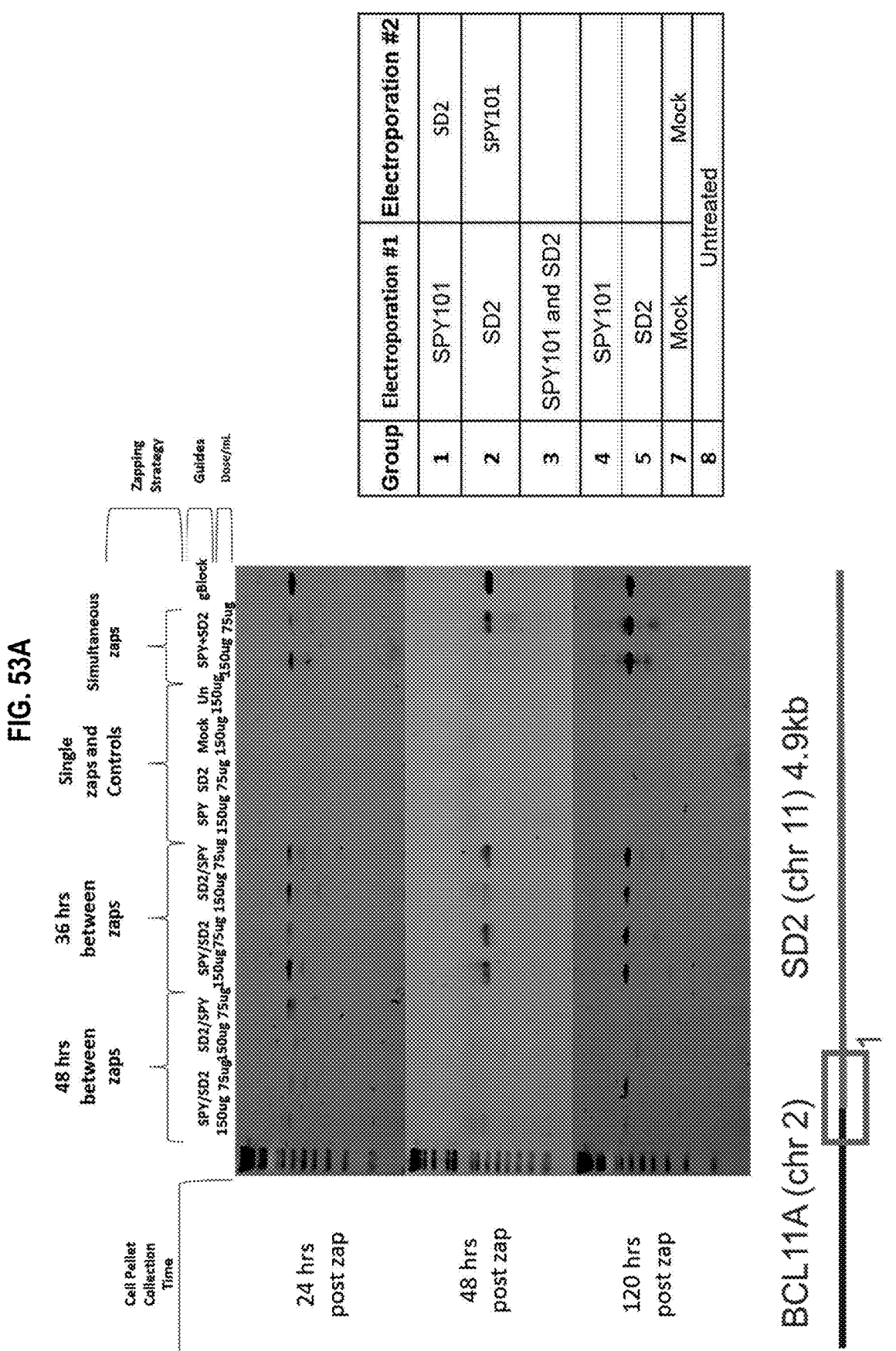
Figure 53B:
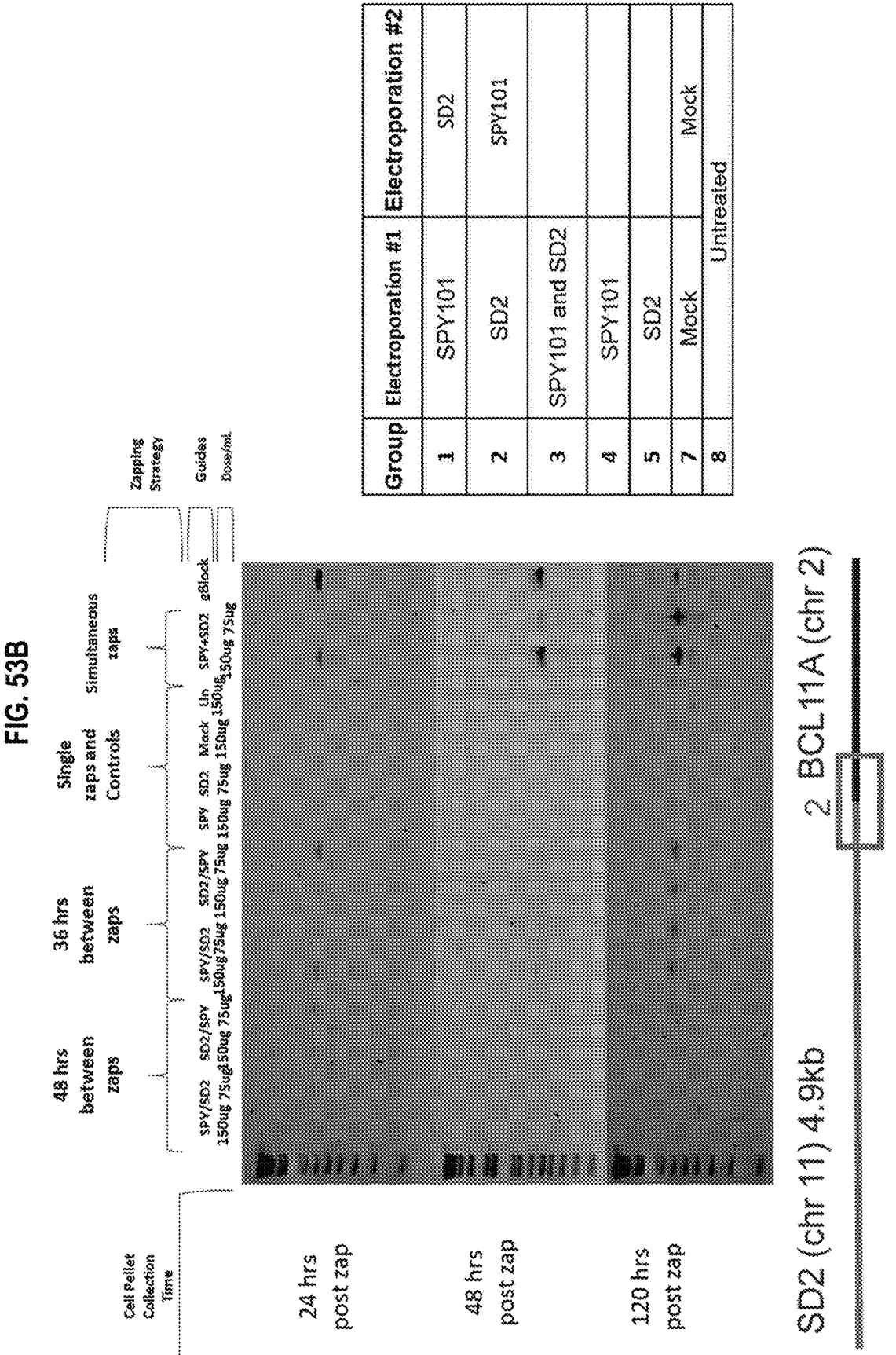
Figure 53C:
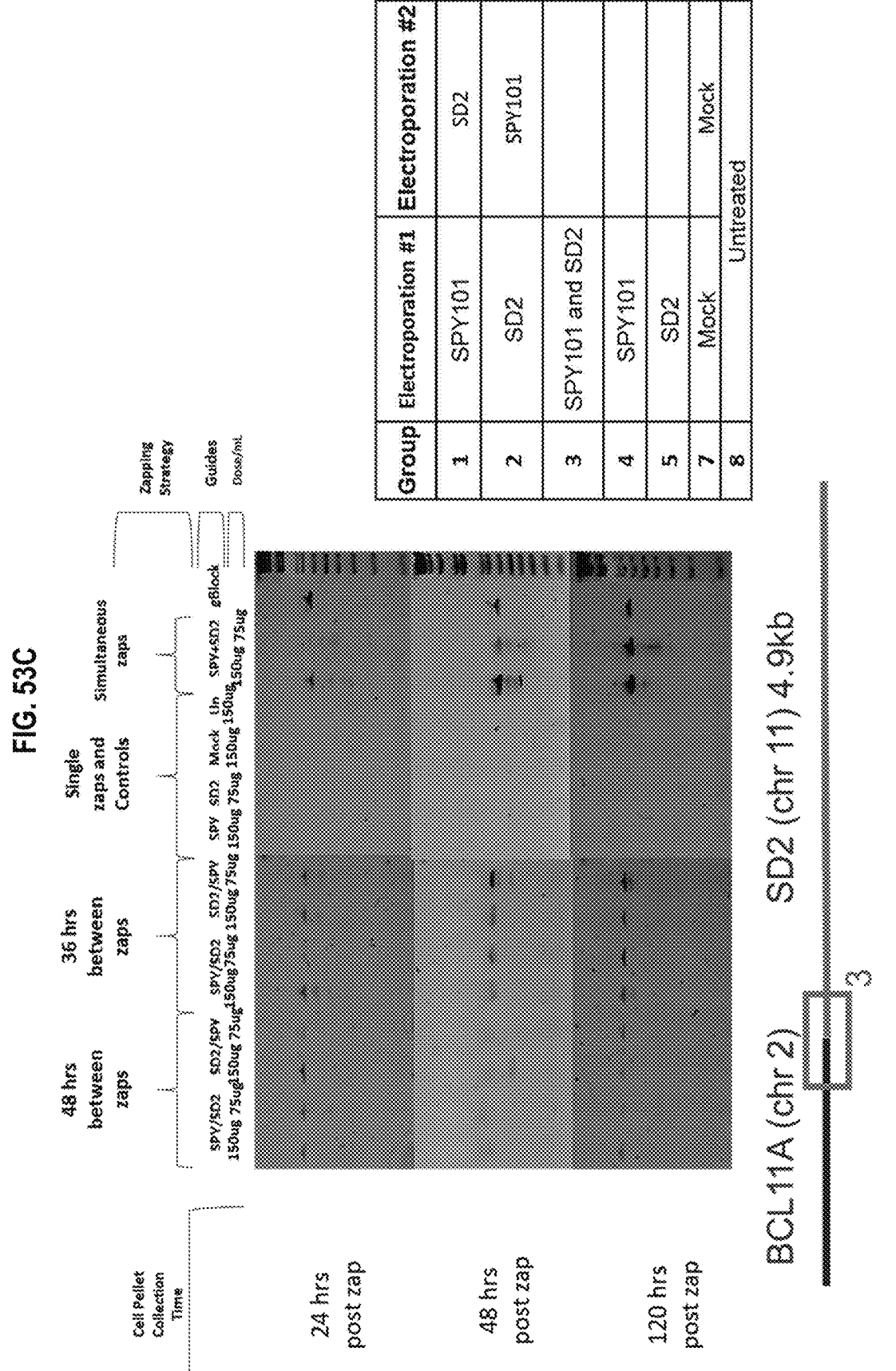
Figure 54:
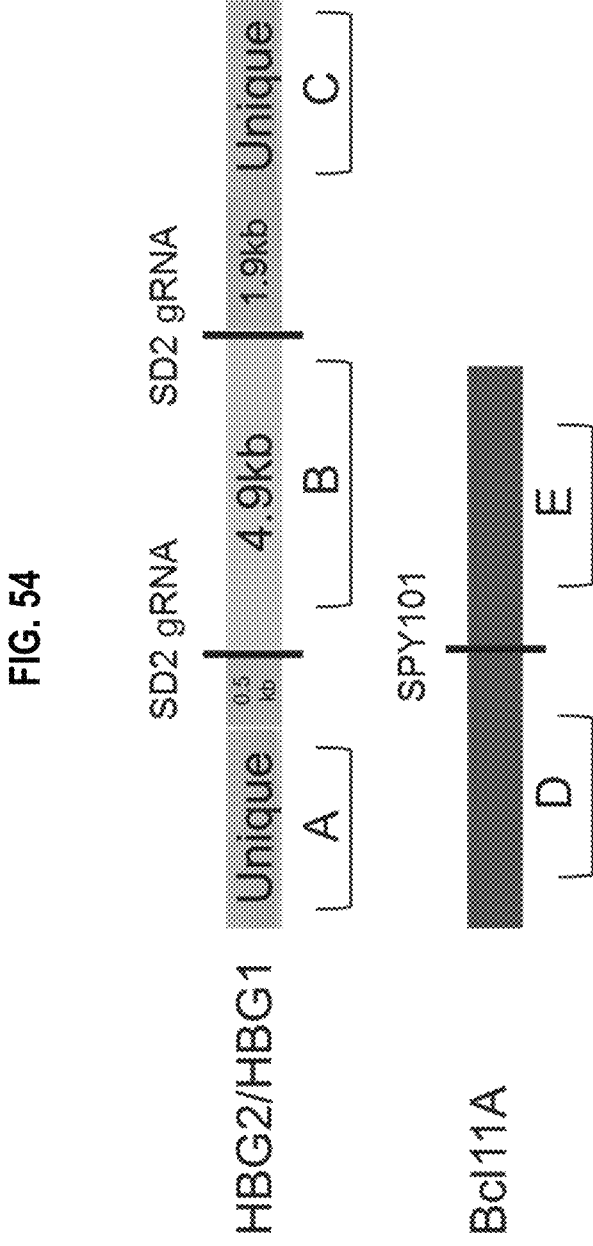
Figure 56B:
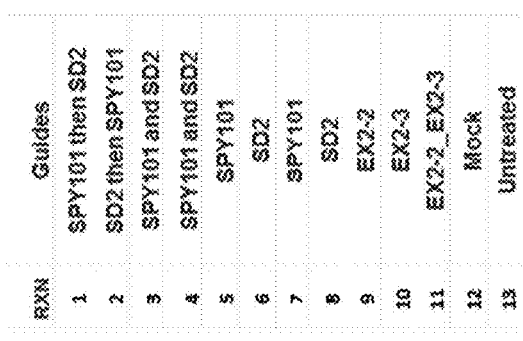
Figure 56C:
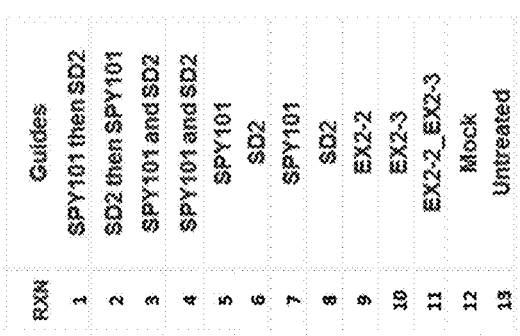

(T7&D), HPFH5 (1&T5), HPFH5 (T7,D,1,T5), Kenya (K5&K17), Exon2-2/2-3, Mock EP, and Untreated CD34 cells. There was minimal difference between cells that had been singly or doubly electroporated;

Figure 42B:
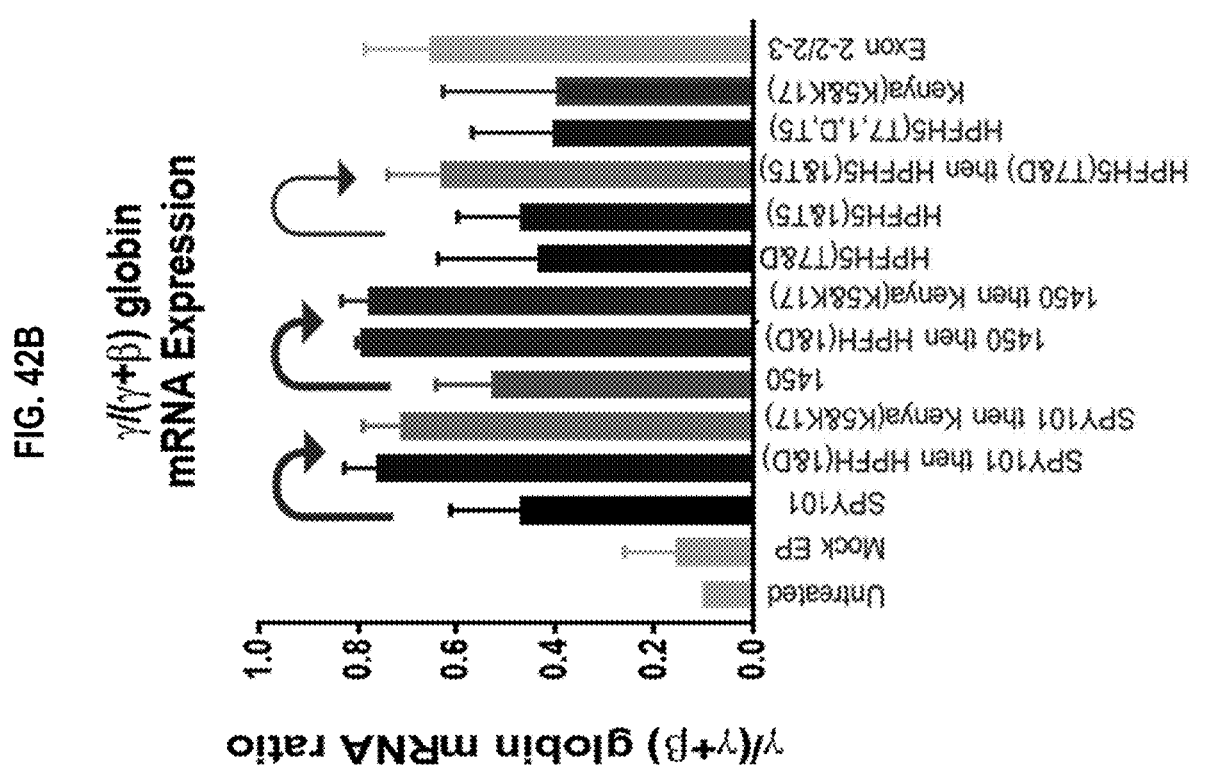

FIGS. 42A-42C show levels of globin expression in human mPB CD34+ cells from Donor LP06a and Donor LKP12 that had been edited using successive electroporations using dual guide RNAs to edit Chr2 and Chr11;

FIG. 42A shows mRNA transcript ratios for (γ globin)/(α globin);

FIG. 42B shows mRNA transcript ratios for (γ globin)/(γ globin+β globin);

FIG. 42C shows protein levels of HbF relative to (HbF+ HbA). Cells that had undergone double electroporated had a higher relative amount of HbF that cells that had undergone single electroporation;

Figure 43:
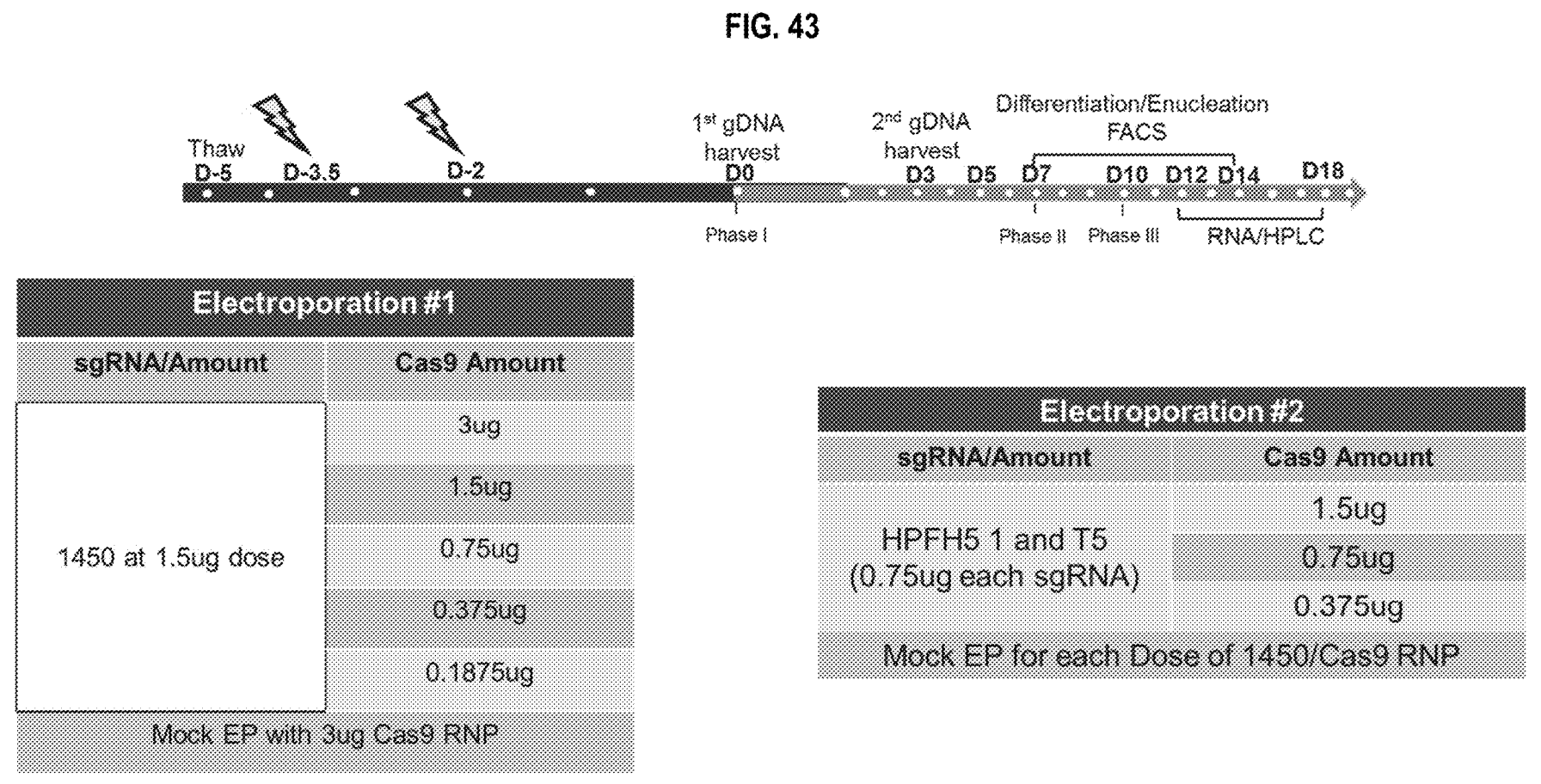

FIG. 43 shows an experimental design that utilizes varying amounts of Cas9 endonuclease during successive electroporations using dual guide RNAs to edit Chr2 and Chr11 in human mPB CD34+ cells;

FIG. 44 show percent gene editing at Chr2 and Chr11 in human mPB CD34+ cells after successive electroporations utilizing 1450 gRNA and HPFH5 gRNA. The amount of Cas9 endonuclease during the first electroporation was varied. Levels of gene editing were consistent for experiments using 0.375-3 µg Cas9;

FIG. 45 show mRNA transcript ratios for (γ globin)/(α globin) and (γ globin)/(γ globin+β globin) in human mPB CD34+ cells after successive electroporations utilizing 1450 gRNA and HPFH5 gRNA in human mPB CD34+ cells. The amount of Cas9 endonuclease during the first electroporation was varied. Levels of mRNA transcripts were consistent for experiments using 0.75-3 µg Cas9;

FIG. 46 show HbF percentages in human mPB CD34+ cells after successive electroporations utilizing 1450 gRNA and HPFH5 gRNA. The amount of Cas9 endonuclease during the first electroporation was varied. Levels of % HbF were consistent for experiments using 0.375-3 µg Cas9;

FIG. 47 shows an experimental design to compare single electroporation with one guide RNA, single electroporation with two guide RNAs, and successive electroporations with two guide RNAs to edit Chr2 and Chr11 in human mPB CD34+ cells;

FIG. 48 shows percent indels in human mPB CD34+ cells from Fred Hutch Donor 304 following gene editing. Cells that were successively electroporated with two guide RNAs (SPY101/SD2; SD2/SPY101) had comparable levels of percent indels relative to control experiments;

FIG. 49 shows three potential translocations, including points of fusion, that may occur when targeting Chr2 and Chr11 in cells with gRNAs specific for BCL11A and the site of SD2 targeting. Note that Fusion 3 represents a SD2-induced inversion;

FIG. 50 show nucleic acid agarose gels demonstrating that translocation events (fusions) that may occur when targeting Chr2 and Chr11 in cells are minimized when performing successive electroporation with two gRNAs (SPY101 then SD2; SD2 then SPY101) compared to simultaneous electroporation with two gRNAs (SPY101 AND SD2);

FIG. 51 shows an experimental design to compare single electroporation with one guide RNA, single electroporation with two guide RNAs, and successive electroporations with two guide RNAs to edit Chr2 and Chr11 in human mPB CD34+ cells;

FIG. 52 shows percent indels in human mPB CD34+ cells from Fred Hutch Donor 304 following gene editing. Cells that were successively electroporated with two guide RNAs (SPY101 Then SD2; SD2 Then SPY101) with a 48 hour period between electroporations had higher levels of percent indels than cells successively electroporated with a 36 hour period between electroporations;

FIGS. 53A-53C show nucleic acid agarose gels demonstrating that translocation events (fusions) that may occur when targeting Chr2 and Chr11 in cells are minimized when performing successive electroporation with two gRNAs (SPY101 then SD2; SD2 then SPY101) with a 48 hour period between electroporations compared a 36 hour period between electroporations;

FIG. 53A shows data corresponding to a translocation fusion 1 event;

FIG. 53B shows data corresponding to a translocation fusion 2 event;

FIG. 53A shows data corresponding to a translocation fusion 3 event (SD2-induced inversion);

FIG. 54 shows a ddPCR assay for determination of chromosomal translocations following gene editing with SD2 and SPY101 gRNAs;

FIG. 55 shows a table of ddPCR data demonstrating that single electroporation with two gRNAs (SPY101 And SD2) leads to increased translocation events compared to successive electroporation with two gRNAs (e.g., SPY101 Then SD2);

FIGS. 56A-56C show effects of single electroporation with one guide RNA, single electroporation with two guide RNAs, and successive electroporations with two guide RNAs to edit Chr2 and Chr11 in human mPB CD34+ cells;

FIG. 56A shows mRNA transcript ratios for (γ globin)/ (18S globin);

FIG. 56B shows mRNA transcript ratios for (γ globin)/(α globin);

FIG. 56C shows mRNA transcript ratios for (γ globin)/(γ globin+β globin).

BRIEF DESCRIPTION OF THE SEQUENCE LISTING

SEQ ID NOs: 1-56,961 is a list of gRNA 20 bp spacer sequences, associated PAM, chromosomal and gene location of the target sequence, cut site, and strand for targeting the human beta globin locus with a *S. pyogenes* Cas9 endonuclease.

SEQ ID NOs: 56,962-64,104 is a list of gRNA 20 bp spacer sequences, associated PAM, chromosomal and gene location of the target sequence, cut site, and strand for targeting the human beta globin locus with a *S. aureus* Cas9 endonuclease.

SEQ ID NOs: 64,105-66,258 is a list of gRNA 24 bp spacer sequences, associated PAM, chromosomal and gene location of the target, cut site, and strand for targeting the human beta globin locus with a *N. meningitides* Cas9 endonuclease.

SEQ ID NOs: 66,259-69, 152 is a list of gRNA 24 bp spacer sequences, associated PAM, chromosomal and gene location of the target, cut site, and strand for targeting the human beta globin locus with a *S. thermophilus* Cas9 endonuclease.

SEQ ID NOs: 69,153-70,300 is a list of gRNA 24 bp spacer sequences, associated PAM, chromosomal and gene location of the target, cut site, and strand for targeting the human beta globin locus with a *T. denticola* Cas9 endonuclease.

SEQ ID NOs: 70,301-156,352 is a list of gRNA 22 bp spacer sequences, associated PAM, chromosomal and gene location of the target, two cut sites, and strand for targeting the human beta globin locus with an *Acidominococcus*, a Lachnospiraceae, and a *Franciscella novicida* Cpf1 endonuclease.

SEQ ID NOs: 156,353-185,834 is a list of gRNA 20 bp spacer sequences, associated PAM, chromosomal and gene location of the target sequence, cut site, and strand for targeting within or near a BCL11A gene or a DNA sequence that encodes a regulatory element of the BCL11A gene with a *S. pyogenes* Cas9 endonuclease.

SEQ ID NOs: 185,835-188,739 is a list of gRNA 20 bp spacer sequences, associated PAM, chromosomal and gene location of the target sequence, cut site, and strand for targeting within or near a BCL11A gene or a DNA sequence that encodes a regulatory element of the BCL11A gene with a *S. aureus* Cas9 endonuclease.

SEQ ID NOs: 188,740-189,772 is a list of gRNA 24 bp spacer sequences, associated PAM, chromosomal and gene location of the target, cut site, and strand for targeting within or near a BCL11A gene or a DNA sequence that encodes a regulatory element of the BCL11A gene with a *S. thermophilus* Cas9 endonuclease.

SEQ ID NOs: 189,773-190,203 is a list of gRNA 24 bp spacer sequences, associated PAM, chromosomal and gene location of the target, cut site, and strand for targeting within or near a BCL11A gene or a DNA sequence that encodes a regulatory element of the BCL11A gene with a *T. denticola* Cas9 endonuclease.

SEQ ID NOs: 190,204-193,083 is a list of gRNA 24 bp spacer sequences, associated PAM, chromosomal and gene location of the target, cut site, and strand for targeting within or near a BCL11A gene or a DNA sequence that encodes a regulatory element of the BCL11A gene with a *N. meningitides* Cas9 endonuclease.

SEQ ID NOs: 193,084-228,299 is a list of gRNA 22 bp spacer sequences, associated PAM, chromosomal and gene location of the target, two cut sites, and strand for targeting within or near a BCL11A gene or a DNA sequence that encodes a regulatory element of the BCL11A gene with an *Acidominococcus*, a Lachnospiraceae, and a *Franciscella novicida* Cpf1 endonuclease.

SEQ ID NO: 228,300 shows a known family of homing endonuclease, as classified by its structure.

SEQ ID NO: 228,301 is a sample guide RNA (gRNA) for a *S. pyogenes* Cas9 endonuclease.

SEQ ID NOs: 228,302-228,304 show sample sgRNA sequences.

DETAILED DESCRIPTION

Hemoglobinopathies

As used herein, the term "hemoglobinopathy" means any defect in the structure, function or expression of any hemoglobin of an individual, and includes defects in the primary, secondary, tertiary or quaternary structure of hemoglobin caused by any mutation, such as deletion mutations or substitution mutations in the coding regions of the β-globin gene, or mutations in, or deletions of, the promoters or enhancers of such genes that cause a reduction in the amount of hemoglobin produced as compared to a normal or standard condition. The term "hemoglobinopathy" further includes any decrease in the amount or effectiveness of hemoglobin, whether normal or abnormal, caused by external factors such as disease, chemotherapy, toxins, poisons, or the like. β-hemoglobinopathies contemplated herein include, but are not limited to, sickle cell disease (SCD, also referred to a sickle cell anemia or SCA), sickle cell trait, hemoglobin C disease, hemoglobin C trait, hemoglobin S/C disease, hemoglobin D disease, hemoglobin E disease, thalassemias, hemoglobins with increased oxygen affinity, hemoglobins with decreased oxygen affinity, unstable hemoglobin disease and methemoglobinemia.

Disorders specifically associated with the β-globin protein are referred to generally as β-hemoglobinopathies. For example, β-thalassemias result from a partial or complete defect in the expression of the β-globin gene, leading to deficient or absent hemoglobin A (HbA). HbA is the most common human hemoglobin tetramer and consists of two α-chains and two β-chains ($\alpha_2\beta_2$). β-thalassemias are due to mutations in the adult β-globin gene (HBB) on chromosome 11, and are inherited in an autosomal, recessive fashion. β-thalassemia or β-thal is classified into two clinically-significant types (which are a focus of symptom management, medical treatments and the present application) that are distinguished by the severity of symptoms: β-thalassemia major (or $\beta^0$, in which mutations block production of β-globin chains, resulting in a severe condition that is also known as "Cooley's anemia") and β-thalassemia intermedia (or $\beta^+$, an intermediate condition in which mutations reduce but do not block production of β-globin chains). In contrast, β-thalassemia minor or β-thalassemia trait refers to the heterozygous situation in which only one of the β-globin alleles contains a mutation, so that β-globin chains can be produced via expression from the other (i.e. unmutated) chromosome 11 allele. While such individuals are carriers of a β-thalassemia mutant allele that they may pass on to their children, individuals with β-thalassemia minor are generally either asymptomatic or nearly asymptomatic themselves as a result of β-globin production from the unaffected allele.

The signs and symptoms of thalassemia major generally appear within the first 2 years of life, when children with the disease can develop life-threatening anemia. Children with thalassemia major often fail to gain sufficient weight or grow at the expected rate (failure to thrive) and may develop jaundice. Affected individuals may also have an enlarged spleen, liver, and heart, and their bones may be misshapen. Many people with thalassemia major have such severe symptoms that they need frequent blood transfusions to replenish their red blood cell supply, which is referred to as transfusion-dependent thalassemia. While transfusions have been a critical life-saver for many patients, they are expensive and are frequently associated with significant side effects. Among others, over time the administration of iron-containing hemoglobin from chronic blood transfusions tends to lead to a buildup of iron in the body, which can result in liver, heart, and endocrine problems.

Thalassemia intermedia is milder than thalassemia major. The signs and symptoms of thalassemia intermedia appear in early childhood or later in life. Although symptoms are less severe, affected individuals still have mild to moderate anemia and may also suffer from slow growth and bone abnormalities.

Sickle cell disease (SCD) is a group of disorders that affects millions of people worldwide. It is most common among people who live in or whose ancestors come from Africa; Mediterranean countries such as Greece, Turkey, and Italy; the Arabian Peninsula; India; Spanish-speaking regions in Central and South America, and parts of the Caribbean. However, SCD is also the most common inherited blood disorder in the United States. SCD includes sickle cell anemia, as well as sickle hemoglobin C disease (HbSC), sickle beta-plus-thalassemia (HbS/$\beta^+$) and sickle beta-zero-thalassemia (HbS/$\beta^0$).

Sickle cell anemia (SCA), which is the most prevalent form of SCD, is among the most common severe monogenic disorders worldwide, with approximately 250,000 children born with SCD every year. The incidence of SCA is greatest in West and Central Africa, where 1-2% of babies are born with the disease, and as many as 25% of people are heterozygous carriers. The SCA point mutation is believed to have been spread through selective advantage because heterozygosity provides modest protection against death from childhood malaria. In India, where malaria is also prevalent, it is estimated that there are more than 2.5 million heterozygous carriers of SCA and approximately 150,000 homozygotes with the disease.

Despite the relative absence of malaria in North America and Europe, the fact that each has large populations with genetic origins in affected areas has meant that both regions have substantial populations of heterozygous SCA carriers, and therefore affected homozygous individuals. For example, the U.S. Centers for Disease Control (CDC) estimates that there are approximately 90,000 to 100,000 Americans with SCA; and incidence is also high in countries of Western Europe, particularly those with large immigrant populations, with an estimated 10,000 in France and 12,000 to 15,000 in the United Kingdom for example. Associated costs to healthcare systems are likewise substantial. In a five-year U.S. study conducted from 1989 through 1993, the CDC estimated that SCD resulted in more than 75,000 hospitalizations annually, and cost approximately $0.5 billion. System wide costs would be expected to be substantially greater now given the steady rise in healthcare costs over the intervening two decades.

All forms of SCD are caused by mutations in the β-globin structural gene (HBB). Sickle cell anemia (SCA) is an autosomal recessive disease caused by a single missense mutation in the sixth codon of the β-globin gene (HBB; A→T) resulting in the substitution of glutamic acid by valine (Glu→Val). The mutant protein, when incorporated into hemoglobin (Hb), results in unstable hemoglobin HbS (which is $\alpha_2\beta_2^{\,S}$) in contrast to normal adult hemoglobin or HbA (which is $\alpha_2\beta_2^{\,A}$). Upon de-oxygenation, HbS polymerizes to form HbSS through hydrophobic interactions between $\beta^S$-6 valine of one tetramer and β-85 phenylalanine and β-88 leucine of an adjacent tetramer in the erythron, which leads to rigidity and vaso-occlusion [Atweh, *Semin. Hematol.* 38 (4): 367-73 (2001)].

When HbS is the predominant form of hemoglobin, as in individuals with SCA, their red blood cells (RBCs) tend to be distorted into a sickle or crescent shape. The sickle-shaped RBCs die prematurely, which can lead to anemia. In addition, the sickle-shaped cells are less flexible than normal RBCs and tend to get stuck in small blood vessels causing vaso-occlusive events. Such vaso-occlusive events are associated with tissue ischemia leading to acute and chronic pain as well as organ damage that can affect any organ in the body, including the bones, lungs, liver, kidneys, brain, eyes, and joints. The spleen is particularly subject to infarction and the majority of individuals with SCD are functionally asplenic in early childhood, increasing their risk for certain types of bacterial infections. Occlusions of small vessels can also cause acute episodic febrile illness called "crises," which are associated with severe pain and multiple organ dysfunction. Over the course of decades there is progressive organ disease and premature death.

Children with SCD may be diagnosed by newborn screening but otherwise do not present until later, when levels of fetal hemoglobin (HbF) decline and levels of HbS increase as a result of the hemoglobin allelic "switch" from fetal hemoglobin (encoded by HBG1 (A-gamma, also written $^A\gamma$) and HBG2 (G-gamma, also written $^G\gamma$)) to the adult β form encoded by HBB). The switch from HbF to the adult form of β-globin (i.e. HbA in unaffected children or HbS in those with SCA) typically begins a few months prior to birth and is complete by about the age of 6 months. The clinical effects of SCD are not manifested until HbF levels become significantly low relative to HbS, which typically occurs two to three months after birth. SCD often first presents as dactylitis or "hand-foot syndrome," a condition associated with pain in the hands and/or feet that may be accompanied by swelling. In addition, the spleen can become engorged with blood cells resulting in a condition known as "splenic sequestration." Hemolysis associated with SCD can result in anemia, jaundice, cholelithiasis, as well as delayed growth. Individuals with the highest rates of SCD hemolysis also tend to experience pulmonary artery hypertension, priapism, and leg ulcers.

Sickle cell anemia (homozygous HbSS) accounts for 60%-70% of sickle cell disease in the United States. The other forms of sickle cell disease result from coinheritance of HbS with other abnormal globin β chain variants, the most common forms being sickle-hemoglobin C disease (HbSC) and two types of sickle β-thalassemia (HbSβ+-thalassemia and HbSβ°-thalassemia). The β-thalassemias are divided into β°-thalassemia, in which reduced levels of normal β-globin chains are produced, and β°-thalassemia, in which there is no β-globin chain synthesis. Other globin β chain variants such as D-Punjab, O-Arab, and E also result in sickle cell disease when coinherited with HbS.

Although improvements in the management of SCD have reduced mortality in affected children followed up since neonatal screening, the mainstay of treatment for the majority of individuals with SCD remains supportive. Current treatments aim at relieving symptoms and treating complications such as: pain from vaso-occlusive crisis, infection, anemia, stroke, priapism, pulmonary hypertension or chronic organ damage. Preventative therapies include infection prophylaxis with regular penicillin, vaccination against *Streptococcus pneumoniae* and *Haemophilus influenzae*, as well as regular transfusions in children with abnormal transcranial Doppler ultrasonography to prevent strokes and iron chelation for transfusional iron overload. Stroke is also considered an indication for bone marrow transplantation in children and adolescents, who have siblings with identical human leukocyte antigen (HLA). Effective treatment of acute pain is one of the most common problems raised by the management of SCA. Thus, at the present time, definitive therapies that substantially alter the natural history of the disease (such as regular transfusion or exchange transfusion, long-term hydroxycarbamide and HSC transplants) are limited.

Fetal Hemoglobin (HbF)

Fetal hemoglobin (HbF) is a tetramer of two adult α-globin polypeptides and two fetal β-like γ-globin polypeptides. The γ-globin genes (HBG1 and HBG2) are normally expressed in the fetal liver, spleen and bone marrow. A tetramer of two γ-chains together with two α-chains constitute HbF. During gestation, the duplicated γ-globin genes constitute the predominant genes transcribed from the β-globin locus. Following birth, γ-globin becomes progressively replaced by adult β-globin, a process referred to as the "fetal switch." This developmental switch from production of predominantly HbF (α2γ2) to production of adult hemoglobin or HbA (α2β2) begins at about 28 to 34 weeks of gestation and continues shortly after birth at which point HbA becomes predominant. The switch results primarily from decreased transcription of the γ-globin genes and increased transcription of β-globin genes. On average, the blood of a normal adult contains only about 2% of total hemoglobin in the form of HbF, though residual HbF levels have a variance of over 20 fold in healthy adults (Atweh, Semin. Hematol. 38 (4): 367-73 (2001)). The two types of γ-chains differ at residue 136 where glycine is found in the G-γ-product (HBG2) and alanine is found in the A-γ-product (HBG1). The HBG1 hemoglobin gene ($^A$γ or A-gamma [*Homo sapiens* (human)] Gene ID: 3047), was updated on 16 Apr. 2014 (www dot ncbi dot nlm dot nih dot gov/gene/3047).

Many of the forms of hemoglobinopathies are a result of the failure to produce normal β-globin protein in sufficient amounts or failure to produce normal β-globin protein entirely. Increased expression of γ-globin (i.e., HbF) will ameliorate β-globin disease severity.

The potential for addressing β-hemoglobinopathies by increasing levels of fetal hemoglobin ($\alpha_2\gamma_2$; HbF) is supported by observations of the mild phenotype of individuals who have co-inherited homozygous β-thalassemia and hereditary persistence of fetal hemoglobin (HPFH), as well as by those patients with homozygous β-thalassemia who synthesize no adult hemoglobin, but in whom a reduced requirement for transfusions is observed in the presence of increased concentrations of HbF. Additional support comes from the observation that certain populations of adult patients with β chain abnormalities have higher than normal levels of HbF, and have been observed to have a milder clinical course of disease than patients with normal adult levels of HbF. For example, a group of Saudi Arabian sickle-cell anemia patients who express 20-30% HbF (as a percent of total hemoglobin) have only mild clinical manifestations of the disease [Pembrey et al., *Br. J. Haematol.* 40:415-429 (1978)]. β-hemoglobinopathies, such as sickle cell anemia and the β-thalassemias, can therefore be ameliorated by increased HbF production.

B-Cell Lymphoma 11A (BCL11A)

B-cell E lymphoma 11A (BCL11A) is a gene located on Chromosome 2 and ranges from 60,451,167-60,553,567 bp (GRCh38). BCL11A is a zinc finger transcription factor that represses HbF and downregulates HbF expression starting at about 6 weeks after birth. The BCL11A gene contains 4 exons, spanning 102.4 kb of genomic DNA. BCL11A also is under transcription regulation, including a binding domain in intron 2 for the master transcription factor GATA-1. GATA-1 binding enhances BCL11A expression which, in turn, represses HbF expression. Intron 2 contains multiple DNase hypersensitive sites (DHS), including sites referred to as +55, +58, and +62 based on the distance in kilobases from the transcriptional start site. Various editing strategies are discussed below to delete, modulate, or inactivate the transcriptional control sequences of BCL11A. Naturally occurring SNPs within this region have been associated with decreased BCL11A expression and increased fetal Hb levels (Orkin et al. 2013 GWAS study). These SNPs are organized around 3 DNA Hypersensitivity sites, +55DHS, +58DHS and +62DHS. Of the 3 regions, the +58 DHS region, appears to be the key region associated with increased fetal Hb levels and also harbors a GATA1 transcriptional control region.

Human β-Globin Locus

Figures 1A, 1B:
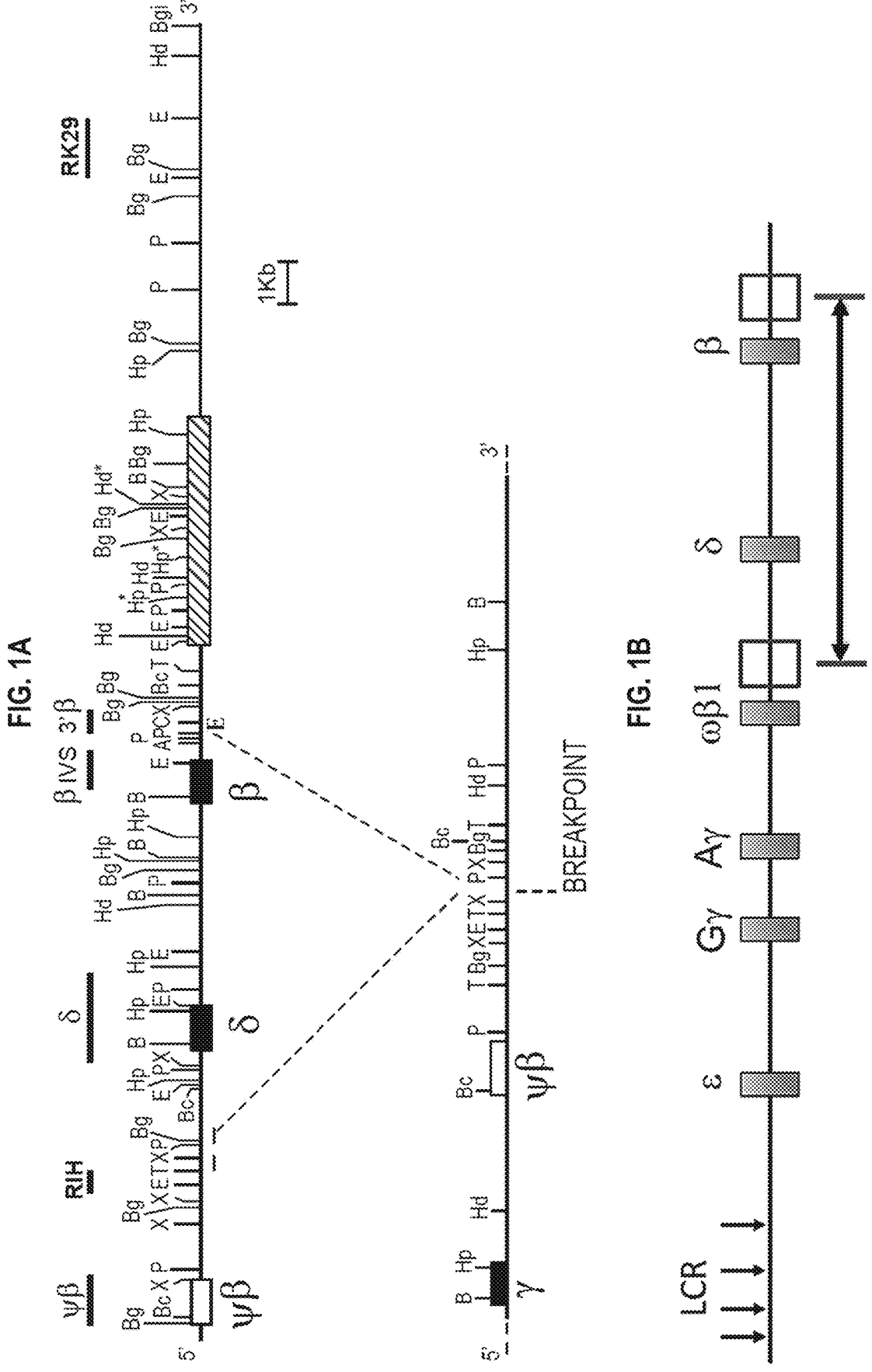
FIGS. 1A-1B show the genomic location of CRISPR target sites for the HPFH5 deletion.
Figure 2:
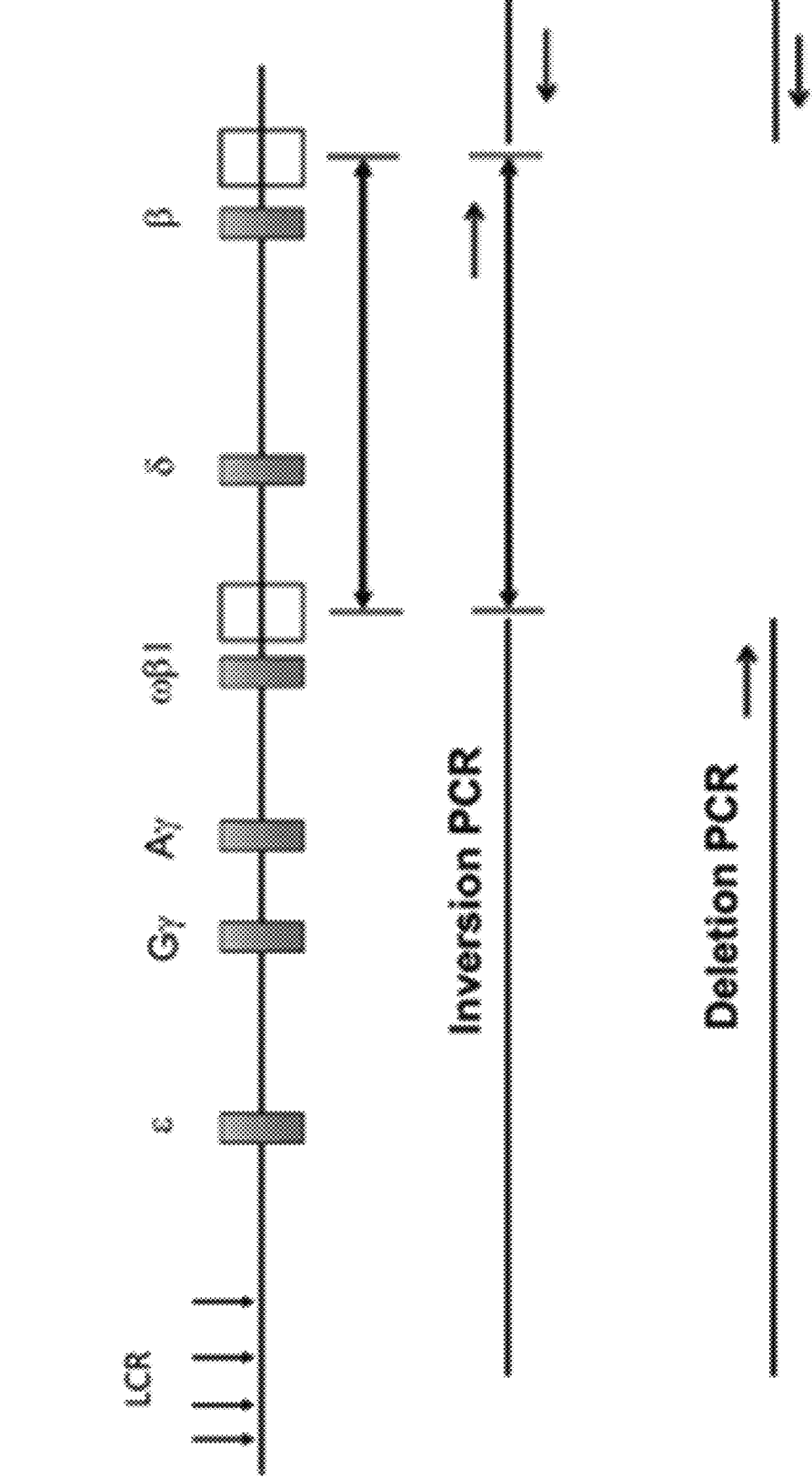
FIG. 2 is a schematic of PCR primer locations for detection of inversions and deletions of the 13 kb fragment.

The human β-globin locus is composed of five β-like genes and one pseudo-β gene located on a short region of chromosome 11 (approximately 45 kb), responsible for the creation of the β chains of hemoglobin. Expression of all of these genes is controlled by single locus control region (LCR), and the genes are differentially expressed throughout development. The order of the LCR and genes in the β-globin cluster, as illustrated in FIG. 1B, is as follows: 5'-[LCR]-ε (epsilon, HBE1)-Gγ (G-gamma, HBG1)-Aγ (A-gamma, HBG2)-[ψβ (psi-beta pseudogene)]-δ (delta, HBD)-β (beta, HBB)-3'.

The arrangement of the five β-like genes reflects the temporal differentiation of their expression during development, with the early-embryonic stage version HbE (encoded by the epsilon gene) being located closest to the LCR, followed by the fetal version HbF (encoded by the γ genes), the delta version, which begins shortly prior to birth and is expressed at low levels in adults as HbA-2 (constituting approximately 3% of adult hemoglobin in normal adults), and finally the beta gene, which encodes the predominant adult version HbA-1 (constituting the remaining 97% of HbA in normal adults).

Expression of the β-like genes is regulated in embryonic erythropoiesis by many transcription factors, including KLF1, which is associated with the upregulation of HbA in adult definitive erythrocytes, and KLF2, which is associated with the expression of embryonic hemoglobin. BCL11A is activated by KLF1 and is likewise known to be involved in the switch from fetal to adult hemoglobin. Down-regulation of BCL11A expression or disruption of its activity or binding to transcriptional regulatory sites has been a focus of long-terms efforts from various groups to increase levels of HbF. See, e.g., U.S. Pat. No. 8,383,604, US2014085593, US20140093913, and references cited therein.

Certain naturally-occurring genetic mutations within the human β-globin locus are associated with de-repression of γ-globin gene expression and the clinical manifestation of HPFH. Such mutations range from single base substitutions associated with various forms of non-deletional HFPF, to deletions spanning tens of kb in the case of some forms of deletional HPFH. A variety of naturally-occurring HPFHs were described in *A Syllabus of Thalassemia Mutations* (1997) by Titus H. J. Huisman, Marianne F. H. Carver, and Erol Baysal, published by The Sickle Cell Anemia Foundation in Augusta, GA, USA, and references cited therein, including both deletional and non-deletional types.

A number of different forms of deletional HPFH have been reported based on studies from individuals and families found to have deletions in a region referred to herein as the "δβ-globin region" which extends from the psi-beta pseudo-gene through delta, beta and the region downstream of beta that is deleted in the larger HPFH alleles such as HPFH-1, as described in the art.

In some cases of HPFH, nearly all of the hemoglobin produced is HbF. However, in most cases, HbF ranges from approximately 15-30% of total hemoglobin depending on the type of HPFH as well as variation among individuals.

Deletions Disrupting or Eliminating the β-Globin Gene and Advantages of Such Deletions in Treating SCD In certain aspects as described and illustrated herein, in addition to increasing expression of the γ-globin gene product HbF, expression of the β-globin gene product is substantially reduced or eliminated by disruption or elimination of the β-globin gene in connection with the genome editing procedure. This occurs when the genome editing uses DNA endonuclease to effect a pair of DSBs, the first at a 5' DSB locus and the second at a 3' DSB locus within the 08-globin region of human chromosome 11, causing a deletion of the chromosomal DNA between the 5' DSB locus and the 3' DSB locus that results in increased expression of γ-globin, the deletion also removes all or a portion of the β-globin gene (HBB) causing a concomitant decrease in expression of or elimination of the β-globin gene product, thereby resulting in a combination of (i) increasing the level of HbF in the cell, and (ii) reducing or eliminating expression of the β-globin gene product from at least one HBB allele on chromosome 11.

The combined effects of increased HbF and reduced or eliminated β-globin gene expression has particular additional advantages in the context of ameliorating hemoglobinopathies such as SCD in which the product of the variant β-globin allele (i.e. HbS) is harmful to cells expressing it, causing premature cell death (as well as other negative effects associated with HbS). Thus, not only do sickled RBCs cause multiple problems for patients, as discussed above and in the art, but sickled RBCs have a substantially reduced life span relative to normal RBCs. The presence of HbS and sickled RBCs also leads to numerous other negative effects as described herein and in the art.

In the case of aspects in which the β-globin gene is effectively disrupted or eliminated as described herein, even "knocking down" (reducing) or "knocking out" (eliminating) only one of the β-globin alleles expressing HbS, e.g., by successfully editing only one of the two copies of the gene in homozygous SCD patients (who have two defective β-globin alleles, one on each copy of chromosome 11) can have a very substantial benefit. In particular, increasing levels of HbF to the range of about 20% is considered to substantially eliminate sickling. However, as a relatively continuous or incremental factor (often referred to as a "quantitative trait") over a significant range, even lower levels HbF can have significant beneficial effects as described herein and in the art. In these aspects, therefore, even though the SCD patient has two defective β-globin alleles, the combination of increasing HbF (which is itself helpful for reducing the effects of SCD) along with reducing HbS (which is itself a driver of many of the deleterious effects in a quantitative manner), by genome editing using the method described and illustrated for these aspects can bring about a combination of effects that together ameliorate one of more symptoms of the disease.

In some cases, the genome editing procedure can effectively alter both copies of an allele. Such bi-allelic editing can in some cases be screened for or selected for, but even if not selected for it can naturally occur, albeit at lower frequency as compared to mono-allelic or single allele hits, since the same target site generally exists on each member of the pairs of chromosomes.

For technical reasons as noted above, however, aspects as described and illustrated herein in which only one of the β-globin alleles is disrupted or eliminated—in addition to increasing levels of HbF—would be expected to have significant positive effects in ameliorating one or more symptoms or conditions associated with SCD.

The ability to generate these significant "cis-type" (on the same allele) effects using the types of genome editing reflected in such aspects can be more advantageous than approaches depending on "trans-type" effects such as those involving knock out or knock down or a trans-acting factor such as a repressor. In particular, as noted above, the genome editing in aspects in which the β-globin gene is effectively disrupted or eliminated can substantially ameliorate effects of HbS by successfully editing on one of the two alleles. In the case of trans-acting repressors, such as a repressor of γ-globin gene expression, knocking down or knocking out one copy of the repressor gene may not be sufficient since expression of the repressor from the other copy of the gene can still reduce γ-globin gene expression limiting the levels of HbF that might be achieved.

Effects of Increased HbF in the Context of β-Thalassemia

As noted above, β-thalassemias result from a partial or complete defect in the expression of the β-globin gene, leading to deficient or absent hemoglobin A (HbA). Since there is no production of HbS, RBCs in β-thal patients do not exhibit the sickling and associated problems associated with SCD. However, a different sort of RBC 'toxicity' and premature cell death occurs as a result of the lack of HbA in the context of β-thal. In particular, the excess of unpaired alpha globin (α-globin) chains in β thalassemia interact with the red cell (RBC) membrane, causing oxidative damage to membrane skeletal components, and potentially other components. This interaction results in a rigid, mechanically unstable membrane that causes increased apoptosis (i.e. programmed cell death) and shortened RBC survival, marked by ineffective erythropoiesis and anemia.

Increasing the levels of HbF in RBCs of such patients can significantly ameliorate one or more symptoms of β-thalassemia because the beta-chains produced by increasing γ-globin gene expression can pair with the previously unpaired alpha-chains to produce HbF, which not only results in a functioning hemoglobin tetramer but concomitantly reduces the levels of unpaired α-globin chains that are a contributing cause of the β-thalassemia condition because of premature RBC cell death.

Positive Selective Advantages of Certain Genome-Edited Cells

In connection with the foregoing advantages provided in certain aspects of the invention, in particular the advantages in terms of RBC survival for sickle cell RBCs that can be mediated by genome editing that not only increases levels of HbF but reduces levels of HbS, and the advantages in terms of RBC survival for β-thal RBCs that not only increases levels of HbF but reduces levels of unpaired alpha-chains, cells that are modified by such genome editing techniques as described and illustrated herein, in some embodiments, will have selective advantages relative to the population of diseased RBCs into which they can be introduced, e.g., by gene editing a patients' own HSC's or erythroid progenitor cells ex vivo and then reintroducing such cells to the patient, where reintroduced cells must generally successfully persist or "engraft" in order for beneficial effects to be sufficient and sustained.

As a result of the foregoing selective advantages, the introduction of even modest numbers of suitable stem cells edited as described herein, in some embodiments, would be expected over time to result in improved cells representing a significantly higher fraction of the overall population of RBCs than they were initially following introduction into a patient. By way of illustration, with successfully gene edited stem cells representing as few as several percent of corresponding cells initially (i.e., compared to the population of resident cells that carry the unedited hemoglobinopathy-associated alleles), the gene edited cells could, in some embodiments, come to represent a majority of cells as a result of selective survival advantages conveyed upon them through use of gene editing techniques as described further herein. The eventual numbers reflecting such positively selected engraftment will vary depending generally on both the degree to which the resident diseased cells exhibit reduced lifespan in a given patient, and the relative survival advantage exhibited by the gene edited cells. However, as noted above, the diseased cells associated with SCD and β-thalassemia have significantly reduced lifespans (due to the presence of HbS and unpaired alpha-chains respectively), and certain aspects not only increase levels of HbF but reduce the levels of HbS (associated with SCD) or reduce the levels of unpaired alpha-chains (associated with β-thalassemia), and therefore the relative survival benefits and with them increased engraftment, are expected to be significant.

Corfu and Corfu-Like Deletions

Although the Corfu chromosomal allele first discovered in a Greek child results in a δβ-thalassemia, it shares some important characteristics with various deletional forms of HPFH, in particular increased levels of HbF, and therefore the deletion associated with Corfu is included with deletional HPFH forms as described herein.

However, Corfu is different from forms of deletional HPFH in terms of HbF levels and β-globin expression. Extremely high levels of HbF are associated with Corfu, approaching 100% of total hemoglobin in the case of the first child identified—and this was particularly surprising because Corfu heterozygotes (the child's parents in the first case) were found to have only normal very low levels of HbF (1-2% of total hemoglobin)—a situation that's been referred to by hematologists as the "Corfu Paradox."

A putative explanation is that the Corfu chromosomal allele was found to contain a splice site mutation in IVS—I position 5 ("IVS—I-5") of the β-globin gene and lower levels of the β-globin gene transcript. It has been reported that the high levels of HbF observed are contributed to post-transcriptionally by enhanced mRNA maturation and/or stabilization of the γ-globin transcript, which is apparently associated with the reduced levels of β-globin mRNA; see, e.g., Chakalova, L. et al., *Blood* 105:2154-2160 (2005).

Since the Corfu chromosomal allele contains both the large deletion and the IVS-1-5 mutation, and reduced levels of β-globin mRNA associated with the latter are believed to independently contribute to the unusually high levels of HbF produced, the IVS-1-5 "Corfu-related β-globin mutation" could be used alone or in combination with other gene edited alterations as described herein in order to increase HbF levels for use in ameliorating hemoglobinopathies.

Target Sequence Selection

For the amelioration of hemoglobinopathies via gene editing, as described herein, it is desirable but not necessary to achieve levels of HbF at the high end of those observed in naturally-occurring cases in order to bring about relative improvements in the disease. In particular, while it had originally been assumed that relatively high levels of HbF were essential for ameliorative effects to be observed, especially with respect to certain complications, studies have shown that even small incremental increases of HbF can have beneficial effects on mortality. See, e.g., Powars et al., *Blood* 63 (4): 921-926 (1984); Platt et al., *N Engl J Med* 330 (23): 1639-1644 (1994); and Akinsheye et al., *Blood* 118: 19-27 (2011).

One reason for the beneficial effects of even low levels of HbF in the context of sickle cell disease, is that even small incremental increases in HbF have been shown to have some beneficial effects, and levels of less than 9% of HbF (relative to total hemoglobin, Hb) appear to be associated with significantly decreased mortality; see, e.g., Platt et al., supra.

Higher levels of HbF are associated with additional clinical benefits and further decreases in morbidity and mortality, as observed in the case of SCD co-inherited with certain naturally-occurring HPFH alleles and/or Corfu thalassemia alleles, in which HbF levels in the 20-30% range have been associated with very substantial to nearly complete normalization of the SCD phenotype.

Genetic modifications within the δβ-globin region that are contemplated for increasing HbF expression to ameliorate a hemoglobinopathy as described herein result in at least about 5%, at least about 9%, at least about 14%, at least about 20%, at least about 25%, or above 30% HbF (relative to total Hb in a subject).

As described and illustrated further herein, exemplary genetic modifications within the δβ-globin region that are contemplated for increasing HbF expression to such levels include, but are not limited to, the following deletions, as well as variations thereof in which the size of the deletion is reduced (e.g., by shifting the 5' boundary of the deletion specified below further toward the 3' boundary of the deletion specified below or shifting the 3' boundary of the deletion further toward the 5' boundary) or increased (by shifting either boundary in the opposite direction). Deletions made by other combinations of two of the following deletion boundaries that increase HbF expression are also specifically contemplated by the disclosure.

A. Deletions in chromosome 11 within the region Chr11:5224779-5237723 based on the GRCh38/hg38 version of the human genome assembly, wherein the 3' boundary of the deletion is proximal (as defined below) to Chr11:5224779 and the 5' boundary of the deletion is proximal to Chr11:5237723;

B. Deletions in chromosome 11 within region Chr11:5234665-5238138 based on the GRCh38/hg38 version of the human genome assembly, wherein the 3' boundary of the deletion is proximal to Chr11:5234665 and the 5' boundary of the deletion is proximal to Chr11:5238138;

C. Deletions in chromosome 11 within region Chr11:5233055-5240389 based on the GRCh38/hg38 version of the human genome assembly, wherein the 3' boundary of the deletion is proximal to Chr11:5233055 and the 5' boundary of the deletion is proximal to Chr11:5240389;

D. Deletions in chromosome 11 within region Chr11:5226631-5249422 based on the GRCh38/hg38 version of the human genome assembly, wherein the 3' boundary of the deletion is proximal to Chr11:5226631 and the 5' boundary of the deletion is proximal to Chr11:5249422;

E. Deletions in chromosome 11 within region Chr11:5249959-5249971 based on the GRCh38/hg38 version of the human genome assembly wherein the 3' boundary of the deletion is at or adjacent to (as defined below) Chr11:5249959 and the 5' boundary of the deletion is at or adjacent to Chr11:5249971;

F. Deletions in chromosome 11 within region Chr11:5196709-5239223 based on the GRCh38/hg38 version of the human genome assembly, wherein the 3' boundary of the deletion is proximal to Chr11:5196709 and the 5' boundary of the deletion is proximal to Chr11:5239223;

G. Deletions in chromosome 11 within region Chr11:5225700-5236750 based on the GRCh38/hg38 version of the human genome assembly, wherein the 3' boundary of the deletion is proximal to Chr11:5225700 and the 5' boundary of the deletion is proximal to Chr11:5236750;

H. Deletions in chromosome 11 within region Chr11:5234655-5238138 based on the GRCh38/hg38 version of the human genome assembly, wherein the 3' boundary of the deletion is proximal to Chr11:5234655 and the 5' boundary of the deletion is proximal to Chr11:5238138;

I. Deletions in chromosome 11 within region Chr11:5255885-5259368 based on the GRCh37/hg19 version of the human genome assembly, wherein the 3' boundary of the deletion is proximal to Chr11:5255885 and the 5' boundary of the deletion is proximal to Chr11: 5259368.

In another aspect, provided herein are methods of increasing the level of HbF in a human cell by genome editing using DNA endonuclease to effect a double-strand break (DSB) positioned at one or more loci within the human β-globin region of human chromosome 11, wherein at least one SSB or DSB is positioned within the γ-globin regulatory region of human chromosome 11, which is located within a region less than 2 kb, less than 1 kb, less than 0.5 kb, or less than 0.25 kb upstream of the start of one of the γ-globin genes (HBG1 or HBG2), causing deletions or insertions of chromosomal DNA at the one or more loci that results in increased expression of γ-globin, thereby increasing the level of HbF in the cell. In another type of method exemplifying this aspect, at least one SSB or DSB is positioned within the δβ-globin region of human chromosome 11.

Illustrative modifications in chromosome 11 in the γ-globin regulatory region include the creation of single base substitutions such as −175 (T to C), −202 (C to G), and −114 (C to T) in the $^G\gamma$ gene; and −196 (C to T), −175 (T to C), −117 (G to A) in the $^A\gamma$ gene.

Illustrative modifications within the δβ-globin region include deletions and insertions within or proximal to the HPFH deletion loci referred to above, and deletions within the δ-globin regulatory region of human chromosome 11 which is located within the region of less than 3 kb, less than 2 kb, less than 1 kb, less than 0.5 kb upstream of the start of the δ-globin gene (HBD), and deletions within the β-globin regulatory region of human chromosome 11, which is located within the region of less than 3 kb, less than 2 kb, and less than 1 kb, or less than 0.5 kb upstream of the start of the β-globin gene (HBB).

Given the relatively wide variations in deletions that are associated with various forms of HPFH, coupled with the fact that even low levels of HbF can provide significant levels of amelioration of hemoglobinopathy (as noted above), and the understanding from a variety of studies that there appear to be multiple loci and types of controls that can contribute to repression of HbF, it will be appreciated that numerous variations of the deletions referenced above (including without limitation larger as well as smaller deletions), would be expected to result in levels of HbF that are within the contemplated ranges, as noted above.

Such variants include deletions that are larger in the 5' and/or 3' direction than naturally-occurring HPFH deletions, or smaller in either direction. Accordingly, by "proximal" with respect to HPFH-like deletions, it is intended that the DSB locus associated with a desired deletion boundary (also referred to herein as an endpoint) can be within a region that is less than about 3 kb from the reference locus noted. In some aspects, the DSB locus is more proximal and within 2 kb, within 1 kb, within 0.5 kb, or within 0.1 kb. In the case of small deletions such as that identified in group E, the desired endpoint can be at or "adjacent to" the reference locus, by which it is intended that the endpoint can be within 100 bp, within 50 bp, within 25 bp, or less than about 10 bp to 5 bp from the reference locus.

A group of aspects can comprise deletions within the "δ-region" (which includes the downstream half of the intergenic sequence between the ωβ1 pseudogene and the δ gene HBD, and proximal sequences downstream sequences in the δ). The δ-proximal-region appears to include a number of elements associated with repression of γ-globin. The 7.2 kb "Large Corfu" δβ thalassemia deletion described and exemplified further herein falls within the δ-region, deleting approximately 1 kb of the δ gene and 6 kb upstream, and can be associated with a significant increase in levels of HbF. A 3.5 "Small Corfu" deletion, described further and illustrated herein, likewise has a deletion in the δ-region, and can be also associated with increased levels of HbF. The δ-region can be also deleted in all major forms of HPFH.

With respect to regions further downstream in the 3' direction, which would be associated with larger deletions as described herein, HPFH-1 through HPFH-5 all have the δ and β genes deleted. Besides regulatory elements in the δ-region that may contribute to active repression of γ-globin, activity of the δ and β promoters can also indirectly contribute to suppression via competition for transcriptional factors required for γ-globin expression.

Many HPFH types also have even larger deletions extending further downstream, and these additional downstream regions can also be incorporated into deletions as described and illustrated herein, since they are known to be associated with substantial increases of HbF, well above the ranges of HbF known to ameliorate hemoglobinopathies as noted above.

One advantage for patients with hemoglobinopathies of replicating or mimicking aspects of deletions that are found naturally in individuals with HPFH is that such deletions are already known to be both safe and associated with the amelioration of hemoglobinopathy. However, among deletional HPFH, it is also clear that smaller deletions such as HPFH-5 are effective for generating substantial increases in HbF. Other aspects comprising smaller deletions are expected to provide substantial increases, and as noted above, even modest levels of increase of HbF have beneficial effects. It is thus expected that many variations of the deletions described and illustrated herein will be effective for ameliorating hemoglobinopathies.

Preferentially, shifts in the location of the 5' boundary and/or the 3' boundary relative to particular reference loci are used to facilitate or enhance particular applications of gene editing, which depend in part on the endonuclease system selected for the editing, as further described and illustrated herein. In a first aspect of such target sequence selection, many endonuclease systems have rules or criteria that guide the initial selection of potential target sites for cleavage, such as the requirement of a PAM sequence motif in a particular position adjacent to the DNA cleavage sites in the case of CRISPR Type II endonucleases.

In another aspect of target sequence selection or optimization, the frequency of "off-target" activity for a particular combination of target sequence and gene editing endonuclease (i.e. the frequency of DSBs occurring at sites other than the selected target sequence) is assessed relative to the frequency of on-target activity. In some cases, cells that have been correctly edited at the desired locus may have a selective advantage relative to other cells. Illustrative but nonlimiting examples of a selective advantage include the acquisition of attributes such as enhanced rates of replication, persistence, resistance to certain conditions, enhanced rates of successful engraftment or persistence in vivo following introduction into a patient, and other attributes associated with the maintenance or increased numbers or viability of such cells. In other cases, cells that have been correctly edited at the desired locus may be positively selected for by one or more screening methods used to identify, sort or otherwise select for cells that have been correctly edited. Both selective advantage and directed selection methods may take advantage of the phenotype associated with the correction.

Whether or not any selective advantage is applicable or any directed selection is to be applied in a particular case, target sequence selection is can also be guided by consideration of off-target frequencies in order to enhance the effectiveness of the application and/or reduce the potential for undesired alterations at sites other than the desired target. As described further and illustrated herein and in the art, the occurrence of off-target activity is influenced by a number of factors including similarities and dissimilarities between the target site and various off target sites, as well as the particular endonuclease used. In many cases, bioinformatics tools are available that assist in the prediction of off-target activity, and frequently such tools can also be used to identify the most likely sites of off-target activity, which can then be assessed in experimental settings to evaluate relative frequencies of off-target to on-target activity, thereby allowing the selection of sequences that have higher relative on-target activities. Illustrative examples of such techniques are provided herein and others are known in the art.

Another aspect of target sequence selection relates to homologous recombination events. It is well known that sequences sharing regions of homology can serve as focal points for homologous recombination events that result in deletion of intervening sequences. Such recombination events occur during the normal course of replication of chromosomes and other DNA sequences, and also at other times when DNA sequences are being synthesized, such as in the case of repairs of double-strand breaks (DSBs) which occur on a regular basis during the normal cycle but may also be enhanced by the occurrence of various events (such as UV light and other inducers of DNA breakage) or the presence of certain agents (such as various chemical inducers). Many such inducers cause DSBs to occur indiscriminately in the genome, and DSBs are regularly being induced and repaired in normal cells. During repair, the original sequence may be reconstructed with complete fidelity, however, in some cases, small insertions or deletions (referred to as "indels") are introduced at the DSB site.

DSBs may also be specifically induced at particular locations, as in the case of the endonucleases systems described herein, which can be used to cause directed or preferential gene modification events at selected chromosomal locations. The tendency for homologous sequences to be subject to recombination in the context of DNA repair (as well as replication) can be taken advantage of in a number of circumstances, and is the basis for one application of gene editing systems such as CRISPR in which homology directed repair (HDR) is used to insert a sequence of interest, provided through use of a "donor" polynucleotide, into a desired chromosomal location.

Regions of homology between particular sequences, which can be small regions of "microhomology" that may comprise as few as ten basepairs or less, can also be used to bring about desired deletions. For example, in the case of the so-called "small deletion" exemplified herein, a single DSB is introduced at a site that exhibits microhomology with a nearby sequence. During the normal course of repair of such DSB, a result that occurs with high frequency is the deletion of the intervening sequence as a result of recombination being facilitated by the DSB and concomitant cellular repair process. In the case of this small deletion, which is in the upstream region of the γ-globin gene, the result of the deletion is to increase levels of HbF, apparently through disruption of a gene silencing sequence.

In some circumstances, however, selecting target sequences within regions of homology can also give rise to much larger deletions including gene fusions (when the deletions are in coding regions), which may or may not be desired given the particular circumstances. For example, as illustrated in FIG. 5B, the homologies that exist between the two closely-related γ-globin genes HBG1 and HBG2 can give rise to large deletions arising through homologous recombination between more distal sites of homology.

The examples provided herein further illustrate the selection of various target regions for the creation of DSBs designed to induce deletions that result in the increase of HbF levels in human cells, as well as the selection of specific target sequences within such regions that are designed to minimize off-target events relative to on-target events.

HBS1L-MYB on Chromosome 6

Genetic studies have identified common variants within the intergenic region (HBS1L-MYB) between GTP-binding elongation factor HBS1L and myeloblastosis oncogene MYB on chromosome 6.

Therapeutic Approach

In some aspects, the overall therapeutic approach is to introduce a permanent deletion, inversion, or mutation within or near two or more of: a human beta globin locus on chromosome 11; a BCL11A gene on chromosome 2 or a DNA sequence that encodes a transcriptional control region of the BCL11A gene on chromosome 2; and an intergenic region HBS1L-MYB on chromosome 6. For example, one therapeutic approach includes introducing a permanent deletion, inversion, or mutation within or near a human beta globin locus on chromosome 11; and a BCL11A gene on chromosome 2 or a DNA sequence that encodes a transcriptional control region of the BCL11A gene on chromosome 2. A second example therapeutic approach includes introducing a permanent deletion, inversion, or mutation within or near a human beta globin locus on chromosome 11; and an intergenic region HBS1L-MYB on chromosome 6. A third example therapeutic approach includes introducing a permanent deletion, inversion, or mutation within or near a BCL11A gene on chromosome 2 or a DNA sequence that encodes a transcriptional control region of the BCL11A gene on chromosome 2; and an intergenic region HBS1L-MYB on chromosome 6. A fourth example therapeutic approach includes introducing a permanent deletion, inversion, or mutation within or near a human beta globin locus on chromosome 11; a BCL11A gene on chromosome 2 or a DNA sequence that encodes a transcriptional control region of the BCL11A gene on chromosome 2; and an intergenic region HBS1L-MYB on chromosome 6. These therapeutic approaches can lead to an increase in expression of γ-globin and thereby increase production of HbF.

Additional Therapeutic Approach

In some embodiments, permanent deletions within or near the human beta globin locus on chromosome 11 can be used to reposition a BCL11A enhancing region (located within the human beta globin locus) closer to the HBG1 and/or HBG2 genes. For example, a HPFH deletion can be located downstream of a HBG1 gene and result in a repositioning of a BCL11A enhancing region closer to the HBG1 gene. A HPFH deletion can be located downstream of a HBG2 gene and result in a repositioning of a BCL11A enhancing region closer to the HBG2 gene. A HPFH deletion can be located downstream of a HBG1 gene and HBG2 gene and result in a repositioning of a BCL11A enhancing region closer to the HBG1 gene and HBG2 gene.

Genome Editing

Genome editing generally refers to the process of modifying the nucleotide sequence of a genome, preferably in a precise or pre-determined manner. Examples of methods of genome editing described herein include methods of using site-directed nucleases to cut DNA at precise target locations in the genome, thereby creating single-strand or double-strand DNA breaks at particular locations within the genome. Such breaks can be and regularly are repaired by natural, endogenous cellular processes such as homology-directed repair (HDR) and non-homologous end-joining (NHEJ), as recently reviewed in Cox et al., *Nature Medicine* 21 (2), 121-31 (2015). These two main DNA repair processes consist of a family of alternative pathways. NHEJ directly joins the DNA ends resulting from a double-strand break sometimes with the loss or addition of nucleotide sequence which may disrupt or enhance gene expression. HDR utilizes a homologous sequence, or donor sequence, as a template for inserting a defined DNA sequence at the break point. The homologous sequence can be in the endogenous genome, such as a sister chromatid. Alternatively, the donor can be an exogenous nucleic acid such as a plasmid, a single-strand oligonucleotide, a double-stranded oligonucleotide, a duplex oligonucleotide or a virus, that has regions of high homology with the nuclease-cleaved locus, but which can also contain additional sequence or sequence changes including deletions that can be incorporated into the cleaved target locus. A third repair mechanism can be microhomology-mediated end joining (MMEJ), also referred to as "Alternative NHEJ, in which the genetic outcome is similar to NHEJ in that small deletions and insertions can occur at the cleavage site. MMEJ can make use of homologous sequences of a few basepairs flanking the DNA break site to drive a more favored DNA end joining repair outcome, and recent reports have further elucidated the molecular mechanism of this process; see, e.g., Cho and Greenberg, *Nature* 518, 174-76 (2015); Kent et al., *Nature Structural and Molecular Biology*, Adv. Online doi: 10.1038/nsmb.2961 (2015); Mateos-Gomez et al., *Nature* 518, 254-57 (2015); Ceccaldi et al., *Nature* 528, 258-62 (2015). In some instances it may be possible to predict likely repair outcomes based on analysis of potential microhomologies at the site of the DNA break.

Each of these genome editing mechanisms can be used to create desired genomic alterations. A step in the genome editing process can be to create one or two DNA breaks, the latter as double-strand breaks or as two single-stranded breaks, in the target locus as near the site of intended mutation. This can be achieved via the use of site-directed polypeptides, as described and illustrated herein.

Site-directed polypeptides, such as a DNA endonuclease, can introduce double-strand breaks or single-strand breaks in nucleic acids, e.g., genomic DNA. The double-strand break can stimulate a cell's endogenous DNA-repair pathways (e.g., homology-dependent repair or non-homologous end joining or alternative non-homologous end joining (A-NHEJ) or microhomology-mediated end joining). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template can comprise sequences that can be homologous to sequences flanking the target nucleic acid cleavage site. The sister chromatid can be used by the cell as the repair template. However, for the purposes of genome editing, the repair template can be supplied as an exogenous nucleic acid, such as a plasmid, duplex oligonucleotide, single-strand oligonucleotide, double-stranded oligonucleotide, or viral nucleic acid. With exogenous donor templates, an additional nucleic acid sequence (such as a transgene) or modification (such as a single or multiple base change or a deletion) can be introduced between the flanking regions of homology so that the additional or altered nucleic acid sequence also becomes incorporated into the target locus. MMEJ can result in a genetic outcome that is similar to NHEJ in that small deletions and insertions can occur at the cleavage site. MMEJ can make use of homologous sequences of a few basepairs flanking the cleavage site to drive a favored end-joining DNA repair outcome. In some instances it may be possible to predict likely repair outcomes based on analysis of potential microhomologies in the nuclease target regions.

Thus, in some cases, homologous recombination can be used to insert an exogenous polynucleotide sequence into the target nucleic acid cleavage site. An exogenous poly-nucleotide sequence is termed a donor polynucleotide (or donor or donor sequence or polynucleotide donor template) herein. The donor polynucleotide, a portion of the donor polynucleotide, a copy of the donor polynucleotide, or a portion of a copy of the donor polynucleotide can be inserted into the target nucleic acid cleavage site. The donor poly-nucleotide can be an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

Nucleases

Gene editing can be conducted using nucleases engineered to target specific sequences. To date there are four major types of nucleases: meganucleases and their derivatives, zinc finger nucleases (ZFNs), transcription activator like effector nucleases (TALENs), and CRISPR endonuclease (e.g., CRISPR-Cas9 nuclease) systems. The nuclease platforms vary in difficulty of design, targeting density and mode of action, particularly as the specificity of ZFNs and TALENs is through protein-DNA interactions, while RNA-DNA interactions primarily guide CRISPR endonucleases such as Cas9. Cas9 cleavage also requires an adjacent motif, the PAM, which differs between different CRISPR systems. Cas9 from *Streptococcus pyogenes* cleaves using a NGG PAM, CRISPR from *Neisseria meningitidis* can cleave at sites with PAMs including NNNNGATT, NNNNNGTTT and NNNNGCTT. A number of other Cas9 orthologs target protospacer adjacent to alternative PAMs.

In some embodiments, CRISPR endonucleases, such as Cas9, can be used in the methods of the present disclosure. However, the teachings described herein, such as therapeutic target sites, could be applied to other forms of endonucleases, such as ZFNs, TALENs, HEs, or MegaTALs, or using combinations of nucleases. However, in order to apply the teachings of the present disclosure to such endonucleases, one would need to, among other things, engineer proteins directed to the specific target sites.

Additional binding domains can be fused to the Cas9 or other CRISPR endonuclease protein to increase specificity. The target sites of these constructs would map to the identified gRNA specified site, but would require additional binding motifs, such as for a zinc finger domain. In the case of Mega-TAL, a meganuclease can be fused to a TALE DNA-binding domain. The meganuclease domain can increase specificity and provide the cleavage. Similarly, inactivated or dead Cas9 (dCas9) can be fused to a cleavage domain and require the sgRNA/Cas9 target site and adjacent binding site for the fused DNA-binding domain. This likely would require some protein engineering of the dCas9, in addition to the catalytic inactivation, to decrease binding without the additional binding site.

Zinc Finger Nucleases

Zinc finger nucleases (ZFNs) are modular proteins comprised of an engineered zinc finger DNA binding domain linked to the catalytic domain of the type II endonuclease FokI. Since FokI functions only as a dimer, a pair of ZFNs must be engineered to bind to cognate target "half-site" sequences on opposite DNA strands and with precise spacing between them to enable the catalytically active FokI dimer to form. Upon dimerization of the FokI domain, which itself has no sequence specificity per se, a DNA double-strand break is generated between the ZFN half-sites as the initiating step in genome editing.

The DNA binding domain of each ZFN can comprise 3-6 zinc fingers of the abundant Cys2-His2 architecture, with each finger primarily recognizing a triplet of nucleotides on one strand of the target DNA sequence, although cross-strand interaction with a fourth nucleotide also can be important. Alteration of the amino acids of a finger in positions that make key contacts with the DNA alters the sequence specificity of a given finger. Thus, a four-finger zinc finger protein can selectively recognize a 12 bp target sequence, where the target sequence is a composite of the triplet preferences contributed by each finger, although triplet preference can be influenced to varying degrees by neighboring fingers. An important aspect then of ZFNs is that they can be readily retargeted to almost any genomic address simply by modifying individual fingers, although considerable expertise is required to do this well. In most applications of ZFNs, proteins of 4-6 fingers can be used, recognizing 12-18 bp respectively. Hence, a pair of ZFNs will typically recognize a combined target sequence of 24-36 bp, not including the 5-7 bp spacer between half-sites. The binding sites can be separated further with larger spacers, including 15-17 bp. A target sequence of this length is likely to be unique in the human genome, assuming repetitive sequences or gene homologs are excluded during the design process. Nevertheless, the ZFN protein-DNA interactions are not absolute in their specificity and so off-target binding and cleavage events do occur, either as a heterodimer between the two ZFNs, or as a homodimer of one or the other of the ZFNs. The latter possibility has been effectively eliminated by engineering the dimerization interface of the FokI domain to create "plus" and "minus" variants, also known as obligate heterodimer variants, which can only dimerize with each other and not with themselves. Forcing the obligate heterodimer prevents formation of the homodimer. This has greatly enhanced specificity of ZFNs, as well as, of any other nuclease that adopts these FokI variants.

A variety of ZFN-based systems have been described in the art, modifications thereof are regularly reported, and numerous references describe rules and parameters that are used to guide the design of ZFNs; see, e.g., Segal et al., *Proc Natl Acad Sci USA* 96 (6): 2758-63 (1999); Dreier B et al., *J Mol Biol.* 303 (4): 489-502 (2000); Liu Q et al., *J Biol Chem.* 277 (6): 3850-6 (2002); Dreier et al., *J Biol Chem* 280 (42): 35588-97 (2005); and Dreier et al., *J Biol Chem.* 276 (31): 29466-78 (2001).

Transcription Activator-Like Effector Nucleases (TALENs)

TALENs represent another format of modular nucleases whereby, as with ZFNs, an engineered DNA binding domain is linked to the FokI nuclease domain, and a pair of TALENs operates in tandem to achieve targeted DNA cleavage. The major difference from ZFNs is the nature of the DNA binding domain and the associated target DNA sequence recognition properties. The TALEN DNA binding domain derives from TALE proteins, which were, originally described in the plant bacterial pathogen *Xanthomonas* sp. TALEs are comprised of tandem arrays of 33-35 amino acid repeats, with each repeat recognizing a single basepair in the target DNA sequence that is typically up to 20 bp in length, giving a total target sequence length of up to 40 bp. Nucleotide specificity of each repeat is determined by the repeat variable diresidue (RVD) which includes just two amino acids at positions 12 and 13. The bases guanine, adenine, cytosine and thymine are predominantly recognized by the four RVDs Asn-Asn, Asn-Ile, His-Asp and Asn-Gly, respectively. This constitutes a much simpler recognition code than for zinc fingers and thus represents an advantage over the latter for nuclease design. Nevertheless, as with ZFNs, the protein-DNA interactions of TALENs are not absolute in their specificity and TALENs have also benefitted from the use of the obligate heterodimer variants of the FokI domain to reduce off-target activity.

Additional variants of the FokI domain have been created that can be deactivated in their catalytic function. If one half of either a TALEN or a ZFN pair contains an inactive FokI domain then only single-strand DNA cleavage (nicking) will occur at the target site rather than a DSB. The outcome is comparable to the use of CRISPR/Cas9/Cpf1 "nickase" mutants in which one of the Cas9 cleavage domains has been deactivated. DNA nicks can be used to drive genome editing by HDR, but at lower efficiency than with a DSB. The main benefit is that off-target nicks are quickly and accurately repaired, unlike the DSB which is prone to NHEJ-mediated mis-repair.

A variety of TALEN-based systems have been described in the art, and modifications thereof are regularly reported; see, e.g., Boch, *Science* 326 (5959): 1509-12 (2009); Mak et al., *Science* 335 (6069): 716-9 (2012); and Moscou et al., *Science* 326 (5959): 1501 (2009). The use of TALENs based on the "Golden Gate" platform, or cloning scheme, has been described by multiple groups; see, e.g., Cermak et al., *Nucleic Acids Res.* 39 (12): e82 (2011); Li et al., *Nucleic Acids Res.* 39 (14): 6315-25 (2011); Weber et al., *PLOS One.* 6 (2): e16765 (2011); Wang et al., *J Genet Genomics* 41 (6): 339-47, Epub 2014 May 17 (2014); and Cermak T et al., *Methods Mol Biol.* 1239:133-59 (2015).

Homing Endonucleases

Homing endonucleases (HE) are sequence-specific endonucleases that have long recognition sequences (14-44 base pairs) and cleave DNA with high specificity-often at sites unique in the genome. There are at least six known families of HEs as classified by their structure, including LAGLIDADG (SEQ ID NO 228,300), GIY-YIG, His-Cis box, H—N—H, PD-(D/E)×K, and Vsr-like that are derived from a broad range of hosts including eukarya, protists, bacteria, archaea, cyanobacteria and phage. As with ZFNs and TALENs, HEs can be used to create a DSB at a target locus as the initial step in genome editing. In addition, some natural and engineered HEs cut only a single strand of the DNA, thereby functioning as site-specific nickases. The large target sequence of HEs and the specificity that they offer have made them attractive candidates to create site-specific DSBs.

A variety of HE-based systems have been described in the art, and modifications thereof are regularly reported; see, e.g., the reviews by Steentoft et al., *Glycobiology* 24 (8): 663-80 (2014); Belfort and Bonocora, *Methods Mol Biol.*

1123:1-26 (2014); Hafez and Hausner, *Genome* 55 (8): 553-69 (2012); and references cited therein.

MegaTAL/Tev-mTALEN/MegaTev

As further examples of hybrid nucleases, the MegaTAL platform and Tev-mTALEN platform use a fusion of the TALE DNA binding domains to catalytically active HEs, taking advantage of both the tunable DNA binding and specificity of the TALE as well as the cleavage sequence specificity of the HE; see, e.g., Boissel et al., *NAR* 42:2591-2601 (2014); Kleinstiver et al., *G3* 4:1155-65 (2014); and Boissel and Scharenberg, *Methods Mol. Biol.* 1239:171-96 (2015).

In a further variation, the MegaTev architecture is the fusion of a meganuclease (Mega) with the nuclease domain derived from the GIY-YIG homing endonuclease I-TevI (Tev). The two active sites are positioned ~30 bp apart on DNA substrate and generate two DSBs with non-compatible cohesive ends; see, e.g., Wolfs et al., *NAR* 42, 8816-29 (2014). It is anticipated that other combinations of existing nuclease-based approaches can evolve and be useful in achieving the targeted genome modifications described herein.

dCas9-FokI and Other Nucleases

Combining the structural and functional properties of the nuclease platforms described above can offer a further approach to genome editing that can potentially overcome some of the inherent deficiencies. As an example, the CRISPR genome editing system can use a single Cas9 endonuclease to create a DSB. The specificity of targeting is driven by a 20 or 24 nucleotide sequence in the guide RNA that undergoes Watson-Crick base-pairing with the target DNA (plus an additional 2 bases in the adjacent NAG or NGG PAM sequence in the case of Cas9 from *S. pyogenes*). Such a sequence is long enough to be unique in the human genome, however, the specificity of the RNA/DNA interaction is not absolute, with significant promiscuity sometimes tolerated particularly in the 5' half of the target sequence, effectively reducing the number of bases that drive specificity. One solution to this has been to completely deactivate the Cas9 or Cpf-1 catalytic function-retaining only the RNA-guided DNA binding function—and instead fusing a FokI domain to the deactivated Cas9; see, e.g., Tsai et al., *Nature Biotech* 32:569-76 (2014); and Guilinger et al., *Nature Biotech.* 32:577-82 (2014). Since FokI has to dimerize to become catalytically active, two guide RNAs are required to tether two Cas9-FokI fusions in close proximity to form the dimer and cleave DNA. This essentially doubles the number of bases in the combined target sites, thereby increasing the stringency of targeting by CRISPR-based systems.

As further example, fusion of the TALE DNA binding domain to a catalytically active HE, such as I-TevI, takes advantage of both the tunable DNA binding and specificity of the TALE as well as the cleavage sequence specificity of I-TevI, with the expectation that off-target cleavage can be further reduced.

CRISPR Endonuclease System

A CRISPR (Clustered Regularly Interspaced Short Palindromic Repeats) genomic locus can be found in the genomes of many prokaryotes (e.g., bacteria and archaea). In prokaryotes, the CRISPR locus encodes products that function as a type of immune system to help defend the prokaryotes against foreign invaders, such as virus and phage. There are three stages of CRISPR locus function: integration of new sequences into the CRISPR locus, expression of CRISPR RNA (crRNA), and silencing of foreign invader nucleic acid. Five types of CRISPR systems (e.g., Type I, Type II, Type III, Type U, and Type V) have been identified.

A CRISPR locus includes a number of short repeating sequences referred to as "repeats". When expressed, the repeats can form secondary structures (e.g., hairpins) and/or comprise unstructured single-stranded sequences. The repeats usually occur in clusters and frequently diverge between species. The repeats are regularly interspaced with unique intervening sequences referred to as "spacers", resulting in a repeat-spacer-repeat locus architecture. The spacers are identical to or have high homology with known foreign invader sequences. A spacer-repeat unit encodes a crisprRNA (crRNA), which is processed into a mature form of the spacer-repeat unit. A crRNA comprises a "seed" or spacer sequence that is involved in targeting a target nucleic acid (in the naturally occurring form in prokaryotes, the spacer sequence targets the foreign invader nucleic acid). A spacer sequence is located at the 5' or 3' end of the crRNA.

A CRISPR locus also comprises polynucleotide sequences encoding CRISPR Associated (Cas) genes. Cas genes encode endonucleases involved in the biogenesis and the interference stages of crRNA function in prokaryotes. Some Cas genes comprise homologous secondary and/or tertiary structures.

Type II CRISPR Systems crRNA biogenesis in a Type II CRISPR system in nature requires a trans-activating CRISPR RNA (tracrRNA). The tracrRNA can be modified by endogenous RNaseIII, and then hybridizes to a crRNA repeat in the pre-crRNA array. Endogenous RNaseIII can be recruited to cleave the pre-crRNA. Cleaved crRNAs can be subjected to exoribonuclease trimming to produce the mature crRNA form (e.g., 5' trimming). The tracrRNA can remain hybridized to the crRNA, and the tracrRNA and the crRNA associate with a site-directed polypeptide (e.g., Cas9). The crRNA of the crRNA-tracrRNA-Cas9 complex can guide the complex to a target nucleic acid to which the crRNA can hybridize. Hybridization of the crRNA to the target nucleic acid can activate Cas9 for targeted nucleic acid cleavage. The target nucleic acid in a Type II CRISPR system is referred to as a protospacer adjacent motif (PAM). In nature, the PAM is essential to facilitate binding of a site-directed polypeptide (e.g., Cas9) to the target nucleic acid. Type II systems (also referred to as Nmeni or CASS4) are further subdivided into Type II-A (CASS4) and II-B (CASS4a). Jinek et al., *Science,* 337 (6096): 816-821 (2012) showed that the CRISPR/Cas9 system is useful for RNA-programmable genome editing, and international patent application publication number WO2013/176772 provides numerous examples and applications of the CRISPR/Cas endonuclease system for site-specific gene editing.

Type V CRISPR Systems

Type V CRISPR systems have several important differences from Type II systems. For example, Cpf1 is a single RNA-guided endonuclease that, in contrast to Type II systems, lacks tracrRNA. In fact, Cpf1-associated CRISPR arrays can be processed into mature crRNAs without the requirement of an additional trans-activating tracrRNA. The Type V CRISPR array can be processed into short mature crRNAs of 42-44 nucleotides in length, with each mature crRNA beginning with 19 nucleotides of direct repeat followed by 23-25 nucleotides of spacer sequence. In contrast, mature crRNAs in Type II systems can start with 20-24 nucleotides of spacer sequence followed by about 22 nucleotides of direct repeat. Also, Cpf1 can utilize a T-rich protospacer-adjacent motif such that Cpf1-crRNA complexes efficiently cleave target DNA preceded by a short T-rich PAM, which is in contrast to the G-rich PAM following the target DNA for Type II systems. Thus, Type V systems cleave at a point that is distant from the PAM, while Type II systems cleave at a point that is adjacent to the PAM. In addition, in contrast to Type II systems, Cpf1 cleaves DNA via a staggered DNA double-stranded break with a 4 or 5 nucleotide 5' overhang. Type II systems cleave via a blunt double-stranded break. Similar to Type II systems, Cpf1 contains a predicted RuvC-like endonuclease domain, but lacks a second HNH endonuclease domain, which is in contrast to Type II systems.

Cas Genes/Polypeptides and Protospacer Adjacent Motifs

Exemplary CRISPR Cas polypeptides include the Cas9 polypeptides in FIG. 1 of Fonfara et al., *Nucleic Acids Research,* 42:2577-2590 (2014). The CRISPR/Cas gene naming system has undergone extensive rewriting since the Cas genes were discovered. FIG. 5 of Fonfara, supra, provides PAM sequences for the Cas9 polypeptides from various species.

Site-Directed Polypeptides

A site-directed polypeptide is a nuclease used in genome editing to cleave DNA. The site-directed nuclease or poly-peptide can be administered to a cell or a patient as either: one or more polypeptides, or one or more mRNAs encoding the polypeptide.

In the context of a CRISPR/Cas or CRISPR/Cpf1 system, the site-directed polypeptide can bind to a guide RNA that, in turn, specifies the site in the target DNA to which the polypeptide is directed. In the CRISPR/Cas or CRISPR/ Cpf1 systems disclosed herein, the site-directed polypeptide can be an endonuclease, such as a DNA endonuclease.

A site-directed polypeptide can comprise a plurality of nucleic acid-cleaving (i.e., nuclease) domains. Two or more nucleic acid-cleaving domains can be linked together via a linker. For example, the linker can comprise a flexible linker. Linkers can comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length.

Naturally-occurring wild-type Cas9 enzymes comprise two nuclease domains, a HNH nuclease domain and a RuvC domain. Herein, the "Cas9" refers to both naturally-occur-ring and recombinant Cas9s. Cas9 enzymes contemplated herein can comprise a HNH or HNH-like nuclease domain, and/or a RuvC or RuvC-like nuclease domain.

HNH or HNH-like domains comprise a McrA-like fold. HNH or HNH-like domains comprises two antiparallel β-strands and an α-helix. HNH or HNH-like domains com-prises a metal binding site (e.g., a divalent cation binding site). HNH or HNH-like domains can cleave one strand of a target nucleic acid (e.g., the complementary strand of the crRNA targeted strand).

RuvC or RuvC-like domains comprise an RNaseH or RNaseH-like fold. RuvC/RNaseH domains are involved in a diverse set of nucleic acid-based functions including acting on both RNA and DNA. The RNaseH domain comprises 5 β-strands surrounded by a plurality of α-helices. RuvC/ RNaseH or RuvC/RNaseH-like domains comprise a metal binding site (e.g., a divalent cation binding site). RuvC/ RNaseH or RuvC/RNaseH-like domains can cleave one strand of a target nucleic acid (e.g., the non-complementary strand of a double-stranded target DNA).

Site-directed polypeptides can introduce double-strand breaks or single-strand breaks in nucleic acids, (e.g., genomic DNA). The double-strand break can stimulate a cell's endogenous DNA-repair pathways (e.g., homology-dependent repair (HDR) or non-homologous end joining (NHEJ) or alternative non-homologous end joining (A-NHEJ) or microhomology-mediated end joining (MMEJ)). NHEJ can repair cleaved target nucleic acid without the need for a homologous template. This can sometimes result in small deletions or insertions (indels) in the target nucleic acid at the site of cleavage and can lead to disruption or alteration of gene expression. HDR can occur when a homologous repair template, or donor, is available. The homologous donor template can comprise sequences that are homologous to sequences flanking the target nucleic acid cleavage site. The sister chromatid can be used by the cell as the repair template. However, for the purposes of genome editing, the repair template can be supplied as an exogenous nucleic acid, such as a plasmid, duplex oligo-nucleotide, single-strand oligonucleotide or viral nucleic acid. With exogenous donor templates, an additional nucleic acid sequence (such as a transgene) or modification (such as a single base or multiple base change or a deletion) can be introduced between the flanking regions of homology so that the additional or altered nucleic acid sequence also becomes incorporated into the target locus. MMEJ can result in a genetic outcome that is similar to NHEJ in that small deletions and insertions can occur at the cleavage site. MMEJ can make use of homologous sequences of a few basepairs flanking the cleavage site to drive a favored end-joining DNA repair outcome. In some instances it can be possible to predict likely repair outcomes based on analysis of potential microhomologies in the nuclease target regions.

Thus, in some cases, homologous recombination can be used to insert an exogenous polynucleotide sequence into the target nucleic acid cleavage site. An exogenous poly-nucleotide sequence is termed a donor polynucleotide (or donor or donor sequence) herein. The donor polynucleotide, a portion of the donor polynucleotide, a copy of the donor polynucleotide, or a portion of a copy of the donor poly-nucleotide can be inserted into the target nucleic acid cleavage site. The donor polynucleotide can be an exog-enous polynucleotide sequence, i.e., a sequence that does not naturally occur at the target nucleic acid cleavage site.

The modifications of the target DNA due to NHEJ and/or HDR can lead to, for example, mutations, deletions, altera-tions, integrations, gene correction, gene replacement, gene tagging, transgene insertion, nucleotide deletion, gene dis-ruption, translocations and/or gene mutation. The processes of deleting genomic DNA and integrating non-native nucleic acid into genomic DNA are examples of genome editing.

The site-directed polypeptide can comprise an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100%, amino acid sequence identity to a wild-type exemplary site-directed polypeptide [e.g., Cas9 from *S. pyogenes,* US2014/0068797 Sequence ID No. 8 or Sapranauskas et al., *Nucleic Acids Res,* 39 (21): 9275-9282 (2011)], and various other site-directed polypep-tides.

The site-directed polypeptide can comprise an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100%, amino acid sequence identity to the nuclease domain of a wild-type exemplary site-directed polypeptide (e.g., Cas9 from *S. pyogenes,* supra).

The site-directed polypeptide can comprise at least 70, 75, 80, 85, 90, 95, 97, 99, or 100% identity to a wild-type site-directed polypeptide (e.g., Cas9 from *S. pyogenes*, supra) over 10 contiguous amino acids. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids. The site-directed polypeptide can comprise at least: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. The site-directed polypeptide can comprise at least: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide.

The site-directed polypeptide can comprise a modified form of a wild-type exemplary site-directed polypeptide. The modified form of the wild-type exemplary site-directed polypeptide can comprise a mutation that reduces the nucleic acid-cleaving activity of the site-directed polypeptide. The modified form of the wild-type exemplary site-directed polypeptide can have less than 90%, less than 80%, less than 70%, less than 60%, less than 50%, less than 40%, less than 30%, less than 20%, less than 10%, less than 5%, or less than 1% of the nucleic acid-cleaving activity of the wild-type exemplary site-directed polypeptide (e.g., Cas9 from *S. pyogenes*, supra). The modified form of the site-directed polypeptide can have no substantial nucleic acid-cleaving activity. When a site-directed polypeptide is a modified form that has no substantial nucleic acid-cleaving activity, it is referred to herein as "enzymatically inactive".

The modified form of the site-directed polypeptide can comprise a mutation such that it can induce a SSB on a target nucleic acid (e.g., by cutting only one of the sugar-phosphate backbones of a double-strand target nucleic acid). The mutation can result in less than 90%, less than 80%, less than 70%, less than 60%, less than 50%, less than 40%, less than 30%, less than 20%, less than 10%, less than 5%, or less than 1% of the nucleic acid-cleaving activity in one or more of the plurality of nucleic acid-cleaving domains of the wild-type site directed polypeptide (e.g., Cas9 from *S. pyogenes*, supra). The mutation can result in one or more of the plurality of nucleic acid-cleaving domains retaining the ability to cleave the complementary strand of the target nucleic acid, but reducing its ability to cleave the non-complementary strand of the target nucleic acid. The mutation can result in one or more of the plurality of nucleic acid-cleaving domains retaining the ability to cleave the non-complementary strand of the target nucleic acid, but reducing its ability to cleave the complementary strand of the target nucleic acid. For example, residues in the wild-type exemplary *S. pyogenes* Cas9 polypeptide, such as Asp10, His840, Asn854 and Asn856 are mutated to inactivate one or more of the plurality of nucleic acid-cleaving domains (e.g., nuclease domains). The residues to be mutated can correspond to residues Asp10, His840, Asn854 and Asn856 in the wild-type exemplary *S. pyogenes* Cas9 polypeptide (e.g., as determined by sequence and/or structural alignment). Non-limiting examples of mutations can include D10A, H840A, N854A or N856A. One skilled in the art will recognize that mutations other than alanine substitutions can be suitable.

A D10A mutation can be combined with one or more of H840A, N854A, or N856A mutations to produce a site-directed polypeptide substantially lacking DNA cleavage activity. A H840A mutation can be combined with one or more of D10A, N854A, or N856A mutations to produce a site-directed polypeptide substantially lacking DNA cleavage activity. A N854A mutation can be combined with one or more of H840A, D10A, or N856A mutations to produce a site-directed polypeptide substantially lacking DNA cleavage activity. A N856A mutation can be combined with one or more of H840A, N854A, or D10A mutations to produce a site-directed polypeptide substantially lacking DNA cleavage activity. Site-directed polypeptides that comprise one substantially inactive nuclease domain are referred to herein as "nickases".

Nickase variants of RNA-guided endonucleases, for example Cas9, can be used to increase the specificity of CRISPR-mediated genome editing. Wild type Cas9 is typically guided by a single guide RNA designed to hybridize with a specified ~20 nucleotide sequence in the target sequence (such as an endogenous genomic locus). However, several mismatches can be tolerated between the guide RNA and the target locus, effectively reducing the length of required homology in the target site to, for example, as little as 13nt of homology, and thereby resulting in elevated potential for binding and double-strand nucleic acid cleavage by the CRISPR/Cas9 complex elsewhere in the target genome—also known as off-target cleavage. Because nickase variants of Cas9 each only cut one strand, in order to create a double-strand break it is necessary for a pair of nickases to bind in close proximity and on opposite strands of the target nucleic acid, thereby creating a pair of nicks, which is the equivalent of a double-strand break. This requires that two separate guide RNAs—one for each nickase—must bind in close proximity and on opposite strands of the target nucleic acid. This requirement essentially doubles the minimum length of homology needed for the double-strand break to occur, thereby reducing the likelihood that a double-strand cleavage event will occur elsewhere in the genome, where the two guide RNA sites—if they exist—are unlikely to be sufficiently close to each other to enable the double-strand break to form. As described in the art, nickases can also be used to promote HDR versus NHEJ. HDR can be used to introduce selected changes into target sites in the genome through the use of specific donor sequences that effectively mediate the desired changes. Descriptions of various CRISPR-Cas systems for use in gene editing can be found, e.g., in WO2013/176772, and in Nature Biotechnology 32, 347-355 (2014), and references cited therein.

Mutations contemplated can include substitutions, additions, and deletions, or any combination thereof. The mutation converts the mutated amino acid to alanine. The mutation converts the mutated amino acid to another amino acid (e.g., glycine, serine, threonine, cysteine, valine, leucine, isoleucine, methionine, proline, phenylalanine, tyrosine, tryptophan, aspartic acid, glutamic acid, asparagines, glutamine, histidine, lysine, or arginine). The mutation converts the mutated amino acid to a non-natural amino acid (e.g., selenomethionine). The mutation converts the mutated amino acid to amino acid mimics (e.g., phosphomimics). The mutation can be a conservative mutation. For example, the mutation can convert the mutated amino acid to amino acids that resemble the size, shape, charge, polarity, conformation, and/or rotamers of the mutated amino acids (e.g., cysteine/serine mutation, lysine/asparagine mutation, histidine/phenylalanine mutation). The mutation can cause a shift in reading frame and/or the creation of a premature stop codon. Mutations can cause changes to regulatory regions of genes or loci that affect expression of one or more genes.

The site-directed polypeptide (e.g., variant, mutated, enzymatically inactive and/or conditionally enzymatically inactive site-directed polypeptide) can target nucleic acid. The site-directed polypeptide (e.g., variant, mutated, enzymatically inactive and/or conditionally enzymatically inactive endoribonuclease) can target DNA. The site-directed polypeptide (e.g., variant, mutated, enzymatically inactive and/or conditionally enzymatically inactive endoribonuclease) can target RNA.

The site-directed polypeptide can comprise one or more non-native sequences (e.g., the site-directed polypeptide is a fusion protein).

The site-directed polypeptide can comprise an amino acid sequence comprising at least 15% amino acid identity to a Cas9 from a bacterium (e.g., *S. pyogenes*), a nucleic acid binding domain, and two nucleic acid cleaving domains (i.e., a HNH domain and a RuvC domain).

The site-directed polypeptide can comprise an amino acid sequence comprising at least 15% amino acid identity to a Cas9 from a bacterium (e.g., *S. pyogenes*), and two nucleic acid cleaving domains (i.e., a HNH domain and a RuvC domain).

The site-directed polypeptide can comprise an amino acid sequence comprising at least 15% amino acid identity to a Cas9 from a bacterium (e.g., *S. pyogenes*), and two nucleic acid cleaving domains, wherein one or both of the nucleic acid cleaving domains comprise at least 50% amino acid identity to a nuclease domain from Cas9 from a bacterium (e.g., *S. pyogenes*).

The site-directed polypeptide can comprise an amino acid sequence comprising at least 15% amino acid identity to a Cas9 from a bacterium (e.g., *S. pyogenes*), two nucleic acid cleaving domains (i.e., a HNH domain and a RuvC domain), and non-native sequence (for example, a nuclear localization signal) or a linker linking the site-directed polypeptide to a non-native sequence.

The site-directed polypeptide can comprise an amino acid sequence comprising at least 15% amino acid identity to a Cas9 from a bacterium (e.g., *S. pyogenes*), two nucleic acid cleaving domains (i.e., a HNH domain and a RuvC domain), wherein the site-directed polypeptide comprises a mutation in one or both of the nucleic acid cleaving domains that reduces the cleaving activity of the nuclease domains by at least 50%.

The site-directed polypeptide can comprise an amino acid sequence comprising at least 15% amino acid identity to a Cas9 from a bacterium (e.g., *S. pyogenes*), and two nucleic acid cleaving domains (i.e., a HNH domain and a RuvC domain), wherein one of the nuclease domains can comprise a mutation of aspartic acid 10, and/or wherein one of the nuclease domains can comprise a mutation of histidine 840, and wherein the mutation reduces the cleaving activity of the nuclease domain(s) by at least 50%.

The one or more site-directed polypeptides, e.g. DNA endonucleases, can comprise two nickases that together effect one double-strand break at a specific locus in the genome, or four nickases that together effect or cause two double-strand breaks at specific loci in the genome. Alternatively, one site-directed polypeptide, e.g. DNA endonuclease, can effect or cause one double-strand break at a specific locus in the genome.

The site-directed polypeptide can be flanked at the N-terminus, the C-terminus, or both the N-terminus and C-terminus by one or more nuclear localization signals (NLSs). For example, a Cas9 endonuclease can be flanked by two NLSs, one NLS located at the N-terminus and the second NLS located at the C-terminus. The NLS can be any NLS known in the art, such as a SV40 NLS.

Genome-Targeting Nucleic Acid

The present disclosure provides a genome-targeting nucleic acid that can direct the activities of an associated polypeptide (e.g., a site-directed polypeptide) to a specific target sequence within a target nucleic acid. The genome-targeting nucleic acid can be an RNA. A genome-targeting RNA is referred to as a "guide RNA" or "gRNA" herein. A guide RNA can comprise at least a spacer sequence that hybridizes to a target nucleic acid sequence of interest, and a CRISPR repeat sequence. In Type II systems, the gRNA also comprises a second RNA called the tracrRNA sequence. In the Type II guide RNA (gRNA), the CRISPR repeat sequence and tracrRNA sequence hybridize to each other to form a duplex. In the Type V guide RNA (gRNA), the crRNA forms a duplex. In both systems, the duplex can bind a site-directed polypeptide, such that the guide RNA and site-direct polypeptide form a complex. The genome-targeting nucleic acid can provide target specificity to the complex by virtue of its association with the site-directed polypeptide. The genome-targeting nucleic acid thus can direct the activity of the site-directed polypeptide.

Each genome-targeting nucleic acid (guide RNA or sgRNA) is designed to include a spacer sequence complementary to its genomic target sequence.

gRNA spacer sequences for targeting the human beta globin locus with a CRISPR/Cas9 endonuclease from *S. pyogenes* have been identified in SEQ ID NOs: 1-56,961 of the Sequence Listing.

gRNA spacer sequences for targeting the human beta globin locus with a CRISPR/Cas9 endonuclease from *S. aureus* have been identified in SEQ ID NOs: 56,962-64,104 of the Sequence Listing.

gRNA spacer sequences for targeting the human beta globin locus with a CRISPR/Cas9 endonuclease from *N. meningitides* have been identified in SEQ ID NOs: 64,105-66,258 of the Sequence Listing.

gRNA spacer sequences for targeting the human beta globin locus with a CRISPR/Cas9 endonuclease from *S. thermophilus* have been identified in SEQ ID NOs: 66,259-69,152 of the Sequence Listing.

gRNA spacer sequences for targeting the human beta globin locus with a CRISPR/Cas9 endonuclease from *T. denticola* have been identified in SEQ ID NOs: 69,153-70,300 of the Sequence Listing.

gRNA spacer sequences for targeting the human beta globin locus with a CRISPR/Cpf1 endonuclease from *Acidominococcus, Lachnospiracease*, and *Franciscell novicida* have been identified in SEQ ID NOs: 70,301-156,352 of the Sequence Listing.

The genome-targeting nucleic acid can be a double-molecule guide RNA. The genome-targeting nucleic acid can be a single-molecule guide RNA.

A double-molecule guide RNA can comprise two strands of RNA. The first strand comprises in the 5' to 3' direction, an optional spacer extension sequence, a spacer sequence and a minimum CRISPR repeat sequence. The second strand can comprise a minimum tracrRNA sequence (complementary to the minimum CRISPR repeat sequence), a 3' tracrRNA sequence and an optional tracrRNA extension sequence.

A single-molecule guide RNA (sgRNA) in a Type II system can comprise in the 5' to 3' direction, an optional spacer extension sequence, a spacer sequence, a minimum CRISPR repeat sequence, a single-molecule guide linker, a minimum tracrRNA sequence, a 3' tracrRNA sequence and an optional tracrRNA extension sequence. The optional tracrRNA extension can comprise elements that contribute additional functionality (e.g., stability) to the guide RNA. The single-molecule guide linker can link the minimum CRISPR repeat and the minimum tracrRNA sequence to form a hairpin structure. The optional tracrRNA extension can comprise one or more hairpins.

A single-molecule guide RNA (sgRNA) in a Type V system can comprise, in the 5' to 3' direction, a minimum CRISPR repeat sequence and a spacer sequence.

The sgRNA can comprise a 20 nucleotide spacer sequence at the 5' end of the sgRNA sequence. The sgRNA can comprise a less than a 20 nucleotide spacer sequence at the 5' end of the sgRNA sequence. The sgRNA can comprise a more than 20 nucleotide spacer sequence at the 5' end of the sgRNA sequence. The sgRNA can comprise a variable length spacer sequence with 17-30 nucleotides at the 5' end of the sgRNA sequence (see Table 1).

The sgRNA can comprise no uracil at the 3'end of the sgRNA sequence, such as in SEQ ID NO: 228,303 of Table 1. The sgRNA can comprise one or more uracil at the 3'end of the sgRNA sequence, such as in SEQ ID NO: 228,304 in Table 1. For example, the sgRNA can comprise 1 uracil (U) at the 3' end of the sgRNA sequence. The sgRNA can comprise 2 uracil (UU) at the 3' end of the sgRNA sequence. The sgRNA can comprise 3 uracil (UUU) at the 3' end of the sgRNA sequence. The sgRNA can comprise 4 uracil (UUUU) at the 3' end of the sgRNA sequence. The sgRNA can comprise 5 uracil (UUUUU) at the 3' end of the sgRNA sequence. The sgRNA can comprise 6 uracil (UUUUUU) at the 3' end of the sgRNA sequence. The sgRNA can comprise 7 uracil (UUUUUUU) at the 3' end of the sgRNA sequence. The sgRNA can comprise 8 uracil (UUUUUUUU) at the 3' end of the sgRNA sequence.

The sgRNA can be unmodified or modified. For example, modified sgRNAs can comprise one or more 2'-O-methyl phosphorothioate nucleotides.

TABLE 1

| SEQ ID NO. | sgRNA sequence |
|---|---|
| 228, 302 | nnnnnnnnnnnnnnnnnnnnnguuuuagagcuagaaauagc aaguuaaaauaaggcuaguccguuaucaacuugaaaaag uggcaccgagucggugcuuuu |
| 228, 303 | nnnnnnnnnnnnnnnnnnnnnguuuuagagcuagaaauagc aaguuaaaauaaggcuaguccguuaucaacuugaaaaag uggcaccgagucggugc |
| 228, 304 | $n_{(17-30)}$guuuuagagcuagaaauagcaaguuaaaaua aggcuaguccguuaucaacuugaaaaaguggcaccgag ucggugcu$_{(1-8)}$ |

A gRNA may be a HPFH5 gRNA, e.g., HPFH5-1, HPFH5-D, HPFH5-T5, or HPFH5-T7, or a Kenya gRNA, e.g., Kenya-K5, Kenya-K17, a 1450 gRNA, a SPY101 gRNA, or a SD2 gRNA. A gRNA may be as described in Table 2.

TABLE 2

| Name | SEQ ID NO. | gRNA sequence |
|---|---|---|
| SD2 | 228, 428 | csususGUCAAGGCUAUUGGUCAGUUUUAG AGCUAGAAAUAGCAAGUUAAAAUAAGGCUA GUCCGUUAUCAACUUGAAAAAGUGGCACCG AGUCGGUGCusususU |
| SPY101 | 228, 429 | csusasACAGUUGCUUUUAUCACGUUUUAG AGCUAGAAAUAGCAAGUUAAAAUAAGGCUA GUCCGUUAUCAACUUGAAAAAGUGGCACCG AGUCGGUGCusususU |
| 1450 | 228, 430 | usgscsUUGGUCGGCACUGAUAGGGUUUUAG AGCUAGAAAUAGCAAGUUAAAAUAAGGCUA GUCCGUUAUCAACUUGAAAAAGUGGCACCG AGUCGGUGCusususU |
| HPFH5-1 | 228, 431 | asususUUUCUUAUUCAAUACCUGUUUUAG AGCUAGAAAUAGCAAGUUAAAAUAAGGCUA GUCCGUUAUCAACUUGAAAAAGUGGCACCG AGUCGGUGCusususU |
| HPFH5-D | 228, 432 | csusgsUUGGUUUCAGAGCAGGUGUUUUAG AGCUAGAAAUAGCAAGUUAAAAUAAGGCUA GUCCGUUAUCAACUUGAAAAAGUGGCACCG AGUCGGUGCusususU |
| HPFH5-T5 | 228, 433 | csuscsCCCCACUCACAGUGACCGUUUUAG AGCUAGAAAUAGCAAGUUAAAAUAAGGCUA GUCCGUUAUCAACUUGAAAAAGUGGCACCG AGUCGGUGCusususU |
| HPFH5-T7 | 228, 434 | asasusCUGCAGUGCUAGUCUCCGUUUUAG AGCUAGAAAUAGCAAGUUAAAAUAAGGCUA GUCCGUUAUCAACUUGAAAAAGUGGCACCG AGUCGGUGCusususU |
| Kenya-K17 | 228, 312 228, 435 | gsususAAGUUCAUGUCAUAGGAGUUUUAG AGCUAGAAAUAGCAAGUUAAAAUAAGGCUA GUCCGUUAUCAACUUGAAAAAGUGGCACCG AGUCGGUGCusususU |
| Kenya-K5 | 228, 436 | cscsasGUGACUAGUGCUUGAAGGUUUUAG AGCUAGAAAUAGCAAGUUAAAAUAAGGCUA GUCCGUUAUCAACUUGAAAAAGUGGCACCG AGUCGGUGCusususU | a, c, g, u: 2'-0-methyl residues
s: phosphorothioate
A, C, G, U: RNA residues

In some embodiments, two or more gRNAs are provided. In some embodiments, the two or more gRNAs are two or more gRNAs provided in Table 2. In some embodiments, the two or more gRNAs comprise at least one SPY101 gRNA in combination with at least one HPFH5 gRNA. In some embodiments, the two or more gRNAs comprise a SPY101 gRNA in combination with a HPFH5-1 gRNA. In some embodiments, the two or more gRNAs comprise a SPY101 gRNA in combination with a HPFH5-D gRNA. In some embodiments, the two or more gRNAs comprise SPY101 gRNA in combination with a HPFH5-T5 gRNA. In some embodiments, the two or more gRNAs comprise a SPY101 gRNA in combination with a HPFH5-T7 gRNA. In some embodiments, the two or more gRNAs comprise at least one SPY101 gRNA in combination with at least one Kenya gRNA. In some embodiments, the two or more gRNAs comprise a SPY101 gRNA in combination with a Kenya-K5 gRNA. In some embodiments, the two or more gRNAs comprise a SPY101 gRNA in combination with a Kenya-K17 gRNA. In some embodiments, the two or more gRNAs comprise a SPY101 gRNA in combination with HPFH5-1 and HPFH5-D gRNAs. In some embodiments, the two or more gRNAs comprise a SPY101 gRNA in combination with HPFH5-T7 and HPFH5-D gRNAs. In some embodiments, the two or more gRNAs comprise a SPY101 gRNA in combination with HPFH5-T5 and HPFH5-1 gRNAs. In some embodiments, the two or more gRNAs comprise a SPY101 gRNA in combination with Kenya-K5 and Kenya-K17 gRNAs. In some embodiments, the two or more gRNAs comprise a SPY101 gRNA in combination with a SD2 gRNA. In some embodiments, the two or more gRNAs comprise at least one 1450 gRNA in combination with at least one HPFH5 gRNA. In some embodiments, the two or more gRNAs comprise a 1450 gRNA in combination with a HPFH5-1 gRNA. In some embodiments, the two or more gRNAs comprise a 1450 gRNA in combination with a HPFH5-D gRNA. In some embodiments, the two or more gRNAs comprise a 1450 gRNA in combination with a HPFH5-T5 gRNA. In some embodiments, the two or more gRNAs comprise a 1450 gRNA in combination with a HPFH5-T7 gRNA. In some embodiments, the two or more gRNAs comprise at least one 1450 gRNA in combination with at least one Kenya gRNA. In some embodiments, the two or more gRNAs comprise a 1450 gRNA in combination with a Kenya-K5 gRNA. In some embodiments, the two or more gRNAs comprise a 1450 gRNA in combination with a Kenya-K17 gRNA. In some embodiments, the two or more gRNAs comprise a 1450 gRNA in combination with HPFH5-1 and HPFH5-D gRNAs. In some embodiments, the two or more gRNAs comprise a 1450 gRNA in combination with HPFH5-T7 and HPFH5-D gRNAs. In some embodiments, the two or more gRNAs comprise a 1450 gRNA in combination with HPFH5-T5 and HPFH5-1 gRNAs. In some embodiments, the two or more gRNAs comprise a 1450 gRNA in combination with Kenya-K5 and Kenya-K17 gRNAs. In some embodiments, the two or more gRNAs comprise a 1450 gRNA in combination with a SD2 gRNA. In some embodiments, the two or more gRNAs comprise at least one of a HPFH5-1, HPFH5-D, HPFH5-T5, HPFH5-T7, Kenya-K5, or Kenya-K1 gRNA in combination with at least one additional HPFH5-1, HPFH5-D, HPFH5-T5, HPFH5-T7, Kenya-K5, or Kenya-K1 gRNA. In some embodiments, the two or more gRNAs comprise a HPFH5-1 gRNA in combination with a HPFH5-1, HPFH5-D, HPFH5-T5, HPFH5-T7, Kenya-K5, or Kenya-K1 gRNA. In some embodiments, the two or more gRNAs comprise a HPFH5-D gRNA in combination with a HPFH5-1, HPFH5-D, HPFH5-T5, HPFH5-T7, Kenya-K5, or Kenya-K1 gRNA. In some embodiments, the two or more gRNAs comprise a HPFH5-T5 gRNA in combination with a HPFH5-1, HPFH5-D, HPFH5-T5, HPFH5-T7, Kenya-K5, or Kenya-K1 gRNA. In some embodiments, the two or more gRNAs comprise a HPFH5-T7 gRNA in combination with a HPFH5-1, HPFH5-D, HPFH5-T5, HPFH5-T7, Kenya-K5, or Kenya-K1 gRNA.

By way of illustration, guide RNAs used in the CRISPR/Cas/Cpf1 system, or other smaller RNAs can be readily synthesized by chemical means as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

Concatenated gRNAs

A concatenated gRNA comprising a first gRNA and second gRNA can be used to introduce a deletion, inversion, or mutation within or near a human beta globin locus on chromosome 11 and within or near one or more of: a BCL11A gene on chromosome 2, and a DNA sequence that harbors a transcriptional control region of the BCL11A gene on chromosome 2. The first gRNA can comprise a gRNA specific for the human beta globin locus, as described in Examples 1-6 and disclosed in the Sequence Listing. The second gRNA can comprise a gRNA specific for the BCL11A gene or a DNA sequence that encodes a transcriptional control region of the BCL11A gene, as described in Examples 14-19 or the Figures; and disclosed in the Sequence Listing.

A concatenated gRNA comprising a first gRNA, a second gRNA, and a third gRNA can be used to introduce a deletion, inversion, or mutation within or near a human beta globin locus on chromosome 11 and within or near one or more of: a BCL11A gene on chromosome 2, and a DNA sequence that encodes a transcriptional control region of the BCL11A gene on chromosome 2. The first gRNA can comprise a gRNA specific for the human beta globin locus, as described in Examples 1-6 and disclosed in the Sequence Listing. The second gRNA can comprise a gRNA specific for the human beta globin locus, as described in Examples 1-6 and disclosed in the Sequence Listing. The third gRNA can comprise a gRNA specific for the BCL11A gene or a DNA sequence that encodes a transcriptional control region of the BCL11A gene, as described in Examples 14-19 or the Figures; and disclosed in the Sequence Listing.

A concatenated gRNA comprising a first gRNA, a second gRNA, and a third gRNA can be used to introduce a deletion, inversion, or mutation within or near a human beta globin locus on chromosome 11 and within or near one or more of: a BCL11A gene on chromosome 2, and a DNA sequence that encodes a transcriptional control region of the BCL11A gene on chromosome 2. The first gRNA can comprise a gRNA specific for the human beta globin locus, as described in Examples 1-6 and disclosed in the Sequence Listing. The second gRNA can comprise a gRNA specific for the BCL11A gene or a DNA sequence that encodes a transcriptional control region of the BCL11A gene, as described in Examples 14-19 or the Figures; and disclosed in the Sequence Listing. The third gRNA can comprise a gRNA specific for the BCL11A gene or a DNA sequence that encodes a transcriptional control region of the BCL11A gene, as described in Examples 14-19 or the Figures; and disclosed in the Sequence Listing.

In some embodiments, a concatenated gRNA may comprise a HPFH5 gRNA, e.g., HPFH5-1, HPFH5-D, HPFH5-T5, or HPFH5-T7, a Kenya gRNA, e.g., Kenya-K5, Kenya-K17, a 1450 gRNA, a SPY101 gRNA, or a SD2 gRNA. In some embodiments, a concatenated gRNA may comprise a gRNA as described in Table 2. In some embodiments, a concatenated gRNA may comprise at least one SPY101 gRNA in combination with at least one HPFH5 gRNA. In some embodiments, a concatenated gRNA may comprise a SPY101 gRNA in combination with a HPFH5-1 gRNA. In some embodiments, a concatenated gRNA may comprise a SPY101 gRNA in combination with a HPFH5-D gRNA. In some embodiments, a concatenated gRNA may comprise a SPY101 gRNA in combination with a HPFH5-T5 gRNA. In some embodiments, a concatenated gRNA may comprise a SPY101 gRNA in combination with a HPFH5-T7 gRNA. In some embodiments, a concatenated gRNA may comprise at least one SPY101 gRNA in combination with at least one Kenya gRNA. In some embodiments, a concatenated gRNA may comprise a SPY101 gRNA in combination with a Kenya-K5 gRNA. In some embodiments, a concatenated gRNA may comprise a SPY101 gRNA in combination with a Kenya-K17 gRNA. In some embodiments, a concatenated gRNA may comprise a SPY101 gRNA in combination with HPFH5-1 and HPFH5-D gRNAs. In some embodiments, a concatenated gRNA may comprise a SPY101 gRNA in combination with HPFH5-T7 and HPFH5-D gRNAs. In some embodiments, a concatenated gRNA may comprise a SPY101 gRNA in combination with HPFH5-T5 and HPFH5-1 gRNAs. In some embodiments, a concatenated gRNA may comprise a SPY101 gRNA in combination with Kenya-K5 and Kenya-K17 gRNAs. In some embodiments, a concatenated gRNA may comprise a SPY101 gRNA in combination with a SD2 gRNA. In some embodiments, a concatenated gRNA may comprise at least one 1450 gRNA in combination with at least one HPFH5 gRNA. In some embodiments, a concatenated gRNA may comprise a 1450 gRNA in combination with a HPFH5-1 gRNA. In some embodiments, a concatenated gRNA may comprise a 1450 gRNA in combination with a HPFH5-D gRNA. In some embodiments, a concatenated gRNA may comprise a 1450 gRNA in combination with a HPFH5-T5 gRNA. In some embodiments, a concatenated gRNA may comprise a 1450 gRNA in combination with a HPFH5-T7 gRNA. In some embodiments, a concatenated gRNA may comprise at least one 1450 gRNA in combination with at least one Kenya gRNA. In some embodiments, a concatenated gRNA may comprise a 1450 gRNA in combination with a Kenya-K5 gRNA. In some embodiments, a concatenated gRNA may comprise a 1450 gRNA in combination with a Kenya-K17 gRNA. In some embodiments, a concatenated gRNA may comprise a 1450 gRNA in combination with HPFH5-1 and HPFH5-D gRNAs. In some embodiments, a concatenated gRNA may comprise a 1450 gRNA in combination with HPFH5-T7 and HPFH5-D gRNAs. In some embodiments, a concatenated gRNA may comprise a 1450 gRNA in combination with HPFH5-T5 and HPFH5-1 gRNAs. In some embodiments, a concatenated gRNA may comprise a 1450 gRNA in combination with Kenya-K5 and Kenya-K17 gRNAs. In some embodiments, a concatenated gRNA may comprise a 1450 gRNA in combination with a SD2 gRNA. In some embodiments, a concatenated gRNA may comprise at least one of a HPFH5-1, HPFH5-D, HPFH5-T5, HPFH5-T7, Kenya-K5, or Kenya-K1 gRNA in combination with at least one additional HPFH5-1, HPFH5-D, HPFH5-T5, HPFH5-T7, Kenya-K5, or Kenya-K1 gRNA. In some embodiments, a concatenated gRNA may comprise a HPFH5-1 gRNA in combination with a HPFH5-1, HPFH5-D, HPFH5-T5, HPFH5-T7, Kenya-K5, or Kenya-K1 gRNA. In some embodiments, a concatenated gRNA may comprise a HPFH5-D gRNA in combination with a HPFH5-1, HPFH5-D, HPFH5-T5, HPFH5-T7, Kenya-K5, or Kenya-K1 gRNA. In some embodiments, a concatenated gRNA may comprise a HPFH5-T5 gRNA in combination with a HPFH5-1, HPFH5-D, HPFH5-T5, HPFH5-T7, Kenya-K5, or Kenya-K1 gRNA. In some embodiments, a concatenated gRNA may comprise a HPFH5-T7 gRNA in combination with a HPFH5-1, HPFH5-D, HPFH5-T5, HPFH5-T7, Kenya-K5, or Kenya-K1 gRNA.

Two or More Concatenated gRNAs

Two or more concatenated gRNAs can be used simultaneously to introduce a deletion, inversion, or mutation within or near a human beta globin locus on chromosome 11 and within or near one or more of: a BCL11A gene on chromosome 2, and a DNA sequence that encodes a transcriptional control region of the BCL11A gene on chromosome 2. The first concatenated gRNA comprises a first gRNA and a second gRNA. The first gRNA of the first concatenated gRNA can comprise a gRNA specific for the human beta globin locus, as described in Examples 1-6 and disclosed in the Sequence Listing. The second gRNA of the first concatenated gRNA can comprise a gRNA specific for the BCL11A gene or a DNA sequence that encodes a transcriptional control region of the BCL11A gene, as described in Examples 14-19 or the Figures; and disclosed in the Sequence Listing. The second concatenated gRNA comprises a first gRNA and a second gRNA. The first gRNA of the second concatenated gRNA can comprise a gRNA specific for the human beta globin locus, as described in Examples 1-6 and disclosed in the Sequence Listing. The second gRNA of the second concatenated gRNA can comprise a gRNA specific for the BCL11A gene or a DNA sequence that encodes a transcriptional control region of the BCL11A gene, as described in Examples 14-19 of the Figures; and disclosed in the Sequence Listing.

Two or more concatenated gRNAs can be used to introduce a deletion, inversion, or mutation within or near a human beta globin locus on chromosome 11 and within or near one or more of: a BCL11A gene on chromosome 2, and a DNA sequence that encodes a transcriptional control region of the BCL11A gene on chromosome 2. The first concatenated gRNA comprises a first gRNA and a second gRNA. The first gRNA of the first concatenated gRNA can comprise a gRNA specific for the human beta globin locus, as described in Examples 1-6 and disclosed in the Sequence Listing. The second gRNA of the first concatenated gRNA can comprise a gRNA specific for the human beta globin locus, as described in Examples 1-6 and disclosed in the Sequence Listing. The second concatenated gRNA comprises a first gRNA and a second gRNA. The first gRNA of the second concatenated gRNA can comprise a gRNA specific for the BCL11A gene or a DNA sequence that encodes a transcriptional control region of the BCL11A gene, as described in Examples 14-19 or the Figures; and disclosed in the Sequence Listing. The second gRNA of the second concatenated gRNA can comprise a gRNA specific for the BCL11A gene or a DNA sequence that encodes a transcriptional control region of the BCL11A gene, as described in Examples 14-19 of the Figures; and disclosed in the Sequence Listing.

Spacer Extension Sequence

Examples of genome-targeting nucleic acids, a spacer extension sequence can modify activity, provide stability and/or provide a location for modifications of a genome-targeting nucleic acid. A spacer extension sequence can modify on- or off-target activity or specificity. In some examples, a spacer extension sequence can be provided. The spacer extension sequence can have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, or 7000 or more nucleotides. The spacer extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, 7000 or more nucleotides. The spacer extension sequence can comprise less than 10 nucleotides in length. The spacer extension sequence can comprise between 10-30 nucleotides in length. The spacer extension sequence can comprise between 30-70 nucleotides in length.

The spacer extension sequence can comprise another moiety (e.g., a stability control sequence, an endoribonuclease binding sequence, a ribozyme). The moiety can decrease or increase the stability of a nucleic acid targeting nucleic acid. The moiety can be a transcriptional terminator segment (i.e., a transcription termination sequence). The moiety can function in a eukaryotic cell. The moiety can function in a prokaryotic cell. The moiety can function in both eukaryotic and prokaryotic cells.

Non-limiting examples of suitable moieties include: a 5' cap (e.g., a 7-methylguanylate cap (m7 G)), a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like).

Spacer Sequence

The spacer sequence hybridizes to a sequence in a target nucleic acid of interest. The spacer of a genome-targeting nucleic acid can interact with a target nucleic acid in a sequence-specific manner via hybridization (i.e., base pairing). The nucleotide sequence of the spacer can vary depending on the sequence of the target nucleic acid of interest.

In a CRISPR/Cas system herein, the spacer sequence can be designed to hybridize to a target nucleic acid that is located 5' of a PAM of the Cas9 enzyme used in the system. The spacer can perfectly match the target sequence or can have mismatches. Each Cas9 enzyme has a particular PAM sequence that it recognizes in a target DNA. For example, *S. pyogenes* recognizes in a target nucleic acid a PAM that comprises the sequence 5'-NRG-3', where R comprises either A or G, where N is any nucleotide and N is immediately 3' of the target nucleic acid sequence targeted by the spacer sequence.

The target nucleic acid sequence can comprise 20 nucleotides. The target nucleic acid can comprise less than 20 nucleotides. The target nucleic acid can comprise more than 20 nucleotides. The target nucleic acid can comprise at least: 5, 10, 15, 16, 17, 18, 19, 20, 21, 22, 23, 24, 25, 30 or more nucleotides. The target nucleic acid can comprise at most: 5, 10, 15, 16, 17, 18, 19, 20, 21, 22, 23, 24, 25, 30 or more nucleotides. The target nucleic acid sequence can comprise 20 bases immediately 5' of the first nucleotide of the PAM. For example, in a sequence comprising 5'-NNNNNNNNNNNNNNNNNNNNNRG-3' (SEQ ID NO 228,301), the target nucleic acid can comprise the sequence that corresponds to the Ns, wherein N is any nucleotide, and the underlined NRG sequence is the *S. pyogenes* PAM.

The spacer sequence that hybridizes to the target nucleic acid can have a length of at least about 6 nucleotides (nt). The spacer sequence can be at least about 6 nt, at least about 10 nt, at least about 15 nt, at least about 18 nt, at least about 19 nt, at least about 20 nt, at least about 25 nt, at least about 30 nt, at least about 35 nt or at least about 40 nt, from about 6 nt to about 80 nt, from about 6 nt to about 50 nt, from about 6 nt to about 45 nt, from about 6 nt to about 40 nt, from about 6 nt to about 35 nt, from about 6 nt to about 30 nt, from about 6 nt to about 25 nt, from about 6 nt to about 20 nt, from about 6 nt to about 19 nt, from about 10 nt to about 50 nt, from about 10 nt to about 45 nt, from about 10 nt to about 40 nt, from about 10 nt to about 35 nt, from about 10 nt to about 30 nt, from about 10 nt to about 25 nt, from about 10 nt to about 20 nt, from about 10 nt to about 19 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. In some examples, the spacer sequence can comprise 20 nucleotides. In some examples, the spacer can comprise 19 nucleotides.

In some examples, the percent complementarity between the spacer sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some examples, the percent complementarity between the spacer sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some examples, the percent complementarity between the spacer sequence and the target nucleic acid is 100% over the six contiguous 5'-most nucleotides of the target sequence of the complementary strand of the target nucleic acid. The percent complementarity between the spacer sequence and the target nucleic acid can be at least 60% over about 20 contiguous nucleotides. The length of the spacer sequence and the target nucleic acid can differ by 1 to 6 nucleotides, which may be thought of as a bulge or bulges.

The spacer sequence can be designed or chosen using a computer program. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like.

Minimum CRISPR Repeat Sequence

A minimum CRISPR repeat sequence can be a sequence with at least: about 30%, about 40%, about 50%, about 60%, about 65%, about 70%, about 75%, about 80%, about 85%, about 90%, about 95%, or 100% sequence identity to a reference CRISPR repeat sequence (e.g., crRNA from *S. pyogenes*).

A minimum CRISPR repeat sequence can comprise nucleotides that can hybridize to a minimum tracrRNA sequence in a cell. The minimum CRISPR repeat sequence and a minimum tracrRNA sequence can form a duplex, i.e. a base-paired double-stranded structure. Together, the minimum CRISPR repeat sequence and the minimum tracrRNA sequence can bind to the site-directed polypeptide. At least a part of the minimum CRISPR repeat sequence can hybridize to the minimum tracrRNA sequence. At least a part of the minimum CRISPR repeat sequence can comprise at least: about 30%, about 40%, about 50%, about 60%, about 65%, about 70%, about 75%, about 80%, about 85%, about 90%, about 95%, or 100% complementary to the minimum tracrRNA sequence. At least a part of the minimum CRISPR repeat sequence can comprise at most: about 30%, about 40%, about 50%, about 60%, about 65%, about 70%, about 75%, about 80%, about 85%, about 90%, about 95%, or 100% complementary to the minimum tracrRNA sequence.

The minimum CRISPR repeat sequence can have a length from about 7 nucleotides to about 100 nucleotides. For example, the length of the minimum CRISPR repeat sequence is from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some examples, the minimum CRISPR repeat sequence can be approximately 9 nucleotides in length. The minimum CRISPR repeat sequence can be approximately 12 nucleotides in length.

The minimum CRISPR repeat sequence can be at least about 60% identical to a reference minimum CRISPR repeat sequence (e.g., wild-type crRNA from *S. pyogenes*) over a stretch of at least 6, 7, or 8 contiguous nucleotides. For example, the minimum CRISPR repeat sequence can be at least about 65% identical, at least about 70% identical, at least about 75% identical, at least about 80% identical, at least about 85% identical, at least about 90% identical, at least about 95% identical, at least about 98% identical, at least about 99% identical or 100% identical to a reference minimum CRISPR repeat sequence over a stretch of at least 6, 7, or 8 contiguous nucleotides.

Minimum tracrRNA Sequence

A minimum tracrRNA sequence can be a sequence with at least: about 30%, about 40%, about 50%, about 60%, about 65%, about 70%, about 75%, about 80%, about 85%, about 90%, about 95%, or 100% sequence identity to a reference tracrRNA sequence (e.g., wild type tracrRNA from *S. pyogenes*).

A minimum tracrRNA sequence can comprise nucleotides that hybridize to a minimum CRISPR repeat sequence in a cell. A minimum tracrRNA sequence and a minimum CRISPR repeat sequence form a duplex, i.e. a base-paired double-stranded structure. Together, the minimum tracrRNA sequence and the minimum CRISPR repeat can bind to a site-directed polypeptide. At least a part of the minimum tracrRNA sequence can hybridize to the minimum CRISPR repeat sequence. The minimum tracrRNA sequence can be at least: about 30%, about 40%, about 50%, about 60%, about 65%, about 70%, about 75%, about 80%, about 85%, about 90%, about 95%, or 100% complementary to the minimum CRISPR repeat sequence.

The minimum tracrRNA sequence can have a length from about 7 nucleotides to about 100 nucleotides. For example, the minimum tracrRNA sequence can be from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt long. The minimum tracrRNA sequence can be approximately 9 nucleotides in length. The minimum tracrRNA sequence can be approximately 12 nucleotides. The minimum tracrRNA can consist of tracrRNA 23-48 nt described in Jinek et al., supra.

The minimum tracrRNA sequence can be at least about 60% identical to a reference minimum tracrRNA (e.g., wild type, tracrRNA from *S. pyogenes*) sequence over a stretch of at least: 6, 7, or 8 contiguous nucleotides. For example, the minimum tracrRNA sequence can be at least: about 65% identical, about 70% identical, about 75% identical, about 80% identical, about 85% identical, about 90% identical, about 95% identical, about 98% identical, about 99% identical or 100% identical to a reference minimum tracrRNA sequence over a stretch of at least: 6, 7, or 8 contiguous nucleotides.

The duplex between the minimum CRISPR RNA and the minimum tracrRNA can comprise a double helix. The duplex between the minimum CRISPR RNA and the minimum tracrRNA can comprise at least about: 1, 2, 3, 4, 5, 6, 7, 8, 9, or 10 or more nucleotides. The duplex between the minimum CRISPR RNA and the minimum tracrRNA can comprise at most about: 1, 2, 3, 4, 5, 6, 7, 8, 9, or 10 or more nucleotides.

The duplex can comprise a mismatch (i.e., the two strands of the duplex are not 100% complementary). The duplex can comprise at least about: 1, 2, 3, 4, or 5 or mismatches. The duplex can comprise at most about: 1, 2, 3, 4, or 5 or mismatches. The duplex can comprise no more than 2 mismatches.

Bulges

In some cases, there can be a "bulge" in the duplex between the minimum CRISPR RNA and the minimum tracrRNA. A bulge is an unpaired region of nucleotides within the duplex. A bulge can contribute to the binding of the duplex to the site-directed polypeptide. The bulge can comprise, on one side of the duplex, an unpaired 5'-XXXY-3' where X is any purine and Y comprises a nucleotide that can form a wobble pair with a nucleotide on the opposite strand, and an unpaired nucleotide region on the other side of the duplex. The number of unpaired nucleotides on the two sides of the duplex can be different.

In one example, the bulge can comprise an unpaired purine (e.g., adenine) on the minimum CRISPR repeat strand of the bulge. In some examples, the bulge can comprise an unpaired 5'-AAGY-3' of the minimum tracrRNA sequence strand of the bulge, where Y comprises a nucleotide that can form a wobble pairing with a nucleotide on the minimum CRISPR repeat strand.

A bulge on the minimum CRISPR repeat side of the duplex can comprise at least: 1, 2, 3, 4, or 5 or more unpaired nucleotides. A bulge on the minimum CRISPR repeat side of the duplex can comprise at most: 1, 2, 3, 4, or 5 or more unpaired nucleotides. A bulge on the minimum CRISPR repeat side of the duplex can comprise 1 unpaired nucleotide.

A bulge on the minimum tracrRNA sequence side of the duplex can comprise at least: 1, 2, 3, 4, 5, 6, 7, 8, 9, or 10 or more unpaired nucleotides. A bulge on the minimum tracrRNA sequence side of the duplex can comprise at most: 1, 2, 3, 4, 5, 6, 7, 8, 9, or 10 or more unpaired nucleotides. A bulge on a second side of the duplex (e.g., the minimum tracrRNA sequence side of the duplex) can comprise 4 unpaired nucleotides.

A bulge can comprise at least one wobble pairing. A bulge can comprise at most one wobble pairing. A bulge can comprise at least one purine nucleotide. A bulge can comprise at least 3 purine nucleotides. A bulge sequence can comprise at least 5 purine nucleotides. A bulge sequence can comprise at least one guanine nucleotide. A bulge sequence can comprise at least one adenine nucleotide.

Hairpins

In various examples, one or more hairpins can be located 3' to the minimum tracrRNA in the 3' tracrRNA sequence.

The hairpin can start at least about: 1, 2, 3, 4, 5, 6, 7, 8, 9, 10, 15, or 20 or more nucleotides 3' from the last paired nucleotide in the minimum CRISPR repeat and minimum tracrRNA sequence duplex. The hairpin can start at most about: 1, 2, 3, 4, 5, 6, 7, 8, 9 or 10 or more nucleotides 3' of the last paired nucleotide in the minimum CRISPR repeat and minimum tracrRNA sequence duplex.

The hairpin can comprise at least about: 1, 2, 3, 4, 5, 6, 7, 8, 9, 10, 15, or 20 or more consecutive nucleotides. The hairpin can comprise at most about: 1, 2, 3, 4, 5, 6, 7, 8, 9, 10, 15, or more consecutive nucleotides.

The hairpin can comprise a CC dinucleotide (i.e., two consecutive cytosine nucleotides).

The hairpin can comprise duplexed nucleotides (e.g., nucleotides in a hairpin, hybridized together). For example, a hairpin can comprise a CC dinucleotide that is hybridized to a GG dinucleotide in a hairpin duplex of the 3' tracrRNA sequence.

One or more of the hairpins can interact with guide RNA-interacting regions of a site-directed polypeptide.

In some examples, there are two or more hairpins, and in other examples there are three or more hairpins.

3' tracrRNA Sequence

A 3' tracrRNA sequence can comprise a sequence with at least: about 30%, about 40%, about 50%, about 60%, about 65%, about 70%, about 75%, about 80%, about 85%, about 90%, about 95%, or 100% sequence identity to a reference tracrRNA sequence (e.g., a tracrRNA from *S. pyogenes*).

The 3' tracrRNA sequence can have a length from about 6 nucleotides to about 100 nucleotides. For example, the 3' tracrRNA sequence can have a length of from about 6 nucleotides (nt) to about 50 nt, from about 6 nt to about 40 nt, from about 6 nt to about 30 nt, from about 6 nt to about 25 nt, from about 6 nt to about 20 nt, from about 6 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. The 3' tracrRNA sequence can have a length of approximately 14 nucleotides.

The 3' tracrRNA sequence can be at least about 60% identical to a reference 3' tracrRNA sequence (e.g., wild type 3' tracrRNA sequence from *S. pyogenes*) over a stretch of at least: 6, 7, or 8 contiguous nucleotides. For example, the 3' tracrRNA sequence can be at least: about 60% identical, about 65% identical, about 70% identical, about 75% identical, about 80% identical, about 85% identical, about 90% identical, about 95% identical, about 98% identical, about 99% identical, or 100% identical, to a reference 3' tracrRNA sequence (e.g., wild type 3' tracrRNA sequence from *S. pyogenes*) over a stretch of at least 6, 7, or 8 contiguous nucleotides.

The 3' tracrRNA sequence can comprise more than one duplexed region (e.g., hairpin, hybridized region). The 3' tracrRNA sequence can comprise two duplexed regions.

The 3' tracrRNA sequence can comprise a stem loop structure. The stem loop structure in the 3' tracrRNA can comprise at least: 1, 2, 3, 4, 5, 6, 7, 8, 9, 10, 15 or 20 or more nucleotides. The stem loop structure in the 3' tracrRNA can comprise at most: 1, 2, 3, 4, 5, 6, 7, 8, 9 or 10 or more nucleotides. The stem loop structure can comprise a functional moiety. For example, the stem loop structure can comprise an aptamer, a ribozyme, a protein-interacting hairpin, a CRISPR array, an intron, or an exon. The stem loop structure can comprise at least about: 1, 2, 3, 4, or 5 or more functional moieties. The stem loop structure can comprise at most about: 1, 2, 3, 4, or 5 or more functional moieties.

The hairpin in the 3' tracrRNA sequence can comprise a P-domain. In some examples, the P-domain can comprise a double-stranded region in the hairpin.

tracrRNA Extension Sequence

A tracrRNA extension sequence may be provided whether the tracrRNA is in the context of single-molecule guides or double-molecule guides. The tracrRNA extension sequence can have a length from about 1 nucleotide to about 400 nucleotides. The tracrRNA extension sequence can have a length of more than: 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, or 400 nucleotides. The tracrRNA extension sequence can have a length from about 20 to about 5000 or more nucleotides. The tracrRNA extension sequence can have a length of more than 1000 nucleotides. The tracrRNA extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400 or more nucleotides. The tracrRNA extension sequence can have a length of less than 1000 nucleotides. The tracrRNA extension sequence can comprise less than 10 nucleotides in length. The tracrRNA extension sequence can be 10-30 nucleotides in length. The tracrRNA extension sequence can be 30-70 nucleotides in length.

The tracrRNA extension sequence can comprise a functional moiety (e.g., a stability control sequence, ribozyme, endoribonuclease binding sequence). In some aspects, a functional moiety comprises a transcriptional terminator segment (i.e., a transcription termination sequence). The functional moiety can have a total length from about 10 nucleotides (nt) to about 100 nucleotides, from about 10 nt to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt, from about 15 nt to about 80 nt, from about 15 nt to about 50 nt, from about 15 nt to about 40 nt, from about 15 nt to about 30 nt, or from about 15 nt to about 25 nt. The functional moiety can function in a eukaryotic cell. The functional moiety can function in a prokaryotic cell. The functional moiety can function in both eukaryotic and prokaryotic cells.

Non-limiting examples of suitable tracrRNA extension functional moieties include: a 3' poly-adenylated tail, a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like). The tracrRNA extension sequence can comprise a primer binding site or a molecular index (e.g., barcode sequence). The tracrRNA extension sequence can comprise one or more affinity tags.

Single-Molecule Guide Linker Sequence

The linker sequence of a single-molecule guide nucleic acid can have a length from about 3 nucleotides to about 100 nucleotides. In Jinek et al., supra, for example, a simple 4 nucleotide "tetraloop" (-GAAA-) was used, Science, 337 (6096): 816-821 (2012). An illustrative linker has a length from about 3 nucleotides (nt) to about 90 nt, from about 3 nt to about 80 nt, from about 3 nt to about 70 nt, from about 3 nt to about 60 nt, from about 3 nt to about 50 nt, from about 3 nt to about 40 nt, from about 3 nt to about 30 nt, from about 3 nt to about 20 nt, from about 3 nt to about 10 nt. For example, the linker can have a length from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. The linker of a single-molecule guide nucleic acid can be between 4 and 40 nucleotides. The linker can be at least about: 100, 500, 1000, 1500, 2000, 2500, 3000, 3500, 4000, 4500, 5000, 5500, 6000, 6500, or 7000 or more nucleotides. The linker can be at most about: 100, 500, 1000, 1500, 2000, 2500, 3000, 3500, 4000, 4500, 5000, 5500, 6000, 6500, or 7000 or more nucleotides.

Linkers can comprise any of a variety of sequences, although in some examples, the linker will not comprise sequences that have extensive regions of homology with other portions of the guide RNA, which might cause intra-molecular binding that could interfere with other functional regions of the guide. In Jinek et al., supra, a simple 4 nucleotide sequence -GAAA- was used, Science, 337 (6096): 816-821 (2012), but numerous other sequences, including longer sequences can likewise be used.

The linker sequence can comprise a functional moiety. For example, the linker sequence can comprise one or more features, including an aptamer, a ribozyme, a protein-inter-acting hairpin, a protein binding site, a CRISPR array, an intron, or an exon. The linker sequence can comprise at least about: 1, 2, 3, 4, or 5 or more functional moieties. In some examples, the linker sequence can comprise at most about: 1, 2, 3, 4, or 5 or more functional moieties.

Complexes of a Nucleic Acid-Targeting Nucleic Acid and a Site-Directed Polypeptide A nucleic acid-targeting nucleic acid interacts with a site-directed polypeptide (e.g., a nucleic acid-guided nucle-ase such as Cas9), thereby forming a complex. The nucleic acid-targeting nucleic acid guides the site-directed polypep-tide to a target nucleic acid.

Target Sequence Selection

Shifts in the location of the 5' boundary and/or the 3' boundary relative to particular reference loci can be used to facilitate or enhance particular applications of gene editing, which depend in part on the endonuclease system selected for the editing, as further described and illustrated herein.

In a first nonlimiting example of such target sequence selection, many endonuclease systems have rules or criteria that can guide the initial selection of potential target sites for cleavage, such as the requirement of a PAM sequence motif in a particular position adjacent to the DNA cleavage sites in the case of CRISPR Type II or Type V endonucleases.

In another nonlimiting example of target sequence selec-tion or optimization, the frequency of off-target activity for a particular combination of target sequence and gene editing endonuclease (i.e. the frequency of DSBs occurring at sites other than the selected target sequence) can be assessed relative to the frequency of on-target activity. In some cases, cells that have been correctly edited at the desired locus can have a selective advantage relative to other cells. Illustrative, but nonlimiting, examples of a selective advantage include the acquisition of attributes such as enhanced rates of replication, persistence, resistance to certain conditions, enhanced rates of successful engraftment or persistence in vivo following introduction into a patient, and other attri-butes associated with the maintenance or increased numbers or viability of such cells. In other cases, cells that have been correctly edited at the desired locus can be positively selected for by one or more screening methods used to identify, sort or otherwise select for cells that have been correctly edited. Both selective advantage and directed selection methods can take advantage of the phenotype associated with the correction. In some cases, cells can be edited two or more times in order to create a second modification that creates a new phenotype that is used to select or purify the intended population of cells. Such a second modification could be created by adding a second gRNA for a selectable or screenable marker. In some cases, cells can be correctly edited at the desired locus using a DNA fragment that contains the cDNA and also a selectable marker.

Whether any selective advantage is applicable or any directed selection is to be applied in a particular case, target sequence selection can also be guided by consideration of off-target frequencies in order to enhance the effectiveness of the application and/or reduce the potential for undesired alterations at sites other than the desired target. As described further and illustrated herein and in the art, the occurrence of off-target activity can be influenced by a number of factors including similarities and dissimilarities between the target site and various off-target sites, as well as the par-ticular endonuclease used. Bioinformatics tools are available that assist in the prediction of off-target activity, and fre-quently such tools can also be used to identify the most likely sites of off-target activity, which can then be assessed in experimental settings to evaluate relative frequencies of off-target to on-target activity, thereby allowing the selection of sequences that have higher relative on-target activities. Illustrative examples of such techniques are provided herein, and others are known in the art.

Another aspect of target sequence selection relates to homologous recombination events. Sequences sharing regions of homology can serve as focal points for homolo-gous recombination events that result in deletion of inter-vening sequences. Such recombination events occur during the normal course of replication of chromosomes and other DNA sequences, and also at other times when DNA sequences are being synthesized, such as in the case of repairs of double-strand breaks (DSBs), which occur on a regular basis during the normal cell replication cycle but can also be enhanced by the occurrence of various events (such as UV light and other inducers of DNA breakage) or the presence of certain agents (such as various chemical induc-ers). Many such inducers cause DSBs to occur indiscrimi-nately in the genome, and DSBs can be regularly induced and repaired in normal cells. During repair, the original sequence can be reconstructed with complete fidelity, how-ever, in some cases, small insertions or deletions (referred to as "indels") are introduced at the DSB site.

DSBs can also be specifically induced at particular loca-tions, as in the case of the endonucleases systems described herein, which can be used to cause directed or preferential gene modification events at selected chromosomal locations. The tendency for homologous sequences to be subject to recombination in the context of DNA repair (as well as replication) can be taken advantage of in a number of circumstances, and is the basis for one application of gene editing systems, such as CRISPR, in which homology directed repair is used to insert a sequence of interest, provided through use of a "donor" polynucleotide, into a desired chromosomal location.

Regions of homology between particular sequences, which can be small regions of "microhomology" that can comprise as few as ten basepairs or less, can also be used to bring about desired deletions. For example, a single DSB can be introduced at a site that exhibits microhomology with a nearby sequence. During the normal course of repair of such DSB, a result that occurs with high frequency is the deletion of the intervening sequence as a result of recombination being facilitated by the DSB and concomitant cellular repair process.

In some circumstances, however, selecting target sequences within regions of homology can also give rise to much larger deletions, including gene fusions (when the deletions are in coding regions), which may or may not be desired given the particular circumstances.

Nucleic Acid Modifications

In some cases, polynucleotides introduced into cells can comprise one or more modifications that can be used individually or in combination, for example, to enhance activity, stability or specificity, alter delivery, reduce innate immune responses in host cells, or for other enhancements, as further described herein and known in the art.

In certain examples, modified polynucleotides can be used in the CRISPR/Cas9/Cpf1 system, in which case the guide RNAs (either single-molecule guides or double-molecule guides) and/or a DNA or an RNA encoding a Cas or Cpf1 endonuclease introduced into a cell can be modified, as described and illustrated below. Such modified polynucleotides can be used in the CRISPR/Cas9/Cpf1 system to edit any one or more genomic loci.

Using the CRISPR/Cas9/Cpf1 system for purposes of nonlimiting illustrations of such uses, modifications of guide RNAs can be used to enhance the formation or stability of the CRISPR/Cas9/Cpf1 genome editing complex comprising guide RNAs, which can be single-molecule guides or double-molecule, and a Cas or Cpf1 endonuclease. Modifications of guide RNAs can also or alternatively be used to enhance the initiation, stability or kinetics of interactions between the genome editing complex with the target sequence in the genome, which can be used, for example, to enhance on-target activity. Modifications of guide RNAs can also or alternatively be used to enhance specificity, e.g., the relative rates of genome editing at the on-target site as compared to effects at other (off-target) sites.

Modifications can also or alternatively be used to increase the stability of a guide RNA, e.g., by increasing its resistance to degradation by ribonucleases (RNases) present in a cell, thereby causing its half-life in the cell to be increased. Modifications enhancing guide RNA half-life can be particularly useful in aspects in which a Cas or Cpf1 endonuclease is introduced into the cell to be edited via an RNA that needs to be translated in order to generate endonuclease, because increasing the half-life of guide RNAs introduced at the same time as the RNA encoding the endonuclease can be used to increase the time that the guide RNAs and the encoded Cas or Cpf1 endonuclease co-exist in the cell.

Modifications can also or alternatively be used to decrease the likelihood or degree to which RNAs introduced into cells elicit innate immune responses. Such responses, which have been well characterized in the context of RNA interference (RNAi), including small-interfering RNAs (siRNAs), as described below and in the art, tend to be associated with reduced half-life of the RNA and/or the elicitation of cytokines or other factors associated with immune responses.

One or more types of modifications can also be made to RNAs encoding an endonuclease that are introduced into a cell, including, without limitation, modifications that enhance the stability of the RNA (such as by increasing its degradation by RNAses present in the cell), modifications that enhance translation of the resulting product (i.e. the endonuclease), and/or modifications that decrease the likelihood or degree to which the RNAs introduced into cells elicit innate immune responses.

Combinations of modifications, such as the foregoing and others, can likewise be used. In the case of CRISPR/Cas9/Cpf1, for example, one or more types of modifications can be made to guide RNAs (including those exemplified above), and/or one or more types of modifications can be made to RNAs encoding Cas endonuclease (including those exemplified above).

By way of illustration, guide RNAs used in the CRISPR/Cas9/Cpf1 system, or other smaller RNAs can be readily synthesized by chemical means, enabling a number of modifications to be readily incorporated, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach that can be used for generating chemically-modified RNAs of greater length is to produce two or more molecules that are ligated together. Much longer RNAs, such as those encoding a Cas9 endonuclease, are more readily generated enzymatically. While fewer types of modifications are available for use in enzymatically produced RNAs, there are still modifications that can be used to, e.g., enhance stability, reduce the likelihood or degree of innate immune response, and/or enhance other attributes, as described further below and in the art; and new types of modifications are regularly being developed.

By way of illustration of various types of modifications, especially those used frequently with smaller chemically synthesized RNAs, modifications can comprise one or more nucleotides modified at the 2' position of the sugar, in some aspects a 2'-O-alkyl, 2'-O-alkyl-O-alkyl, or 2'-fluoro-modified nucleotide. In some examples, RNA modifications can comprise 2'-fluoro, 2'-amino or 2' O-methyl modifications on the ribose of pyrimidines, abasic residues, or an inverted base at the 3' end of the RNA. Such modifications can be routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligonucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Some oligonucleotides are oligonucleotides with phosphorothioate backbones and those with heteroatom backbones, particularly CH2-NH—O—CH2, CH, ~N(CH3)~O~CH2 (known as a methylene(methylimino) or MMI backbone), CH2-O—N(CH3)-CH2, CH2-N(CH3)-N(CH3)-CH2 and O—N(CH3)-CH2-CH2 backbones, wherein the native phosphodiester backbone is represented as O—P—O—CH); amide backbones [see De Mesmaeker et al., Ace. Chem. Res., 28:366-374 (1995)]; morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Morpholino-based oligomeric compounds are described in Braasch and David Corey, Biochemistry, 41 (14): 4503-4510 (2002); Genesis, Volume 30, Issue 3, (2001); Heasman, Dev. Biol., 243:209-214 (2002); Nasevicius et al., Nat. Genet., 26:216-220 (2000); Lacerra et al., Proc. Natl. Acad. Sci., 97:9591-9596 (2000); and U.S. Pat. No. 5,034,506, issued Jul. 23, 1991.

Cyclohexenyl nucleic acid oligonucleotide mimetics are described in Wang et al., J. Am. Chem. Soc., 122:8595-8602 (2000).

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and CH2 component parts; see U.S. Pat. Nos. 5,034,506; 5,166,315; 5,185, 444; 5,214,134; 5,216,141; 5,235,033; 5,264,562; 5,264, 564; 5,405,938; 5,434,257; 5,466,677; 5,470,967; 5,489, 677; 5,541,307; 5,561,225; 5,596,086; 5,602,240; 5,610, 289; 5,602,240; 5,608,046; 5,610,289; 5,618,704; 5,623, 070; 5,663,312; 5,633,360; 5,677,437; and 5,677,439.

One or more substituted sugar moieties can also be included, e.g., one of the following at the 2' position: OH, SH, $SCH_3$, F, OCN, OCH3 OCH3, OCH3 O(CH2)n CH3, O(CH2)n NH2, or O(CH2)n CH3, where n is from 1 to about 10; C1 to C10 lower alkyl, alkoxyalkoxy, substituted lower alkyl, alkaryl or aralkyl; Cl; Br; CN; CF3; OCF3; O—, S—, or N-alkyl; O—, S—, or N-alkenyl; SOCH3; SO2 CH3; ONO2; NO2; N3; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. In some aspects, a modification includes 2'-methoxyethoxy (2'-0-CH2CH2OCH3, also known as 2'-O-(2-methoxyethyl)) (Martin et al, Helv. Chim. Acta, 1995, 78, 486). Other modifications include 2'-methoxy (2'-0-CH3), 2'-propoxy (2'-OCH2 CH2CH3) and 2'-fluoro (2'-F). Similar modifications can also be made at other positions on the oligonucleotide, particularly the 3' position of the sugar on the 3' terminal nucleotide and the 5' position of 5' terminal nucleotide. Oligonucleotides can also have sugar mimetics, such as cyclobutyls in place of the pentofuranosyl group.

In some examples, both a sugar and an internucleoside linkage, i.e., the backbone, of the nucleotide units can be replaced with novel groups. The base units can be maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide can be replaced with an amide containing backbone, for example, an aminoethylglycine backbone. The nucleobases can be retained and bound directly or indirectly to aza nitrogen atoms of the amide portion of the backbone. Representative United States patents that teach the preparation of PNA compounds comprise, but are not limited to, U.S. Pat. Nos. 5,539,082; 5,714,331; and 5,719, 262. Further teaching of PNA compounds can be found in Nielsen et al, Science, 254:1497-1500 (1991).

Guide RNAs can also include, additionally or alternatively, nucleobase (often referred to in the art simply as "base") modifications or substitutions. As used herein, "unmodified" or "natural" nucleobases include adenine (A), guanine (G), thymine (T), cytosine (C), and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, as well as synthetic nucleobases, e.g., 2-aminoadenine, 2-(methylamino) adenine, 2-(imidazolylalkyl) adenine, 2-(aminoalklyamino) adenine or other heterosubstituted alkyladenines, 2-thiouracil, 2-thiothymine, 5-bromouracil, 5-hydroxymethyluracil, 8-azaguanine, 7-deazaguanine, N6 (6-aminohexyl) adenine, and 2,6-diaminopurine. Kornberg, A., DNA Replication, W. H. Freeman & Co., San Francisco, pp 75-77 (1980); Gebeyehu et al., Nucl. Acids Res. 15:4513 (1997). A "universal" base known in the art, e.g., inosine, can also be included. 5-Me-C substitutions have been shown to increase nucleic acid duplex stability by 0.6-1.2° C. (Sanghvi, Y. S., in Crooke, S. T. and Lebleu, B., eds., Antisense Research and Applications, CRC Press, Boca Raton, 1993, pp. 276-278) and are aspects of base substitutions.

Modified nucleobases can comprise other synthetic and natural nucleobases, such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine, and 3-deazaguanine and 3-deazaadenine.

Further, nucleobases can comprise those disclosed in U.S. Pat. No. 3,687,808, those disclosed in 'The Concise Encyclopedia of Polymer Science And Engineering', pages 858-859, Kroschwitz, J. I., ed. John Wiley & Sons, 1990, those disclosed by Englisch et al., Angewandle Chemie, International Edition', 1991, 30, page 613, and those disclosed by Sanghvi, Y. S., Chapter 15, Antisense Research and Applications', pages 289-302, Crooke, S. T. and Lebleu, B. ea., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., eds, 'Antisense Research and Applications', CRC Press, Boca Raton, 1993, pp. 276-278) and are aspects of base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,681,941; 5,750,692; 5,763,588; 5,830,653; 6,005,096; and U.S. Patent Application Publication 2003/0158403.

Thus, the term "modified" refers to a non-natural sugar, phosphate, or base that is incorporated into a guide RNA, an endonuclease, or both a guide RNA and an endonuclease. It is not necessary for all positions in a given oligonucleotide to be uniformly modified, and in fact more than one of the aforementioned modifications can be incorporated in a single oligonucleotide, or even in a single nucleoside within an oligonucleotide.

The guide RNAs and/or mRNA (or DNA) encoding an endonuclease can be chemically linked to one or more moieties or conjugates that enhance the activity, cellular distribution, or cellular uptake of the oligonucleotide. Such moieties comprise, but are not limited to, lipid moieties such as a cholesterol moiety [Letsinger et al., Proc. Natl. Acad. Sci. USA, 86:6553-6556 (1989)]; cholic acid [Manoharan et al., Bioorg. Med. Chem. Let., 4:1053-1060 (1994)]; a thioether, e.g., hexyl-S-tritylthiol [Manoharan et al, Ann. N. Y. Acad. Sci., 660:306-309 (1992) and Manoharan et al., Bioorg. Med. Chem. Let., 3:2765-2770 (1993)]; a thiocholesterol [Oberhauser et al., Nucl. Acids Res., 20:533-538 (1992)]; an aliphatic chain, e.g., dodecandiol or undecyl residues [Kabanov et al., FEBS Lett., 259:327-330 (1990) and Svinarchuk et al., Biochimie, 75:49-54 (1993)]; a phospholipid, e.g., di-hexadecyl-rac-glycerol or triethylammonium 1,2-di-O-hexadecyl-rac-glycero-3-H-phosphonate [Manoharan et al., Tetrahedron Lett., 36:3651-3654 (1995) and Shea et al., Nucl. Acids Res., 18:3777-3783 (1990)]; a polyamine or a polyethylene glycol chain [Mancharan et al., Nucleosides & Nucleotides, 14:969-973 (1995)]; adamantane acetic acid [Manoharan et al., Tetrahedron Lett., 36:3651-3654 (1995)]; a palmityl moiety [(Mishra et al., Biochim. Biophys. Acta, 1264:229-237 (1995)]; or an octadecylamine or hexylamino-carbonyl-t oxycholesterol moiety [Crooke et al., J. Pharmacol. Exp. Ther., 277:923-937 (1996)]. See also U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

Sugars and other moieties can be used to target proteins and complexes comprising nucleotides, such as cationic polysomes and liposomes, to particular sites. For example, hepatic cell directed transfer can be mediated via asialoglycoprotein receptors (ASGPRs); see, e.g., Hu, et al., Protein Pept Lett. 21 (10): 1025-30 (2014). Other systems known in the art and regularly developed can be used to target biomolecules of use in the present case and/or complexes thereof to particular target cells of interest.

These targeting moieties or conjugates can include conjugate groups covalently bound to functional groups, such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this disclosure, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

Longer polynucleotides that are less amenable to chemical synthesis and are typically produced by enzymatic synthesis can also be modified by various means. Such modifications can include, for example, the introduction of certain nucleotide analogs, the incorporation of particular sequences or other moieties at the 5' or 3' ends of molecules, and other modifications. By way of illustration, the mRNA encoding Cas9 is approximately 4 kb in length and can be synthesized by in vitro transcription. Modifications to the mRNA can be applied to, e.g., increase its translation or stability (such as by increasing its resistance to degradation with a cell), or to reduce the tendency of the RNA to elicit an innate immune response that is often observed in cells following introduction of exogenous RNAs, particularly longer RNAs such as that encoding Cas9.

Numerous such modifications have been described in the art, such as polyA tails, 5' cap analogs (e.g., Anti Reverse Cap Analog (ARCA) or m7G(5')ppp(5')G (mCAP)), modified 5' or 3' untranslated regions (UTRs), use of modified bases (such as Pseudo-UTP, 2-Thio-UTP, 5-Methylcytidine-5'-Triphosphate (5-Methyl-CTP) or N6-Methyl-ATP), or treatment with phosphatase to remove 5' terminal phosphates. These and other modifications are known in the art, and new modifications of RNAs can be further developed.

There are numerous commercial suppliers of modified RNAs, including for example, TriLink Biotech, AxoLabs, Bio-Synthesis Inc., Dharmacon and many others. As described by TriLink, for example, 5-Methyl-CTP can be used to impart desirable characteristics, such as increased nuclease stability, increased translation or reduced interaction of innate immune receptors with in vitro transcribed RNA. 5-Methylcytidine-5'-Triphosphate (5-Methyl-CTP), N6-Methyl-ATP, as well as Pseudo-UTP and 2-Thio-UTP, have also been shown to reduce innate immune stimulation in culture and in vivo while enhancing translation, as illustrated in publications by Kormann et al. and Warren et al. referred to below.

It has been shown that chemically modified mRNA delivered in vivo can be used to achieve improved therapeutic effects; see, e.g., Kormann et al., Nature Biotechnology 29, 154-157 (2011). Such modifications can be used, for example, to increase the stability of the RNA molecule and/or reduce its immunogenicity. Using chemical modifications such as Pseudo-U, N6-Methyl-A, 2-Thio-U and 5-Methyl-C, it was found that substituting just one quarter of the uridine and cytidine residues with 2-Thio-U and 5-Methyl-C respectively resulted in a significant decrease in toll-like receptor (TLR) mediated recognition of the mRNA in mice. By reducing the activation of the innate immune system, these modifications can be used to effectively increase the stability and longevity of the mRNA in vivo; see, e.g., Kormann et al., supra.

It has also been shown that repeated administration of synthetic messenger RNAs incorporating modifications designed to bypass innate anti-viral responses can reprogram differentiated human cells to pluripotency. See, e.g., Warren, et al., Cell Stem Cell, 7 (5): 618-30 (2010). Such modified mRNAs that act as primary reprogramming proteins can be an efficient means of reprogramming multiple human cell types. Such cells are referred to as induced pluripotency stem cells (iPSCs), and it was found that enzymatically synthesized RNA incorporating 5-Methyl-CTP, Pseudo-UTP and an Anti Reverse Cap Analog (ARCA) could be used to effectively evade the cell's antiviral response; see, e.g., Warren et al., supra.

Other modifications of polynucleotides described in the art include, for example, the use of polyA tails, the addition of 5' cap analogs (such as m7G(5')ppp(5')G (mCAP)), modifications of 5' or 3' untranslated regions (UTRs), or treatment with phosphatase to remove 5' terminal phosphates—and new approaches are regularly being developed.

A number of compositions and techniques applicable to the generation of modified RNAs for use herein have been developed in connection with the modification of RNA interference (RNAi), including small-interfering RNAs (siRNAs). siRNAs present particular challenges in vivo because their effects on gene silencing via mRNA interference are generally transient, which can require repeat administration. In addition, siRNAs are double-stranded RNAs (dsRNA) and mammalian cells have immune responses that have evolved to detect and neutralize dsRNA, which is often a by-product of viral infection. Thus, there are mammalian enzymes such as PKR (dsRNA-responsive kinase), and potentially retinoic acid-inducible gene I (RIG-I), that can mediate cellular responses to dsRNA, as well as Toll-like receptors (such as TLR3, TLR7 and TLR8) that can trigger the induction of cytokines in response to such molecules; see, e.g., the reviews by Angart et al., Pharmaceuticals (Basel) 6 (4): 440-468 (2013); Kanasty et al., Molecular Therapy 20 (3): 513-524 (2012); Burnett et al., Biotechnol J. 6 (9): 1130-46 (2011); Judge and MacLachlan, Hum Gene Ther 19 (2): 111-24 (2008); and references cited therein.

A large variety of modifications have been developed and applied to enhance RNA stability, reduce innate immune responses, and/or achieve other benefits that can be useful in connection with the introduction of polynucleotides into human cells, as described herein; see, e.g., the reviews by Whitehead K A et al., Annual Review of Chemical and Biomolecular Engineering, 2:77-96 (2011); Gaglione and Messere, Mini Rev Med Chem, 10 (7): 578-95 (2010); Chernolovskaya et al, Curr Opin Mol Ther., 12 (2): 158-67 (2010); Deleavey et al., Curr Protoc Nucleic Acid Chem Chapter 16: Unit 16.3 (2009); Behlke, Oligonucleotides 18 (4): 305-19 (2008); Fucini et al., Nucleic Acid Ther 22 (3): 205-210 (2012); Bremsen et al., Front Genet 3:154 (2012).

As noted above, there are a number of commercial suppliers of modified RNAs, many of which have specialized in modifications designed to improve the effectiveness of siRNAs. A variety of approaches are offered based on various findings reported in the literature. For example, Dharmacon notes that replacement of a non-bridging oxygen with sulfur (phosphorothioate, PS) has been extensively used to improve nuclease resistance of siRNAs, as reported by Kole, Nature Reviews Drug Discovery 11:125-140 (2012). Modifications of the 2'-position of the ribose have been reported to improve nuclease resistance of the internucleotide phosphate bond while increasing duplex stability (Tm), which has also been shown to provide protection from immune activation. A combination of moderate PS backbone modifications with small, well-tolerated 2'-substitutions (2'-O-Methyl, 2'-Fluoro, 2'-Hydro) have been associated with highly stable siRNAs for applications in vivo, as reported by Soutschek et al. Nature 432:173-178 (2004); and 2'-O-Methyl modifications have been reported to be effective in improving stability as reported by Volkov, Oligonucleotides 19:191-202 (2009). With respect to decreasing the induction of innate immune responses, modifying specific sequences with 2'-O-Methyl, 2'-Fluoro, 2'-Hydro have been reported to reduce TLR7/TLR8 interaction while generally preserving silencing activity; see, e.g., Judge et al., Mol. Ther. 13:494-505 (2006); and Cekaite et al., J. Mol. Biol. 365:90-108 (2007). Additional modifications, such as 2-thiouracil, pseudouracil, 5-methylcytosine, 5-methyluracil, and N6-methyladenosine have also been shown to minimize the immune effects mediated by TLR3, TLR7, and TLR8; see, e.g., Kariko, K. et al., Immunity 23:165-175 (2005).

As is also known in the art, and commercially available, a number of conjugates can be applied to polynucleotides, such as RNAs, for use herein that can enhance their delivery and/or uptake by cells, including for example, cholesterol, tocopherol and folic acid, lipids, peptides, polymers, linkers and aptamers; see, e.g., the review by Winkler, Ther. Deliv. 4:791-809 (2013), and references cited therein.

Codon-Optimization

A polynucleotide encoding a site-directed polypeptide can be codon-optimized according to methods standard in the art for expression in the cell containing the target DNA of interest. For example, if the intended target nucleic acid is in a human cell, a human codon-optimized polynucleotide encoding Cas9 is contemplated for use for producing the Cas9 polypeptide.

Complexes of a Genome-Targeting Nucleic Acid and a Site-Directed Polypeptide

A genome-targeting nucleic acid interacts with a site-directed polypeptide (e.g., a nucleic acid-guided nuclease such as Cas9), thereby forming a complex. The genome-targeting nucleic acid guides the site-directed polypeptide to a target nucleic acid.

RNPs

The site-directed polypeptide and genome-targeting nucleic acid can each be administered separately to a cell or a patient. On the other hand, the site-directed polypeptide can be pre-complexed with one or more genome-targeting nucleic acids (guide RNAs, sgRNA, or crRNA together with a tracrRNA). The pre-complexed material can then be administered to a cell or a patient. Such pre-complexed material is known as a ribonucleoprotein particle (RNP). The site-directed polypeptide in the RNP can be, for example, a Cas9 endonuclease or a Cpf1 endonuclease. The site-directed polypeptide can be flanked at the N-terminus, the C-terminus, or both the N-terminus and C-terminus by one or more nuclear localization signals (NLSs). For example, a Cas9 endonuclease can be flanked by two NLSs, one NLS located at the N-terminus and the second NLS located at the C-terminus. The NLS can be any NLS known in the art, such as a SV40 NLS. The weight ratio of genome-targeting nucleic acid to site-directed polypeptide in the RNP can be 1:1. For example, the weight ratio of sgRNA to Cas9 endonuclease in the RNP can be 1:1.

Nucleic Acids Encoding System Components

The present disclosure provides a nucleic acid comprising a nucleotide sequence encoding a genome-targeting nucleic acid of the disclosure, a site-directed polypeptide of the disclosure, and/or any nucleic acid or proteinaceous molecule necessary to carry out the aspects of the methods of the disclosure.

The nucleic acid encoding a genome-targeting nucleic acid of the disclosure, a site-directed polypeptide of the disclosure, and/or any nucleic acid or proteinaceous molecule necessary to carry out the aspects of the methods of the disclosure can comprise a vector (e.g., a recombinant expression vector).

The term "vector" refers to a nucleic acid molecule capable of transporting another nucleic acid to which it has been linked. One type of vector is a "plasmid", which refers to a circular double-stranded DNA loop into which additional nucleic acid segments can be ligated. Another type of vector is a viral vector, wherein additional nucleic acid segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

In some examples, vectors can be capable of directing the expression of nucleic acids to which they are operatively linked. Such vectors are referred to herein as "recombinant expression vectors", or more simply "expression vectors", which serve equivalent functions.

The term "operably linked" means that the nucleotide sequence of interest is linked to regulatory sequence(s) in a manner that allows for expression of the nucleotide sequence. The term "regulatory sequence" is intended to include, for example, promoters, enhancers and other expression control elements (e.g., polyadenylation signals). Such regulatory sequences are well known in the art and are described, for example, in Goeddel; Gene Expression Technology: Methods in Enzymology 185, Academic Press, San Diego, CA (1990). Regulatory sequences include those that direct constitutive expression of a nucleotide sequence in many types of host cells and those that direct expression of the nucleotide sequence only in certain host cells (e.g., tissue-specific regulatory sequences). It will be appreciated by those skilled in the art that the design of the expression vector can depend on such factors as the choice of the target cell, the level of expression desired, and the like.

Figure 7A:
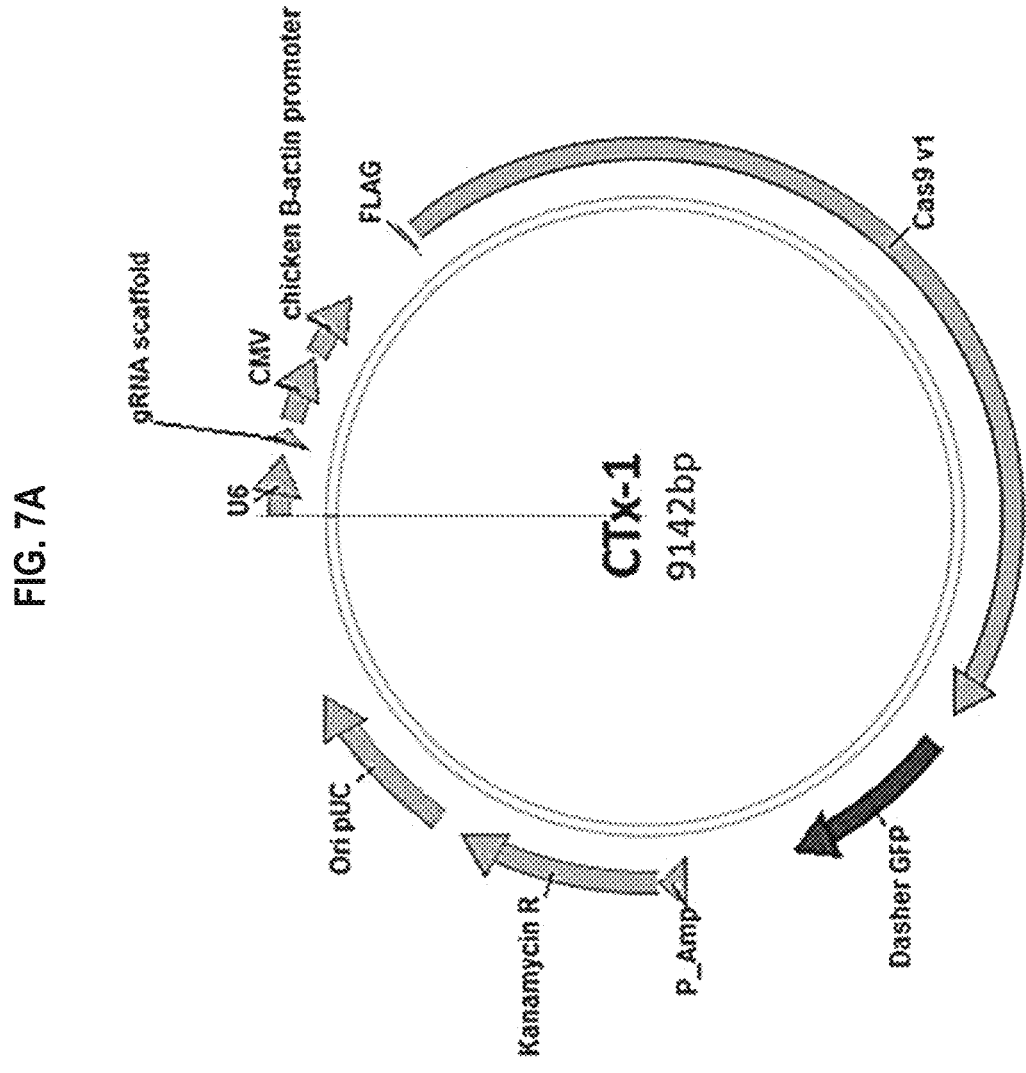
FIGS. 7A-7C show plasmids (CTx-1, CTx-2, CTx-3) comprising a codon optimized gene for *S. pyogenes* Cas9 endonuclease.
Figure 7B:
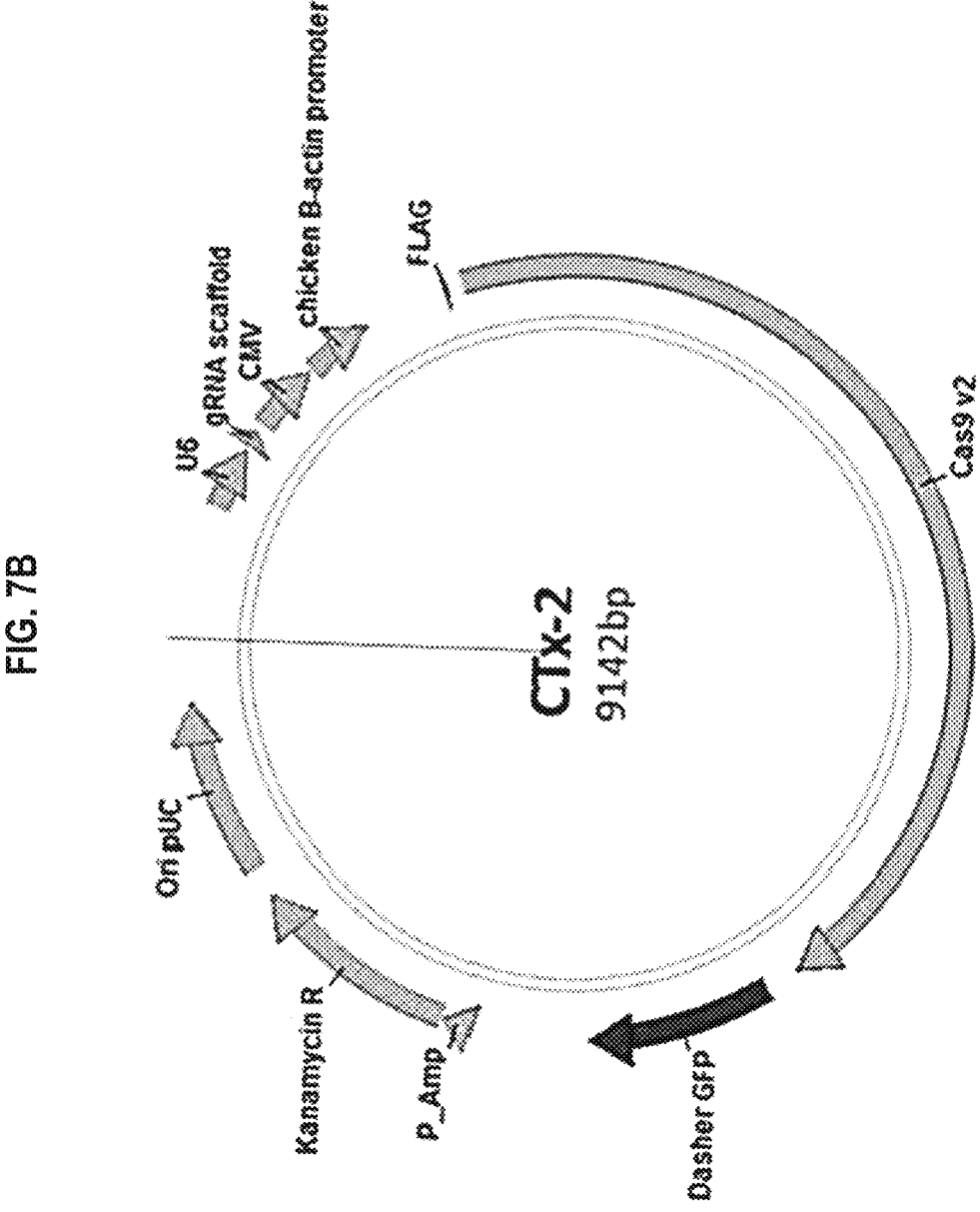
Figure 7C:
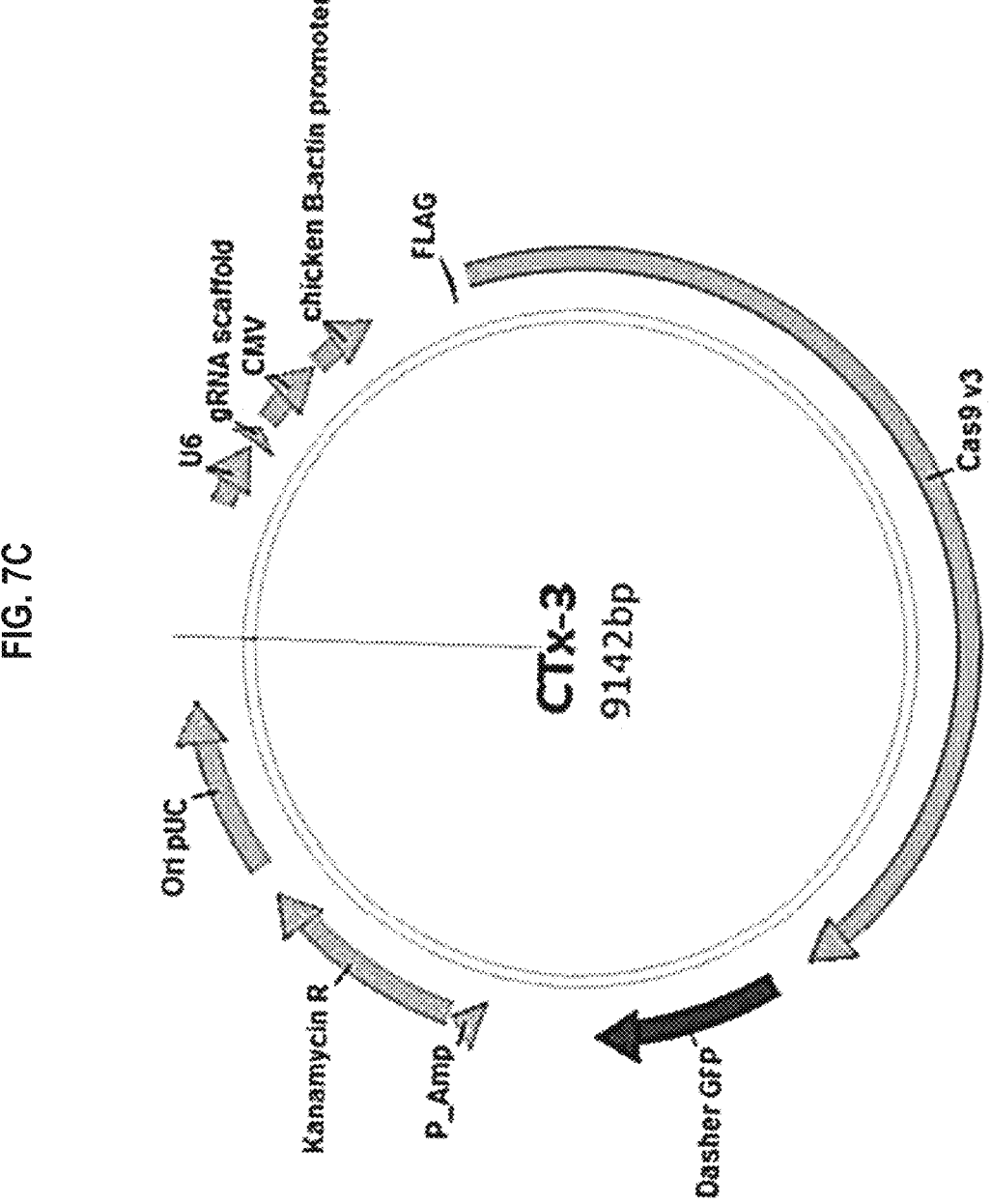
Figure 8A:
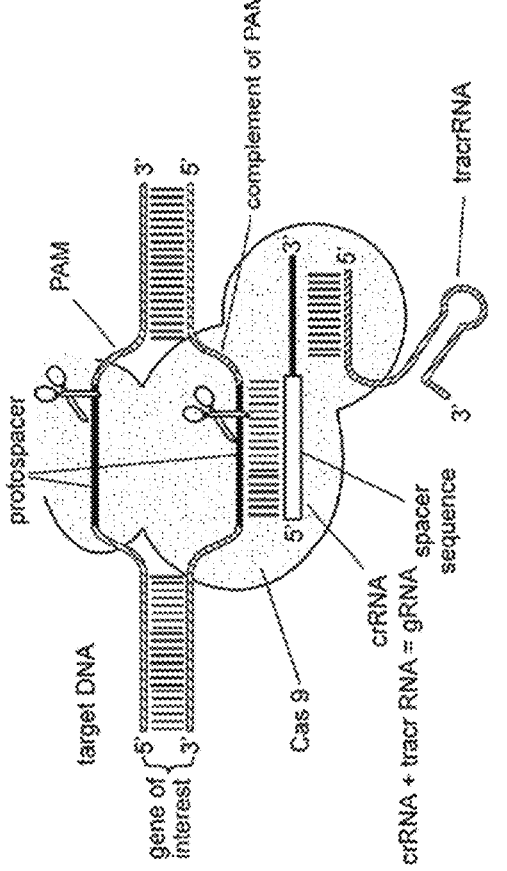
FIGS. 8A-8B depict the type II CRISPR/Cas system.
Figure 8B:
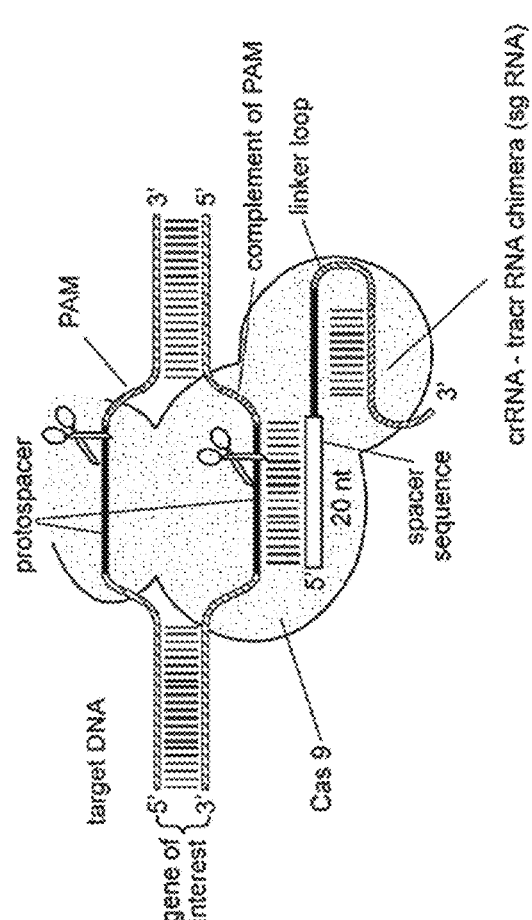

Expression vectors contemplated include, but are not limited to, viral vectors based on vaccinia virus, poliovirus, adenovirus, adeno-associated virus, SV40, herpes simplex virus, human immunodeficiency virus, a retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors. Other vectors contemplated for eukaryotic target cells include, but are not limited to, the vectors pXT1, pSG5, pSVK3, pBPV, pMSG, and pSVLSV40 (Pharmacia). Additional vectors contemplated for eukaryotic target cells include, but are not limited to, the vectors pCTx-1, pCTx-2, and pCTx-3, which are described in FIGS. 7A to 7C. Other vectors can be used so long as they are compatible with the host cell.

In some examples, a vector can comprise one or more transcription and/or translation control elements. Depending on the host/vector system utilized, any of a number of suitable transcription and translation control elements, including constitutive and inducible promoters, transcription enhancer elements, transcription terminators, etc. can be used in the expression vector. The vector can be a self-inactivating vector that either inactivates the viral sequences or the components of the CRISPR machinery or other elements.

Non-limiting examples of suitable eukaryotic promoters (i.e., promoters functional in a eukaryotic cell) include those from cytomegalovirus (CMV) immediate early, herpes simplex virus (HSV) thymidine kinase, early and late SV40, long terminal repeats (LTRs) from retrovirus, human elongation factor-1 promoter (EF1), a hybrid construct comprising the cytomegalovirus (CMV) enhancer fused to the chicken beta-actin promoter (CAG), murine stem cell virus promoter (MSCV), phosphoglycerate kinase-1 locus promoter (PGK), and mouse metallothionein-I.

For expressing small RNAs, including guide RNAs used in connection with Cas endonuclease, various promoters such as RNA polymerase III promoters, including for example U6 and H1, can be advantageous. Descriptions of and parameters for enhancing the use of such promoters are known in art and additional information and approaches are regularly being described; see, e.g., Ma, H. et al., *Molecular Therapy—Nucleic Acids* 3, e161 (2014) doi: 10.1038/mtna.2014.12.

The expression vector can also contain a ribosome binding site for translation initiation and a transcription terminator. The expression vector can also comprise appropriate sequences for amplifying expression. The expression vector can also include nucleotide sequences encoding non-native tags (e.g., histidine tag, hemagglutinin tag, green fluorescent protein, etc.) that are fused to the site-directed polypeptide, thus resulting in a fusion protein.

A promoter can be an inducible promoter (e.g., a heat shock promoter, tetracycline-regulated promoter, steroid-regulated promoter, metal-regulated promoter, estrogen receptor-regulated promoter, etc.). The promoter can be a constitutive promoter (e.g., CMV promoter, UBC promoter). In some cases, the promoter can be a spatially restricted and/or temporally restricted promoter (e.g., a tissue specific promoter, a cell type specific promoter, etc.).

The nucleic acid encoding a genome-targeting nucleic acid of the disclosure and/or a site-directed polypeptide can be packaged into or on the surface of delivery vehicles for delivery to cells. Delivery vehicles contemplated include, but are not limited to, nanospheres, liposomes, quantum dots, nanoparticles, polyethylene glycol particles, hydrogels, and micelles. As described in the art, a variety of targeting moieties can be used to enhance the preferential interaction of such vehicles with desired cell types or locations.

Introduction of the complexes, polypeptides, and nucleic acids of the disclosure into cells can occur by viral or bacteriophage infection, transfection, conjugation, protoplast fusion, lipofection, electroporation, nucleofection, calcium phosphate precipitation, polyethyleneimine (PEI)-mediated transfection, DEAE-dextran mediated transfection, liposome-mediated transfection, particle gun technology, calcium phosphate precipitation, direct micro-injection, nanoparticle-mediated nucleic acid delivery, and the like.

Delivery

Guide RNA polynucleotides (RNA or DNA) and/or endonuclease polynucleotide(s) (RNA or DNA) can be delivered by viral or non-viral delivery vehicles known in the art, such as electroporation, mechanical force, cell deformation (SQZ Biotech), and cell penetrating peptides. Alternatively, endonuclease polypeptide(s) can be delivered by viral or non-viral delivery vehicles known in the art, such as electroporation or lipid nanoparticles. In further alternative aspects, the DNA endonuclease can be delivered as one or more polypeptides, either alone or pre-complexed with one or more guide RNAs, or one or more crRNA together with a tracrRNA.

Electroporation is a delivery technique in which an electrical field is applied to one or more cells in order to increase the permeability of the cell membrane, which allows substances such as drugs, nucleic acids (genome-targeting nucleic acids), proteins (site-directed polypeptides), or RNPs, to be introduced into the cell. In general, electroporation works by passing thousands of volts across a distance of one to two millimeters of suspended cells in an electroporation cuvette (1.0-1.5 kV, 250-750V/cm). As used herein, the term "zap" or "zapping" may be used to describe an electroporation event.

Polynucleotides can be delivered by non-viral delivery vehicles including, but not limited to, nanoparticles, liposomes, ribonucleoproteins, positively charged peptides, small molecule RNA-conjugates, aptamer-RNA chimeras, and RNA-fusion protein complexes. Some exemplary non-viral delivery vehicles are described in Peer and Lieberman, Gene Therapy, 18:1127-1133 (2011) (which focuses on non-viral delivery vehicles for siRNA that are also useful for delivery of other polynucleotides).

Polynucleotides, such as guide RNA, sgRNA, and mRNA encoding an endonuclease, can be delivered to a cell or a patient by a lipid nanoparticle (LNP).

A LNP refers to any particle having a diameter of less than 1000 nm, 500 nm, 250 nm, 200 nm, 150 nm, 100 nm, 75 nm, 50 nm, or 25 nm. Alternatively, a nanoparticle can range in size from 1-1000 nm, 1-500 nm, 1-250 nm, 25-200 nm, 25-100 nm, 35-75 nm, or 25-60 nm.

LNPs can be made from cationic, anionic, or neutral lipids. Neutral lipids, such as the fusogenic phospholipid DOPE or the membrane component cholesterol, can be included in LNPs as 'helper lipids' to enhance transfection activity and nanoparticle stability. Limitations of cationic lipids include low efficacy owing to poor stability and rapid clearance, as well as the generation of inflammatory or anti-inflammatory responses.

LNPs can also be comprised of hydrophobic lipids, hydrophilic lipids, or both hydrophobic and hydrophilic lipids.

Any lipid or combination of lipids that are known in the art can be used to produce a LNP. Examples of lipids used to produce LNPs are: DOTMA, DOSPA, DOTAP, DMRIE, DC-cholesterol, DOTAP-cholesterol, GAP-DMORIE-DPyPE, and GL67A-DOPE-DMPE-polyethylene glycol (PEG). Examples of cationic lipids are: 98N12-5, C12-200, DLin-KC2-DMA (KC2), DLin-MC3-DMA (MC3), XTC, MD1, and 7C1. Examples of neutral lipids are: DPSC, DPPC, POPC, DOPE, and SM. Examples of PEG-modified lipids are: PEG-DMG, PEG-CerC14, and PEG-CerC20.

The lipids can be combined in any number of molar ratios to produce a LNP. In addition, the polynucleotide(s) can be combined with lipid(s) in a wide range of molar ratios to produce a LNP.

As stated previously, the site-directed polypeptide and genome-targeting nucleic acid can each be administered separately to a cell or a patient. On the other hand, the site-directed polypeptide can be pre-complexed with one or more guide RNAs, or one or more crRNA together with a tracrRNA. The pre-complexed material can then be administered to a cell or a patient. Such pre-complexed material is known as a ribonucleoprotein particle (RNP).

RNA is capable of forming specific interactions with RNA or DNA. While this property is exploited in many biological processes, it also comes with the risk of promiscuous interactions in a nucleic acid-rich cellular environment. One solution to this problem is the formation of ribonucleoprotein particles (RNPs), in which the RNA is pre-complexed with an endonuclease. Another benefit of the RNP is protection of the RNA from degradation.

The endonuclease in the RNP can be modified or unmodified. Likewise, the gRNA, crRNA, tracrRNA, or sgRNA can be modified or unmodified. Numerous modifications are known in the art and can be used.

The endonuclease and sgRNA can be generally combined in a 1:1 molar ratio. Alternatively, the endonuclease, crRNA and tracrRNA can be generally combined in a 1:1:1 molar ratio. However, a wide range of molar ratios can be used to produce a RNP.

A recombinant adeno-associated virus (AAV) vector can be used for delivery. Techniques to produce rAAV particles, in which an AAV genome to be packaged that includes the polynucleotide to be delivered, rep and cap genes, and helper virus functions are provided to a cell are standard in the art. Production of rAAV typically requires that the following components are present within a single cell (denoted herein as a packaging cell): a rAAV genome, AAV rep and cap genes separate from (i.e., not in) the rAAV genome, and helper virus functions. The AAV rep and cap genes may be from any AAV serotype for which recombinant virus can be derived, and may be from a different AAV serotype than the rAAV genome ITRs, including, but not limited to, AAV serotypes AAV-1, AAV-2, AAV-3, AAV-4, AAV-5, AAV-6, AAV-7, AAV-8, AAV-9, AAV-10, AAV-11, AAV-12, AAV-13 and AAV rh.74. Production of pseudotyped rAAV is disclosed in, for example, international patent application publication number WO 01/83692. See Table 3.

TABLE 3

| AAV Serotype | Genbank Accession No. |
|---|---|
| AAV-1 | NC_002077.1 |
| AAV-2 | NC_001401.2 |
| AAV-3 | NC_001729.1 |
| AAV-3B | AF028705.1 |
| AAV-4 | NC_001829.1 |
| AAV-5 | NC_006152.1 |
| AAV-6 | AF028704.1 |
| AAV-7 | NC_006260.1 |
| AAV-8 | NC_006261.1 |
| AAV-9 | AX753250.1 |
| AAV-10 | AY631965.1 |
| AAV-11 | AY631966.1 |
| AAV-12 | DQ813647.1 |
| AAV-13 | EU285562.1 |

A method of generating a packaging cell involves creating a cell line that stably expresses all of the necessary components for AAV particle production. For example, a plasmid (or multiple plasmids) comprising a rAAV genome lacking AAV rep and cap genes, AAV rep and cap genes separate from the rAAV genome, and a selectable marker, such as a neomycin resistance gene, are integrated into the genome of a cell. AAV genomes have been introduced into bacterial plasmids by procedures such as GC tailing (Samulski et al., 1982, Proc. Natl. Acad. S6. USA, 79:2077-2081), addition of synthetic linkers containing restriction endonuclease cleavage sites (Laughlin et al., 1983, Gene, 23:65-73) or by direct, blunt-end ligation (Senapathy & Carter, 1984, J. Biol. Chem., 259:4661-4666). The packaging cell line can then be infected with a helper virus, such as adenovirus. The advantages of this method are that the cells are selectable and are suitable for large-scale production of rAAV. Other examples of suitable methods employ adenovirus or baculovirus, rather than plasmids, to introduce rAAV genomes and/or rep and cap genes into packaging cells.

General principles of rAAV production are reviewed in, for example, Carter, 1992, Current Opinions in Biotechnology, 1533-539; and Muzyczka, 1992, Curr. Topics in Microbial. and Immunol., 158:97-129). Various approaches are described in Ratschin et al., Mol. Cell. Biol. 4:2072 (1984); Hermonat et al., Proc. Natl. Acad. Sci. USA, 81:6466 (1984); Tratschin et al., Mol. Cell. Biol. 5:3251 (1985); Mclaughlin et al., J. Virol., 62:1963 (1988); and Lebkowski et al., 1988 Mol. Cell. Biol., 7:349 (1988). Samulski et al. (1989, J. Virol., 63:3822-3828); U.S. Pat. No. 5,173,414; WO 95/13365 and corresponding U.S. Pat. No. 5,658,776; WO 95/13392; WO 96/17947; PCT/US98/18600; WO 97/09441 (PCT/US96/14423); WO 97/08298 (PCT/US96/13872); WO 97/21825 (PCT/US96/20777); WO 97/06243 (PCT/FR96/01064); WO 99/11764; Perrin et al. (1995)

Vaccine 13:1244-1250; Paul et al. (1993) Human Gene Therapy 4:609-615; Clark et al. (1996) Gene Therapy 3:1124-1132; U.S. Pat. Nos. 5,786,211; 5,871,982; and 6,258,595.

AAV vector serotypes can be matched to target cell types. For example, the following exemplary cell types can be transduced by the indicated AAV serotypes among others. See Table 4.

TABLE 4

| Tissue/Cell Type | Serotype |
|---|---|
| Liver | AAV8, AAV3, AAV5, AAV9 |
| Skeletal muscle | AAV1, AAV7, AAV6, AAV8, AAV9 |
| Central nervous system | AAV5, AAV1, AAV4 |
| RPE | AAV5, AAV4 |
| Photoreceptor cells | AAV5 |
| Lung | AAV9 |
| Heart | AAV8 |
| Pancreas | AAV8 |
| Kidney | AAV2, AA8 |

In addition to adeno-associated viral vectors, other viral vectors can be used. Such viral vectors include, but are not limited to, lentivirus, alphavirus, enterovirus, pestivirus, baculovirus, herpesvirus, Epstein Barr virus, papovaviruses, poxvirus, vaccinia virus, and herpes simplex virus.

In some cases, Cas9 mRNA, sgRNA targeting one or two loci within or near a human beta globin locus on chromosome 11 and within or near one or more of: a BCL11A gene on chromosome 2, and a DNA sequence that encodes a transcriptional control region of the BCL11A gene on chromosome 2 can each be separately formulated into lipid nanoparticles, or are all co-formulated into one lipid nanoparticle.

In some cases, Cas9 mRNA can be formulated in a lipid nanoparticle, while sgRNA can be delivered in an AAV vector.

Options are available to deliver the Cas9 nuclease as a DNA plasmid, as mRNA or as a protein. The guide RNA can be expressed from the same DNA, or can also be delivered as an RNA. The RNA can be chemically modified to alter or improve its half-life, or decrease the likelihood or degree of immune response. The endonuclease protein can be complexed with the gRNA prior to delivery. Viral vectors allow efficient delivery; split versions of Cas9 and smaller orthologs of Cas9 can be packaged in AAV. A range of non-viral delivery methods also exist that can deliver each of these components, or non-viral and viral methods can be employed in tandem. For example, nano-particles can be used to deliver the protein and guide RNA, while AAV can be used to deliver a donor DNA.

Guide RNA Formulation

Guide RNAs of the invention can be formulated with pharmaceutically acceptable excipients such as carriers, solvents, stabilizers, adjuvants, diluents, etc., depending upon the particular mode of administration and dosage form. Guide RNA compositions can be generally formulated to achieve a physiologically compatible pH, and range from a pH of about 3 to a pH of about 11, about pH 3 to about pH 7, depending on the formulation and route of administration. In alternative aspects, the pH can be adjusted to a range from about pH 5.0 to about pH 8. In some aspects, the compositions can comprise a therapeutically effective amount of at least one compound as described herein, together with one or more pharmaceutically acceptable excipients. Optionally, the compositions can comprise a combination of the compounds described herein, or may include a second active ingredient useful in the treatment or prevention of bacterial growth (for example and without limitation, anti-bacterial or anti-microbial agents), or may include a combination of reagents of the invention.

Suitable excipients can include, for example, carrier molecules that include large, slowly metabolized macromolecules such as proteins, polysaccharides, polylactic acids, polyglycolic acids, polymeric amino acids, amino acid copolymers, and inactive virus particles. Other exemplary excipients can include antioxidants (for example and without limitation, ascorbic acid), chelating agents (for example and without limitation, EDTA), carbohydrates (for example and without limitation, dextrin, hydroxyalkylcellulose, and hydroxyalkylmethylcellulose), stearic acid, liquids (for example and without limitation, oils, water, saline, glycerol and ethanol) wetting or emulsifying agents, pH buffering substances, and the like.

Genetically Modified Cells

The term "genetically modified cell" refers to a cell that comprises at least one genetic modification introduced by genome editing (e.g., using the CRISPR/Cas9/Cpf1 system). In some ex-vivo examples herein, the genetically modified cell can be a genetically modified progenitor cell. In some in vivo examples herein, the genetically modified cell can be a genetically modified hematopoietic progenitor cell. A genetically modified cell comprising an exogenous genome-targeting nucleic acid and/or an exogenous nucleic acid encoding a genome-targeting nucleic acid is contemplated herein.

In connection with de-repressing γ-globin expression, the phrase "increasing γ-globin levels in a cell" or "increased γ-globin expression in a cell" indicates that γ-globin in a cell or population of cells is at least 2% higher in the cell or population of cells subject to genome editing than in a comparable, control population, in which there has been no genome editing. In some aspects, the increase in γ-globin expression is at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 16%, at least about 17%, at least about 18%, at least about 19%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, at least about 2-fold, at least about 3-fold, at least about 4-fold, at least about 5-fold, at least about 6-fold, at least about 7-fold, at least about 8-fold, at least about 9-fold, at least about 10-fold, at least about 15-fold, at least about 20-fold, at least about 25-fold, at least about 30-fold, at least about 35-fold, at least about 40-fold, at least about 45-fold, at least about 50-fold, at least about 100-fold or more than a comparable control treated population. The term "control treated population" describes a population of cells that has been treated with identical media, viral induction, nucleic acid sequences, temperature, confluency, flask size, pH, etc., with the exception of the addition of the genome editing components. Any method known in the art can be used to measure an increase in γ-globin expression, for example, Western Blot analysis of γ-globin or quantifying γ-globin mRNA.

The term "isolated cell" refers to a cell that has been removed from an organism in which it was originally found, or a descendant of such a cell. Optionally, the cell can be cultured in vitro, e.g., under defined conditions or in the presence of other cells. Optionally, the cell can be later introduced into a second organism or re-introduced into the organism from which it (or the cell from which it is descended) was isolated.

The term "isolated population" with respect to an isolated population of cells refers to a population of cells that has been removed and separated from a mixed or heterogeneous population of cells. In some cases, the isolated population can be a substantially pure population of cells, as compared to the heterogeneous population from which the cells were isolated or enriched. In some cases, the isolated population can be an isolated population of human hematopoietic progenitor cells, e.g., a substantially pure population of human hematopoietic progenitor cells as compared to a heterogeneous population of cells comprising human hematopoietic progenitor cells and cells from which the human hematopoietic progenitor cells were derived.

The term "substantially enhanced," with respect to a particular cell population, refers to a population of cells in which the occurrence of a particular type of cell is increased relative to pre-existing or reference levels, by at least 2-fold, at least 3-, at least 4-, at least 5-, at least 6-, at least 7-, at least 8-, at least 9, at least 10-, at least 20-, at least 50-, at least 100-, at least 400-, at least 1000-, at least 5000-, at least 20000-, at least 100000- or more fold depending, e.g., on the desired levels of such cells for ameliorating a hemoglobinopathy.

The term "substantially enriched" with respect to a particular cell population, refers to a population of cells that is at least: about 10%, about 20%, about 30%, about 40%, about 50%, about 60%, about 70% or more with respect to the cells making up a total cell population.

The term "substantially pure" with respect to a particular cell population, refers to a population of cells that is at least about 75%, at least about 85%, at least about 90%, or at least about 95% pure, with respect to the cells making up a total cell population. That is, the terms "substantially pure" or "essentially purified," with regard to a population of hematopoietic progenitor cells, refers to a population of cells that contain fewer than: about 20%, about 15%, about 10%, about 9%, about 8%, about 7%, about 6%, about 5%, about 4%, about 3%, about 2%, about 1%, or less than 1%, of cells that are not hematopoietic progenitor cells as defined by the terms herein.

Human Cells

For ameliorating hemoglobinopathies, as described and illustrated herein, the principal targets for gene editing are human cells. For example, in the ex-vivo methods, the human cells can be somatic cells, which after being modified using the techniques as described, can give rise to red blood cells (RBCs) or progenitor cells with increased levels of HbF in a patient suffering from a hemoglobinopathy such as β-thalassemia or sickle cell disease.

As described herein and in the art, even relatively modest and incremental increases in levels of HbF in a patient suffering from a hemoglobinopathy such as β-thalassemia or sickle cell disease can be beneficial for improvement of symptoms and/or survival. In some aspects, the levels of HbF achieved can tend toward those observed in patients with HPFH, which vary among patients and type of HPFH but in a substantial number of cases result in HbF comprising in the range of 10-30% of total hemoglobin (versus 1-2% in typical adults). However, studies have shown that lower levels of HbF can nevertheless have effects that are significant enough to be regarded as decreasing overall mortality expectations among groups of patients with SCD; see, e.g., Platt et al., *N Engl J Med.* 330 (23): 1639-1644 (1994). And even modest improvements of symptoms can have beneficial effects for patients. For example, a reduction in the need for transfusions, a lessening of the incidence or severity of one or more symptoms of a hemoglobinopathy, or a reduction of side effects as a result of reduced levels or frequency of treatments or procedures can all be meaningful and beneficial for patients. Accordingly, in some aspects, the increase in HbF can be in the range of about 80%, 60%, 40% or 20% of the levels of HbF observed in patients with HPFH. Further considerations regarding levels of HbF that can be achieved are provided herein, including the detailed description and examples, as supplemented by references cited herein and/or published in the art.

By performing gene editing as described herein in progenitor cells such as erythroid progenitor cells, such as autologous progenitor cells that are derived from and therefore already completely matched with the patient in need, it can be possible to generate cells that can be safely reintroduced into the patient and effectively give rise to a population of circulating RBCs that can be effective in ameliorating one or more clinical conditions associated with the patient's disease.

While the presence of significant numbers of RBCs having elevated levels of HbF is beneficial, in some aspects more than one quarter of circulating red blood cells (RBCs) can have significantly elevated levels of HbF, in some aspects at least half of circulating RBCs can have significantly elevated levels of HbF, and in some aspects at least 80% of circulating RBCs can have significantly elevated levels of HbF in order to effectively prevent clinical erythrocyte sickling.

Progenitor cells (also referred to as stem cells herein), such as erythroid or hematopoietic progenitor cells, are capable of both proliferation and giving rise to more progenitor cells, these in turn having the ability to generate a large number of mother cells that can in turn give rise to differentiated or differentiable daughter cells. The daughter cells themselves can be induced to proliferate and produce progeny that subsequently differentiate into one or more mature cell types, while also retaining one or more cells with parental developmental potential. The term "stem cell" refers then, to a cell with the capacity or potential, under particular circumstances, to differentiate to a more specialized or differentiated phenotype, and which retains the capacity, under certain circumstances, to proliferate without substantially differentiating. In one aspect, the term progenitor or stem cell refers to a generalized mother cell whose descendants (progeny) specialize, often in different directions, by differentiation, e.g., by acquiring completely individual characters, as occurs in progressive diversification of embryonic cells and tissues. Cellular differentiation is a complex process typically occurring through many cell divisions. A differentiated cell can derive from a multipotent cell that itself is derived from a multipotent cell, and so on. While each of these multipotent cells can be considered stem cells, the range of cell types that each can give rise to may vary considerably. Some differentiated cells also have the capacity to give rise to cells of greater developmental potential. Such capacity can be natural or can be induced artificially upon treatment with various factors. In many biological instances, stem cells can also be "multipotent" because they can produce progeny of more than one distinct cell type, but this is not required for "stem-ness."

Self-renewal can be another important aspect of the stem cell. In theory, self-renewal can occur by either of two major mechanisms. Stem cells can divide asymmetrically, with one daughter retaining the stem state and the other daughter expressing some distinct other specific function and phenotype. Alternatively, some of the stem cells in a population can divide symmetrically into two stems, thus maintaining some stem cells in the population as a whole, while other cells in the population give rise to differentiated progeny only. Generally, "progenitor cells" have a cellular phenotype that is more primitive (i.e., is at an earlier step along a developmental pathway or progression than is a fully differentiated cell). Often, progenitor cells also have significant or very high proliferative potential. Progenitor cells can give rise to multiple distinct differentiated cell types or to a single differentiated cell type, depending on the developmental pathway and on the environment in which the cells develop and differentiate.

In the context of cell ontogeny, the adjective "differentiated," or "differentiating" is a relative term. A "differentiated cell" is a cell that has progressed further down the developmental pathway than the cell to which it is being compared. Thus, stem cells can differentiate into lineage-restricted precursor cells (such as a hematopoietic progenitor cell), which in turn can differentiate into other types of precursor cells further down the pathway (such as an erythrocyte precursor), and then to an end-stage differentiated cell, such as an erythrocyte, which plays a characteristic role in a certain tissue type, and may or may not retain the capacity to proliferate further.

The term "hematopoietic progenitor cell" refers to cells of a stem cell lineage that give rise to all the blood cell types, including erythroid (erythrocytes or red blood cells (RBCs)), myeloid (monocytes and macrophages, neutrophils, basophils, eosinophils, megakaryocytes/platelets, and dendritic cells), and lymphoid (T-cells, B-cells, NK-cells).

A "cell of the erythroid lineage" indicates that the cell being contacted is a cell that undergoes erythropoiesis such that upon final differentiation it forms an erythrocyte or red blood cell. Such cells originate from bone marrow hematopoietic progenitor cells. Upon exposure to specific growth factors and other components of the hematopoietic microenvironment, hematopoietic progenitor cells can mature through a series of intermediate differentiation cellular types, all intermediates of the erythroid lineage, into RBCs. Thus, cells of the "erythroid lineage" comprise hematopoietic progenitor cells, rubriblasts, prorubricytes, erythroblasts, metarubricytes, reticulocytes, and erythrocytes.

The hematopoietic progenitor cell can express at least one of the following cell surface markers characteristic of hematopoietic progenitor cells: CD34+, CD59+, Thy1/CD90+, CD3810/−, and C-kit/CDI 17+. In some examples provided herein, the hematopoietic progenitors can be CD34+.

The hematopoietic progenitor cell can be a peripheral blood stem cell obtained from the patient after the patient has been treated with one or more factors such as granulocyte colony stimulating factor (optionally in combination with Plerixaflor). In illustrative aspects, CD34+ cells are enriched using CliniMACS® Cell Selection System (Miltenyi Biotec). CD34+ cells can be stimulated in serum-free medium (e.g., CellGrow SCGM media, CellGenix) with cytokines (e.g., SCF, rhTPO, rhFLT3) before genome editing. Addition of SR1 and dmPGE2 and/or other factors is contemplated to improve long-term engraftment.

The hematopoietic progenitor cells of the erythroid lineage can have a cell surface marker characteristic of the erythroid lineage: such as CD71 and Terl 19.

Hematopoietic stem cells (HSCs) can be an important target for gene therapy as they provide a prolonged source of the corrected cells. HSCs give rise to both the myeloid and lymphoid lineages of blood cells. Mature blood cells have a finite life-span and must be continuously replaced throughout life. Blood cells are continually produced by the proliferation and differentiation of a population of pluripotent HSCs that can be replenished by self-renewal. Bone marrow (BM) is the major site of hematopoiesis in humans and a good source for hematopoietic stem and progenitor cells (HSPCs). HSPCs can be found in small numbers in the peripheral blood (PB). In some indications or treatments their numbers increase. The progeny of HSCs mature through stages, generating multi-potential and lineage-committed progenitor cells. Treated cells, such as CD34+ cells, would be returned to the patient. The level of engraftment can be important, as is the ability of the cells' multilineage engraftment of gene-edited cells following CD34+ infusion in vivo.

Induced Pluripotent Stem Cells

The genetically engineered human cells described herein can be induced pluripotent stem cells (iPSCs). An advantage of using iPSCs is that the cells can be derived from the same subject to which the progenitor cells are to be administered. That is, a somatic cell can be obtained from a subject, reprogrammed to an induced pluripotent stem cell, and then re-differentiated into a hematopoietic progenitor cell to be administered to the subject (e.g., autologous cells). Because the progenitors are essentially derived from an autologous source, the risk of engraftment rejection or allergic response can be reduced compared to the use of cells from another subject or group of subjects. In some aspects, the hematopoietic progenitors are derived from non-autologous sources. In addition, the use of iPSCs negates the need for cells obtained from an embryonic source. Thus, in one aspect, the stem cells used in the disclosed methods are not embryonic stem cells.

Although differentiation is generally irreversible under physiological contexts, several methods have been recently developed to reprogram somatic cells to iPSCs. Exemplary methods are known to those of skill in the art and are described briefly herein below.

The term "reprogramming" refers to a process that alters or reverses the differentiation state of a differentiated cell (e.g., a somatic cell). Stated another way, reprogramming refers to a process of driving the differentiation of a cell backwards to a more undifferentiated or more primitive type of cell. It should be noted that placing many primary cells in culture can lead to some loss of fully differentiated characteristics. Thus, simply culturing such cells included in the term differentiated cells does not render these cells non-differentiated cells (e.g., undifferentiated cells) or pluripotent cells. The transition of a differentiated cell to pluripotency requires a reprogramming stimulus beyond the stimuli that lead to partial loss of differentiated character in culture. Reprogrammed cells also have the characteristic of the capacity of extended passaging without loss of growth potential, relative to primary cell parents, which generally have capacity for only a limited number of divisions in culture.

The cell to be reprogrammed can be either partially or terminally differentiated prior to reprogramming. Reprogramming can encompass complete reversion of the differentiation state of a differentiated cell (e.g., a somatic cell) to a pluripotent state or a multipotent state. Reprogramming can encompass complete or partial reversion of the differentiation state of a differentiated cell (e.g., a somatic cell) to an undifferentiated cell (e.g., an embryonic-like cell). Reprogramming can result in expression of particular genes by the cells, the expression of which further contributes to reprogramming. In certain examples described herein, reprogramming of a differentiated cell (e.g., a somatic cell) can cause the differentiated cell to assume an undifferentiated state (e.g., is an undifferentiated cell). The resulting cells are referred to as "reprogrammed cells," or "induced pluripotent stem cells (iPSCs or iPS cells)."

Reprogramming can involve alteration, e.g., reversal, of at least some of the heritable patterns of nucleic acid modification (e.g., methylation), chromatin condensation, epigenetic changes, genomic imprinting, etc., that occur during cellular differentiation. Reprogramming is distinct from simply maintaining the existing undifferentiated state of a cell that is already pluripotent or maintaining the existing less than fully differentiated state of a cell that is already a multipotent cell (e.g., a hematopoietic stem cell). Reprogramming is also distinct from promoting the self-renewal or proliferation of cells that are already pluripotent or multipotent, although the compositions and methods described herein can also be of use for such purposes, in some examples.

Many methods are known in the art that can be used to generate pluripotent stem cells from somatic cells. Any such method that reprograms a somatic cell to the pluripotent phenotype would be appropriate for use in the methods described herein.

Reprogramming methodologies for generating pluripotent cells using defined combinations of transcription factors have been described. Mouse somatic cells can be converted to ES cell-like cells with expanded developmental potential by the direct transduction of Oct4, Sox2, Klf4, and c-Myc; see, e.g., Takahashi and Yamanaka, *Cell* 126 (4): 663-76 (2006). iPSCs resemble ES cells as they restore the pluripotency-associated transcriptional circuitry and much of the epigenetic landscape. In addition, mouse iPSCs satisfy all the standard assays for pluripotency: specifically, in vitro differentiation into cell types of the three germ layers, teratoma formation, contribution to chimeras, germline transmission [see, e.g., Maherali and Hochedlinger, *Cell Stem Cell*. 3 (6): 595-605 (2008)], and tetraploid complementation.

Human iPSCs can be obtained using similar transduction methods, and the transcription factor trio, OCT4, SOX2, and NANOG, has been established as the core set of transcription factors that govern pluripotency; see, e.g., Budniatzky and Gepstein, *Stem Cells Transl Med*. 3 (4): 448-57 (2014); Barrett et al., *Stem Cells Trans Med* 3:1-6 sctm.2014-0121 (2014); Focosi et al., *Blood Cancer Journal* 4: e211 (2014); and references cited therein. The production of iPSCs can be achieved by the introduction of nucleic acid sequences encoding stem cell-associated genes into an adult, somatic cell, historically using viral vectors.

iPSCs can be generated or derived from terminally differentiated somatic cells, as well as from adult stem cells, or somatic stem cells. That is, a non-pluripotent progenitor cell can be rendered pluripotent or multipotent by reprogramming. In such instances, it may not be necessary to include as many reprogramming factors as required to reprogram a terminally differentiated cell. Further, reprogramming can be induced by the non-viral introduction of reprogramming factors, e.g., by introducing the proteins themselves, or by introducing nucleic acids that encode the reprogramming factors, or by introducing messenger RNAs that upon translation produce the reprogramming factors (see e.g., Warren et al., *Cell Stem Cell,* 7 (5): 618-30 (2010). Reprogramming can be achieved by introducing a combination of nucleic acids encoding stem cell-associated genes including, for example Oct-4 (also known as Oct-3/4 or Pouf51), SoxI, Sox2, Sox3, Sox 15, Sox 18, NANOG, KlfI, Klf2, Klf4, Klf5, NR5A2, c-Myc, 1-Myc, n-Myc, Rem2, Tert, and LIN28. Reprogramming using the methods and compositions described herein can further comprise introducing one or more of Oct-3/4, a member of the Sox family, a member of the Klf family, and a member of the Myc family to a somatic cell. The methods and compositions described herein can further comprise introducing one or more of each of Oct-4, Sox2, Nanog, c-MYC and Klf4 for reprogramming. As noted above, the exact method used for reprogramming is not necessarily critical to the methods and compositions described herein. However, where cells differentiated from the reprogrammed cells are to be used in, e.g., human therapy, in one aspect the reprogramming is not affected by a method that alters the genome. Thus, in such examples, reprogramming can be achieved, e.g., without the use of viral or plasmid vectors.

The efficiency of reprogramming (i.e., the number of reprogrammed cells) derived from a population of starting cells can be enhanced by the addition of various agents, e.g., small molecules, as shown by Shi et al., *Cell—Stem Cell* 2:525-528 (2008); Huangfu et al., *Nature Biotechnology* 26 (7): 795-797 (2008) and Marson et al., *Cell—Stem Cell* 3:132-135 (2008). Thus, an agent or combination of agents that enhance the efficiency or rate of induced pluripotent stem cell production can be used in the production of patient-specific or disease-specific iPSCs. Some non-limiting examples of agents that enhance reprogramming efficiency include soluble Wnt, Wnt conditioned media, BIX-01294 (a G9a histone methyltransferase), PD0325901 (a MEK inhibitor), DNA methyltransferase inhibitors, histone deacetylase (HDAC) inhibitors, valproic acid, 5'-azacytidine, dexamethasone, suberoylanilide, hydroxamic acid (SAHA), vitamin C, and trichostatin (TSA), among others.

Other non-limiting examples of reprogramming enhancing agents include: Suberoylanilide Hydroxamic Acid (SAHA (e.g., MK0683, vorinostat) and other hydroxamic acids), BML-210, Depudecin (e.g., (−)-Depudecin), HC Toxin, Nullscript (4-(1,3-Dioxo-IH,3H-benzo[de]isoquinolin-2-yl)-N-hydroxybutanamide), Phenylbutyrate (e.g., sodium phenylbutyrate) and Valproic Acid ((VPA) and other short chain fatty acids), Scriptaid, Suramin Sodium, Trichostatin A (TSA), APHA Compound 8, Apicidin, Sodium Butyrate, pivaloyloxymethyl butyrate (Pivanex, AN-9), Trapoxin B, Chlamydocin, Depsipeptide (also known as FR901228 or FK228), benzamides (e.g., CI-994 (e.g., N-acetyl dinaline) and MS-27-275), MGCD0103, NVP-LAQ-824, CBHA (m-carboxycinnaminic acid bishydroxamic acid), JNJ16241199, Tubacin, A-161906, proxamide, oxamflatin, 3-Cl-UCHA (e.g., 6-(3-chlorophenylureido) caproic hydroxamic acid), AOE (2-amino-8-oxo-9,10-epoxydecanoic acid), CHAP31 and CHAP 50. Other reprogramming enhancing agents include, for example, dominant negative forms of the HDACs (e.g., catalytically inactive forms), siRNA inhibitors of the HDACs, and antibodies that specifically bind to the HDACs. Such inhibitors are available, e.g., from BIOMOL International, Fukasawa, Merck Biosciences, Novartis, Gloucester Pharmaceuticals, Titan Pharmaceuticals, MethylGene, and Sigma Aldrich.

To confirm the induction of pluripotent stem cells for use with the methods described herein, isolated clones can be tested for the expression of a stem cell marker. Such expression in a cell derived from a somatic cell identifies the cells as induced pluripotent stem cells. Stem cell markers can be selected from the non-limiting group including SSEA3, SSEA4, CD9, Nanog, Fbx15, Ecatl, Esgl, Eras, Gdf3, Fgf4, Cripto, Daxl, Zpf296, Slc2a3, Rexl, Utfl, and Natl. In one case, for example, a cell that expresses Oct4 or Nanog is identified as pluripotent. Methods for detecting the expression of such markers can include, for example, RT-PCR and immunological methods that detect the presence of the encoded polypeptides, such as Western blots or flow cytometric analyses. Detection can involve not only RT-PCR, but can also include detection of protein markers. Intracellular markers may be best identified via RT-PCR, or protein detection methods such as immunocytochemistry, while cell surface markers are readily identified, e.g., by immunocytochemistry.

The pluripotent stem cell character of isolated cells can be confirmed by tests evaluating the ability of the iPSCs to differentiate into cells of each of the three germ layers. As one example, teratoma formation in nude mice can be used to evaluate the pluripotent character of the isolated clones. The cells can be introduced to nude mice and histology and/or immunohistochemistry can be performed on a tumor arising from the cells. The growth of a tumor comprising cells from all three germ layers, for example, further indicates that the cells are pluripotent stem cells.

Creating Patient Specific iPSCs

One step of the ex vivo methods of the present disclosure can involve creating a patient specific iPS cell, patient specific iPS cells, or a patient specific iPS cell line. There are many established methods in the art for creating patient specific iPS cells, as described in Takahashi and Yamanaka 2006; Takahashi, Tanabe et al. 2007. For example, the creating step can comprise: a) isolating a somatic cell, such as a skin cell or fibroblast, from the patient; and b) introducing a set of pluripotency-associated genes into the somatic cell in order to induce the cell to become a pluripotent stem cell. The set of pluripotency-associated genes can be one or more of the genes selected from the group consisting of OCT4, SOX2, KLF4, Lin28, NANOG, and cMYC.

Performing a Biopsy or Aspirate of the Patient's Bone Marrow

A biopsy or aspirate is a sample of tissue or fluid taken from the body. There are many different kinds of biopsies or aspirates. Nearly all of them involve using a sharp tool to remove a small amount of tissue. If the biopsy will be on the skin or other sensitive area, numbing medicine can be applied first. A biopsy or aspirate can be performed according to any of the known methods in the art. For example, in a bone marrow aspirate, a large needle is used to enter the pelvis bone to collect bone marrow.

Isolating a Mesenchymal Stem Cell

Mesenchymal stem cells can be isolated according to any method known in the art, such as from a patient's bone marrow or peripheral blood. For example, marrow aspirate can be collected into a syringe with heparin. Cells can be washed and centrifuged on a Percoll™ density gradient. Percoll™ is composed of colloidal silica coated with polyvinylpyrrolidone (PVP). The silica particles are 15 to 30 nm in diameter and are coated with non-dialyzable polyvinylpyrrolidone (PVP). Cells, such as blood cells, liver cells, interstitial cells, macrophages, mast cells, and thymocytes, can be separated using Percoll™. The cells can be cultured in Dulbecco's modified Eagle's medium (DMEM) (low glucose) containing 10% fetal bovine serum (FBS) (Pittinger M F, Mackay A M, Beck S C et al., Science 1999; 284:143-147).

Treating a Patient with GCSF

A patient can optionally be treated with granulocyte colony stimulating factor (GCSF) in accordance with any method known in the art. The GCSF can be administered in combination with Plerixaflor (also known as Mozobil®).

Plerixaflor is an immunostimulant used to mobilize hematopoietic stem cells into the blood stream.

Isolating a Hematopoietic Progenitor Cell from a Patient

A hematopoietic progenitor cell can be isolated from a patient by any method known in the art. CD34+ cells can be enriched, e.g., using CliniMACS® Cell Selection System (Miltenyi Biotec). CD34+ cells can be weakly stimulated in serum-free medium (e.g., CellGrow SCGM media, CellGenix) with cytokines (e.g., SCF, rhTPO, rhFLT3) before genome editing.

Differentiation of Genome-Edited iPSCs into Hematopoietic Progenitor Cells

Another step of the ex vivo methods of the present disclosure can comprise differentiating the genome-edited iPSCs into hematopoietic progenitor cells. The differentiating step can be performed according to any method known in the art.

Differentiation of Genome-Edited Mesenchymal Stem Cells into Hematopoietic Progenitor Cells Another step of the ex vivo methods of the present disclosure can comprise differentiating the genome-edited mesenchymal stem cells into hematopoietic progenitor cells. The differentiating step can be performed according to any method known in the art.

Implanting Cells into Patients

Another step of the ex vivo methods of the present disclosure can comprise implanting the cells into patients. This implanting step can be accomplished using any method of implantation known in the art. For example, the genetically modified cells can be injected directly in the patient's blood or otherwise administered to the patient. The genetically modified cells may be purified ex vivo using a selected marker.

One advantage of an ex vivo cell therapy approach is the ability to conduct a comprehensive analysis of the therapeutic prior to administration. Nuclease-based therapeutics can have some level of off-target effects. Performing gene correction ex vivo allows one to characterize the corrected cell population prior to implantation. The present disclosure includes sequencing the entire genome of the corrected cells to ensure that the off-target effects, if any, can be in genomic locations associated with minimal risk to the patient. Furthermore, populations of specific cells, including clonal populations, can be isolated prior to implantation.

Another advantage of ex vivo cell therapy relates to genetic correction in iPSCs compared to other primary cell sources. iPSCs are prolific, making it easy to obtain the large number of cells that will be required for a cell-based therapy. Furthermore, iPSCs are an ideal cell type for performing clonal isolations. This allows screening for the correct genomic correction, without risking a decrease in viability. In contrast, other primary cells are viable for only a few passages and difficult to clonally expand. Thus, manipulation of iPSCs for the treatment of hemoglobinopathies can be much easier, and can shorten the amount of time needed to make the desired genetic correction.

For ex vivo therapy, transplantation requires clearance of bone-marrow niches or the donor HSCs to engraft. Current methods rely on radiation and/or chemotherapy. Due to the limitations these impose, safer conditioning regiments have been and are being developed, such as immunodepletion of bone marrow cells by antibodies or antibody toxin conjugates directed against hematopoietic cell surface markers, for example CD117, c-kit and others. Success of HSC transplantation depends upon efficient homing to bone marrow, subsequent engraftment, and bone marrow repopulation. The level of gene-edited cells engrafted is important, as is the ability of the cells' multilineage engraftment.

Hematopoietic stem cells (HSCs) are an important target for ex vivo gene therapy as they provide a prolonged source of the corrected cells. Treated CD34+ cells would be returned to the patient.

Methods can also include an in vivo based therapy. Chromosomal DNA of the cells in the patient is edited using the materials and methods described herein. The cells can be bone marrow cells, hematopoietic progenitor cells, or CD34+ cells.

Although blood cells present an attractive target for ex vivo treatment and therapy, increased efficacy in delivery may permit direct in vivo delivery to the hematopoietic stem cells (HSCs) and/or other B and T cell progenitors, such as CD34+ cells. Ideally the targeting and editing would be directed to the relevant cells. Cleavage in other cells can also be prevented by the use of promoters only active in certain cells and or developmental stages. Additional promoters are inducible, and therefore can be temporally controlled if the nuclease is delivered as a plasmid. The amount of time that delivered RNA and protein remain in the cell can also be adjusted using treatments or domains added to change the half-life. In vivo treatment would eliminate a number of treatment steps, but a lower rate of delivery can require higher rates of editing. In vivo treatment can eliminate problems and losses from ex vivo treatment and engraftment.

An advantage of in vivo gene therapy can be the ease of therapeutic production and administration. The same therapeutic approach and therapy will have the potential to be used to treat more than one patient, for example a number of patients who share the same or similar genotype or allele. In contrast, ex vivo cell therapy typically requires using a patient's own cells, which are isolated, manipulated and returned to the same patient.

Pharmaceutically Acceptable Carriers

The ex vivo methods of administering progenitor cells to a subject contemplated herein can involve the use of therapeutic compositions comprising progenitor cells.

Therapeutic compositions can contain a physiologically tolerable carrier together with the cell composition, and optionally at least one additional bioactive agent as described herein, dissolved or dispersed therein as an active ingredient. In some cases, the therapeutic composition is not substantially immunogenic when administered to a mammal or human patient for therapeutic purposes, unless so desired.

In general, the progenitor cells described herein can be administered as a suspension with a pharmaceutically acceptable carrier. One of skill in the art will recognize that a pharmaceutically acceptable carrier to be used in a cell composition will not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the progenitor cells, as described herein, using routine experimentation.

A cell composition can also be emulsified or presented as a liposome composition, provided that the emulsification procedure does not adversely affect cell viability. The cells and any other active ingredient can be mixed with excipients that are pharmaceutically acceptable and compatible with the active ingredient and in amounts suitable for use in the therapeutic methods described herein.

Additional agents included in a cell composition can include pharmaceutically acceptable salts of the components therein. Pharmaceutically acceptable salts include the acid addition salts (formed with the free amino groups of the polypeptide) that are formed with inorganic acids such as, for example, hydrochloric or phosphoric acids, or such organic acids as acetic, tartaric, mandelic and the like. Salts formed with the free carboxyl groups can also be derived from inorganic bases such as, for example, sodium, potassium, ammonium, calcium or ferric hydroxides, and such organic bases as isopropylamine, trimethylamine, 2-ethyl-amino ethanol, histidine, procaine and the like.

Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, polyethylene glycol and other solutes. Liquid compositions can also contain liquid phases in addition to and to the exclusion of water. Exemplary of such additional liquid phases are glycerine, vegetable oils such as cottonseed oil, and water-oil emulsions. The amount of an active compound used in the cell compositions that is effective in the treatment of a particular disorder or condition can depend on the nature of the disorder or condition, and can be determined by standard clinical techniques.

Administration and Efficacy

The terms "administering", "introducing" and "transplanting" are used interchangeably in the context of the placement of cells, e.g., progenitor cells, into a subject, by a method or route that results in at least partial localization of the introduced cells at a desired site, such as a site of injury or repair, such that a desired effect(s) is produced. The cells e.g., progenitor cells, or their differentiated progeny can be administered by any appropriate route that results in delivery to a desired location in the subject where at least a portion of the implanted cells or components of the cells remain viable. The period of viability of the cells after administration to a subject can be as short as a few hours, e.g., twenty-four hours, to a few days, to as long as several years, or even the lifetime of the patient, i.e., long-term engraftment. For example, in some aspects described herein, an effective amount of hematopoietic progenitor cells is administered via a systemic route of administration, such as an intraperitoneal or intravenous route.

The terms "individual", "subject," "host" and "patient" are used interchangeably herein and refer to any subject for whom diagnosis, treatment or therapy is desired. In some aspects, the subject is a mammal. In some aspects, the subject is a human being.

When provided prophylactically, progenitor cells described herein can be administered to a subject in advance of any symptom of a hemoglobinopathy, e.g., prior to initiation of the switch from fetal γ-globin to predominantly β-globin and/or prior to the development of significant anemia or other symptom associated with the hemoglobinopathy. Accordingly, the prophylactic administration of a hematopoietic progenitor cell population serves to prevent a hemoglobinopathy, as disclosed herein.

When provided therapeutically, hematopoietic progenitor cells are provided at (or after) the onset of a symptom or indication of a hemoglobinopathy, e.g., upon the onset of disease.

The hematopoietic progenitor cell population being administered according to the methods described herein can comprise allogeneic hematopoietic progenitor cells obtained from one or more donors. "Allogeneic" refers to a hematopoietic progenitor cell or biological samples comprising hematopoietic progenitor cells obtained from one or more different donors of the same species, where the genes at one or more loci are not identical. For example, a hematopoietic progenitor cell population being administered to a subject can be derived from umbilical cord blood obtained from one more unrelated donor subjects, or from one or more non-identical siblings. In some cases, syngeneic hematopoietic progenitor cell populations can be used, such as those obtained from genetically identical animals, or from identical twins. The hematopoietic progenitor cells can be autologous cells; that is, the hematopoietic progenitor cells can be obtained or isolated from a subject and administered to the same subject, i.e., the donor and recipient are the same.

The term "effective amount" refers to the amount of a population of progenitor cells or their progeny needed to prevent or alleviate at least one or more sign or symptom of a hemoglobinopathy, and relates to a sufficient amount of a composition to provide the desired effect, e.g., to treat a subject having a hemoglobinopathy. The term "therapeutically effective amount" therefore refers to an amount of progenitor cells or a composition comprising progenitor cells that is sufficient to promote a particular effect when administered to a typical subject, such as one who has or is at risk for a hemoglobinopathy. An effective amount, as used herein, would also include an amount sufficient to prevent or delay the development of a symptom of the disease, alter the course of a symptom of the disease (for example but not limited to, slow the progression of a symptom of the disease), or reverse a symptom of the disease. It is understood that for any given case, an appropriate "effective amount" can be determined by one of ordinary skill in the art using routine experimentation.

For use in the various aspects described herein, an effective amount of progenitor cells, comprises at least $10^2$ progenitor cells, at least $5 \times 10^2$ progenitor cells, at least $10^3$ progenitor cells, at least $5 \times 10^3$ progenitor cells, at least $10^4$ progenitor cells, at least $5 \times 10^4$ progenitor cells, at least $10^5$ progenitor cells, at least $2 \times 10^5$ progenitor cells, at least $3 \times 10^5$ progenitor cells, at least $4 \times 10^5$ progenitor cells, at least $5 \times 10^5$ progenitor cells, at least $6 \times 10^5$ progenitor cells, at least $7 \times 10^5$ progenitor cells, at least $8 \times 10^5$ progenitor cells, at least $9 \times 10^5$ progenitor cells, at least $1 \times 10^6$ progenitor cells, at least $2 \times 10^6$ progenitor cells, at least $3 \times 10^6$ progenitor cells, at least $4 \times 10^6$ progenitor cells, at least $5 \times 10^6$ progenitor cells, at least $6 \times 10^6$ progenitor cells, at least $7 \times 10^6$ progenitor cells, at least $8 \times 10^6$ progenitor cells, at least $9 \times 10^6$ progenitor cells, or multiples thereof. The progenitor cells can be derived from one or more donors, or are can be obtained from an autologous source. In some examples described herein, the progenitor cells can be expanded in culture prior to administration to a subject in need thereof.

Modest and incremental increases in the levels of HbF expressed in cells of patients having a hemoglobinopathy can be beneficial for ameliorating one or more symptoms of the disease, for increasing long-term survival, and/or for reducing side effects associated with other treatments. In some embodiments, upon administration of such cells to human patients, the presence of RBCs that are producing increased levels of HbF is beneficial. In some aspects, effective treatment of a subject gives rise to at least about 9% HbF relative to total Hb in the treated subject. In some aspects, HbF will be at least about 14% of total Hb. In some aspects HbF will be at least about 20% to 30% of total Hb. Similarly, the introduction of even relatively limited sub-populations of cells having significantly elevated levels of HbF (referred to as "F-cells") can be beneficial in various patients since in some situations normalized cells will have a selective advantage relative to diseased cells. However, even modest levels of circulating RBCs with elevated levels of HbF can be beneficial for ameliorating one or more aspects of hemoglobinopathy in patients. In some aspects, about 10%, about 20%, about 30%, about 40%, about 50%, about 60%, about 70%, about 80%, about 90% or more of the RBCs in patients to whom such cells are administered are producing increased levels of HbF as described herein.

"Administered" refers to the delivery of a progenitor cell composition into a subject by a method or route that results in at least partial localization of the cell composition at a desired site. A cell composition can be administered by any appropriate route that results in effective treatment in the subject, i.e. administration results in delivery to a desired location in the subject where at least a portion of the composition delivered, i.e. at least $1 \times 10^4$ cells are delivered to the desired site for a period of time. Modes of administration include injection, infusion, instillation, or ingestion. "Injection" includes, without limitation, intravenous, intra-muscular, intra-arterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In some examples, the route is intravenous. For the delivery of cells, administration by injection or infusion can be made.

The cells can be administered systemically. The phrases "systemic administration," "administered systemically", "peripheral administration" and "administered peripherally" refer to the administration of a population of progenitor cells other than directly into a target site, tissue, or organ, such that it enters, instead, the subject's circulatory system and, thus, is subject to metabolism and other like processes.

The efficacy of a treatment comprising a composition for the treatment of a hemoglobinopathy can be determined by the skilled clinician. However, a treatment is considered "effective treatment," if any one or all of the signs or symptoms of, as but one example, levels of functional fetal hemoglobin, γ-globin expression, and functional BCL11A are altered in a beneficial manner (e.g., increased by at least 10% for HbF, increased by at least 30% for γ-globin expression, and/or decreased by at least 10% for BCL11A), or other clinically accepted symptoms or markers of disease are improved or ameliorated. Efficacy can also be measured by failure of an individual to worsen as assessed by hospitalization or need for medical interventions (e.g., reduced transfusion dependence, or progression of the disease is halted or at least slowed). Methods of measuring these indicators are known to those of skill in the art and/or described herein. Treatment includes any treatment of a disease in an individual or an animal (some non-limiting examples include a human, or a mammal) and includes: (1) inhibiting the disease, e.g., arresting, or slowing the pro-gression of symptoms; or (2) relieving the disease, e.g., causing regression of symptoms; and (3) preventing or reducing the likelihood of the development of symptoms.

In some embodiments, the treatment according to the present invention ameliorates one or more symptoms asso-ciated with a β-hemoglobinopathy by increasing the amount of fetal hemoglobin in the individual. Symptoms and signs typically associated with a hemoglobinopathy, include for example, anemia, tissue hypoxia, organ dysfunction, abnor-mal hematocrit values, ineffective erythropoiesis, abnormal reticulocyte (erythrocyte) count, abnormal iron load, the presence of ring sideroblasts, splenomegaly, hepatomegaly, impaired peripheral blood flow, dyspnea, increased hemoly-sis, jaundice, anemic pain crises, acute chest syndrome, splenic sequestration, priapism, stroke, hand-foot syndrome, and pain such as angina pectoris.

Kits

The present disclosure provides kits for carrying out the methods described herein. A kit can include one or more of: a genome-targeting nucleic acid, a polynucleotide encoding a genome-targeting nucleic acid, a site-directed polypeptide, a polynucleotide encoding a site-directed polypeptide, and/ or any nucleic acid or proteinaceous molecule necessary to carry out the aspects of the methods described herein, or any combination thereof.

A kit can comprise: (1) a vector comprising a nucleotide sequence encoding a genome-targeting nucleic acid, (2) the site-directed polypeptide or a vector comprising a nucleotide sequence encoding the site-directed polypeptide, and (3) a reagent for reconstitution and/or dilution of the vector(s) and or polypeptide.

A kit can comprise: (1) a vector comprising (i) a nucleo-tide sequence encoding a genome-targeting nucleic acid, and (ii) a nucleotide sequence encoding the site-directed poly-peptide; and (2) a reagent for reconstitution and/or dilution of the vector.

In any of the above kits, the kit can comprise a single-molecule guide genome-targeting nucleic acid. In any of the above kits, the kit can comprise a double-molecule genome-targeting nucleic acid. In any of the above kits, the kit can comprise two or more double-molecule guides or single-molecule guides. The kits can comprise a vector that encodes the nucleic acid targeting nucleic acid.

In any of the above kits, the kit can further comprise a polynucleotide to be inserted to effect the desired genetic modification.

Components of a kit can be in separate containers, or combined in a single container.

Any kit described above can further comprise one or more additional reagents, where such additional reagents are selected from a buffer, a buffer for introducing a polypeptide or polynucleotide into a cell, a wash buffer, a control reagent, a control vector, a control RNA polynucleotide, a reagent for in vitro production of the polypeptide from DNA, adaptors for sequencing and the like. A buffer can be a stabilization buffer, a reconstituting buffer, a diluting buffer, or the like. A kit can also comprise one or more components that can be used to facilitate or enhance the on-target binding or the cleavage of DNA by the endonu-clease, or improve the specificity of targeting.

In addition to the above-mentioned components, a kit can further comprise instructions for using the components of the kit to practice the methods. The instructions for prac-ticing the methods can be recorded on a suitable recording medium. For example, the instructions can be printed on a substrate, such as paper or plastic, etc. The instructions can be present in the kits as a package insert, in the labeling of the container of the kit or components thereof (i.e., associ-ated with the packaging or subpackaging), etc. The instruc-tions can be present as an electronic storage data file present on a suitable computer readable storage medium, e.g. CD-ROM, diskette, flash drive, etc. In some instances, the actual instructions are not present in the kit, but means for obtaining the instructions from a remote source (e.g. via the Internet), can be provided. An example of this case is a kit that comprises a web address where the instructions can be viewed and/or from which the instructions can be downloaded. As with the instructions, this means for obtaining the instructions can be recorded on a suitable substrate.

Electroporation

The process of electroporation generally involves the formation of pores in a cell membrane, or in a vesicle, by the application of electric field pulses across a liquid cell suspension containing cells or vesicles. During the poration process, cells are often suspended in a liquid media and then subjected to an electric field pulse. The medium can be electrolyte, non-electrolyte, or a mixture of electrolytes and non-electrolytes. The strength of the electric field applied to the suspension and the length of the pulse (the time that the electric field is applied to a cell suspension) varies according to the cell type. To create a pore in a cell's outer membrane, the electric field must be applied for such a length of time and at such a voltage as to create a set potential across the cell membrane for a period of time long enough to create a pore.

Applying a voltage across a plasma membrane that exceeds a certain threshold level forms a pore in the membrane. If the strength of the applied electrical field and/or duration of exposure to it are properly chosen, the pores formed by the electrical pulse reseal after a short period of time, during which extracellular compounds have a chance to enter into the cell. However, excessive exposure of live cells to electrical fields can cause apoptosis and/or necrosis-processes that result in cell death.

Generally, the process of electroporation is often used for the transformation of bacteria, yeast, plant protoplasts, cultured cells and other cells or vesicles as a way of introducing some substance into a cell or a vesicle, such as loading it with a molecular probe, a drug that can change the cell's function, or pieces of DNA or forms of RNA, such as mRNA, siRNA, guide RNA (gRNA) or microRNA. This procedure is also highly efficient for the introduction of chemical or biological agents that specifically intervene in molecular pathways in tissue culture cells or primary cells, especially mammalian cells. For example, electroporation is used in the process of producing knockout mice, as well as in tumor treatment, gene therapy, and cell-based therapy.

Successive Gene Editing

In some embodiments, the present disclosure utilizes multiple, successive gene editing steps. In some embodiments, successive gene editing steps involve the use of multiple, successive electroporations to introduce gene editing compositions, e.g., gRNA(s) and CRISPR endonucleases (e.g., Cas9 or Cpf1).

In some embodiments, each successive gene editing step (e.g., each electroporation step) involves use the same compositions, e.g., use the same gRNA(s) and same CRISPR endonuclease(s). In other embodiments, successive gene editing steps (e.g., successive electroporation steps) involve different compositions, e.g., use of different gRNA(s) and/or different CRISPR endonuclease(s). In some embodiments, each successive gene editing step (e.g., each electroporation step) targets the same chromosomal locus. In other embodiments, successive gene editing steps (e.g., successive electroporation steps) target different chromosomal loci. In some embodiments, successive gene editing steps (e.g., successive electroporation steps) involve targeting of a human beta globin locus on chromosome 11 and/or one or more BCL11A-related loci on chromosome 2.

In some embodiments, successive gene editing steps (e.g., successive electroporation steps) may comprise the use of a HPFH5 gRNA, e.g., HPFH5-1, HPFH5-D, HPFH5-T5, or HPFH5-T7, a Kenya gRNA, e.g., Kenya-K5, Kenya-K17, a 1450 gRNA, a SPY101 gRNA, and/or a SD2 gRNA. In some embodiments, successive gene editing steps (e.g., successive electroporation steps) may comprise the use of one or more gRNAs provided in Table 2. In some embodiments, successive gene editing steps may comprise the use of at least one SPY101 gRNA in combination with at least one HPFH5 gRNA (e.g., one editing step with SPY101 gRNA and another editing step with at least one HPFH5 gRNA). In some embodiments, successive gene editing steps may comprise the use of a SPY101 gRNA in combination with a HPFH5-1 gRNA (e.g., one editing step with SPY101 gRNA and another editing step with HPFH5-1 gRNA). In some embodiments, successive gene editing steps may comprise the use of a SPY101 gRNA in combination with a HPFH5-D gRNA (e.g., one editing step with SPY101 gRNA and another editing step with HPFH5-D gRNA). In some embodiments, successive gene editing steps may comprise the use of a SPY101 gRNA in combination with a HPFH5-T5 gRNA (e.g., one editing step with SPY101 gRNA and another editing step with HPFH5-T5 gRNA). In some embodiments, successive gene editing steps may comprise the use of a SPY101 gRNA in combination with a HPFH5-T7 gRNA (e.g., one editing step with SPY101 gRNA and another editing step with HPFH5-T7 gRNA). In some embodiments, successive gene editing steps may comprise the use of at least one SPY101 gRNA in combination with at least one Kenya gRNA (e.g., one editing step with SPY101 gRNA and another editing step with at least one Kenya gRNA). In some embodiments, successive gene editing steps may comprise the use of a SPY101 gRNA in combination with a Kenya-K5 gRNA (e.g., one editing step with SPY101 gRNA and another editing step with Kenya-K5 gRNA). In some embodiments, successive gene editing steps may comprise the use of a SPY101 gRNA in combination with a Kenya-K17 gRNA (e.g., one editing step with SPY101 gRNA and another editing step with Kenya-K17 gRNA). In some embodiments, successive gene editing steps may comprise the use of a SPY101 gRNA in combination with HPFH5-1 and HPFH5-D gRNAs (e.g., one editing step with SPY101 gRNA and another one or two editing steps with HPFH5-1 and HPFH5-D gRNAs). In some embodiments, successive gene editing steps may comprise the use of a SPY101 gRNA in combination with HPFH5-T7 and HPFH5-D gRNAs (e.g., one editing step with SPY101 gRNA and another one or two editing steps with HPFH5-T7 and HPFH5-D gRNAs). In some embodiments, successive gene editing steps may comprise the use of a SPY101 gRNA in combination with HPFH5-T5 and HPFH5-1 gRNAs (e.g., one editing step with SPY101 gRNA and another one or two editing steps with HPFH5-T5 and HPFH5-1 gRNAs). In some embodiments, successive gene editing steps may comprise the use of a SPY101 gRNA in combination with Kenya-K5 and Kenya-K17 gRNAs (e.g., one editing step with SPY101 gRNA and another one or two editing steps with Kenya-K5 and Kenya-K17 gRNAs). In some embodiments, successive gene editing steps may comprise the use of a SPY101 gRNA in combination with a SD2 gRNA (e.g., one editing step with SPY101 gRNA and another editing step with SD2 gRNA). In some embodiments, successive gene editing steps may comprise the use of at least one 1450 gRNA in combination with at least one HPFH5 gRNA (e.g., one editing step with 1450 gRNA and another editing step with at least one HPFH5 gRNA). In some embodiments, successive gene editing steps may comprise the use of a 1450 gRNA in combination with a HPFH5-1 gRNA (e.g., one editing step with 1450 gRNA and another editing step with HPFH5-1 gRNA). In some embodiments, successive gene editing steps may comprise the use of a 1450 gRNA in combination with a HPFH5-D gRNA (e.g., one editing step with 1450 gRNA and another editing step with HPFH5-D gRNA). In some embodiments, successive gene editing steps may comprise the use of a 1450 gRNA in combination with a HPFH5-T5 gRNA (e.g., one editing step with 1450 gRNA and another editing step with HPFH5-T5 gRNA). In some embodiments, successive gene editing steps may comprise the use of a 1450 gRNA in combination with a HPFH5-T7 gRNA (e.g., one editing step with 1450 gRNA and another editing step with HPFH5-T7 gRNA). In some embodiments, successive gene editing steps may comprise the use of at least one 1450 gRNA in combination with at least one Kenya gRNA (e.g., one editing step with 1450 gRNA and another editing step with at least one Kenya gRNA). In some embodiments, successive gene editing steps may comprise the use of a 1450 gRNA in combination with a Kenya-K5 gRNA (e.g., one editing step with 1450 gRNA and another editing step with Kenya-K5 gRNA). In some embodiments, successive gene editing steps may comprise the use of a 1450 gRNA in combination with a Kenya-K17 gRNA (e.g., one editing step with 1450 gRNA and another editing step with Kenya-K17 gRNA). In some embodiments, successive gene editing steps may comprise the use of a 1450 gRNA in combination with HPFH5-1 and HPFH5-D gRNAs (e.g., one editing step with 1450 gRNA and another one or two editing steps with HPFH5-1 and HPFH5-D gRNAs). In some embodiments, successive gene editing steps may comprise the use of a 1450 gRNA in combination with HPFH5-T7 and HPFH5-D gRNAs (e.g., one editing step with 1450 gRNA and another one or two editing steps with HPFH5-T7 and HPFH5-D gRNAs). In some embodiments, successive gene editing steps may comprise the use of a 1450 gRNA in combination with HPFH5-T5 and HPFH5-1 gRNAs (e.g., one editing step with 1450 gRNA and another one or two editing steps with HPFH5-T5 and HPFH5-1 gRNAs). In some embodiments, successive gene editing steps may comprise the use of a 1450 gRNA in combination with Kenya-K5 and Kenya-K17 gRNAs (e.g., one editing step with 1450 gRNA and another one or two editing steps with Kenya-K5 and Kenya-K17 gRNAs). In some embodiments, successive gene editing steps may comprise the use of a 1450 gRNA in combination with a SD2 gRNA (e.g., one editing step with 1450 gRNA and another editing step with SD2 gRNA). In some embodiments, successive gene editing steps may comprise the use of at least one of a HPFH5-1, HPFH5-D, HPFH5-T5, HPFH5-T7, Kenya-K5, or Kenya-K1 gRNA in combination with at least one additional HPFH5-1, HPFH5-D, HPFH5-T5, HPFH5-T7, Kenya-K5, or Kenya-K1 gRNA. In some embodiments, successive gene editing steps may comprise the use of a HPFH5-1 gRNA in combination with a HPFH5-1, HPFH5-D, HPFH5-T5, HPFH5-T7, Kenya-K5, or Kenya-K1 gRNA. In some embodiments, successive gene editing steps may comprise the use of a HPFH5-D gRNA in combination with a HPFH5-1, HPFH5-D, HPFH5-T5, HPFH5-T7, Kenya-K5, or Kenya-K1 gRNA. In some embodiments, successive gene editing steps may comprise the use of a HPFH5-T5 gRNA in combination with a HPFH5-1, HPFH5-D, HPFH5-T5, HPFH5-T7, Kenya-K5, or Kenya-K1 gRNA. In some embodiments, successive gene editing steps may comprise the use of a HPFH5-T7 gRNA in combination with a HPFH5-1, HPFH5-D, HPFH5-T5, HPFH5-T7, Kenya-K5, or Kenya-K1 gRNA.

In some embodiments, successive gene editing (e.g., successive electroporation) may involve 2, 3, 4, 5, 6, or more gene editing steps. In some embodiments, successive gene editing may involve 2 gene editing steps. In some embodiments, successive gene editing may involve 3 gene editing steps.

In some embodiments, successive gene editing steps may involve the use of a concatenated gRNA.

In some embodiments, successive gene editing steps (e.g., successive electroporation steps) provide improved persistence of gene editing, higher levels of gene editing, improved biological outcomes, e.g., increased levels of HbF, fewer off-target effects, and/or fewer translocations, compared to single gene editing events. In some embodiments, successive gene editing steps (e.g., successive electroporation steps) provide fewer translocations compared to single gene editing events (e.g., a single electroporation step).

In some embodiments, successive gene editing steps (e.g., successive electroporation steps) may occur 12, 18, 24, 36, 48, 72, or more hours apart from one another, e.g., a second electroporation may occur 48 hours after a first electroporation. In some embodiments, successive gene editing steps (e.g., successive electroporation steps) occur 12-72, 12-48, or 36-72 hours apart from one another. In some embodiments, successive gene editing steps (e.g., successive electroporation steps) occur 36 hours apart. In some embodiments, successive gene editing steps (e.g., successive electroporation steps) occur 48 hours apart.

In some embodiments, a first gene editing step (e.g., a first successive electroporation step) may occur within 12, 36, 48, or 72 of thawing a population of cells or obtaining a population of cells from a biological source, e.g., a human subject or human patient.

In some embodiments, a population of edited cells may be purified, e.g., using FACS, between two successive gene editing steps, e.g., between a first and second electroporation, or after completing a series of successive gene editing steps (e.g., a series of successive electroporation steps). In some embodiments, a population of cells may be allowed to differentiate and/or enucleate between two successive gene editing steps (e.g., successive electroporation steps) or after completing a series of successive gene editing steps (e.g., successive electroporation steps).

In some embodiments, successive gene editing steps (e.g., successive electroporation steps) may be performed on any cell type described herein, e.g., HSPC, mPB CD34+. In some embodiments, successive gene editing steps (e.g., successive electroporation steps) may be performed on myeloid progenitor cells.

Definitions

The term "comprising" or "comprises" is used in reference to compositions, methods, and respective component(s) thereof, that are essential to the invention, yet open to the inclusion of unspecified elements, whether essential or not.

The term "consisting essentially of" refers to those elements required for a given aspect. The term permits the presence of additional elements that do not materially affect the basic and novel or functional characteristic(s) of that aspect of the invention.

The term "consisting of" refers to compositions, methods, and respective components thereof as described herein, which are exclusive of any element not recited in that description of the aspect.

The singular forms "a," "an," and "the" include plural references unless the context clearly dictates otherwise.

Any numerical range recited in this specification describes all sub-ranges of the same numerical precision (i.e., having the same number of specified digits) subsumed within the recited range. For example, a recited range of "1.0 to 10.0" describes all sub-ranges between (and including) the recited minimum value of 1.0 and the recited maximum value of 10.0, such as, for example, "2.4 to 7.6," even if the range of "2.4 to 7.6" is not expressly recited in the text of the specification. Accordingly, the Applicant reserves the right to amend this specification, including the claims, to expressly recite any sub-range of the same numerical precision subsumed within the ranges expressly recited in this specification. All such ranges are inherently described in this specification such that amending to expressly recite any such sub-ranges will comply with written description, sufficiency of description, and added matter requirements, including the requirements under 35 U.S.C. § 112 (a) and Article 123 (2) EPC. Also, unless expressly specified or otherwise required by context, all numerical parameters described in this specification (such as those expressing values, ranges, amounts, percentages, and the like) may be read as if prefaced by the word "about," even if the word "about" does not expressly appear before a number. Additionally, numerical parameters described in this specification should be construed in light of the number of reported significant digits, numerical precision, and by applying ordinary rounding techniques. It is also understood that numerical parameters described in this specification will necessarily possess the inherent variability characteristic of the underlying measurement techniques used to determine the numerical value of the parameter.

EXAMPLES

The invention will be more fully understood by reference to the following examples, which provide illustrative non-limiting aspects of the invention.

The examples describe the use of the CRISPR/Cas system as an illustrative genome editing technique to create defined therapeutic genomic deletions or single base substitutions, collectively termed "genomic modifications" herein, in the human beta globin gene locus on chromosome 11 and BCL11A gene on chromosome 2 or a DNA sequence that encodes a transcriptional control region of the BCL11A gene on chromosome 2, that lead to an upregulation of expression of HbF. Exemplary therapeutic modifications are genetically and/or functionally similar or identical to those observed in hematopoietic cells of individuals with hemoglobinopathy such as sickle cell or β-thalassemia in which the modifications de-repress, or lead to the re-expression of, γ-globin and thus fetal hemoglobin. Introduction of the defined therapeutic modifications represents a novel therapeutic strategy for the potential amelioration of hemoglobinopathies, as described and illustrated herein.

Example 1—CRISPR/SpCas9 Target Sites for the Human Beta Globin Locus

Regions of the human beta globin locus were scanned for target sites. Each area was scanned for a protospacer adjacent motif (PAM) having the sequence NRG. gRNA 20 bp spacer sequences corresponding to the PAM were identified, as shown in SEQ ID NOs: 1-56,961 of the Sequence Listing.

Example 2—CRISPR/SaCas9 Target Sites for the Human Beta Globin Locus

Regions of the human beta globin locus were scanned for target sites. Each area was scanned for a protospacer adjacent motif (PAM) having the sequence NNGRRT. gRNA 20 bp spacer sequences corresponding to the PAM were identified, as shown in SEQ ID NOs: 56,962-64,104 of the Sequence Listing.

Example 3—CRISPR/NmCas9 Target Sites for the Human Beta Globin Locus

Regions of the human beta globin locus were scanned for target sites. Each area was scanned for a protospacer adjacent motif (PAM) having the sequence NNNNGATT. gRNA 24 bp spacer sequences corresponding to the PAM were identified, as shown in SEQ ID NOs: 64,105-66,258 of the Sequence Listing.

Example 4—CRISPR/StCas9 Target Sites for the Human Beta Globin Locus

Regions of the human beta globin locus were scanned for target sites. Each area was scanned for a protospacer adjacent motif (PAM) having the sequence NNAGAAW. gRNA 24 bp spacer sequences corresponding to the PAM were identified, as shown in SEQ ID NOs: 66,259-69,152 of the Sequence Listing.

Example 5—CRISPR/TdCas9 Target Sites for the Human Beta Globin Locus

Regions of the human beta globin locus were scanned for target sites. Each area was scanned for a protospacer adjacent motif (PAM) having the sequence NAAAAC. gRNA 24 bp spacer sequences corresponding to the PAM were identified, as shown in SEQ ID NOs: 69,153-70,300 of the Sequence Listing.

Example 6—CRISPR/Cpf1 Target Sites for the Human Beta Globin Locus

Regions of the human beta globin locus were scanned for target sites. Each area was scanned for a protospacer adjacent motif (PAM) having the sequence TTN. gRNA 20-24 bp spacer sequences corresponding to the PAM were identified, as shown in SEQ ID NOs: 70,301-156,352 of the Sequence Listing.

Example 7—Creation of Deletions Proximal to Chr11:5224779-5237723

In this example, we illustrate use of the methods described herein to generate certain deletions that are proximal to the region Chr11:5224779-5237723. Deletions in this region have been observed in human patients designated as HPFH-5 (or "HPFH Sicilian") described in Camaschella et al., *Haematologica*, 75 (Suppl 5): 26-30 (1990). The 13 kb deletion variant in the human β-globin locus observed in the human patients was associated with the clinical phenotype of hereditary persistence of fetal hemoglobin (HPFH), in which the presence of fetal hemoglobin can complement the defect in adult hemoglobin synthesis or function, and ameliorate disease, in sickle cell anemia or β-thalassemia.

In this example, we illustrate that the CRISPR/Cas system can be used to create deletions functionally resembling those associated with natural HPFH alleles such as HPFH-5. Guide RNAs were designed to eliminate the pathogenic sickle cell allele by deleting the δ and β globin genes as well as substantial portion of the Y globin gene 3' region. FIG. 1A shows the human beta globin locus with hollow boxes highlighting the HPFH-5 5' and 3' target sites. The 13 kb deletion starts 3 kb 5' to the δβ1 gene and ends 1.7 kb 3' to the end of the β gene (690 bp downstream from the β gene polyA signal). See FIG. 1B. In addition, guide RNAs were designed to target sites throughout the 13 kb region in order to determine the therapeutic potential of smaller deletions within this locus.

Experimental Methods

Selection of Target Sites

Regions of the β-globin gene cluster were scanned for target sites, including the 5' and 3' regions associated with hereditary persistence of fetal hemoglobin-5 (HPFH-5). Each area was scanned for protospacer adjacent motifs (PAMs) having the sequence NGG and/or NRG. Guide strands corresponding to the PAMs were identified.

For this illustrative example, candidate guides were screened and selected in a multi-step process that involved both theoretical binding and experimentally assessed activity. By way of illustration, candidate guides having sequences that match a particular on-target site with adjacent PAM can be assessed for their potential to cleave at off-target sites having similar sequences, using one or more of a variety of bioinformatics tools available for assessing off-target binding, as described and illustrated in more detail below, in order to assess the likelihood of effects at chromosomal positions other than those intended. Candidates predicted to have relatively lower potential for off-target activity can then be assessed experimentally to measure their on-target activity, and then off-target activities at various sites. Preferred guides have sufficiently high on-target activity to achieve desired levels of gene editing at the selected locus, and relatively lower off-target activity, to reduce the likelihood of alterations at other chromosomal loci. The ratio of on-target to off-target activity is often referred to as the "specificity" of a guide.

For initial screening of predicted off-target activities, there are a number of bioinformatics tools known and publicly available that can be used to predict the most likely off-target sites; and since binding to target sites in the CRISPR Cas9 nuclease system is driven by Watson-Crick base pairing between complementary sequences, the degree of dissimilarity (and therefore reduced potential for off-target binding) is essentially related to primary sequence differences: mismatches and bulges, i.e. bases that are changed to a non-complementary base, and insertions or deletions of bases in the potential off-target site relative to the target site. An exemplary bioinformatics tool called COSMID (CRISPR Off-target Sites with Mismatches, Insertions and Deletions) (available on the web at crispr dot bme dot gatech dot edu) compiles such similarities.

CRISPR Cloning

Plasmids expressing the Cas9 protein and guide strand RNA were assembled using a vector that expressed humanized Cas9 from *S. pyogenes* and the single-molecule guide RNA. Complementary oligonucleotides corresponding to the guide strand were obtained (Operon or IDT), kinased, annealed and cloned into the vector. Guide RNAs were tested in cells:

The first three spacer sequences target the 5' boundary of the region to be deleted, and the last three target the 3' boundary of the region to be deleted.

Cell Transfection

K-562 cells were cultured in RPMI media supplemented with 10% FBS and 2 mM fresh L-glutamine and passaged as they approached a confluency of $1 \times 10^5$/ml. An Amaxa Nucleofector 4D was used to transfect 200,000 K-562 cells with 1 μg vector expressing HPFH5 targeting sgRNAs, and 1000 ng of plasmid expressing Cas9 following manufacturer's instructions. The genomic DNA was harvested after 3 days using QuickExtract DNA extraction solution (Epicentre, Madison, WI), as described.

Hek293T cells were seeded 24 hours prior to transfection in 24-well plates at a density of 80,000 cells per well and cultured in DMEM media supplemented with 10% FBS and 2 mM fresh L-glutamine. Cells were transfected with 1000 ng of plasmid expressing Cas9 and gRNA using 2 μl of Lipofectamine 2000 (Life technologies), according to manufacturer's instructions. Genomic DNA was harvested at 72 hours after transfection using QuickExtract DNA Extraction Solution (Epicenter).

On- and Off-Target Mutation Detection by Sequencing

To sequence the on-target sites and putative off-target sites, the appropriate amplification primers were identified and reactions were set up with these primers using the genomic DNA harvested using QuickExtract DNA extraction solution (Epicentre) from treated cells three days post-transfection. The amplification primers contain the gene specific portion flanked by adapters. The forward primer's 5' end includes a modified forward (read1) primer-binding site. The reverse primer's 5' end contains a combined modified reverse (read2) and barcode primer-binding site, in opposite orientation. The individual PCR reactions were validated by separating on agarose gels, then purified and re-amplified. The second round forward primers contain the Illumina P5 sequence, followed by a proportion of the modified forward (read1) primer binding site. The second round reverse primers contain the Illumina P7 sequence (at the 5' end), followed by the 6-base barcode and the combined modified reverse (read2) and barcode primer binding site. The second round amplifications were also checked on agarose gels, then purified, and quantitated using a NanoDrop spectrophotometer. The amplification products were pooled to match concentration and then submitted to the Emory Integrated Genomic core for library prepping and sequencing on an Illumina Miseq machine.

The sequencing reads were sorted by barcode and then aligned to the reference sequences supplied by bioinformatics for each product. Insertion and deletion rates in the aligned sequencing reads were detected in the region of the putative cut sites using software previously described; see, e.g., Lin et al., *Nucleic Acids Res.*, 42:7473-7485 (2014). The levels of insertions and deletions detected in this window were then compared to the level seen in the same location in genomic DNA isolated from in mock transfected cells to minimize the effects of sequencing artifacts.

Mutation Detection Assays

The on- and off-target cleavage activities of Cas9 and guide RNA combinations were measured using the mutation rates resulting from the imperfect repair of double-strand breaks by NHEJ.

On-target loci were amplified using AccuPrime Taq DNA Polymerase High Fidelity (Life Technologies, Carlsbad, CA) following manufacturer's instructions for 40 cycles (94° C., 30 s; 52-60° C., 30 s; 68° C., 60 s) in 50 μl reactions containing 1 μl of the cell lysate, and 1 μl of each 10 UM amplification primer. T7EI mutation detection assays were performed, as per manufacturers protocol [Reyon et al., *Nat. Biotechnol.*, 30:460-465 (2012)], with the digestions separated on 2% agarose gels and quantified using ImageJ [Guschin et al., *Methods Mol. Biol.*, 649:247-256 (2010)]. The assays determine the percentage of insertions/deletions ("indels") in the bulk population of cells.

Detecting Inversions and Deletions by End-Point PCR

All end-point PCR reactions were performed using AccuPrime Taq DNA Polymerase High Fidelity (Life Technologies) following manufacturer's instructions for 40 cycles (94° C., 30 s; 60° C., 30 s; 68° C., 45 s) in a 50 μl reaction containing 1 μl of the cell lysate, and 1 μl of each 10 μM target region amplification primer.

Deletion Quantification Using Drop Digital PCR (ddPCR)

The level of joined chromosomal ends, indicating the intended chromosomal deletions, was quantitated using the BioRad (Hercules, CA) drop digital PCR machine (ddPCR) QX200. The machines allow absolute quantification by breaking individual PCR reactions into ~20,000 droplets that are individually tested by end-point PCR using a Cyber green-like reagent and a reader that can effectively differentiate between PCR-positive and PCR-negative droplets. Genomic DNA for ddPCR was extracted from K-562 cells using the QiaAMP DNA mini kit (Qiagen, Valencia, CA). PCR reactions contained 2×ddPCR EvaGreen supermix, 200 ng of genomic DNA, primers, and HindIII (1 U/reaction). Reactions were run for 40 cycles (94° C., 30 s; 55-65° C., 30 s; 72° C., 90 s).

Example 8—Creation of Deletions Proximal to Chr11:5233055-5240389

Figure 3:
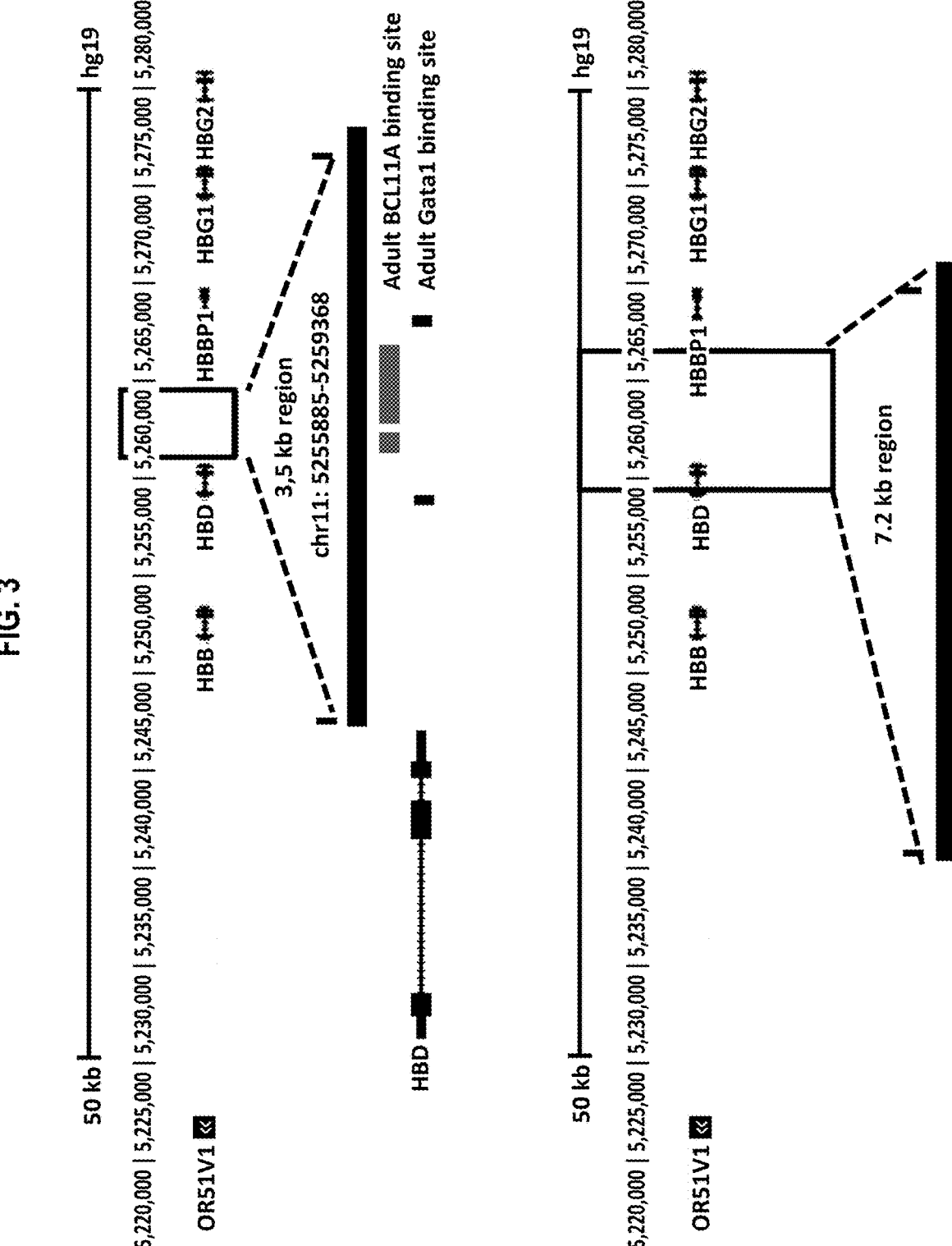
FIG. 3 shows a schematic of the genomic location of HPFH Corfu 3.5 kb and 7.2 kb deletions.

In this example, we illustrate use of the methods described herein to generate certain deletions that are proximal to the region Chr11:5233055-5240389. Deletions in this region have been observed in human patients with a 7.2 kb deletion in the human β-globin locus on chromosome 11 that is referred to herein as the "Corfu long" deletion. In the homozygous state, such a deletion is associated with a complete absence of hemoglobin A and A2 and a high level of fetal hemoglobin and HPFH [Wainscoat et al, *Ann. NY Acad Sci* 445:20 (1985) and Kulozik et al, *Blood* 71:457 (1988)]. This deletion is depicted in FIG. 3. We further determined that known binding sites for key regulators of γ-globin-BCL11a and Gata1—are located within a 3.5 kb subregion within the 7.2 kb region (FIG. 3). It is contemplated that deletion of this smaller region alone (deletion in chromosome 11 within region Chr11:5233055-5240389) might be sufficient to confer an HPFH phenotype comparable to that seen with the larger deletion and, moreover, may be achievable at a higher efficiently of genome editing than for the larger deletion. CRISPR guide RNAs were designed to effect cleavage at each end of the 7.2 kb and 3.5 kb regions and their ability to effect deletion of the intervening fragment was validated.

Individual guide RNAs directed towards the boundaries of each of the Corfu deletions were tested for their efficiency of gene editing. Vectors encoding the guide RNAs were generated and introduced into cells as described in Example 7.

Example 9—Creation of Deletions Proximal to Chr11:5226631-5249422

Figure 4:
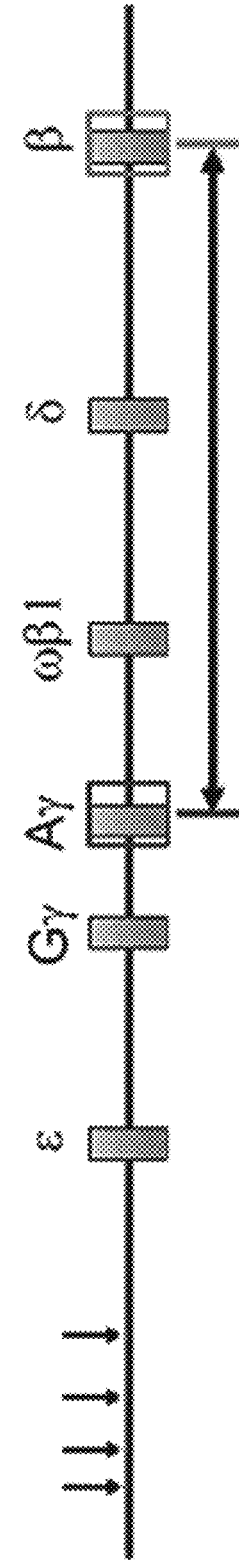
FIG. 4 is a schematic of the β-globin locus showing the location of the Kenya deletion, 5' (left box) and 3' (right box)

In this example, we illustrate use of the methods described herein to generate certain deletions that are proximal to the region Chr11:5226631-5249422. Deletions in this region have been observed in human patients with a large deletion in the human β-globin locus on chromosome 11 that is referred to herein as the HPFH Kenya-like variant [Huisman et al, *Arch. Biochem. Biophys.* 152:850 (1972) and Ojwang et al, *Hemoglobin* 7:115 (1983)]. The naturally-occurring variant appears to have resulted from non-homologous crossing over between amino acids 80-87 of the $^A\gamma$ and β-globin genes and deletion of the intervening ~23 kb of sequence in chromosome 11 within region Chr11:5226631-5249422. The Kenya fusion protein contains amino acid residues 1-80 of the $^A\gamma$ chain and 87-146 of the β chain. CRISPR guide RNAs used to effect cleavage at each boundary of the ~23 kb region (FIG. 4) were designed and validated. Vectors encoding the guide RNAs were generated and introduced into cells as described in Example 7.

Example 10—Creation of Deletions Proximal to Chr11:5249959-5249971

Figure 5A:
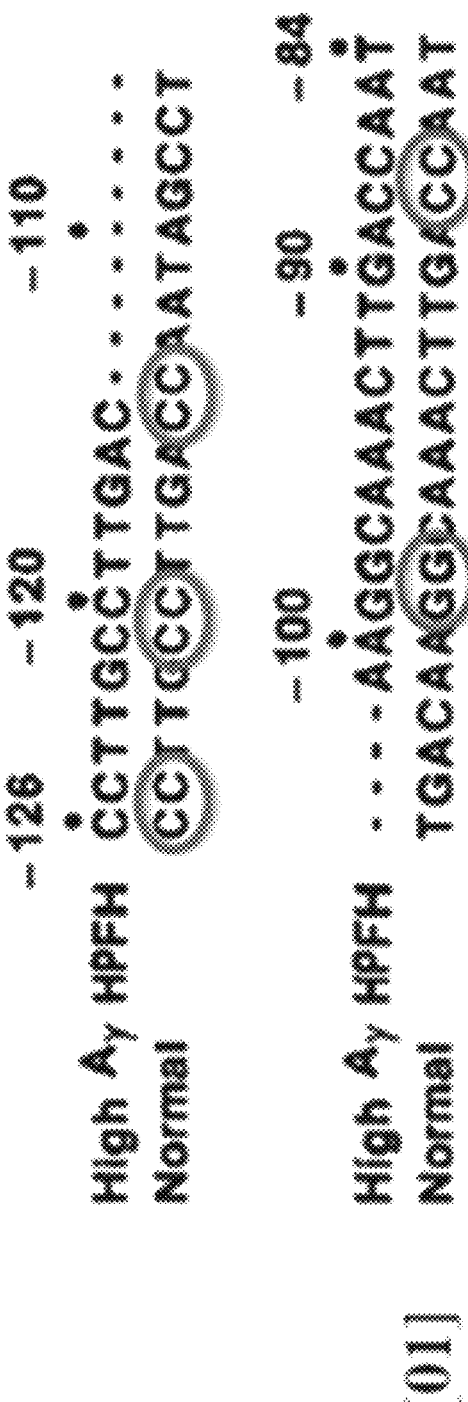
Figure 5B:
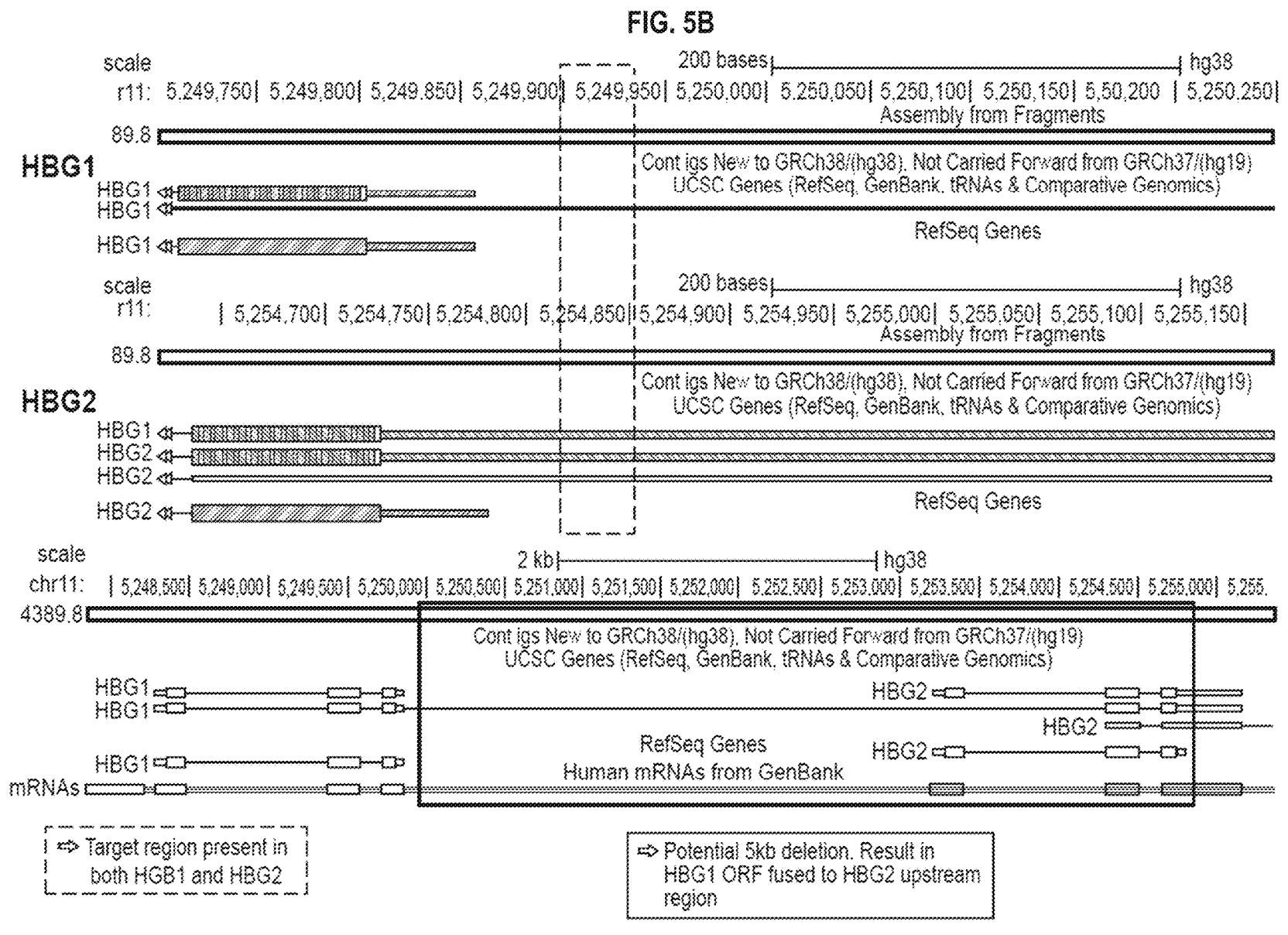

In this example, we illustrate use of the methods described herein to generate certain deletions that are proximal to the region Chr11:5249959-5249971. Deletions in this region have been observed in human patients with a small deletion variant of the β-globin locus in chromosome 11 within region Chr11:5249959-5249971 that was identified and shown to be associated with HPFH [Gilman et al, *Nucleic acids Research* 16 (22): 10635 (1988)]. This deletion spans −102 to −114 of the γ-globin gene and encompasses the distal CCAAT box believed important for regulation of the γ-gene promoter (FIG. 5A). Potential PAM sites for CRISPR are circled (FIG. 5A).

One approach is to cleave this locus within the 13 bp region and allow NHEJ to mis-repair the lesion with the expectation that in some instances the exact 13 bp deletion might be recapitulated. However, the repair outcome by NHEJ alone cannot be assured and it is unlikely that the precise 13 bp deletion will occur at a clinically significant frequency-rather than additional deletions or insertions, which may themselves have the desired therapeutic consequence. Alternatively, the DSB could be repaired by HDR in the presence of a co-delivered repair template donor that specifies the precise 13 bp deletion.

A third approach to creating the 13 bp deletion could be taken that makes use of microhomology at the intended mutation site and the repair pathway of MMEJ. In the present example analysis of the sequence encompassing and adjacent to the 13 bp deletion site revealed the presence of two 8 bp repeat sequences which we predicted would likely recombine during MMEJ-mediated repair to produce the 13 bp deletion in the presence of a single double-strand break. Vectors encoding the guide RNAs were generated and introduced into cells as described in Example 7.

Example 11—Creation of Deletions Proximal to Chr11:5196709-5239223

In this example, we illustrate use of the methods described herein to generate certain deletions that are proximal to the region Chr11:5196709-5239223. Deletions in this region have been observed in human patients with a large deletion in the human β-globin locus on chromosome 11 that is referred to as the HPFH-4 (or "HPFH Italian") allele [Camaschella et al, *Haematologia* 75 (5): 26 (1990)] and is characterized by a 40 kb deletion (FIG. 6A) in chromosome 11 within region Chr11:5196709-5239223 that fully encompasses the shorter (13 kb) HPFH-5 allele. It is contemplated that genome editing technologies such as CRISPR can be used to create a targeted deletion of the corresponding or similar genomic region, or subset thereof, in hematopoietic cells of individuals with hemoglobinopathy such as sickle cell or β-thalassemia to de-repress, or lead to the re-expression of, γ-globin and thus fetal hemoglobin.

Example 12—Creation of Deletions Proximal to Chr11:5225700-5236750

In this example, we illustrate use of the methods described herein to generate certain deletions that are proximal to the region Chr11:5225700-5236750. Deletions in this region have been observed in human patients with the HPFH Black allele [Anagnou et al., *Blood* 65:1245 (1985)], which is characterized by a large deletion (FIG. 6B) in chromosome 11 within region Chr11:5225700-5236750 that overlaps completely with theHPFH-4 and HPFH-5 deletions. It is contemplated that genome editing technologies such as CRISPR can be used to create a targeted deletion of the corresponding or similar genomic region, or subset thereof, in hematopoietic cells of individuals with hemoglobinopathy such as sickle cell or β-thalassemia to de-repress, or lead to the re-expression of, γ-globin and thus fetal hemoglobin.

Example 13—Creation of HPFH-Associated Non-Deletion Mutations

The −175 (T to C) point mutation in the $^G\gamma$ or $^A\gamma$ gene of β-globin locus is associated with a phenotype of pancellular HPFH, i.e. across many cells with fairly uniform distribution; see, e.g., Ottolenghi et al., *Blood* 71:815 (1988) and Surrey et al., *Blood* 71:807 (1988). The HPFH phenotype is believed to be due to disruption of one or more cis-elements to which regulatory factors normally bind and repress γ-globin expression, or to enhancement of binding of regulatory factors that upregulate γ-globin expression. It is contemplated that genome editing technologies such as CRISPR can be used to create the point mutation, or other modification resulting in changes in regulatory factor binding, in hematopoietic cells of individuals with hemoglobinopathy such as sickle cell or β-thalassemia to de-repress, or lead to the re-expression of, γ-globin and thus fetal hemoglobin.

Figures 6A, 6B, 6C:
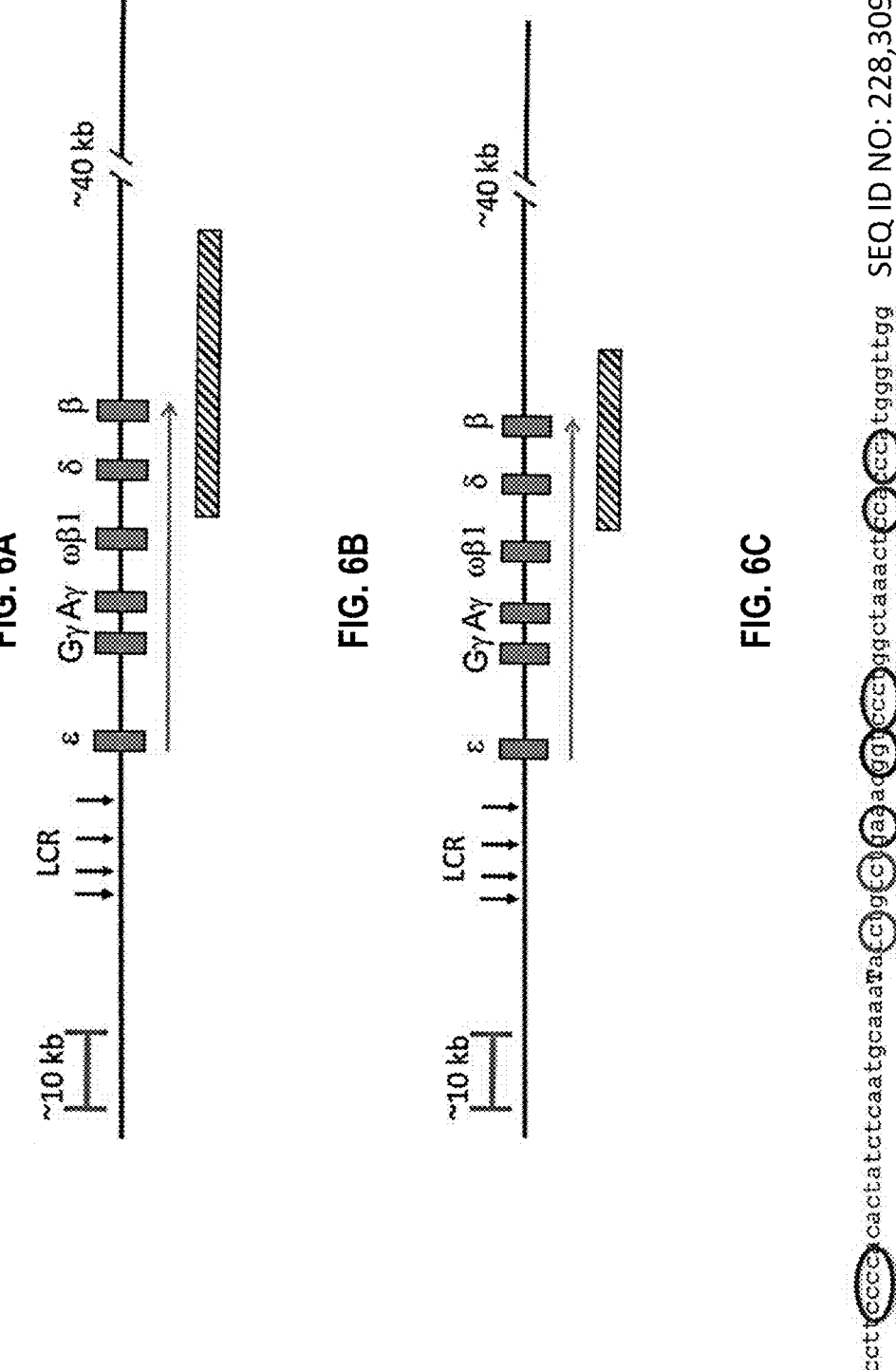
FIGS. 6A-6C show other deletion and non-deletion modifications of the β-globin locus associated with HPFH.

Multiple putative PAM sequences for *S. pyogenes* Cas9 are located adjacent to this target site (FIG. 6C). Potential PAM sites for *S. pyogenes* Cas9 are circled. Nucleotide T175 is shown in bold (FIG. 6C).

Example 14—CRISPR/SpCas9 Target Sites for the Transcriptional Control Sequence of the BCL11A Gene Regions of the 12.4 kb transcriptional control sequence of the BCL11A gene were scanned for target sites. Each area was scanned for a protospacer adjacent motif (PAM) having the sequence NRG. gRNA 20 bp spacer sequences corresponding to the PAM were identified, as shown in SEQ ID NOs: 156,353-185,834 of the Sequence Listing.

Example 15—CRISPR/SaCas9 Target Sites for the Transcriptional Control Sequence of the BCL11A Gene Regions of the 12.4 kb transcriptional control sequence of the BCL11A gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 185,835-188,739 of the Sequence Listing.

Example 16—CRISPR/StCas9 Target Sites for the Transcriptional Control Sequence of the BCL11A Gene Regions of the 12.4 kb transcriptional control sequence of the BCL11A gene were scanned for target sites. Each area was scanned for a protospacer adjacent motif (PAM) having the sequence NNAGAAW. gRNA 24 bp spacer sequences corresponding to the PAM were identified, as shown in SEQ ID NOS: 188,740-189,772 of the Sequence Listing.

Example 17—CRISPR/TdCas9 Target Sites for the Transcriptional Control Sequence of the BCL11A Gene Regions of the 12.4 kb transcriptional control sequence of the BCL11A gene were scanned for target sites. Each area was scanned for a protospacer adjacent motif (PAM) having the sequence NAAAAC. gRNA 24 bp spacer sequences corresponding to the PAM were identified, as shown in SEQ ID NOS: 189,773-190,203 of the Sequence Listing.

Example 18—CRISPR/NmCas9 Target Sites for the Transcriptional Control Sequence of the BCL11A Gene Regions of the 12.4 kb transcriptional control sequence of the BCL11A gene were scanned for target sites. Each area was scanned for a protospacer adjacent motif (PAM) having the sequence NNNNGATT. gRNA 24 bp spacer sequences corresponding to the PAM were identified, as shown in SEQ ID NOS: 190,204-193,083 of the Sequence Listing.

Example 19—CRISPR/Cpf1 Target Sites for the Transcriptional Control Sequence of the BCL11A Gene Regions of the 12.4 kb transcriptional control sequence of the BCL11A gene were scanned for target sites. Each area was scanned for a protospacer adjacent motif (PAM) having the sequence TTN. gRNA 20-24 bp spacer sequences corresponding to the PAM were identified, as shown in SEQ ID NOs: 193,084-228,299 of the Sequence Listing.

Example 20—Bioinformatics Analysis of the Guide Strands

Candidate guides from Examples 14-19 will be screened and selected in a multi-step process that involves both theoretical binding and experimentally assessed activity, as previously described in Example 7. By way of illustration, candidate guides having sequences that match a particular on-target site, such as a site within the transcriptional control sequence of the BCL11A gene, with adjacent PAM can be assessed for their potential to cleave at off-target sites having similar sequences, using one or more of a variety of bioinformatics tools available for assessing off-target binding, as described and illustrated in more detail below, in order to assess the likelihood of effects at chromosomal positions other than those intended. Candidates predicted to have relatively lower potential for off-target activity can then be assessed experimentally to measure their on-target activity, and then off-target activities at various sites. Preferred guides have sufficiently high on-target activity to achieve desired levels of gene editing at the selected locus, and relatively lower off-target activity to reduce the likelihood of alterations at other chromosomal loci. The ratio of on-target to off-target activity is often referred to as the "specificity" of a guide.

For initial screening of predicted off-target activities, there are a number of bioinformatics tools known and publicly available that can be used to predict the most likely off-target sites; and since binding to target sites in the CRISPR/Cas9 or CRISPR/Cpf1 nuclease system is driven by Watson-Crick base pairing between complementary sequences, the degree of dissimilarity (and therefore reduced potential for off-target binding) is essentially related to primary sequence differences: mismatches and bulges, i.e. bases that are changed to a non-complementary base, and insertions or deletions of bases in the potential off-target site relative to the target site. An exemplary bioinformatics tool called COSMID (CRISPR Off-target Sites with Mismatches, Insertions and Deletions) (available on the web at crispr.b-me.gatech.edu) compiles such similarities. Other bioinformatics tools include, but are not limited to autoCOSMID and CCTop.

Bioinformatics were used to minimize off-target cleavage in order to reduce the detrimental effects of mutations and chromosomal rearrangements. Studies on CRISPR/Cas9 systems suggested the possibility of off-target activity due to non-specific hybridization of the guide strand to DNA sequences with base pair mismatches and/or bulges, particularly at positions distal from the PAM region. Therefore, it is important to have a bioinformatics tool that can identify potential off-target sites that have insertions and/or deletions between the RNA guide strand and genomic sequences, in addition to base-pair mismatches. Bioinformatics tools based upon the off-target prediction algorithm CCTop were used to search genomes for potential CRISPR off-target sites (CCTop is available on the web at crispr.cos.uni-heidelberg.de/). The output ranked lists of the potential off-target sites based on the number and location of mismatches, allowing more informed choice of target sites, and avoiding the use of sites with more likely off-target cleavage.

Additional bioinformatics pipelines were employed that weigh the estimated on- and/or off-target activity of gRNA targeting sites in a region. Other features that may be used to predict activity include information about the cell type in question, DNA accessibility, chromatin state, transcription factor binding sites, transcription factor binding data, and other CHIP-seq data. Additional factors are weighed that predict editing efficiency, such as relative positions and directions of pairs of gRNAs, local sequence features and micro-homologies.

Example 21—Testing of Preferred Guides in Cells for On-Target Activity

Figure 9:
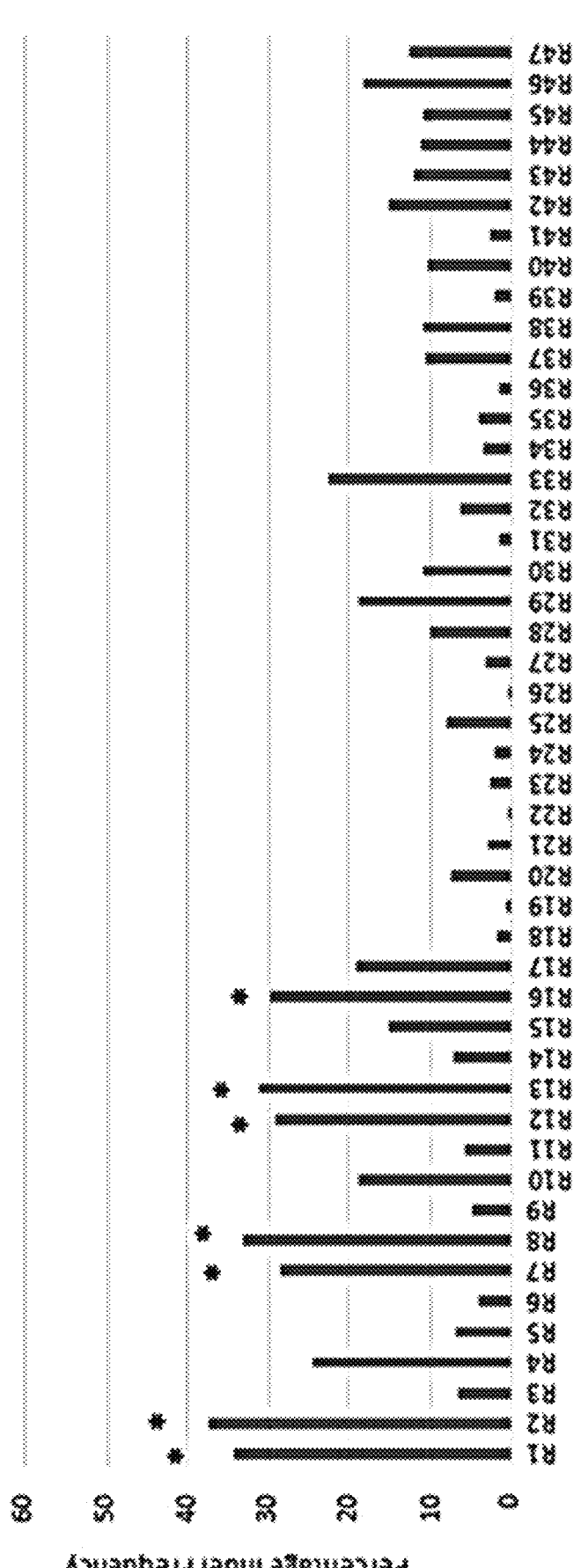
FIG. 9 is a table showing indel frequencies for various gRNAs that are specific for the +58 DNA hypersensitive site (DHS) of the BCL11A gene.
Figure 9:
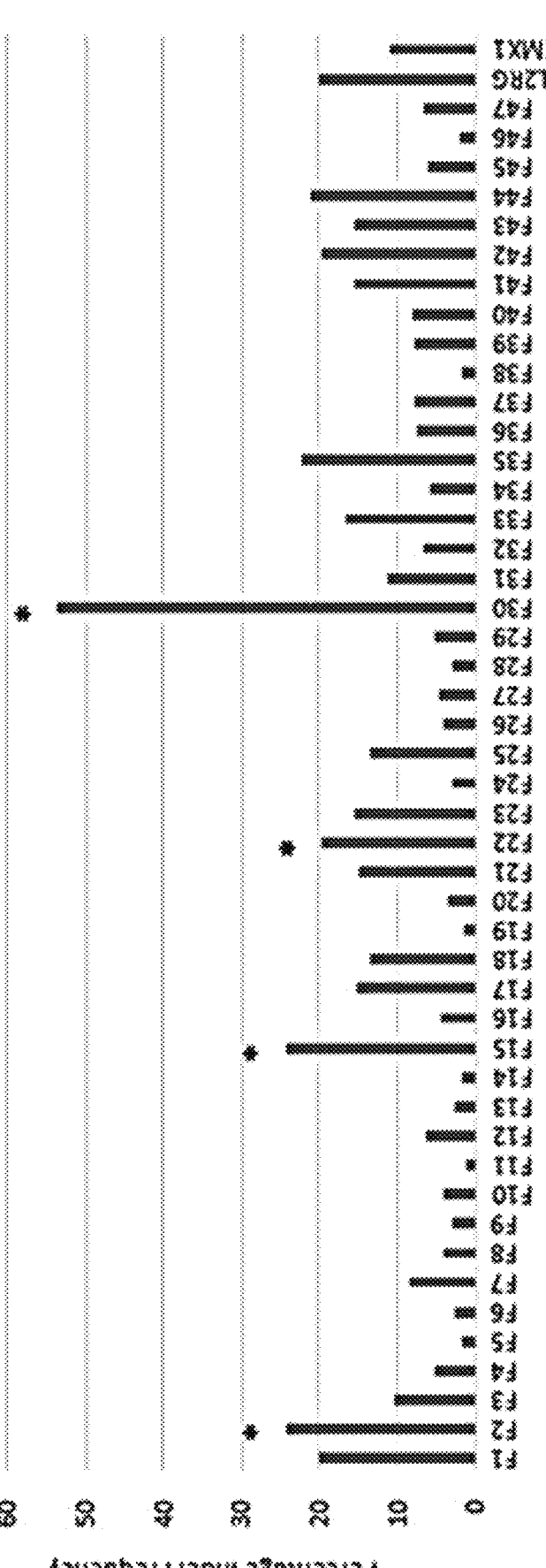

The gRNAs from Examples 14-19 predicted to have the lowest off-target activity were then tested for on-target activity in K562 cells, and evaluated for indel frequency using TIDE as demonstrated in FIG. 9. The gRNA sequences shown in FIG. 9 are included in FIGS. 11A, 11B, and 11C.

TIDE is a web tool to rapidly assess genome editing by CRISPR-Cas9 of a target locus determined by a guide RNA (gRNA or sgRNA). Based on quantitative sequence trace data from two standard capillary sequencing reactions, the TIDE software quantifies the editing efficacy and identifies the predominant types of insertions and deletions (indels) in the DNA of a targeted cell pool. See Brinkman et al, Nucl.

Acids Res. (2014) for a detailed explanation and examples. An alternative method is Next-generation sequencing (NGS), also known as high-throughput sequencing, which is the catch-all term used to describe a number of different modern sequencing technologies including: Illumina (Solexa) sequencing, Roche 454 sequencing, Ion torrent: Proton/PGM sequencing, and SOLID sequencing. These recent technologies allow one to sequence DNA and RNA much more quickly and cheaply than the previously used Sanger sequencing, and as such have revolutionised the study of genomics and molecular biology.

Transfection of tissue culture cells, allows screening of different constructs and a robust means of testing activity and specificity. Tissue culture cell lines, such as K562 or HEK293T are easily transfected and result in high activity. These or other cell lines will be evaluated to determine the cell lines that match with CD34+ and provide the best surrogate. These cells will then be used for many early stage tests. For example, individual gRNAs for *S. pyogenes* Cas9 can be transfected into the cells using plasmids, such as, for example, CTx-1, CTx-2, or CTx-3 described in FIG. 7A-7C, which are suitable for expression in human cells. Alternatively, commercially available vectors may also be used. For the Indel Freq assessment of the BCL11A gRNAs described herein, a commercially available Cas9 expression plasmid (GeneArt, Thermo Fisher) was employed. Several days later (48 hrs for this experiment), the genomic DNA was harvested and the target site amplified by PCR. The cutting activity was measured by the rate of insertions, deletions and mutations introduced by NHEJ repair of the free DNA ends. Although this method cannot differentiate correctly repaired sequences from uncleaved DNA, the level of cutting can be gauged by the amount of mis-repair. Off-target activity can be observed by amplifying identified putative off-target sites and using similar methods to detect cleavage. Translocation can also be assayed using primers flanking cut sites, to determine if specific cutting and translocations happen. Un-guided assays have been developed allowing complementary testing of off-target cleavage including guide-seq. The gRNA or pairs of gRNA with significant activity can then be followed up in cultured cells to measure the modulation or inactivation of the +58 DNA hypersensitive site (DHS) within the transcriptional control sequence of the BCL11A gene. Off-target events can be followed again. Similarly CD34+ cells can be transfected and the level of modulation or inactivation of the +58 DNA hypersensitive site (DHS) within the transcriptional control sequence of the BCL11A gene and possible off-target events measured. These experiments allow optimization of nuclease and donor design and delivery.

Example 22—Testing of Preferred BCL11A gRNAs in Cells for Off-Target Activity The BCL11A gRNAs from Examples 14-19 having the best on-target activity from the TIDE and next generation sequencing studies in the above example will then be tested for off-target activity using whole genome sequencing. Candidate gRNAs will be more completely evaluated in CD34+ cells or iPSCs.

Example 23—Testing of Preferred BCL11A gRNA Combinations in Cells

The BCL11A gRNAs from Examples 14-19 having the best on-target activity from the TIDE and next generation sequencing studies and lowest off-target activity will be tested in combinations to evaluate the size of the deletion resulting from the use of each gRNA combination. Potential gRNA combinations will be evaluated in primary human CD34 cells.

Figure 10A:
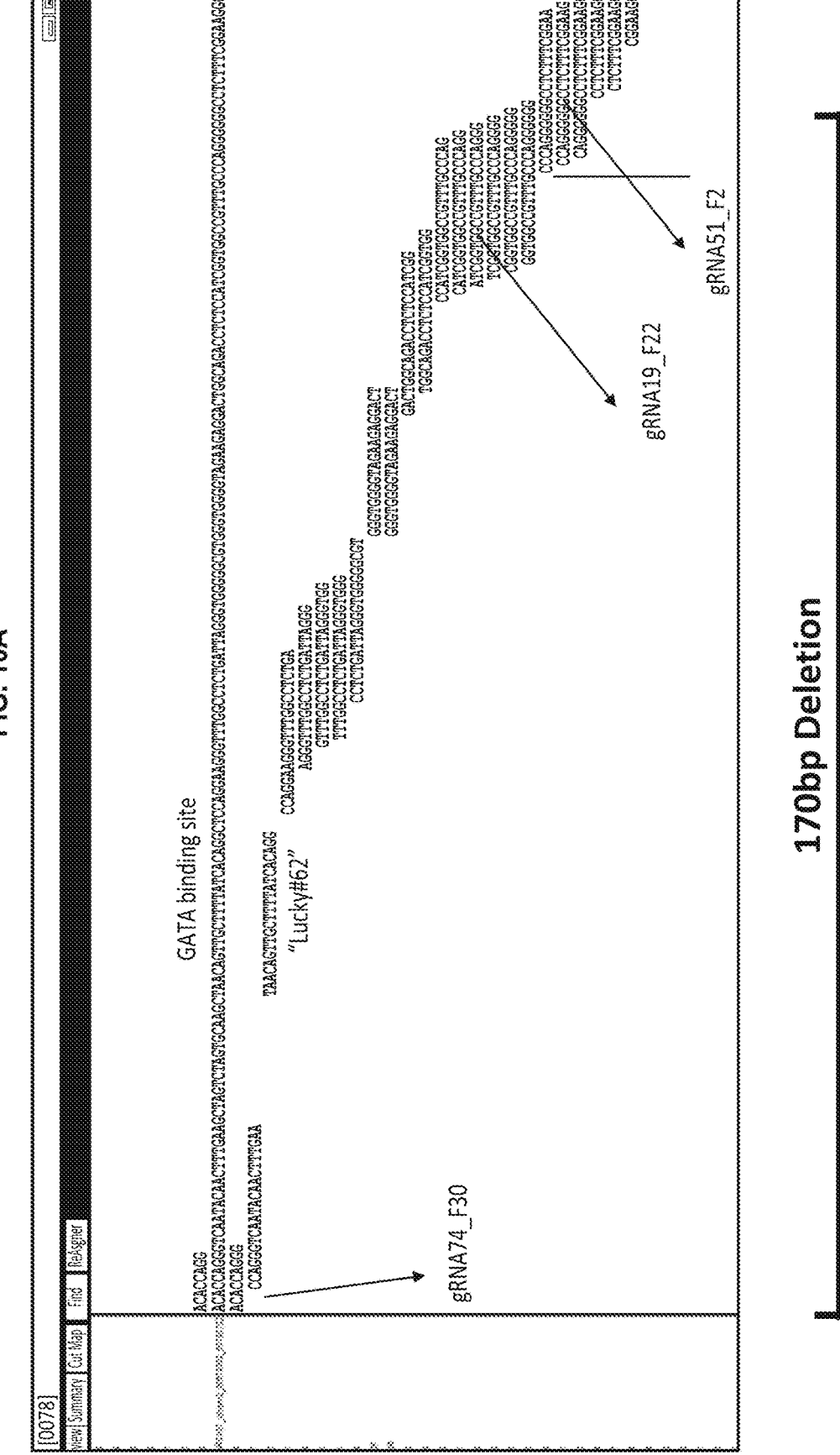

For example, gRNA combinations will be tested for efficiency of deleting all or a portion of the transcriptional control sequence of the BCL11A gene. The gRNA combinations will also be tested for efficiency of deleting all or a portion of the +58 DNA hypersensitive site (DHS) of the BCL11A gene as depicted in FIG. 10A and as demonstrated in FIG. 10B.

Example 24—Editing Cells Using gRNAs that Target the Human Beta Globin Locus and gRNAs that Target the BCL11A Gene Mobilized human peripheral blood CD34+ cells were cultured in serum free STEMSPAN media with erythroid expansion (100×) cytokine cocktail for two days. 100,000 cells were washed and electroporated using Cas9 mRNA with one or more gRNA specific for the human beta globin locus (gRNAs described in Examples 1-6 and disclosed in the Sequence Listing) and one or more gRNA specific for the BCL11A gene or a DNA sequence that encodes a transcriptional control region of the BCL11A gene (gRNAs described in Examples 14-19 or the Figures; and disclosed in the Sequence Listing). Cells were allowed to recover for one day before being switched to an erythroid differentiation medium (IMDM+Glutamax supplemented with 5% human serum, 10 ug/ml insulin, 20 ug/ml SCF, 5 ug/ml IL-3, 3 U/ml EPO, 1 uM dexamethasone, 1 uM β-estradiol, 330 ug/ml holo-transferrin and 2 U/ml heraprin). Single erythroid progenitors were generated using flow cytometry one day later and cultured in the erythroid differentiation medium. Half of the colonies were collected 12 days post sorting for DNA and RNA analysis. The rest were collected 16 days post sorting for the analysis of hemoglobin proteins. Globin expression (HBG/HBA or HBG/(HBB+HBG)) was determined by real-time PCR and compared for each of the edited erythroid clones.

Example 25—Editing Cells with a Concatenated gRNA

Mobilized human peripheral blood CD34+ cells were cultured in serum free STEMSPAN media with erythroid expansion (100×) cytokine cocktail for two days. 100,000 cells were washed and electroporated using Cas9 mRNA with a concatenated gRNA comprising a first gRNA and second gRNA. The first gRNA can comprise a gRNA specific for the human beta globin locus, as described in Examples 1-6 and disclosed in the Sequence Listing. The second gRNA can comprise a gRNA specific for the BCL11A gene or a DNA sequence that encodes a transcriptional control region of the BCL11A gene, as described in Examples 14-19 or the Figures; and disclosed in the Sequence Listing. Cells were allowed to recover for one day before being switched to an erythroid differentiation medium (IMDM+Glutamax supplemented with 5% human serum, 10 ug/ml insulin, 20 ug/ml SCF, 5 ug/ml IL-3, 3 U/ml EPO, 1 uM dexamethasone, 1 uM β-estradiol, 330 ug/ml holo-transferrin and 2 U/ml heraprin). Single erythroid progenitors were generated using flow cytometry one day later and cultured in the erythroid differentiation medium. Half of the colonies were collected 12 days post sorting for DNA and RNA analysis. The rest were collected 16 days post sorting for the analysis of hemoglobin proteins. Globin expression (HBG/HBA or HBG/(HBB+HBG)) was determined by real-time PCR and compared for each of the edited erythroid clones.

Example 26—Editing Cells with a Concatenated gRNA

Mobilized human peripheral blood CD34+ cells were cultured in serum free STEMSPAN media with erythroid expansion (100×) cytokine cocktail for two days. 100,000 cells were washed and electroporated using Cas9 mRNA with a concatenated gRNA comprising a first gRNA, a second gRNA, and a third gRNA. The first gRNA can comprise a gRNA specific for the human beta globin locus, as described in Examples 1-6 and disclosed in the Sequence Listing. The second gRNA can comprise a gRNA specific for the human beta globin locus, as described in Examples 1-6 and disclosed in the Sequence Listing. The third gRNA can comprise a gRNA specific for the BCL11A gene or a DNA sequence that encodes a transcriptional control region of the BCL11A gene, as described in Examples 14-19 or the Figures; and disclosed in the Sequence Listing. Cells were allowed to recover for one day before being switched to an erythroid differentiation medium (IMDM+Glutamax supplemented with 5% human serum, 10 ug/ml insulin, 20 ug/ml SCF, 5 ug/ml IL-3, 3 U/ml EPO, 1 uM dexamethasone, 1 uM β-estradiol, 330 ug/ml holo-transferrin and 2 U/ml heraprin). Single erythroid progenitors were generated using flow cytometry one day later and cultured in the erythroid differentiation medium. Half of the colonies were collected 12 days post sorting for DNA and RNA analysis. The rest were collected 16 days post sorting for the analysis of hemoglobin proteins. Globin expression (HBG/HBA or HBG/(HBB+HBG)) was determined by real-time PCR and compared for each of the edited erythroid clones.

Example 27—Editing Cells with a Concatenated gRNA

Mobilized human peripheral blood CD34+ cells were cultured in serum free STEMSPAN media with erythroid expansion (100×) cytokine cocktail for two days. 100,000 cells were washed and electroporated using Cas9 mRNA with a concatenated gRNA comprising a first gRNA, a second gRNA, and a third gRNA. The first gRNA can comprise a gRNA specific for the human beta globin locus, as described in Examples 1-6 and disclosed in the Sequence Listing. The second gRNA can comprise a gRNA specific for the BCL11A gene or a DNA sequence that encodes a transcriptional control region of the BCL11A gene, as described in Examples 14-19 or the Figures; and disclosed in the Sequence Listing. The third gRNA can comprise a gRNA specific for the BCL11A gene or a DNA sequence that encodes a transcriptional control region of the BCL11A gene, as described in Examples 14-19 or the Figures; and disclosed in the Sequence Listing. Cells were allowed to recover for one day before being switched to an erythroid differentiation medium (IMDM+Glutamax supplemented with 5% human serum, 10 ug/ml insulin, 20 ug/ml SCF, 5 ug/ml IL-3, 3 U/ml EPO, 1 uM dexamethasone, 1 uM β-estradiol, 330 ug/ml holo-transferrin and 2 U/ml heraprin). Single erythroid progenitors were generated using flow cytometry one day later and cultured in the erythroid differentiation medium. Half of the colonies were collected 12 days post sorting for DNA and RNA analysis. The rest were collected 16 days post sorting for the analysis of hemoglobin proteins. Globin expression (HBG/HBA or HBG/(HBB+

HBG)) was determined by real-time PCR and compared for each of the edited erythroid clones.

Example 28—Editing Cells with Two Concatenated gRNAs

Mobilized human peripheral blood CD34+ cells were cultured in serum free STEMSPAN media with erythroid expansion (100x) cytokine cocktail for two days. 100,000 cells were washed and electroporated using Cas9 mRNA with two concatenated gRNAs. The first concatenated gRNA comprises a first gRNA and a second gRNA. The first gRNA of the first concatenated gRNA can comprise a gRNA specific for the human beta globin locus, as described in Examples 1-6 and disclosed in the Sequence Listing. The second gRNA of the first concatenated gRNA can comprise a gRNA specific for the BCL11A gene or a DNA sequence that encodes a transcriptional control region of the BCL11A gene, as described in Examples 14-19 or the Figures; and disclosed in the Sequence Listing. The second concatenated gRNA comprises a first gRNA and a second gRNA. The first gRNA of the second concatenated gRNA can comprise a gRNA specific for the human beta globin locus, as described in Examples 1-6 and disclosed in the Sequence Listing. The second gRNA of the second concatenated gRNA can comprise a gRNA specific for the BCL11A gene or a DNA sequence that encodes a transcriptional control region of the BCL11A gene, as described in Examples 14-19 or the Figures; and disclosed in the Sequence Listing. Cells were allowed to recover for one day before being switched to an erythroid differentiation medium (IMDM+Glutamax supplemented with 5% human serum, 10 ug/ml insulin, 20 ug/ml SCF, 5 ug/ml IL-3, 3 U/ml EPO, 1 uM dexamethasone, 1 uM β-estradiol, 330 ug/ml holo-transferrin and 2 U/ml heraprin). Single erythroid progenitors were generated using flow cytometry one day later and cultured in the erythroid differentiation medium. Half of the colonies were collected 12 days post sorting for DNA and RNA analysis. The rest were collected 16 days post sorting for the analysis of hemoglobin proteins. Globin expression (HBG/HBA or HBG/(HBB+HBG)) was determined by real-time PCR and compared for each of the edited erythroid clones.

Example 29—Editing Cells with Two Concatenated gRNAs

Mobilized human peripheral blood CD34+ cells were cultured in serum free STEMSPAN media with erythroid expansion (100x) cytokine cocktail for two days. 100,000 cells were washed and electroporated using Cas9 mRNA with two concatenated gRNAs. The first concatenated gRNA comprises a first gRNA and a second gRNA. The first gRNA of the first concatenated gRNA can comprise a gRNA specific for the human beta globin locus, as described in Examples 1-6 and disclosed in the Sequence Listing. The second gRNA of the first concatenated gRNA can comprise a gRNA specific for the human beta globin locus, as described in Examples 1-6 and disclosed in the Sequence Listing. The second concatenated gRNA comprises a first gRNA and a second gRNA. The first gRNA of the second concatenated gRNA can comprise a gRNA specific for the BCL11A gene or a DNA sequence that encodes a transcriptional control region of the BCL11A gene, as described in Examples 14-19 or the Figures; and disclosed in the Sequence Listing. The second gRNA of the second concatenated gRNA can comprise a gRNA specific for the BCL11A gene or a DNA sequence that encodes a transcriptional control region of the BCL11A gene, as described in Examples 14-19 or the Figures; and disclosed in the Sequence Listing. Cells were allowed to recover for one day before being switched to an erythroid differentiation medium (IMDM+Glutamax supplemented with 5% human serum, 10 ug/ml insulin, 20 ug/ml SCF, 5 ug/ml IL-3, 3 U/ml EPO, 1 uM dexamethasone, 1 uM β-estradiol, 330 ug/ml holo-transferrin and 2 U/ml heraprin). Single erythroid progenitors were generated using flow cytometry one day later and cultured in the erythroid differentiation medium. Half of the colonies were collected 12 days post sorting for DNA and RNA analysis. The rest were collected 16 days post sorting for the analysis of hemoglobin proteins. Globin expression (HBG/HBA or HBG/(HBB+HBG)) was determined by real-time PCR and compared for each of the edited erythroid clones.

Example 30—Clinical Studies and Pharmacology

It is well established that an increase in HbF levels reduces HbS polymerization and thereby ameliorates the phenotype of SCA, reducing clinical complications.

In the context of the CRISPR/Cas9 technology, or by using other endonucleases for gene editing as described herein, the main objectives of primary pharmacodynamic studies in human subjects/patients will be to demonstrate successful de-repression of γ-globin and concomitant increases and beneficial effects of HbF, and to determine the safety and efficacy of such genetic modifications for the treatment of hemoglobinopathies.

Cell-based studies can include both wild-type cells, such as normal CD34+ hHSCs, which do not normally express high levels of HbF, but are edited as described herein to increase their levels of HbF; as well as cells such as CD34+ cells that are derived from patients having a hemoglobinopathy such as β-thalassemia or SCD.

Total red cell HbF will be measured by cationic HPLC and the distribution of HbF in red cells will be quantified in F-cells (cells with detectable HbF levels) using FACS. Although even small incremental increases in HbF have been shown to have beneficial effects in the context of SCD, as discussed above, in some aspects at least about 9% of total Hb in a subject will be HbF, which is associated with decreased mortality in SCD; see, e.g., Platt et al., *N Engl J Med.* 330 (23): 1639-1644 (1994). In some aspects, HbF will be at least about 14%, which is associated with additional clinical benefits, and in some aspects HbF will be at least about 20% to 30%, which is associated with substantial normalization of phenotype in the context of SCD. Similarly, the introduction of even relatively limited subpopulations of cells having significantly elevated levels of HbF (referred to as "F-cells") can be beneficial in various patients since in some situations normalized cells will have a selective advantage relative to diseased cells. Even modest levels of circulating RBCs with elevated levels of HbF can be beneficial for ameliorating one or more aspects of hemoglobinopathy in patients. However, it is generally contemplated that at least one tenth of circulating red blood cells (RBCs) will have elevated levels of HbF, more than one quarter of circulating RBCs will have elevated levels of HbF, or at least one third of circulating RBCs will have elevated levels of HbF. In some aspects, at least about one half, and in some aspects at least about three quarters or more, of circulating RBCs will have elevated levels of HbF.

Example 31—Biodistribution

A preliminary feasibility study (non-GLP) will be performed to demonstrate engraftment of CD34+ hHSCs in NOD/SCID IL2Rγ mice. A GLP biodistribution and persistence study will be performed in immune-compromised NOD/SCID IL2Rγ mice. CRISPR/Cas9-modified human CD34+ HSCs will be administered by i.v. injection (or other routes, e.g. intraosseous) to NOD/SCID IL2Rγ mice. Non-modified CD34+ hHSCs will be used as a control.

Example 32—In Vivo Pharmacology Study

In an illustrative example of in vivo pharmacology, gene-edited HSCs are introduced into immunodeficient mice, and results such as HSC engraftment are assessed. For example, "NSG" or NOD scid gamma (NOD.Cg-Prkdcscid Il2rgtm1Wjl/SzJ), is a strain of inbred laboratory mice, among the most immunodeficient described to date; see, e.g., Shultz et al., *Nat. Rev. Immunol.* 7 (2): 118-130 (2007). Another immune-compromised mouse model applicable for investigating hematopoietic stem cell transplantation is the NOD/MrkBomTac-Prkdc$^{scid}$ mouse (www dot Taconic dot com/NODSC).

One illustrative approach employing an immune-compromised mouse model is to inject CRISPR/Cas9-modified CD34+ human HSCs into immune-compromised NOD/SCID/IL2rγ mice to demonstrate homing and engraftment capabilities.

It is also possible to consider studies in model animals, provided such models are reasonably predictive of one or more aspects of conditions in human patients. Development of animal models providing information relevant to certain aspects of various diseases continues to be the subject of regular improvements in the art, and the use of CRISPR/Cas-9 gene editing is greatly facilitating the more rapid creation of such disease-relevant animal models.

Example 33—Use of Edited Cells for the Amelioration of β-Thalassemia

Using the methods described and illustrated herein, human cells expressing increased levels of HbF can be produced. Such cells can include, for example, human hematopoietic stem cells (human HSCs) that are capable of giving rise to cells of the erythroid lineage such as red blood cells (RBCs). Such HSCs can therefore be used to ameliorate one or more symptoms associated with β-thalassemia.

For example, when the genome editing procedure is applied to increase the levels of HbF in cells of a patient suffering from a β-thalassemia, one or more symptoms or complications of the β-thalassemia can be ameliorated, as a result of the combination of two beneficial effects. First, HbF provides a functional form of hemoglobin that can play a significant role in ameliorating the anemia and associated clinical conditions of β-thalassemia (i.e. in β-thalassemia major and β-thalassemia intermedia), in which the adult β-globin chains that would normally be expressed from the HBB gene are absent or reduced. Second, the level of unpaired α-globin chains, which is a cause of a number of other problems associated clinically β-thalassemia, are reduced because the α-globin chains can be paired with β-globin chains encoded by the γ-globin genes, expression of which is increased as described herein.

As also noted herein, β-thalassemia RBCs have selective disadvantages compared to normal RBCs in terms of survival and other factors; and treatment of cells as described herein overcomes certain disadvantages by, e.g., increasing the levels of HbF, and concomitantly decreasing the levels of unpaired α-globin chains.

In addition, other techniques can be applied to enhance the delivery, expansion and/or persistence of cells modified by genome editing as described herein. These include ablation techniques in which some resident cells are eliminated prior to the introduction of cells. Such techniques are routinely used, for example, in the context of bone marrow transplantation and other procedures in which normal or corrected cells are introduced into patients. Numerous such procedures are known in the art and routinely practiced in connection with the treatment of human patients.

One illustrative and nonlimiting example of the use of such techniques for the amelioration of β-thalassemia is as follows.

In an autologous procedure, genome editing is performed on cells derived from a patient with β-thalassemia. Since the patient's own cells are already matched, they do not therefore raise the potential issues associated with use of allogeneic cells. Correction of such cells ex vivo followed by their reintroduction into the patient presents a means of ameliorating the disease.

As one illustrative example of cells that can be used, peripheral blood stem cells (PBSCs) from a patient with β-thalassemia can be derived from the bloodstream. A process called apheresis or leukapheresis can be used to obtain the PBSCs. For 4 or 5 days before apheresis, the patient may be given a medication to increase the number of stem cells released into the bloodstream. In apheresis, blood is removed through a large vein in the arm or a central venous catheter (a flexible tube that is placed in a large vein in the neck, chest, or groin area). The blood goes through a machine that removes stem cells.

As another illustrative example of cells that can be used, hematopoietic stem cells (HSCs) can be harvested from the patient's bone marrow using well known techniques. CD34 is an antigen associated with hematopoietic stem cells, and isolation of CD34+ HSCs can likewise be accomplished by well-known and clinically-validated methods. For example, a magnetic bead separation process that has been FDA-approved for use in various transplantation contexts and that is available commercially from Miltenyi Biotec, along with preparations for the handling and maintenance of such cells, can be used.

For treating a human patient with β-thalassemia as described herein, a population of CD34+ HSCs adjusted to reflect the patient's weight can be used, e.g. a population comprising about ten million CD34+ HSCs per kilogram of weight. This population of cells is then modified using the genome editing methods described herein. By way of illustration, if Cas9 is the genome editing endonuclease, the protein can be introduced into the CD34+ HSCs by transfection of mRNA using various known techniques; along with the introduction, potentially simultaneously in the transfection, of guide RNAs (which can be single-molecule guides or double-molecule guides) that target loci as described herein. Depending on the procedure used, a portion of the cells (e.g., half the original cells) may then be used for reintroduction into the patient. If ablation is to be used to enhance engraftment of the newly-introduced cells, the patient may be subject to, e.g., mild bone marrow conditioning prior to introduction of the genome edited HSCs. Following any conditioning, the population of genome edited HSCs can be reintroduced into the patient, e.g., by transfusion. Over time, the HSCs give rise to cells of the erythroid lineage, including red blood cells (RBCs).

In the resulting RBCs, genome editing in the case of β-thalassemia results in an increase in the level of HbF, and a concomitant decrease in unpaired-globin chains; as a result of which one or more symptoms or complications associated with the β-thalassemia are ameliorated.

Example 34—Use of Edited Cells for the Amelioration of Sickle Cell Anemia

Using the methods described and illustrated herein, human cells expressing increased levels of HbF can be produced. Such cells can include, for example, human hematopoietic stem cells (human HSCs) that are capable of giving rise to cells of the erythroid lineage such as red blood cells (RBCs). Such HSCs can therefore be used to ameliorate one or more symptoms associated with Sickle Cell Disease, such as Sickle Cell Anemia.

For example, when the genome editing procedure is applied to increase the levels of HbF in cells of a patient suffering from a Sickle Cell Anemia (SCA), one or more symptoms or complications of SCA can be ameliorated. In certain aspects, at least one copy of the mutant β-globin gene is knocked down or eliminated, resulting in combination of two beneficial effects. First, HbF provides a functional form of hemoglobin that can play a significant role in ameliorating the anemia and associated clinical conditions of SCA. Second, the level of sickle cell hemoglobin (HbS) expressed from the mutant β-globin is reduced or eliminated. The presence of HbS causes a number of the problems associated clinically with SCA, and even modest reductions in the presence of HbS can be used to reduce or essentially prevent sickling, as described herein and in the art.

As also noted herein, sickle cell RBCs have selective disadvantages compared to normal RBCs in terms of survival and other factors; and treatment of cells as described herein overcomes certain disadvantages by, e.g., increasing the levels of HbF, and, in aspects in which the mutant β-globin gene is knocked down or eliminated, concomitantly decreasing the levels of HbS.

In addition, other techniques can be applied to enhance the delivery, expansion and/or persistence of cells modified by genome editing as described herein. These include ablation techniques in which some resident cells are eliminated prior to the introduction of cells. Such techniques are routinely used, for example, in the context of bone marrow transplantation and other procedures in which normal or corrected cells are introduced into patients. Numerous such procedures are known in the art and routinely practiced in connection with the treatment of human patients.

One illustrative and nonlimiting example of the use of such techniques for the amelioration of SCA is as follows.

In an autologous procedure, genome editing is performed on cells derived from a patient with SCA. Since the patient's own cells are already matched, they do not therefore raise the potential issues associated with use of allogeneic cells. Correction of such cells ex vivo followed by their reintroduction into the patient presents a means of ameliorating the disease.

As one illustrative example of cells that can be used, PBSCs from a patient with SCA can be derived from the bloodstream, or HSCs can be harvested from the patient's bone marrow, each as described above in the preceding example using well-known techniques. CD34+ cells can then be derived, using procedures as described in the preceding example and well-known techniques.

For treating a human patient with SCA as described herein, a population of CD34+ HSCs adjusted to reflect the patient's weight can be used, e.g. a population comprising about ten million CD34+ HSCs per kilogram of weight. This population of cells is then modified using the genome editing methods described herein. By way of illustration, if Cas9 is the genome editing endonuclease, the protein can be introduced into the CD34+ HSCs by transfection of mRNA using various known techniques; along with the introduction, potentially simultaneously in the transfection, of guide RNAs (which can be single-molecule guides or double-molecule guides) that target loci as described herein. Depending on the procedure used, a portion of the cells (e.g., half the original cells) may then be used for reintroduction into the patient. If ablation is to be used to enhance engraftment of the newly-introduced cells, the patient may be subject to, e.g., mild bone marrow conditioning prior to introduction of the genome edited HSCs. Following any conditioning, the population of genome edited HSCs can be reintroduced into the patient, e.g., by transfusion. Over time, the HSCs give rise to cells of the erythroid lineage, including red blood cells (RBCs).

In the resulting RBCs, genome editing in the case of SCA results in an increase in the level of HbF, and in aspects in which the mutant β-globin gene is knocked down or eliminated, concomitantly decreasing the levels of HbS; as a result of which one or more symptoms or complications associated with the β-thalassemia are ameliorated.

Example 35—Successive Electroporations Using Dual Guide RNAs (SPY101 and SD2)

Successive electroporation is a method of electroporating cells 36-48 hours after thawing, followed by a second electroporation 36-48 hours later.

Figure 12:
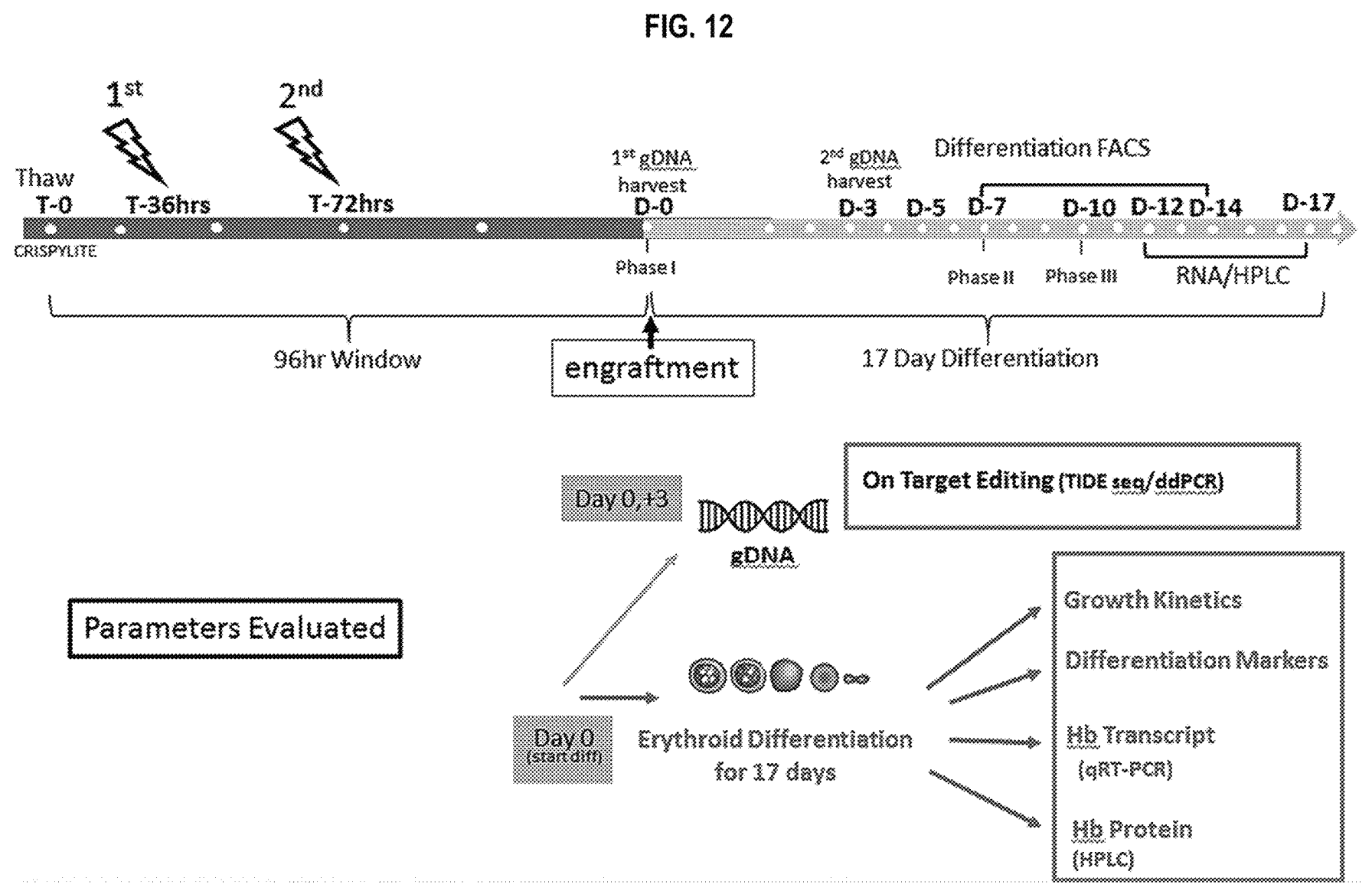

Successive electroporations using dual guide RNAs were performed using the experimental design shown in FIG. 12. Human mobilized peripheral blood (mPB) CD34+ cells were obtained from Fred Hutch Donor 304 and Donor LKP06B and either: successively electroporated with 1.5 μg SPY101 and then 1.5 μg SD2 (SPY/SD); successively electroporated with 1.5 μg SD2 and then 1.5 μg SPY101 (SD/SPY); simultaneously electroporated with 1.5 μg SPY101 and 1.5 μg SD2 (SPY&SD); individually electroporated with 3 μg SPY101 (SPY); individually electroporated with 3 μg SD2 (SD); simultaneously electroporated with 1.5 μg of a guide RNA that targets Exon 2 and 1.5 μg of a second guide RNA that targets Exon 2 (EX2); electroporated with Cas9 RNP (mock); or not electroporated (untreated).

Successive electroporations using SPY101 and then SD2 (or SD2 and then SPY101) were compared to single guide RNA electroporations (both individually using SPY101 or SD2; and simultaneously using SPY101 and SD2 at the same time) to determine the impact of successive electroporations using SPY101 and then SD2 (or SD2 and then SPY101) on the cell's health, editing rates, ability to differentiate, globin mRNA levels, and HbF protein levels.

Figures 13A, 13B:
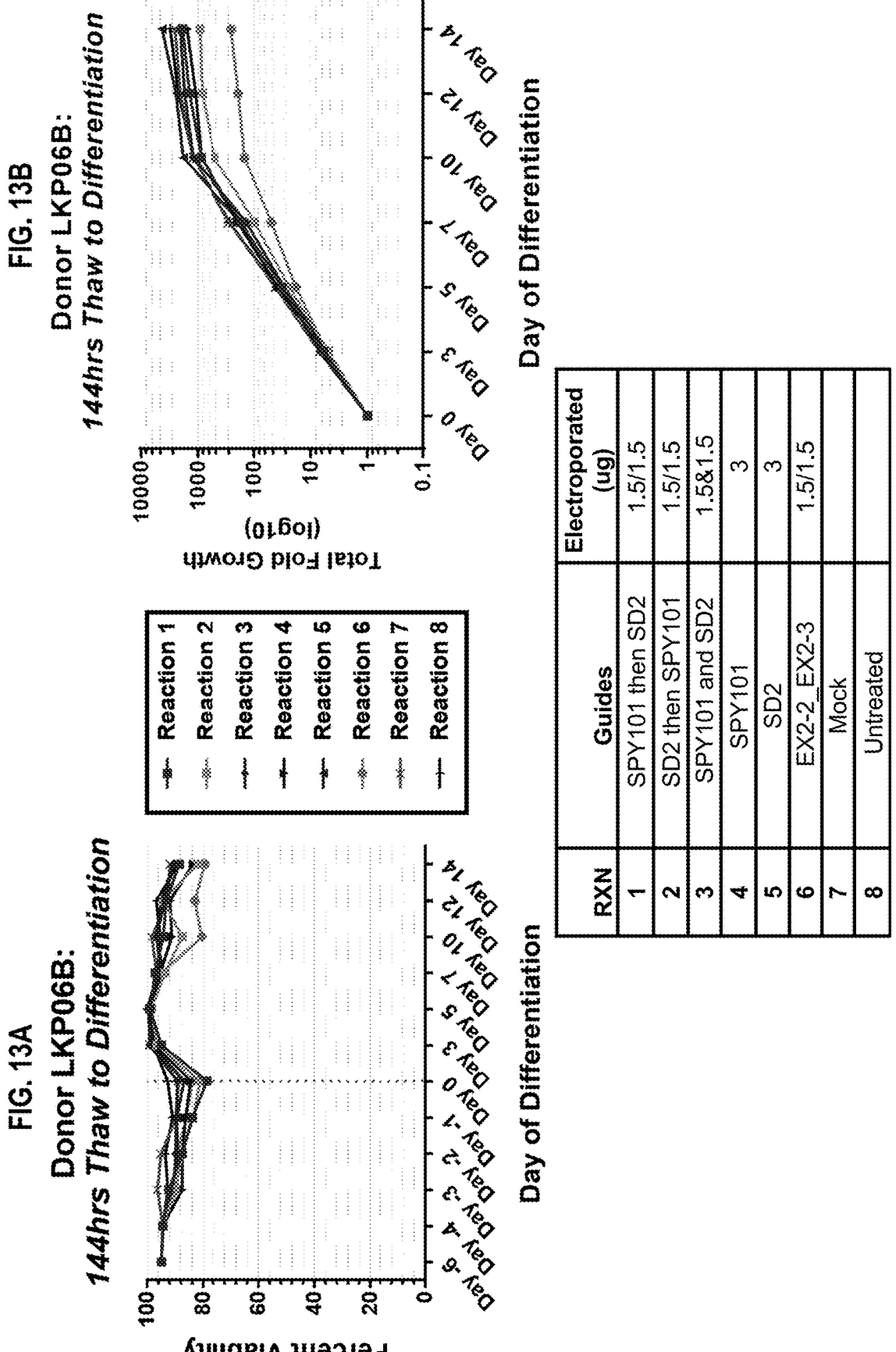
FIGS. 13A-13B show the viability and growth kinetics of human mobilized peripheral blood (mPB) CD34+ cells from Donor LKP06B successively electroporated with dual guide RNAs compared to human mPB CD34+ cells from Donor LKP06B electroporated with a single guide RNA.

Cell health of each of the electroporated mPBs described herein was accessed by measuring the viability and growth kinetics of the electroporated mPBs at various time points (Day−6, Day−4, Day−3, Day−2, Day−1, Day0, Day 3, Day 5, Day 7, Day 10, Day 12, and Day 14). Day−6 cells were thawed mPB cells that were not yet electroporated. Day−4 cells were mPBs that were thawed 48-hours earlier and electroporated for the first time at this time point. Day−3 cells were mPBs that were thawed 72-hours earlier and electroporated 24 hours earlier. Day−2 cells were mPBs that were thawed 96-hours earlier and electroporated for the second time at this time point for those mPBs that received successive electroporations. Day−1 cells were mPBs that were thawed 120-hours earlier and electroporated for the second time 24-hours earlier for those mPBs that received successive electroporations. DO cells were mPBs that were thawed 144-hours earlier and electroporated for the second time 48-hours earlier for those mPBs that received successive electroporations. Each time point after DO refers to a stage of mPB differentiation to erythrocytes, such D3, D5, D7, D10, D12, and D14. As demonstrated in FIGS. 13A-B, cell viability and cell growth kinetics are similar between mPB CD34+ cells from Donor LKP06B successively electroporated with SPY101 and then SD2 (or SD2 and then SPY101) and mPB CD34+ cells from Donor LKP06B electroporated with a single guide RNA (regardless of whether the single guide electroporation used SPY101 or SD2; or simultaneously used SPY101 and SD2).

Figures 14A, 14B:
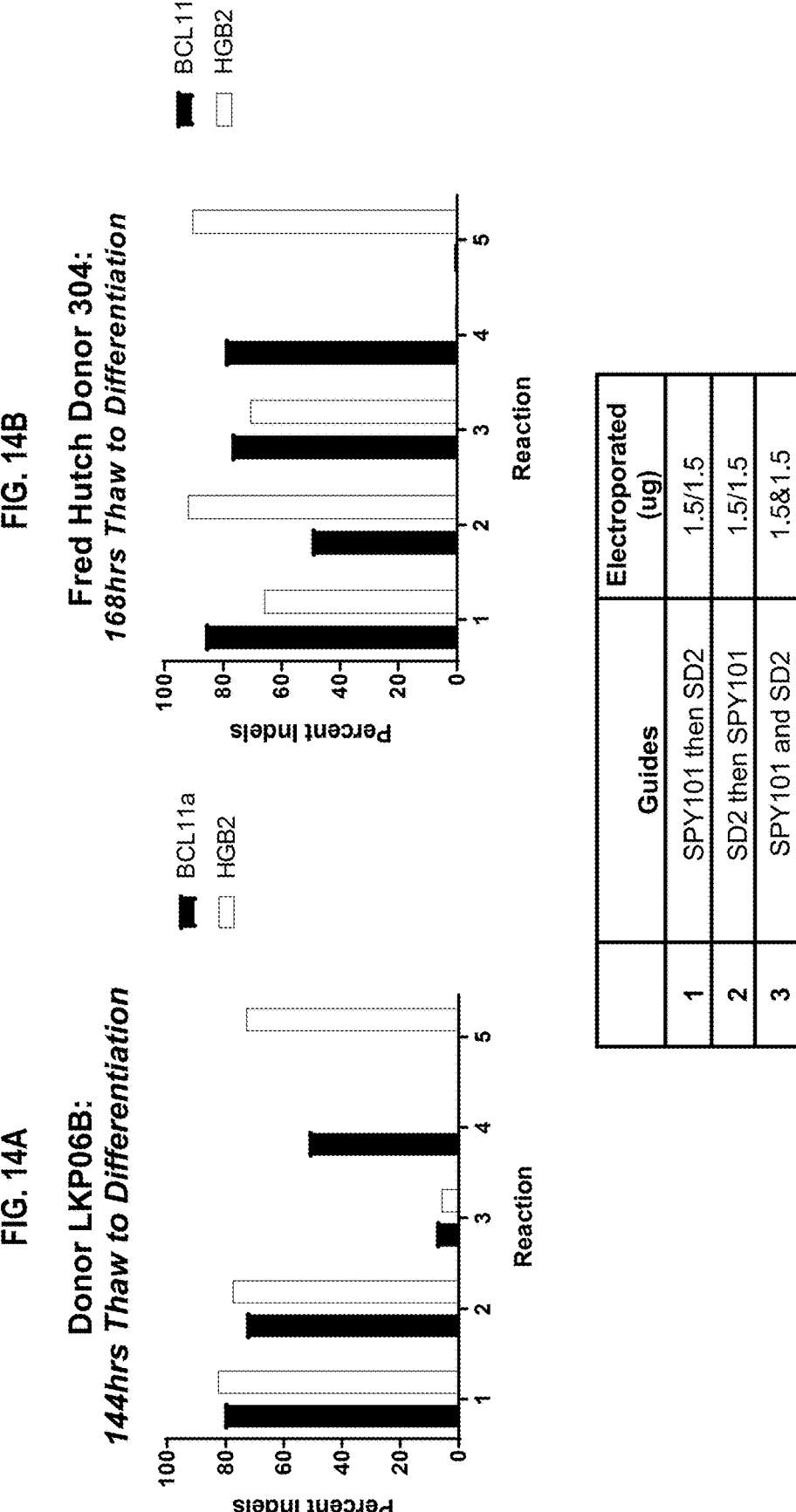
FIGS. 14A-14B show the rate of DNA editing (% indels) at the BCL11a locus and HBG2 locus in human mPB CD34+ cells successively electroporated with dual guide RNAs compared to human mPB CD34+ cells electroporated with a single guide RNA.

Editing rates of each of the electroporated samples described herein were accessed by measuring the cutting efficiencies (percent Indels) of cells from each of the electroporated mPBs. Genomic DNA was isolated at Day 3 and cutting efficiency was evaluated using TIDE analysis. As demonstrated in FIGS. 14A-B, editing rates are similar between mPB CD34+ cells from Fred Hutch Donor 304 and Donor LKP06B successively electroporated with SPY101 and then SD2 (or SD2 and then SPY101) and mPB CD34+ cells from Fred Hutch Donor 304 and Donor LKP06B electroporated with a single guide RNA (regardless of whether the single guide electroporation used SPY101 or SD2; or simultaneously used SPY101 and SD2).

Figures 15A, 15B:
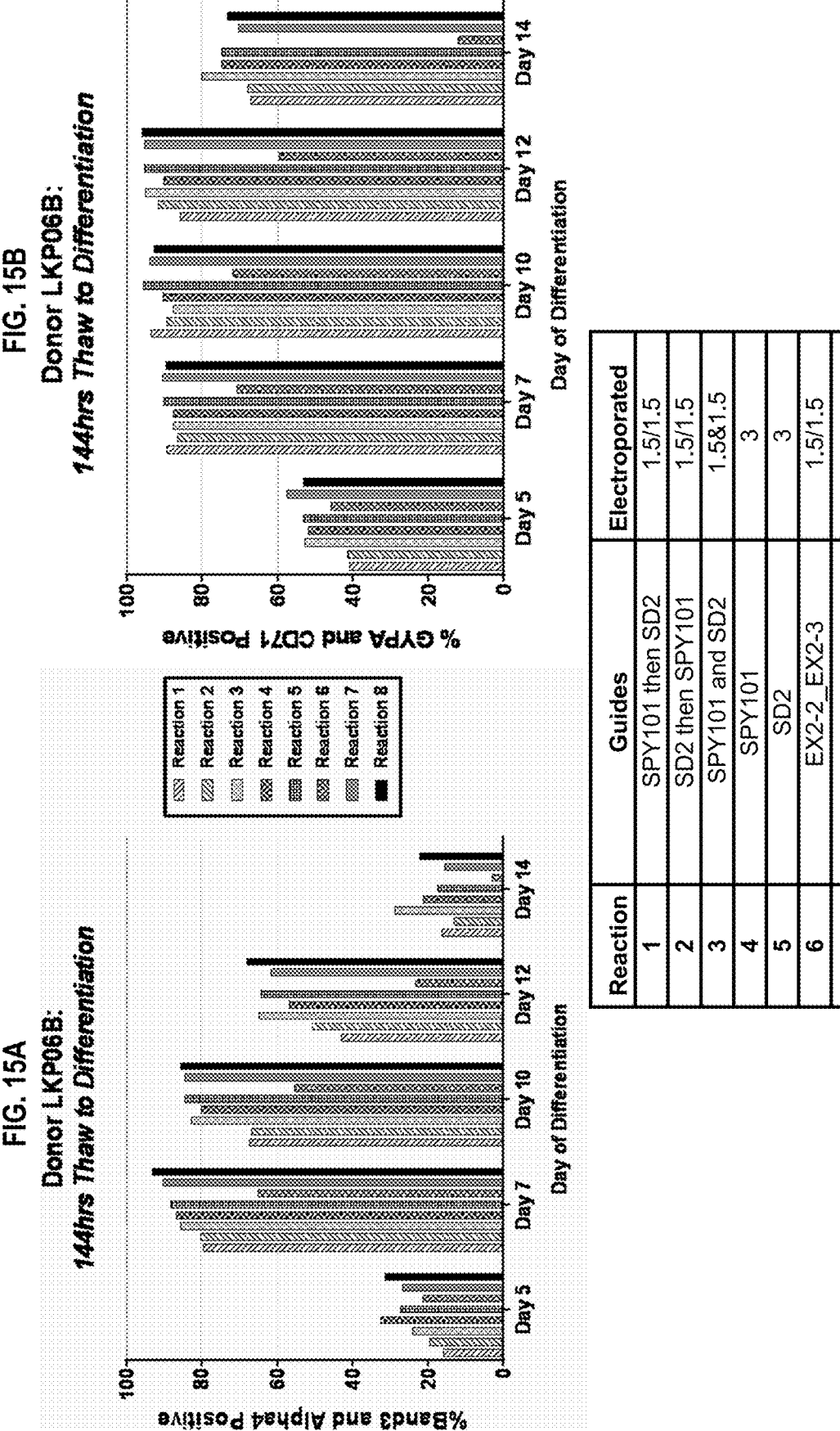
FIGS. 15A-15B show the differentiation of human mPB CD34+ cells from Donor LKP06B successively electroporated with dual guide RNAs compared to human mPB CD34+ cells from Donor LKP06B electroporated with a single guide RNA. Differentiation was determined by measuring the percentage of Band3, Alpha4, GYPA, and CD71.

Differentiation of mPBs to erythrocytes for each of the electroporated mPBs described herein was accessed by measuring the expression of Band3, Alpha4, GYPA, and CD71 for each of the electroporated mPBs at various time points (Day 5, Day 7, Day 10, Day 12, and Day 14) via FACs. As demonstrated in FIGS. 15A-B, there were minimal differences in differentiation between mPB CD34+ cells from Donor LKP06B successively electroporated with SPY101 and then SD2 (or SD2 and then SPY101) and mPB CD34+ cells from Donor LKP06B electroporated with a single guide RNA (regardless of whether the single guide electroporation used SPY101 or SD2; or simultaneously used SPY101 and SD2).

Differentiation of mPBs to erythrocytes for each of the electroporated mPBs described herein was also accessed by measuring the percentage of enucleation for each of the electroporated mPBs at various time points (Day 5, Day 7, Day 10, Day 12, and Day 14). As demonstrated in FIG. 16, there were minimal differences in enucleation between mPB CD34+ cells from Donor LKP06B successively electroporated with SPY101 and then SD2 (or SD2 and then SPY101) and mPB34+ cells from Donor LKP06B electroporated with a single guide RNA (regardless of whether the single guide electroporation used SPY101 or SD2; or simultaneously used SPY101 and SD2).

Figures 17A, 17B:
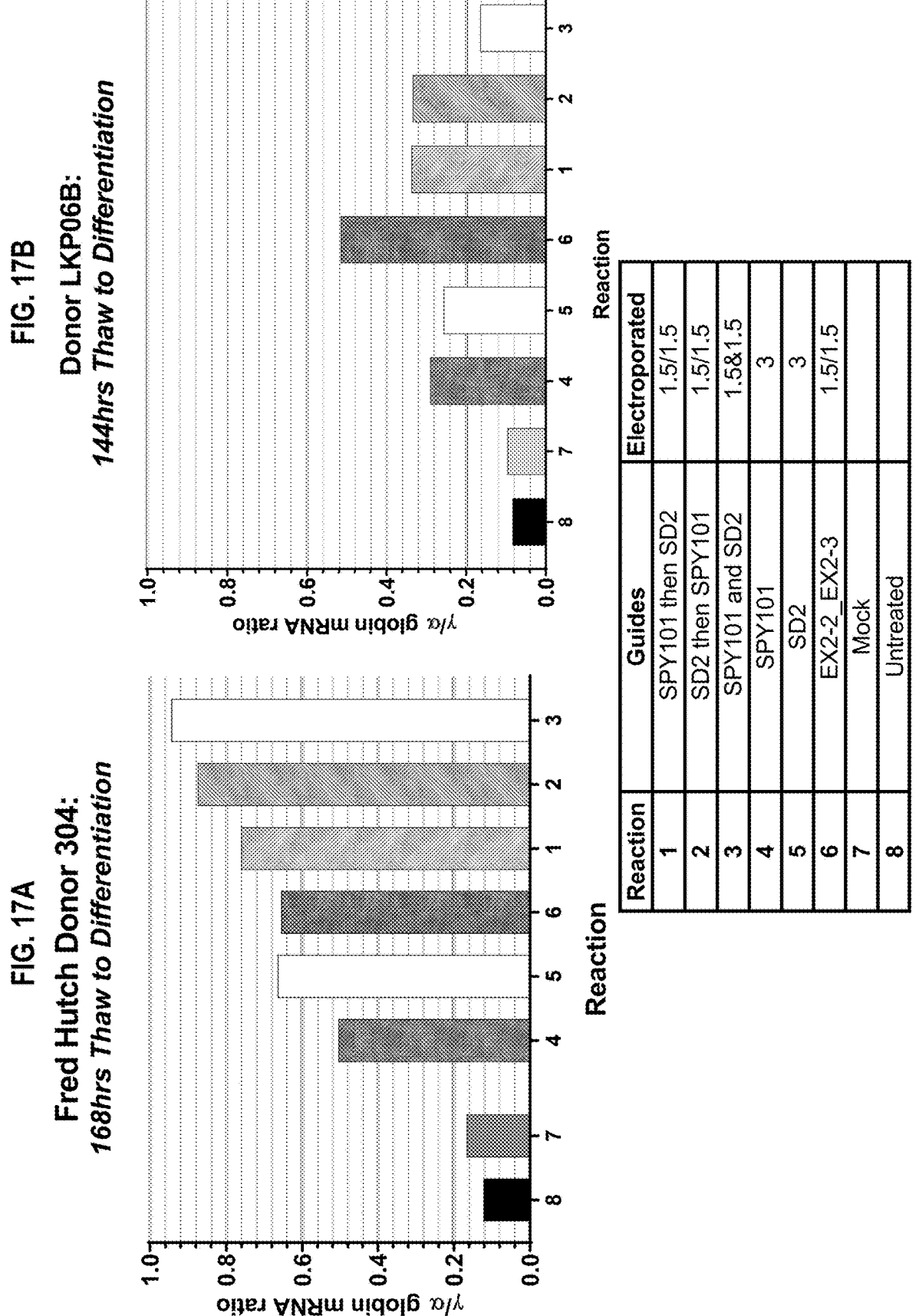
FIGS. 17A-17B show the γ/α globin mRNA ratio in human mPB CD34+ cells successively electroporated with dual guide RNAs compared to human mPB CD34+ cells electroporated with a single guide RNA.

Globin expression ($\gamma/\alpha$ globin mRNA) was measured for each of the electroporated mPBs described herein that differentiated into erythrocytes (Day 12 differentiated cells) using quantitative real-time PCR (qRT-PCR). As demonstrated in FIGS. 17A-B, $\gamma/\alpha$ globin mRNA expression increased from 15-70% for mPB CD34+ cells successively electroporated with SPY101 and then SD2 (or SD2 and then SPY101) compared to mPB CD34+ cells electroporated with a single guide RNA (regardless of whether the single guide electroporation used SPY101 or SD2; or simultaneously used SPY101 and SD2).

Figures 18A, 18B:
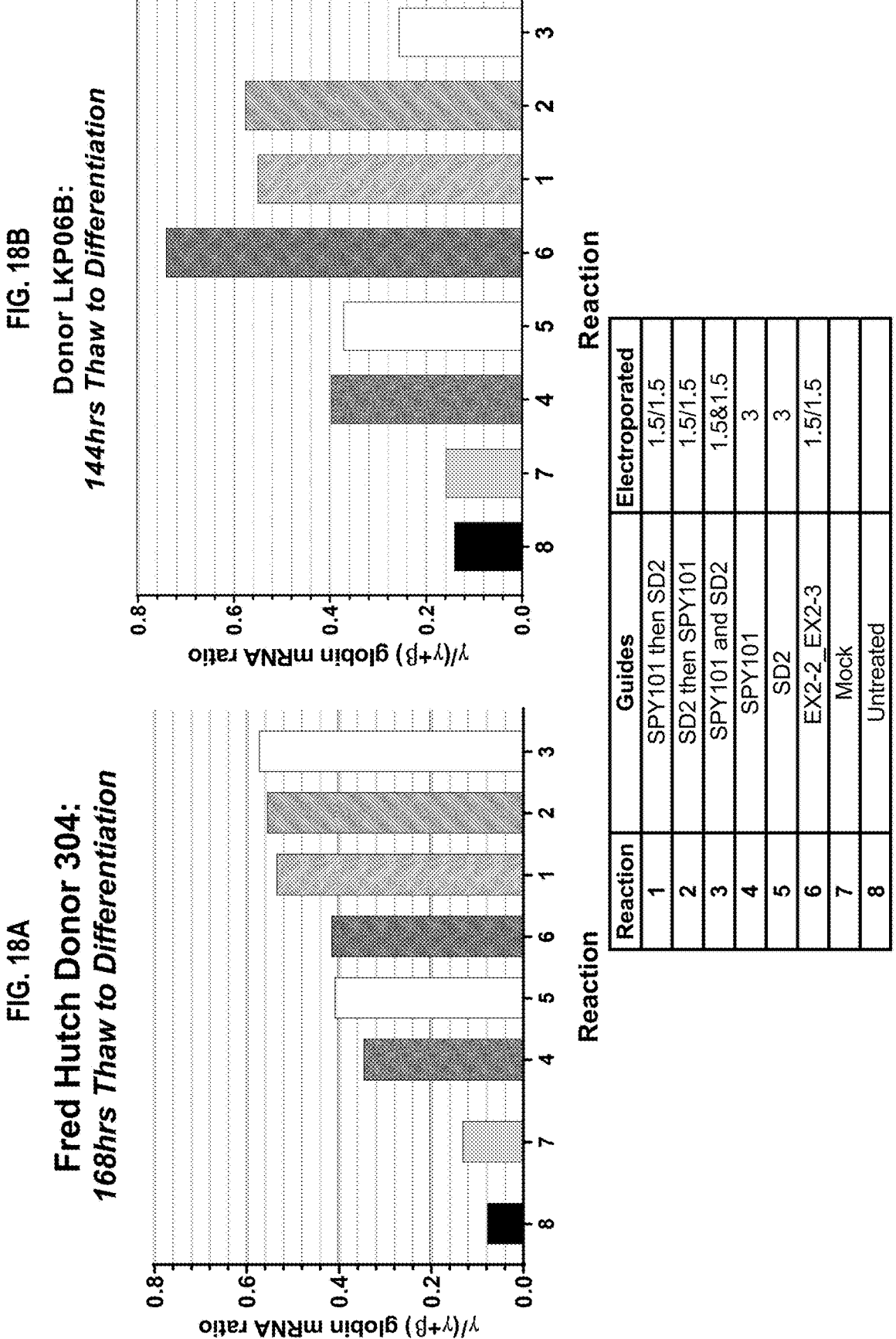
FIGS. 18A-18B show the globin mRNA ratio in human mPB CD34+ cells successively electroporated with dual guide RNAs compared to human mPB CD34+ cells electroporated with a single guide RNA.

Globin expression ($\gamma(\gamma+\beta)$ globin mRNA) was measured for each of the electroporated mPBs described herein that differentiated into erythrocytes (Day 12 differentiated cells) using qRT-PCR. As demonstrated in FIGS. 18A-B, $\gamma(\gamma+\beta)$ globin mRNA expression increased from 30-60% for mPB CD34+ cells successively electroporated with SPY101 and then SD2 (or SD2 and then SPY101) compared to mPB CD34+ cells electroporated with a single guide RNA (regardless of whether the single guide electroporation used SPY101 or SD2; or simultaneously used SPY101 and SD2).

Figures 19A, 19B:
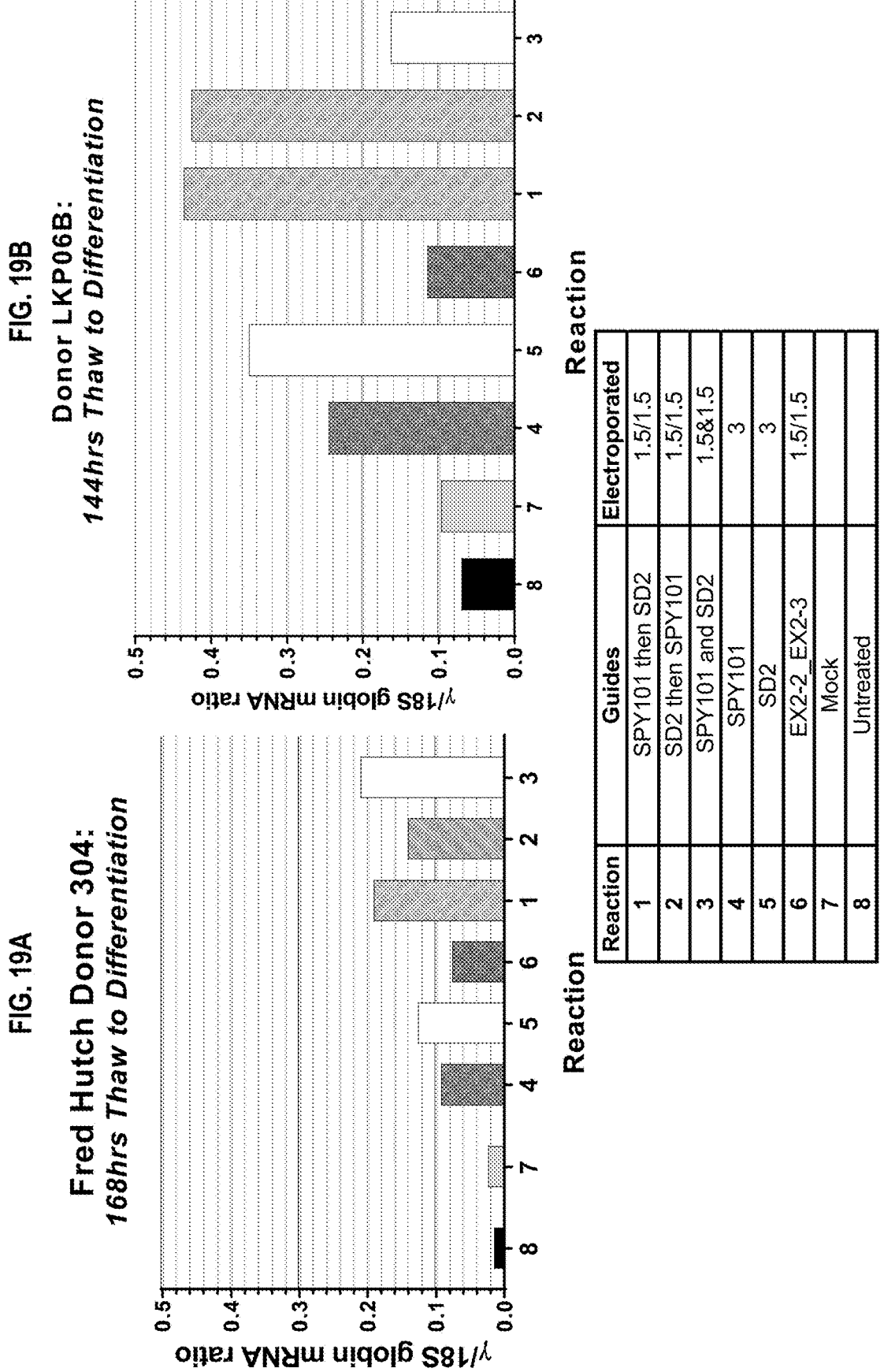
FIGS. 19A-19B show the γ/18S globin mRNA ratio in human mPB CD34+ cells successively electroporated with dual guide RNAs compared to human mPB CD34+ cells electroporated with a single guide RNA.
Figure 21A:
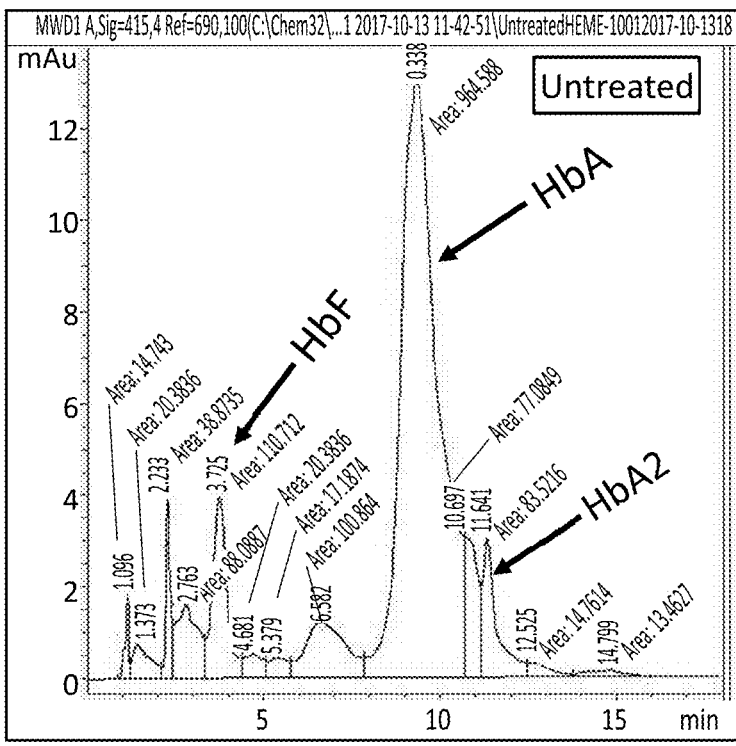
FIGS. 21A-21E show HbF expression in human mPB CD34+ cells successively electroporated with dual guide RNAs, human mPB CD34+ cells electroporated with a single guide RNA, and untreated human mPB CD34+ cells.
Figure 21B:
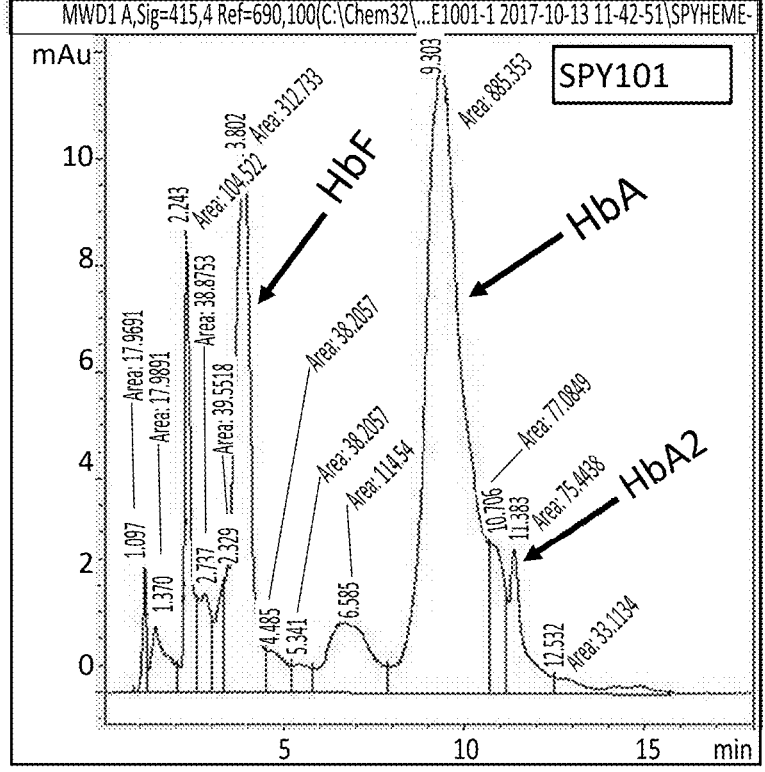
Figure 21C:
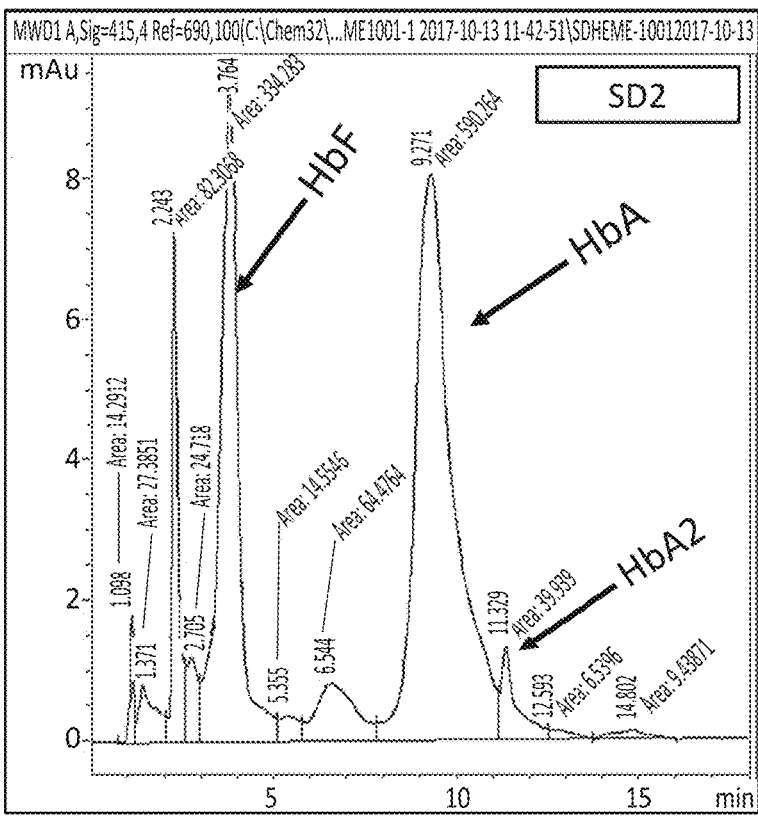
Figure 21D:
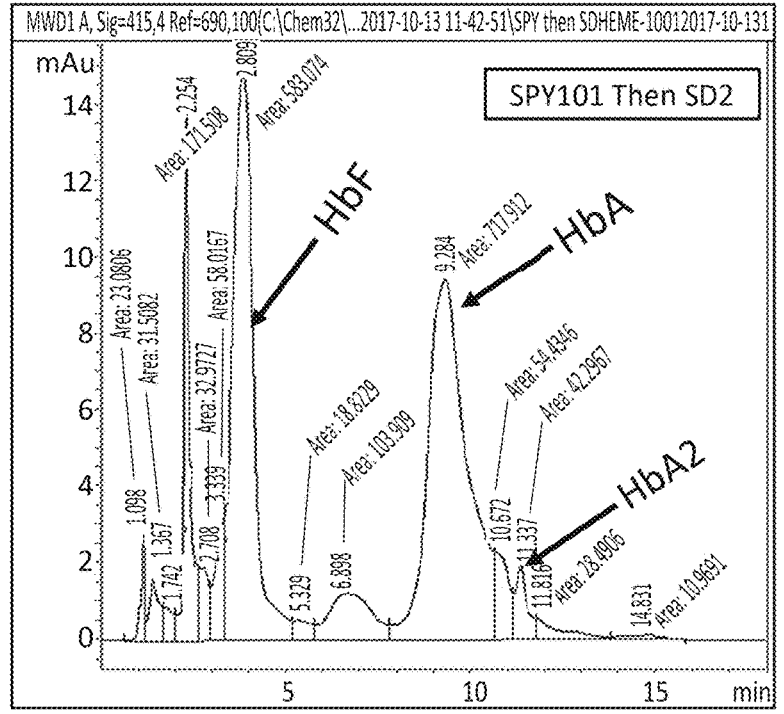
Figure 21E:
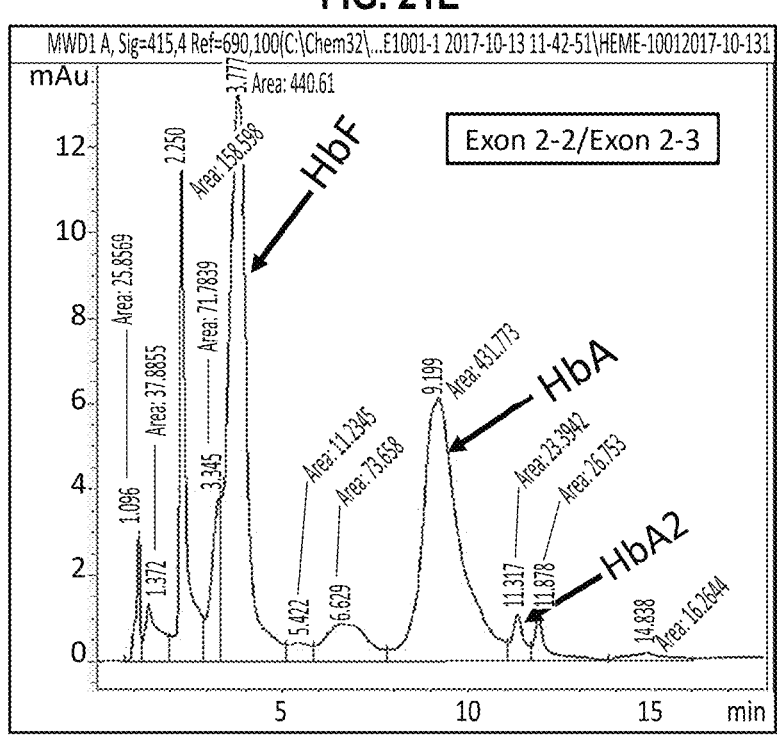

Globin expression ($\gamma/18S$ globin mRNA) was measured for each of the electroporated mPBs described herein that differentiated into erythrocytes (Day 12 differentiated cells) using qRT-PCR. As demonstrated in FIGS. 19A-B, $\gamma/18S$ globin mRNA expression increased for mPB CD34+ cells successively electroporated with SPY101 and then SD2 (or SD2 and then SPY101) compared to mPB CD34+ cells electroporated with a single guide RNA (regardless of whether the single guide electroporation used SPY101 or SD2; or simultaneously used SPY101 and SD2).

HbF expression was measured for each of the electroporated mPBs described herein that differentiated into erythrocytes (Day 17 differentiated cells) using HPLC. As demonstrated in FIGS. 20 and 21A-E, HbF expression increased for mPB CD34+ cells successively electroporated with SPY101 and then SD2 (or SD2 and then SPY101) compared to mPB CD34+ cells electroporated with a single guide RNA (regardless of whether the single guide electroporation used SPY101 or SD2; or simultaneously used SPY101 and SD2).

Figure 22:
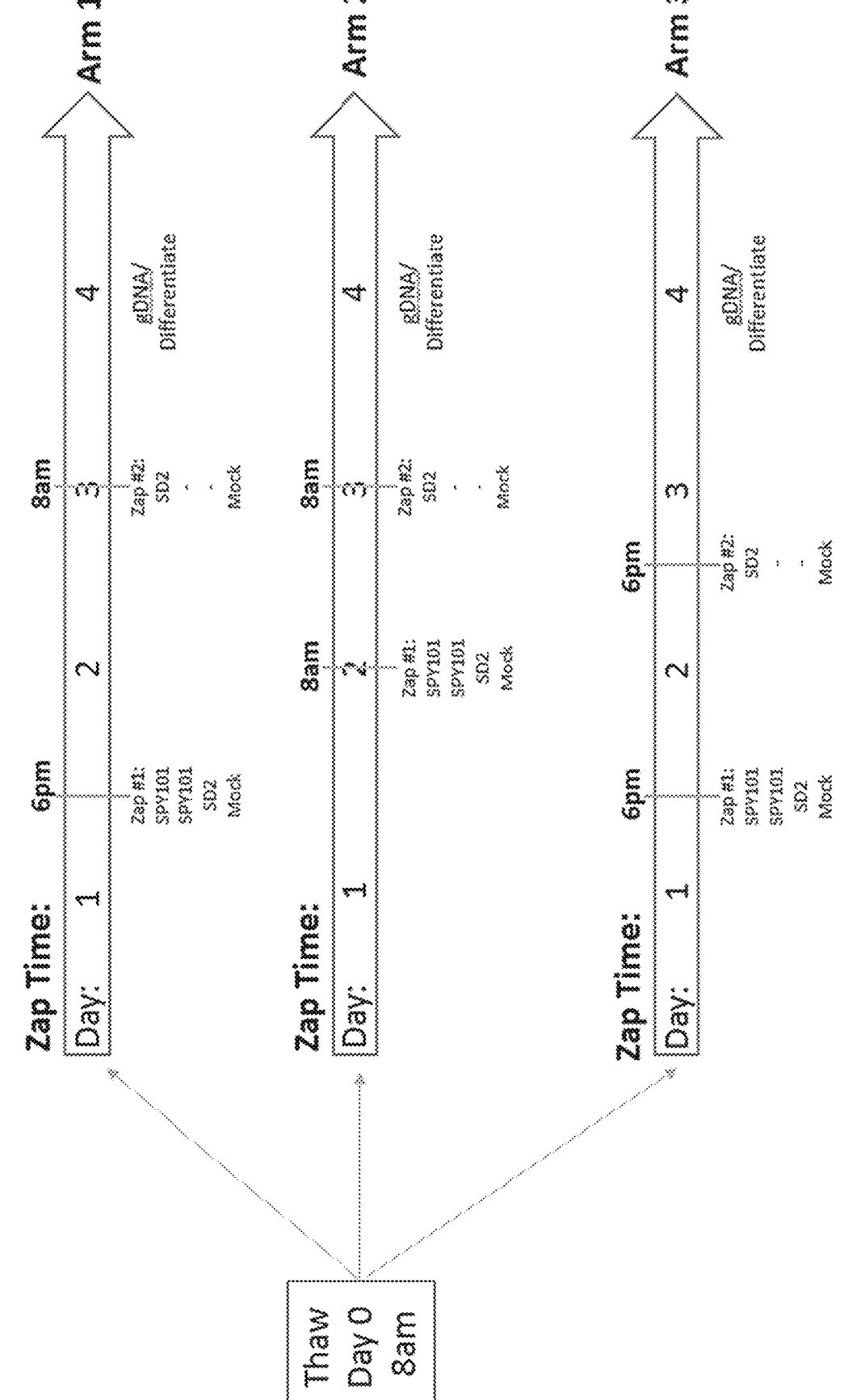
FIG. 22 shows three different experimental designs (Arms 1-3) that include successive electroporations using dual guide RNAs. Each experimental design tests different timing options for the successive electroporations.

Three different experimental designs (Arm conditions 1-3), depicted in FIG. 22, were tested to determine the optimal time points for a first electroporation and a second electroporation within a 96-hour time frame prior to differentiation and the optimal time period between the first and second electroporations. Arm 1 conditions include a first electroporation of mPB CD34+ cells at 34 hours after thawing, a second electroporation at 72-hours after thawing, and 38 hours between the first and second electroporations. Arm 2 conditions include a first electroporation of mPB CD34+ cells at 48 hours after thawing, a second electroporation at 72-hours after thawing, and 24 hours between the first and second electroporations. Arm 3 conditions include a first electroporation of mPB CD34+ cells at 34 hours after thawing, a second electroporation at 58-hours after thawing, and 24 hours between the first and second electroporations.

Successive electroporations using dual guide RNAs under Arm conditions 1-3 were performed using the experimental design shown in FIGS. 12 and 22. Human mPB CD34+ cells were obtained from Donor LKP06B and either: successively electroporated with 1.5 µg SPY101 and then 1.5 µg SD2 (SPY/SD); individually electroporated with 3 µg SPY101 (SPY); individually electroporated with 3 µg SD2 (SD); electroporated with Cas9 RNP (mock); or not electroporated (untreated).

Figures 24A, 24B:
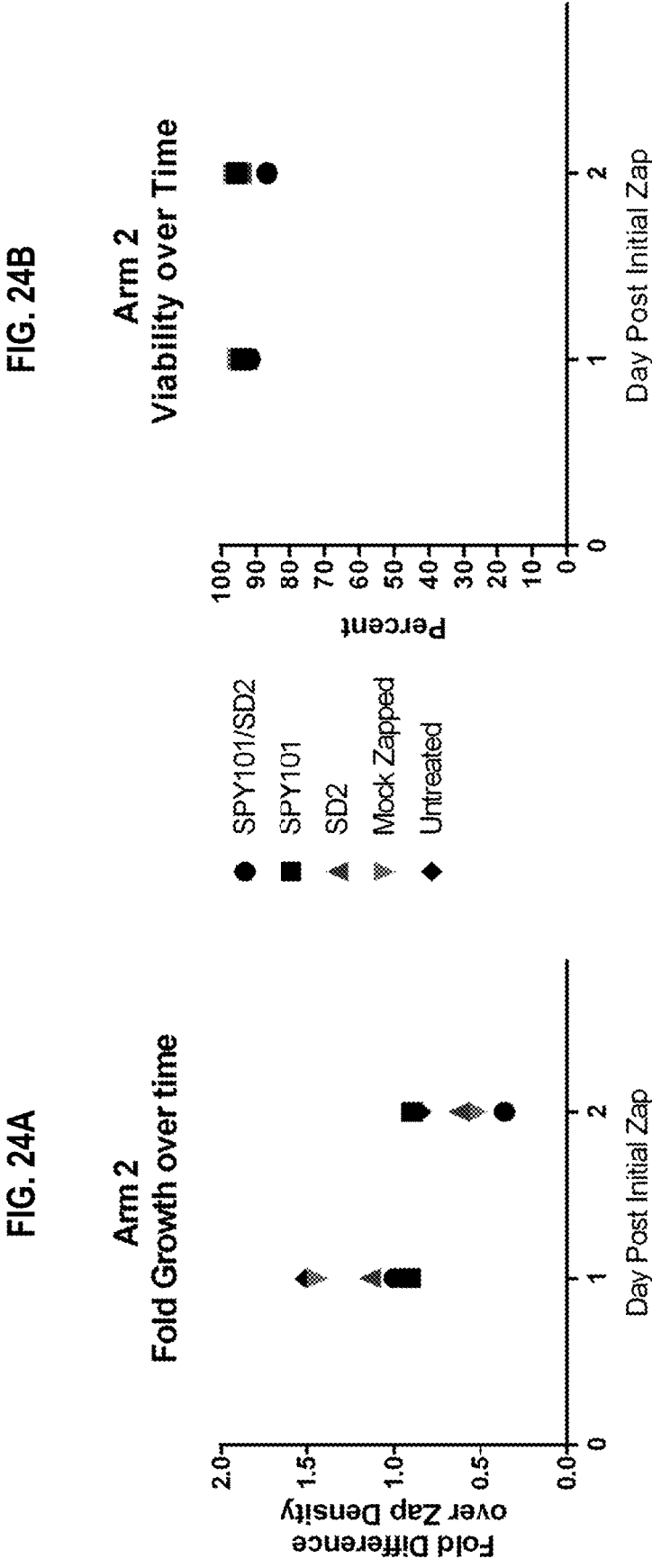
FIGS. 24A-24B show the growth kinetics and viability of human mPB CD34+ cells successively electroporated with dual guide RNAs under Arm 2 conditions compared to human mPB CD34+ cells electroporated with a single guide RNA under Arm 2 conditions.
Figures 26A, 26B:
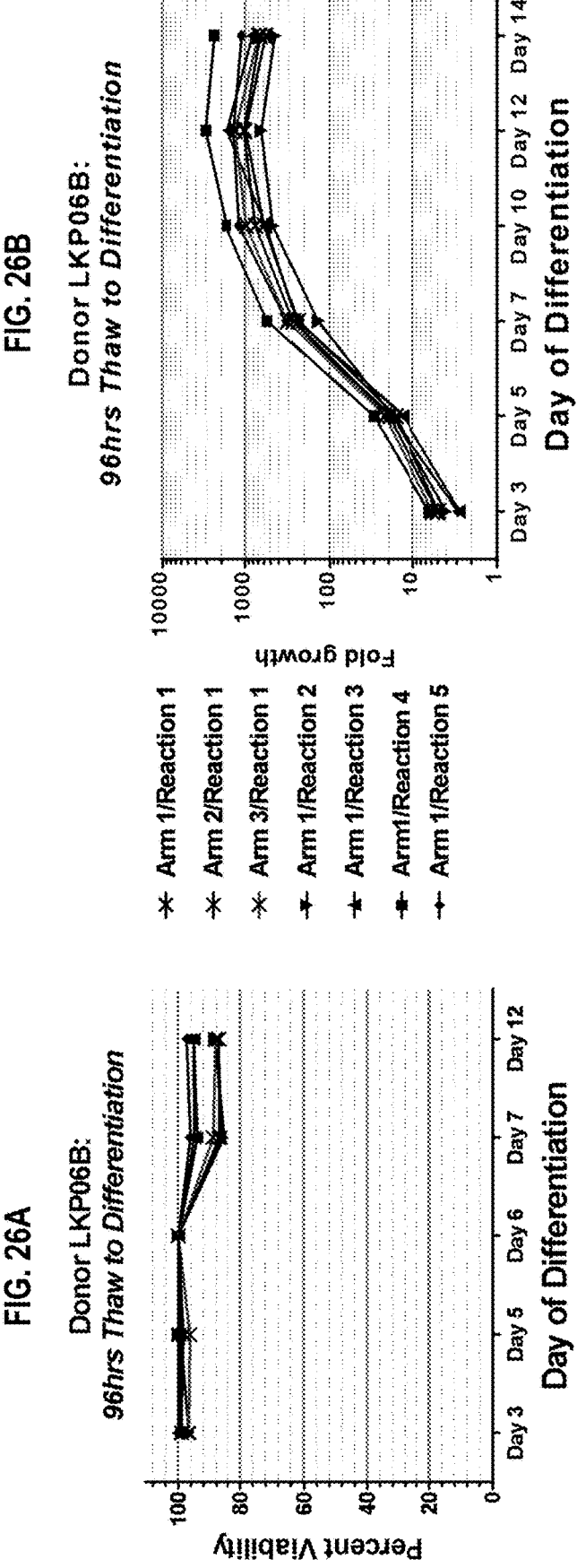
FIGS. 26A-26B shows the viability and growth kinetics of human mPB CD34+ cells successively electroporated with dual guide RNAs under Arm conditions 1-3 compared to human mPB CD34+ cells electroporated with a single guide RNA under Arm conditions 1-3.

Cell health of each of the electroporated mPBs described herein under Arm conditions 1-3 was accessed by measuring the viability and growth kinetics of the electroporated mPBs at various time points post the initial or first electroporation (Day 1, Day 2, Day 3). As demonstrated in FIGS. 23A-B, under Arm 1 conditions, there was slowed growth 1-day after the first electroporation, but the viability remained consistent. As demonstrated in FIGS. 24A-B, under the Arm 2 conditions, there was a loss of cells within 24 hours between the two electroporations, but viability remained consistent. As demonstrated in FIGS. 25A-B, under the Arm 3 conditions, there was slowed growth between the thawing of the cells and the first electroporation. There was also slowed growth between the first electroporation and second electroporation. As demonstrated in FIGS. 26A-B, there was no difference in cell viability and growth kinetics between edited mPBs and unedited mPBs throughout differentiation.

Editing rates of each of the electroporated mPBs described herein under Arm conditions 1-3 were accessed by measuring the cutting efficiencies (percent Indels) of cells from each of the electroporated mPBs. Genomic DNA was isolated at Day 3 and cutting efficiency was evaluated using TIDE analysis. As demonstrated in FIG. 27, editing rates are similar between mPB CD34+ cells from Donor LKP06B successively electroporated with SPY101 and then SD2 and mPB CD34+ cells from Donor LKP06B electroporated with a single guide RNA (a single guide electroporation used SPY101 or SD2). These results demonstrate that the timing between thaw and electroporations or in between electroporations does not impact editing rates.

Figure 28A:
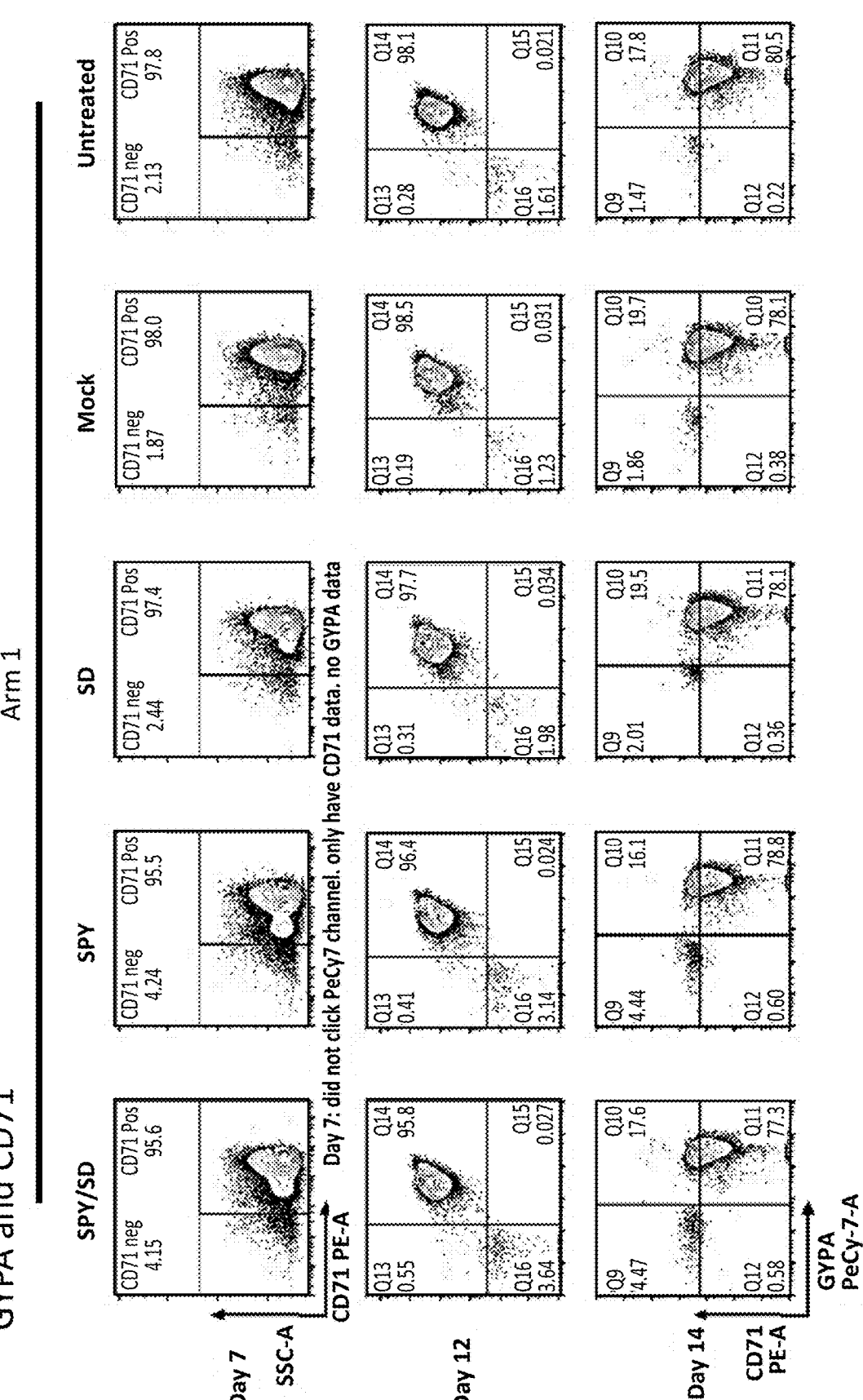
FIGS. 28A-28B show the differentiation of human mPB CD34+ cells successively electroporated with dual guide RNAs under Arm conditions 1-3 compared to human mPB CD34+ cells electroporated with a single guide RNA under Arm conditions 1-3. Differentiation was determined by measuring the percentage of Band3, Alpha4, GYPA, and CD71.
Figure 28A:
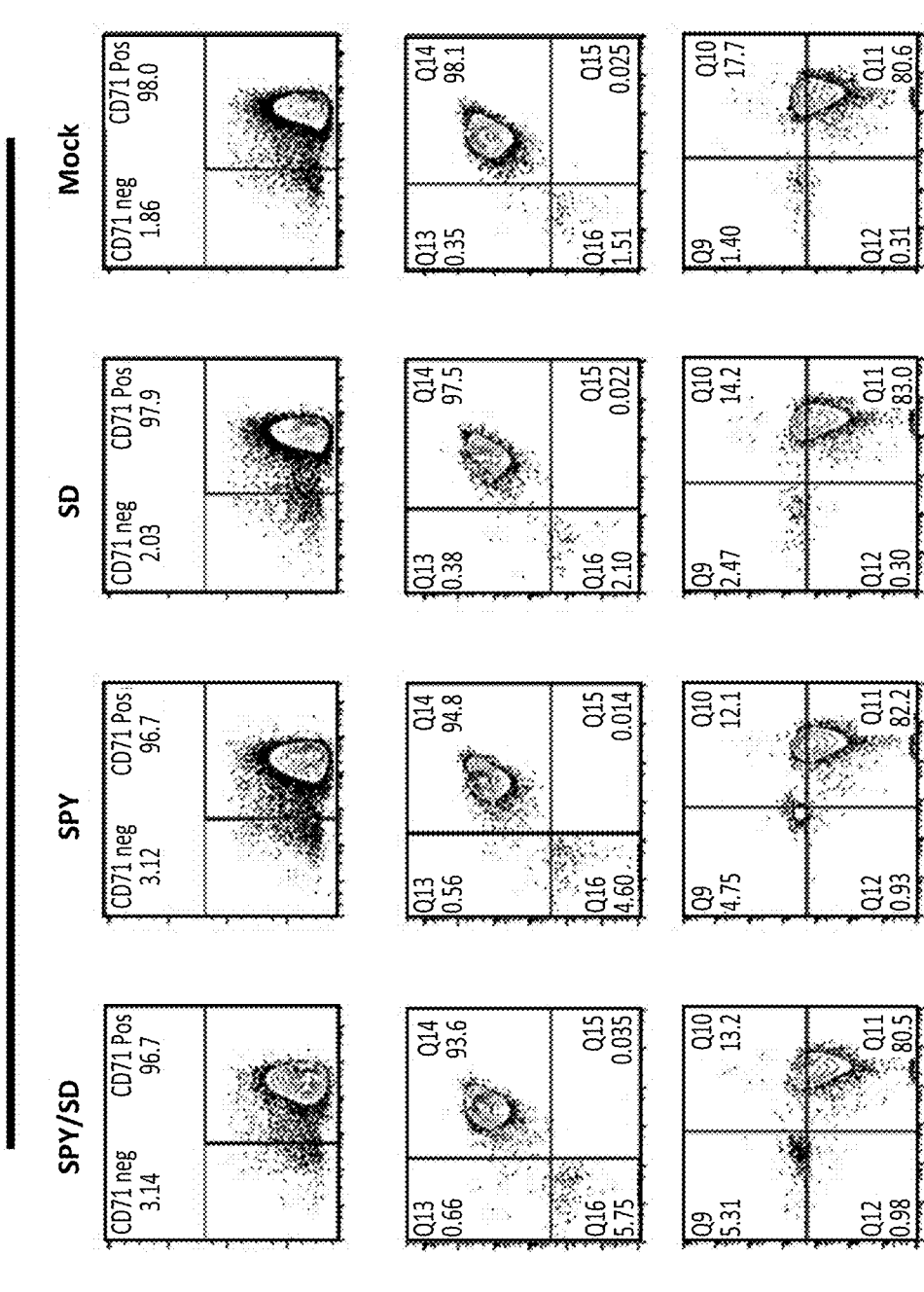
Figure 28A:
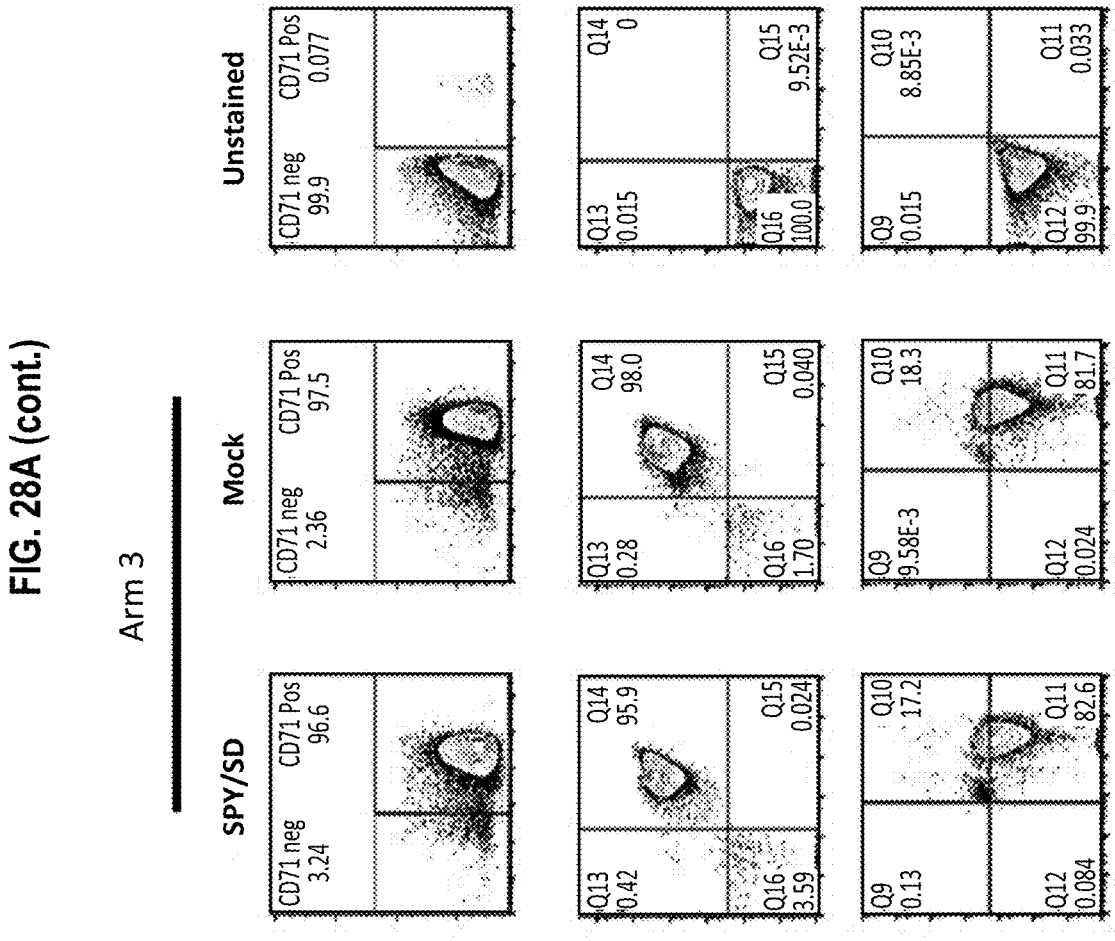
Figure 28B:
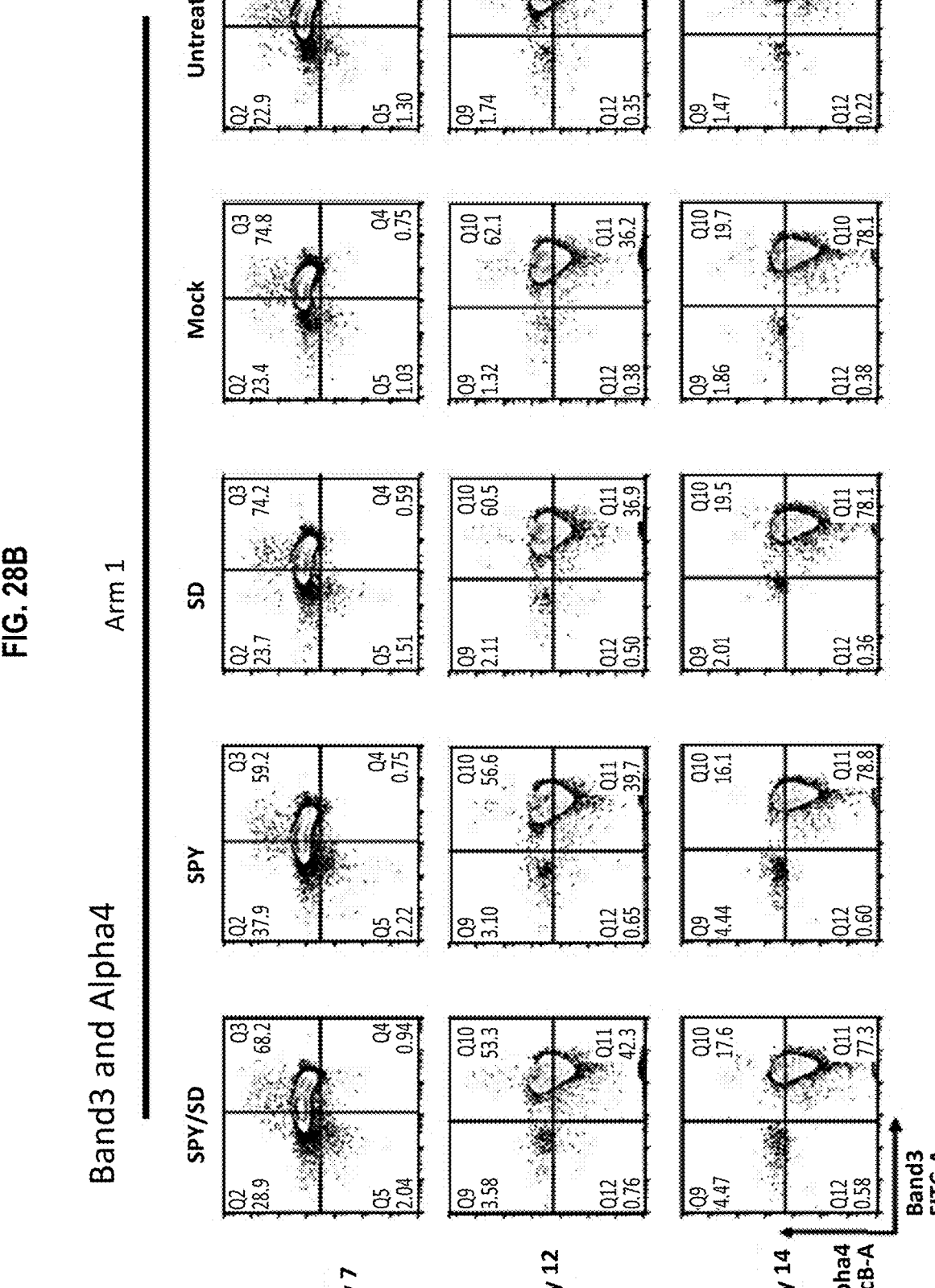
Figure 28B:
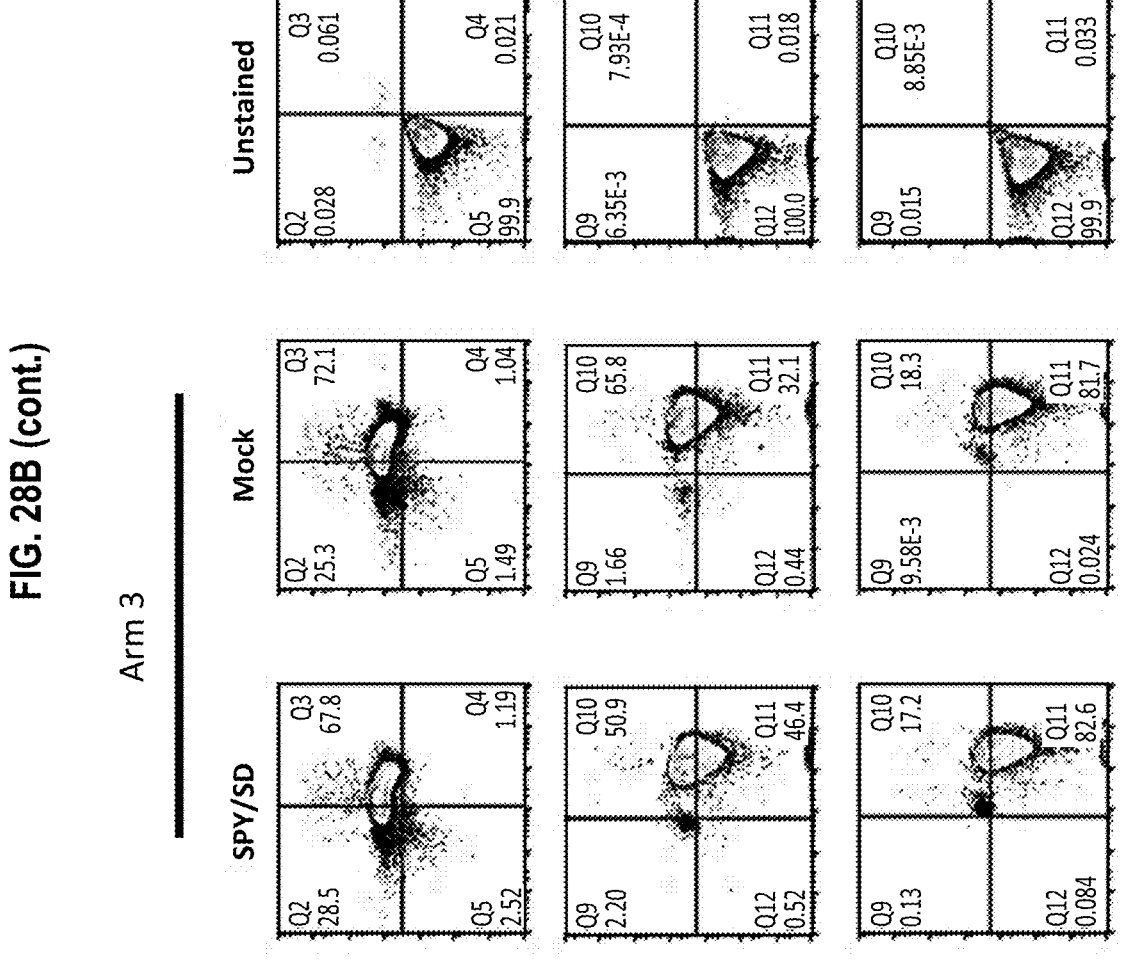

Differentiation of mPBs to erythrocytes for each of the electroporated mPBs described herein under Arm conditions 1-3 was accessed by measuring the expression of Band3, Alpha4, GYPA, and CD71 for each of the electroporated mPBs at various time points (Day 7, Day 12, and Day 14) via FACs. As demonstrated in FIGS. 28A-B, there were no differences in differentiation between mPB CD34+ cells from Donor LKP06B successively electroporated with SPY101 and then SD2 under Arm conditions 1-3 and mPB CD34+ cells from Donor LKP06B electroporated with a single guide RNA (an electroporation using SPY101 or SD2) under Arm conditions 1-3.

Figure 29:
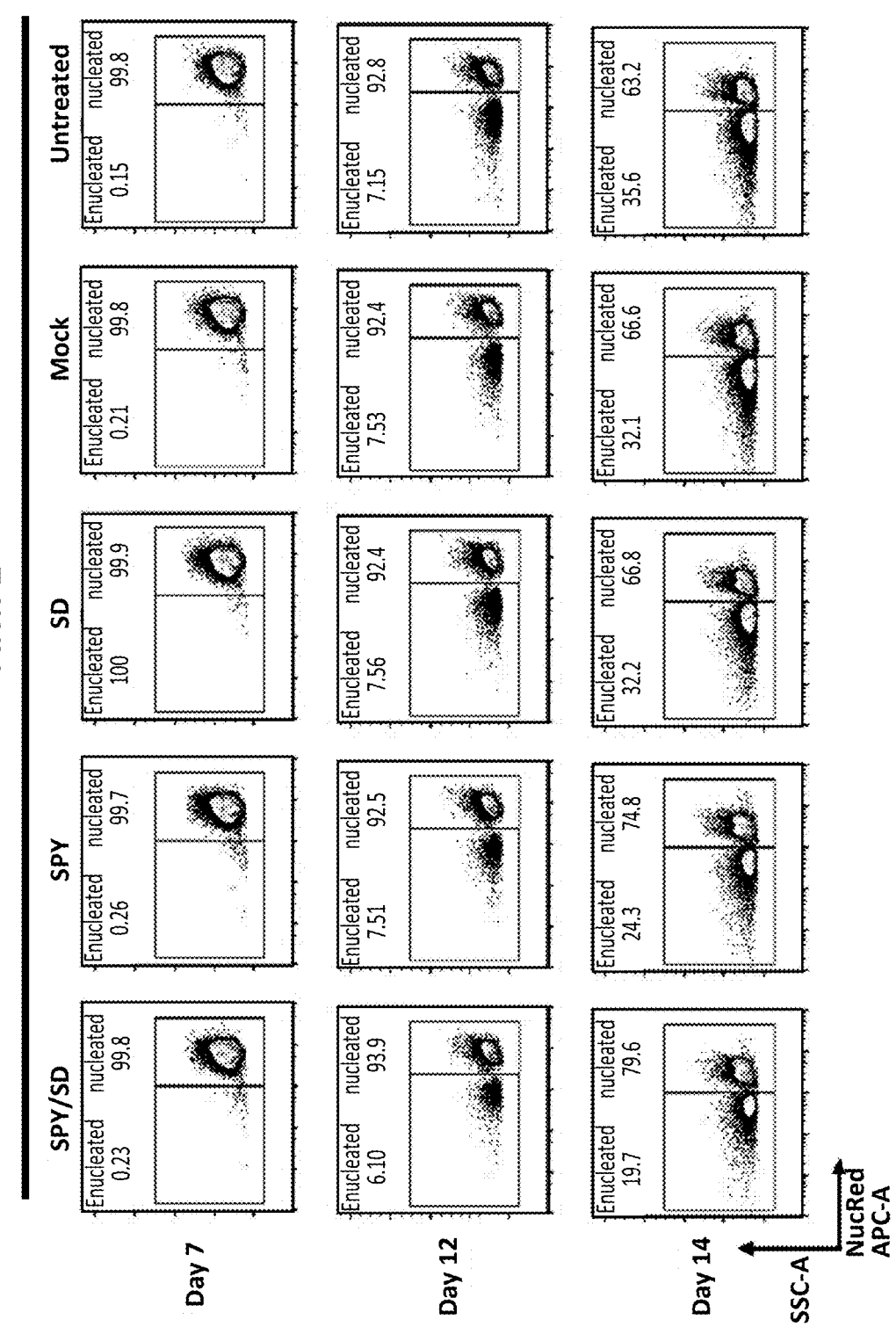
FIG. 29 shows the enucleation of human mPB CD34+ cells successively electroporated with dual guide RNAs under Arm conditions 1-3 compared to human mPB CD34+ cells electroporated with a single guide RNA under Arm conditions 1-3.
Figure 29:
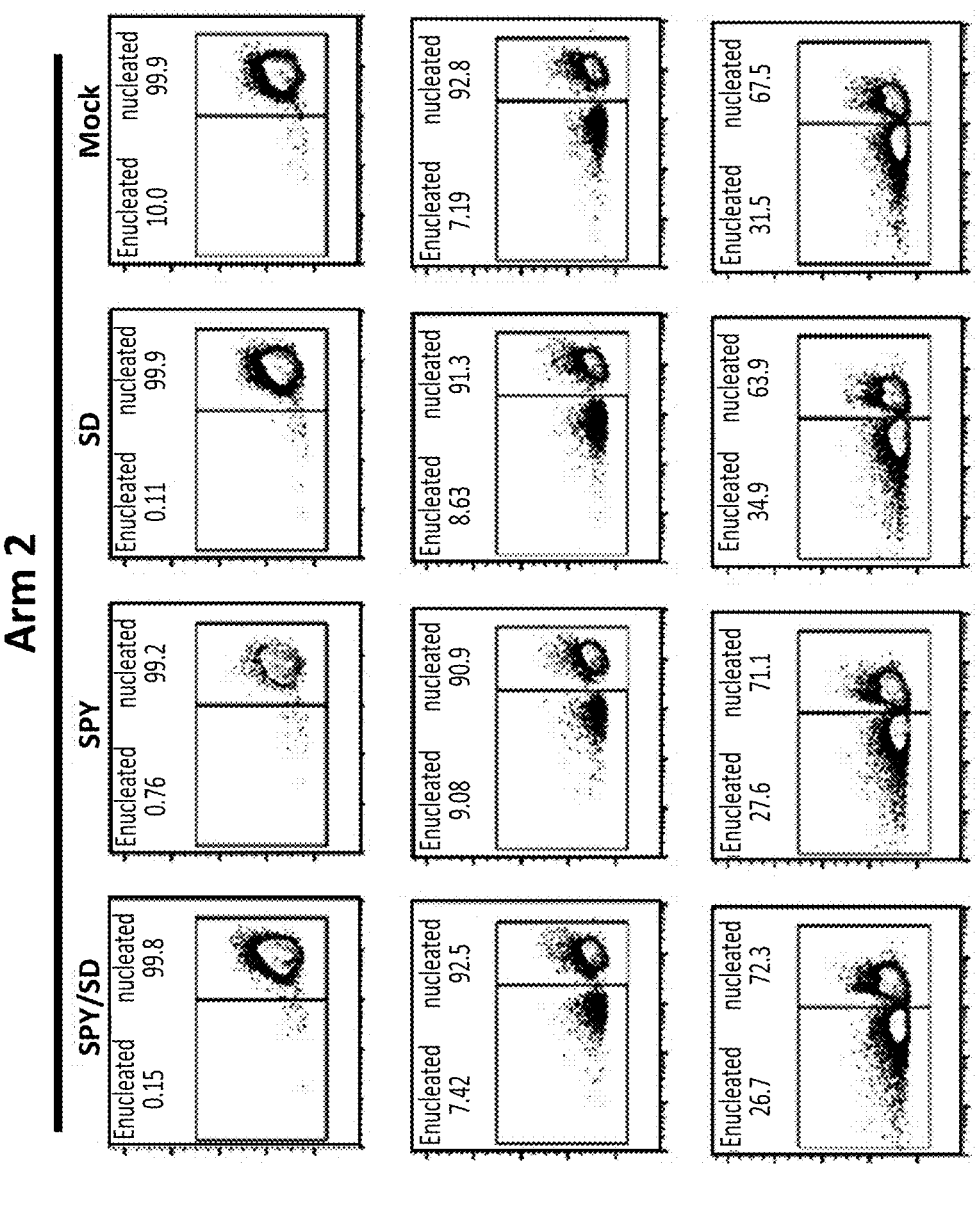
Figure 29:
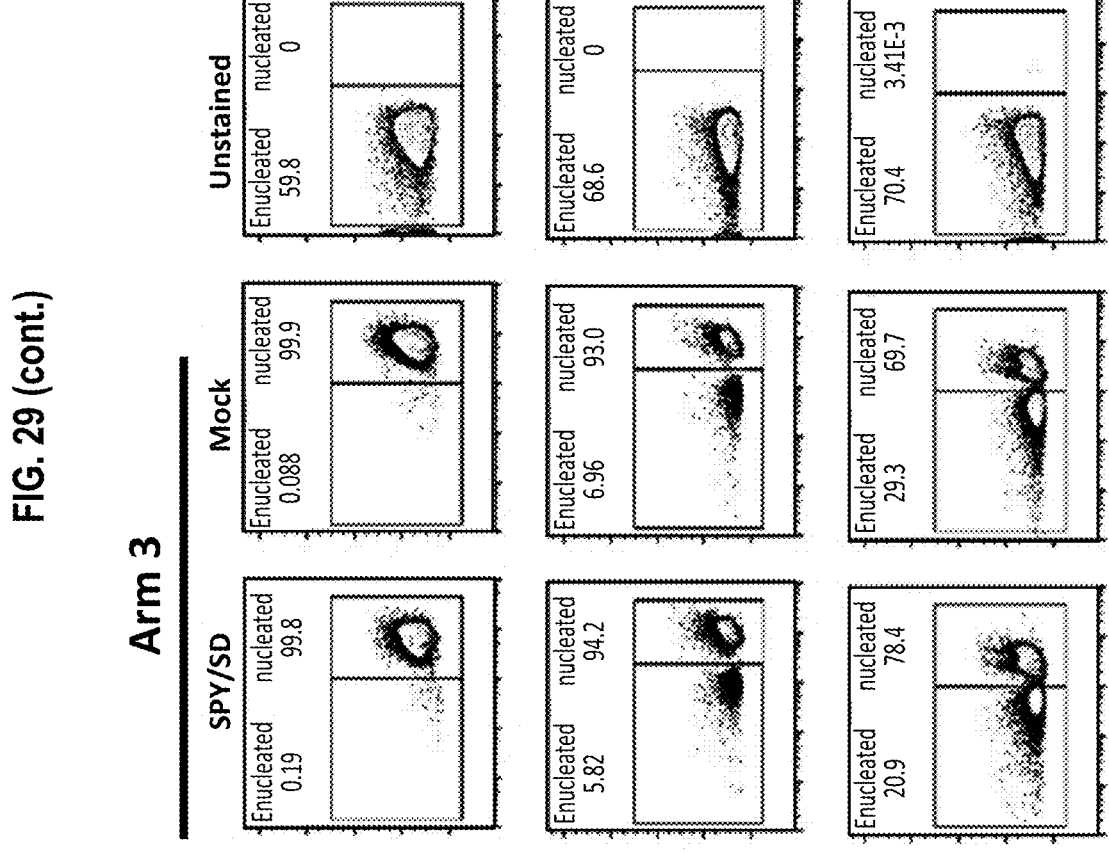

Differentiation of mPBs to erythrocytes for each of the electroporated mPBs described herein under Arm conditions 1-3 was also accessed by measuring the level of enucleation for each of the electroporated mPBs at various time points (Day 7, Day 12, and Day 14). As demonstrated in FIG. 29, there were no differences in differentiation between mPB CD34+ cells from Donor LKP06B successively electroporated with SPY101 and then SD2 under Arm conditions 1-3 and mPB CD34+ cells from Donor LKP06B electroporated with a single guide RNA (an electroporation using SPY101 or SD2) under Arm conditions 1-3.

Figure 30:
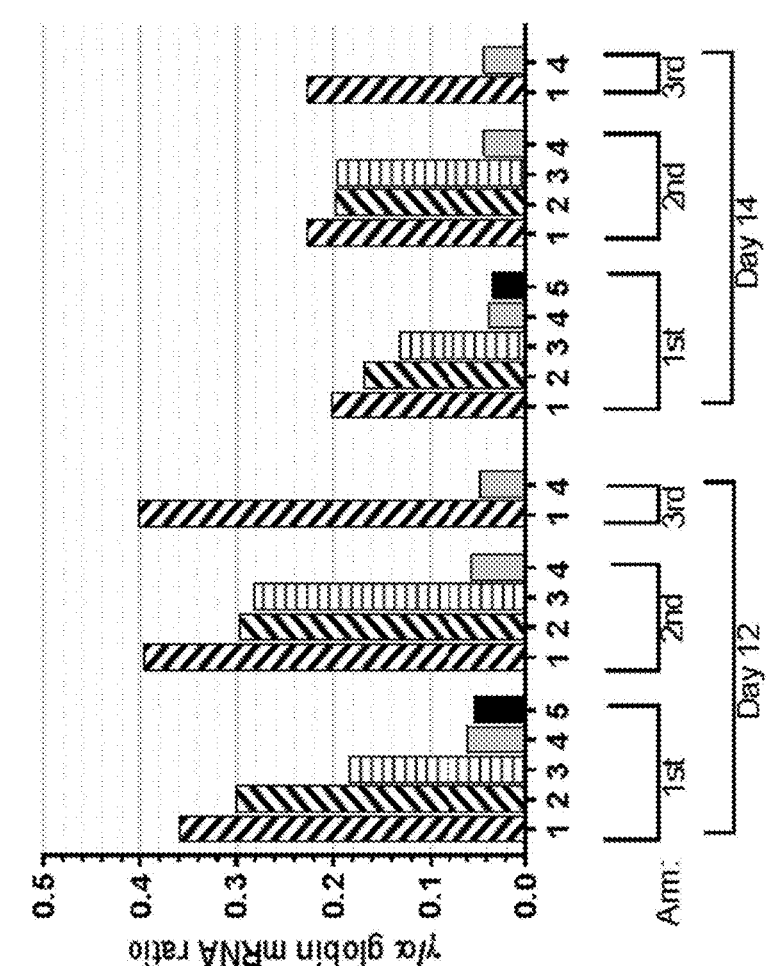
FIG. 30 shows the γ/α globin mRNA ratio in human mPB CD34+ cells from Donor LKP06B successively electroporated with dual guide RNAs under Arm conditions 1-3 compared to human mPB CD34+ cells from Donor LKP06B electroporated with a single guide RNA under Arm conditions 1-3.

Globin expression (γ/α globin mRNA) was measured using qRT-PCR for each of the electroporated mPBs described herein that differentiated into erythrocytes (Day 12 differentiated cells). Each of the electroporated mPBs was electroporated under Arm conditions 1-3. As demonstrated in FIG. 30, the timing between the thaw and first electroporation and timing between the first and second electroporations does not impact the γ/α globin mRNA percent increase between mPB CD34+ cells successively electroporated with SPY101 and then SD2 and mPB CD34+ cells electroporated with a single guide RNA (a single guide electroporation using SPY101 or SD2).

Globin expression (γ/(γ+β) globin mRNA) was measured using qRT-PCR for each of the electroporated mPBs described herein that differentiated into erythrocytes (Day 12 differentiated cells). Each of the electroporated mPBs was electroporated under Arm conditions 1-3. As demonstrated in FIG. 31, the timing between the thaw and first electroporation and timing between the first and second electroporations does not impact the γ/(γ+β) globin mRNA percent increase between mPB CD34+ cells successively electroporated with SPY101 and then SD2 and mPB CD34+ cells electroporated with a single guide RNA (a single guide electroporation using SPY101 or SD2).

Globin expression (γ/18S globin mRNA) was measured using qRT-PCR for each of the electroporated mPBs described herein that differentiated into erythrocytes (Day 12 differentiated cells). Each of the electroporated mPBs was electroporated under Arm conditions 1-3. As demonstrated in FIG. 32, the timing between the thaw and first electroporation and timing between the first and second electroporations does not impact the γ/18S globin mRNA percent increase between mPB CD34+ cells successively electroporated with SPY101 and then SD2 and mPB CD34+ cells electroporated with a single guide RNA (a single guide electroporation using SPY101 or SD2).

Example 36—Successive Electroporations Using Dual Guide RNAs (SPY101 and SD2) in a NSG Mouse Model System Human CD34+ cells that had been edited with Cas9/gRNAs using successive electroporation were introduced into NSG mice (immunodeficient mice) in order to evaluate on-target gene editing, translocations, and human chimerism in mouse blood and bone marrow samples.

Two different experimental designs, as shown in FIGS. 33A-33B, were utilized. The first design involved a first electroporation 36 hours after thawing CD34+ cells followed by a second electroporation 72 hours after thawing (36 hours between electroporations). The second design involved a first electroporation 48 hours after thawing CD34+ cells followed by a second electroporation 96 hours after thawing (48 hours between electroporations). In both experimental designs, cells were intravenously dosed into NSG mice 96 hours after thawing of cells and following successive electroporation. The gRNAs (or mock doses) used during the first and second electroporations are provided in FIG. 33B.

Samples of peripheral blood were taken from all mice at weeks 8 and 12; mice were sacrificed at week 16. Peripheral blood samples were subsequently tested for human chimerism, as shown in FIG. 34. Mice transplanted with cells edited using a successive electroporation method (e.g., 48/48/6 group with guides, e.g., first electroporation at hour 48, second electroporation at hour 96, transplantation at hour 102) show a reduction in % chimerism relative to the Mock EP group.

Bone marrow was extracted from the mice after death at week 16 and similarly tested for human chimerism, as shown in FIG. 35. Mice transplanted with cells edited using a successive electroporation method (e.g., 48/48/6 group with guides, e.g., first electroporation at hour 48, second electroporation at hour 96, transplantation at hour 102) show a reduction in % chimerism relative to the Mock EP group. Genomic DNA of bone marrow samples were also tested for percent indels resulting from the gene editing prior to cellular administration. As shown in FIG. 36, mice in the 48/48/6 group with guides, e.g., first electroporation at hour 48, second electroporation at hour 96, showed high % indels. These data demonstrate that successive electroporation strategies provide surprisingly effective persistence of genetic editing, e.g., in bone marrow tissues.

Example 37—Successive Electroporations Using Dual Guide RNAs in Human mPB CD34+ Cells from Donor LP06a and Donor LKP12

Human mPB CD34+ cells from Donor LP06a and Donor LKP12 were successively electroporated with Cas9 endonuclease and two gRNAs to edit the human beta globin locus on chromosome 11 (HPFH5 gRNAs, e.g., HPFH5-1, HPFH5-D, HPFH5-T5, and HPFH5-T7; Kenya gRNAs, e.g., Kenya-K5, Kenya-K17) and a BCL11A locus on chromosome 2 (1450 gRNA, SPY101 gRNA).

As shown in FIG. 37, cells were subjected to a first electroporation with gRNA(s) and Cas9 3.5 days before a first genomic DNA (gDNA) harvest and a second electroporation (in selected reaction conditions) with gRNAs and Cas9 2 days before the first genomic DNA harvest. gDNA was harvested on Day 0 and Day 3. Beginning at Day 7, cells were allowed to differentiate and enucleate.

Reaction conditions included successive electroporation experiments as well as single electroporation experiments.

As shown in FIG. 38, each reaction condition was assayed for average fold growth during the differentiation stage, editing at Chr2, editing (deletion) at Chr11, and percent HbF relative to (HbF+HbA). Reaction conditions with two successive electroporations with two gRNAs provided editing at Chr2 and Chr11 at comparable levels to corresponding single electroporation reaction conditions. Notably, reaction conditions with two successive electroporations with two gRNAs provided increased HbF expression (see, e.g., 64±2% HbF for 'SPY Then HPFH5-1&D' reaction condition) relative to single electroporation conditions (see, e.g., 38±7% HbF for 'SPY Alone').

As shown in FIG. 39, a ddPCR assay was performed on Days 4 and 14 of the experiment to test for deletion rates (%) in Chr11. Most reaction conditions provided similar levels of deletion, with deletion % between about 30-40%. However, notably, successive electroporation to introduce two different gRNA sets that targeted Chr11 (see, 'HPFH5-T7&D Then HPFH5-1&T5') provided deletion % of about 60% at Day 4 and about 55% at Day 14.

Cells of the experiment were subjected to an enucleation gating strategy using FACS (FIG. 40). Reaction conditions using successive electroporation with two gRNAs had levels and rates of enucleation that were comparable with single electroporation reaction conditions (FIG. 41).

At Day 18 of the experiment, after differentiation was complete, cells were again tested for percent HbF relative to (HbF+HbA). As shown in FIG. 42, reaction conditions using successive electroporation with two gRNAs had higher relative levels of HbF. Note that percent HbF was determined using HPLC. Protein globin levels may routinely be measured using HPLC.

Example 38—Successive Electroporations Using Varying Amounts of Cas9 Endonuclease Human mPB CD34+ cells from Donor LP06a and Donor LKP12 were successively electroporated with two gRNAs and varying levels of Cas9 endonuclease to edit the human beta globin locus on chromosome 11 and a BCL11A locus on chromosome 2.

As shown in FIG. 43, cells were subjected to a first electroporation with 1450 gRNA and varying amounts of Cas9 endonuclease 3.5 days before a first genomic DNA (gDNA) harvest and a second electroporation with HPFH5 gRNAs and varying amounts of Cas9 endonuclease 2 days before the first genomic DNA harvest. gDNA was harvested on Day 0 and Day 3. Beginning at Day 7, cells were allowed to differentiate and enucleate.

As shown in FIGS. 44-46, each reaction condition was assayed for editing at Chr2, editing (deletion) at Chr11, mRNA transcript ratios for (γ globin)/(α globin), mRNA transcript ratios for (γ globin)/(γ globin+β globin), and percent HbF relative to (HbF+HbA). Notably, levels of gene editing and percent HbF were consistent for experiments using 0.375, 0.75, 1.5, and 3 µg Cas9 endonuclease, particularly in the first electroporation step. These data suggest that relatively small amounts of endonuclease can provide useful and efficient gene editing in a successive electroporation context.

Example 38—Comparison of Differing Electroporation Strategies in Human mPB CD34+ Cells on Gene Editing and Translocations An experimental design, as shown in FIG. 47, to compare single electroporation with one guide RNA, single electroporation with two guide RNAs, and successive electroporations with two guide RNAs to edit a BCL11A locus on Chr2 (SPY101 gRNA) and a human beta globin locus on Chr11 (SD2 gRNA) in human mPB CD34+ cells from Fred Hutch Donor 304 was performed.

Cells were subjected to a first electroporation with gRNA (s) and Cas9 4 days before a second genomic DNA (gDNA) harvest and a second electroporation (in selected reaction conditions) with gRNA(s) and Cas9 2 days before the second genomic DNA harvest. gDNA was harvested on Day−2 and Day 0. Beginning at Day 5, cells were allowed to differentiate.

Reaction conditions included single electroporation experiments with one guide RNA (SPY101 or SD2) and Cas9, single electroporation experiments with both SPY101 and SD2 (i.e., simultaneous electroporation), and successive electroporations with both SPY101 and SD2.

Genomic DNA was tested for % indels, as shown in FIG. 48. Cells that were successively electroporated with two guide RNAs (SPY101/SD2; SD2/SPY101) had comparable levels of percent indels relative to single electroporation experiments with one or two gRNAs.

There are three potential translocation events when using these two gRNAs (SPY101 and SD2), as shown in FIG. 49. The three points of fusion (translocation event) occur at the sites cut by Cas9 when directed by the aforementioned gRNAs. The third of these fusions occurs as a result of an inversion of Chr11 induced by SD2.

In order to assess relative amounts of translocations across reaction conditions of this experimental design, genomic DNA was amplified using PCR. PCR primers specific for each of the three possible translocations were used to amplify each gDNA sample from edited cells. Notably, as shown in agarose gels of FIG. 50, it was found that successive electroporation conditions (e.g., SPY101 Then SD2) produced fewer translocation events than simultaneous electroporation conditions (e.g., SPY101 And SD2). These data suggest that successive electroporation produce fewer undesirable and/or off-target gene edits than simultaneous electroporation.

Example 39—Comparison of Differing Electroporation Strategies in Human mPB CD34+ Cells on Gene Editing and Translocations An experimental design, as shown in FIG. 51, to compare single electroporation with one guide RNA, single electroporation with two guide RNAs, and successive electroporations with two guide RNAs to edit a BCL11A locus on Chr2 (SPY101 gRNA) and a human beta globin locus on Chr11 (SD2 gRNA) in human mPB CD34+ cells from Fred Hutch Donor 304 was performed. This experimental design further tested the effect of altering the time between the first and second electroporations in successive electroporation conditions.

Cells were subjected to a first electroporation with gRNA/Cas9 on either Day 3 or Day 3.5 after thawing cells. In successive electroporation reaction conditions, a second electroporation with gRNA/Cas9 was performed on Day 5. Genomic DNA (gDNA) was harvested from Days 6-10.

Reaction conditions included single electroporation experiments with one guide RNA (SPY101 or SD2) and Cas9, single electroporation experiments with both SPY101 and SD2 (i.e., simultaneous electroporation), and successive electroporations with both SPY101 and SD2.

Genomic DNA was tested for % indels, as shown in FIG. 52. Cells that were successively electroporated with a 48-hour period between electroporations had slightly higher levels of percent indels relative to cells that were successively electroporated with a 36-hour period between electroporations. Cells edited with simultaneous electroporation strategies had significantly lower percent indels than all successive electroporation conditions.

As described in Example 38 and shown in FIG. 49, there are three potential translocation events when using these two gRNAs (SPY101 and SD2). In order to assess relative amounts of translocations across reaction conditions of this experimental design, genomic DNA was amplified using PCR. PCR primers specific for each of the three possible translocations were used to amplify each gDNA sample from edited cells. Notably, as shown in agarose gels of FIGS. 53A-53C, it was found that successive electroporation conditions (e.g., SPY101 Then SD2) produced fewer translocation events than simultaneous electroporation conditions (e.g., SPY101 And SD2). Further, successive electroporation conditions with a 48-hour period between electroporations had fewer translocation events than conditions with a 36-hour period.

A ddPCR assay for secondary determination of chromosomal translocations following gene editing with SD2 and SPY101 gRNAs was then designed, as shown in FIG. 54. The 'A:E' translocation event is assayed by the use of one primer that binds the 'A' region; and a second primer that binds the 'E' region (amplicon size of around 600 bp). The 'D:C' translocation event is assayed by the use of one primer that binds 'D' region; and a second primer that binds the 'C' region (amplicon size of around 2000 bp). The 'A:D' translocation event is assayed by the use of one primer that binds 'A' region; and a second primer that binds the 'D' region (amplicon size of around 600 bp). The 'C:E' translocation event is assayed by the use of one primer that binds 'C' region; and a second primer that binds the 'E' region (amplicon size of around 2000 bp).

This ddPCR assay provided secondary confirmation, as shown in FIG. 55, that simultaneous electroporation with two gRNAs (SPY101 And SD2) leads to increased translocation events compared to successive electroporation with two gRNAs (e.g., SPY101 Then SD2). Further, this assay provides secondary confirmation that successive electroporation conditions with a 48-hour period between electroporations had fewer translocation events than conditions with a 36-hour period.

Note Regarding Illustrative Examples

While the present disclosure provides descriptions of various specific aspects for the purpose of illustrating various aspects of the present invention and/or its potential applications, it is understood that variations and modifications will occur to those skilled in the art. Accordingly, the invention or inventions described herein should be understood to be at least as broad as they are claimed, and not as more narrowly defined by particular illustrative aspects provided herein.

Any patent, publication, or other disclosure material identified herein is incorporated by reference into this specification in its entirety unless otherwise indicated, but only to the extent that the incorporated material does not conflict with existing descriptions, definitions, statements, or other disclosure material expressly set forth in this specification. As such, and to the extent necessary, the express disclosure as set forth in this specification supersedes any conflicting material incorporated by reference. Any material, or portion thereof, that is said to be incorporated by reference into this specification, but which conflicts with existing definitions, statements, or other disclosure material set forth herein, is only incorporated to the extent that no conflict arises between that incorporated material and the existing disclosure material. Applicants reserve the right to amend this specification to expressly recite any subject matter, or portion thereof, incorporated by reference herein.

---

SEQUENCE LISTING (228436 sequences)

SEQ ID NO: 1 - DNA, 20 bp, Artificial Sequence
  Synthetic oligonucleotide; GAG chr11 5150055 5150074 5150071 +
aaaaaaatgatctatgacct

SEQ ID NO: 2 - DNA, 20 bp, Artificial Sequence
  Synthetic oligonucleotide; AGG chr11 5150056 5150075 5150072 +
aaaaaatgatctatgacctg

SEQ ID NO: 3 - DNA, 20 bp, Artificial Sequence
  Synthetic oligonucleotide; AAG chr11 5150065 5150084 5150081 +
tctatgacctgaggtttttc

SEQ ID NO: 4 - DNA, 20 bp, Artificial Sequence
  Synthetic oligonucleotide; TAG chr11 5150078 5150097 5150094 +
gtttttcaagaacaattgac

SEQ ID NO: 5 - DNA, 20 bp, Artificial Sequence
  Synthetic oligonucleotide; TAG chr11 5150106 5150125 5150122 +
aattcttatgccactaattt

SEQ ID NO: 6 - DNA, 20 bp, Artificial Sequence
  Synthetic oligonucleotide; TAG chr11 5150115 5150134 5150131 +
gccactaattttagacaata

SEQ ID NO: 7 - DNA, 20 bp, Artificial Sequence
  Synthetic oligonucleotide; TAG chr11 5150139 5150158 5150155 +
cctcctcttcactaacacaa

SEQ ID NO: 8 - DNA, 20 bp, Artificial Sequence
  Synthetic oligonucleotide; TAG chr11 5150145 5150164 5150161 +
cttcactaacacaatagccc

SEQ ID NO: 9 - DNA, 20 bp, Artificial Sequence
  Synthetic oligonucleotide; TGG chr11 5150168 5150187 5150184 +
acttatttatatttgctgtg

SEQ ID NO: 10 - DNA, 20 bp, Artificial Sequence
  Synthetic oligonucleotide; AAG chr11 5150188 5150207 5150204 +
tggtatgctgccacatgccc

SEQ ID NO: 11 - DNA, 20 bp, Artificial Sequence
  Synthetic oligonucleotide; CAG chr11 5150191 5150210 5150207 +
tatgctgccacatgcccaag

SEQ ID NO: 12 - DNA, 20 bp, Artificial Sequence
  Synthetic oligonucleotide; TAG chr11 5150240 5150259 5150256 +
acacacacacgtcttacttg

SEQ ID NO: 13 - DNA, 20 bp, Artificial Sequence
  Synthetic oligonucleotide; AAG chr11 5150248 5150267 5150264 +
acgtcttacttgtagaacac

SEQ ID NO: 14 - DNA, 20 bp, Artificial Sequence
  Synthetic oligonucleotide; TGG chr11 5150273 5150292 5150289 +
aacaaatgaatactctccaa

SEQ ID NO: 15 - DNA, 20 bp, Artificial Sequence
  Synthetic oligonucleotide; TAG chr11 5150283 5150302 5150299 +
tactctccaatggcacatta

SEQ ID NO: 16 - DNA, 20 bp, Artificial Sequence
  Synthetic oligonucleotide; TGG chr11 5150290 5150309 5150306 +
caatggcacattatagcttt

SEQ ID NO: 17 - DNA, 20 bp, Artificial Sequence
  Synthetic oligonucleotide; AAG chr11 5150297 5150316 5150313 +
acattatagcttttggaata

SEQ ID NO: 18 - DNA, 20 bp, Artificial Sequence
  Synthetic oligonucleotide; CAG chr11 5150302 5150321 5150318 +
atagcttttggaataaagtc

SEQ ID NO: 19 - DNA, 20 bp, Artificial Sequence
  Synthetic oligonucleotide; TAG chr11 5150324 5150343 5150340 +
gcaactctgcacaacattaa

SEQ ID NO: 20 - DNA, 20 bp, Artificial Sequence
  Synthetic oligonucleotide; AAG chr11 5150361 5150380 5150377 +
catattttccttgtctcccc

SEQ ID NO: 21 - DNA, 20 bp, Artificial Sequence
  Synthetic oligonucleotide; TAG chr11 5150397 5150416 5150413 +
tcataccatattgaaaaaac

SEQ ID NO: 22 - DNA, 20 bp, Artificial Sequence
  Synthetic oligonucleotide; GAG chr11 5150399 5150418 5150415 +
ataccatattgaaaaaacta

SEQ ID NO: 23 - DNA, 20 bp, Artificial Sequence
  Synthetic oligonucleotide; TAG chr11 5150422 5150441 5150438 +
ttaccttaaactacattatc

SEQ ID NO: 24 - DNA, 20 bp, Artificial Sequence
  Synthetic oligonucleotide; TGG chr11 5150449 5150468 5150465 +
aatctcctctactatctacc

SEQ ID NO: 25 - DNA, 20 bp, Artificial Sequence
  Synthetic oligonucleotide; TGG chr11 5150473 5150492 5150489 +
atgatgtgttcttacttcct

SEQ ID NO: 26 - DNA, 20 bp, Artificial Sequence
  Synthetic oligonucleotide; AAG chr11 5150496 5150515 5150512 +
ctactcatccatcattcctc

SEQ ID NO: 27 - DNA, 20 bp, Artificial Sequence
  Synthetic oligonucleotide; CAG chr11 5150502 5150521 5150518 +
atccatcattcctcaagaat

SEQ ID NO: 28 - DNA, 20 bp, Artificial Sequence
  Synthetic oligonucleotide; GAG chr11 5150504 5150523 5150520 +
ccatcattcctcaagaatca

SEQ ID NO: 29 - DNA, 20 bp, Artificial Sequence
  Synthetic oligonucleotide; AGG chr11 5150505 5150524 5150521 +
catcattcctcaagaatcag

SEQ ID NO: 30 - DNA, 20 bp, Artificial Sequence
  Synthetic oligonucleotide; TGG chr11 5150557 5150576 5150573 +
taaatgcaactcccctgctt

SEQ ID NO: 31 - DNA, 20 bp, Artificial Sequence
  Synthetic oligonucleotide; TAG chr11 5150561 5150580 5150577 +
tgcaactcccctgctttggt

SEQ ID NO: 32 - DNA, 20 bp, Artificial Sequence
  Synthetic oligonucleotide; CAG chr11 5150664 5150683 5150680 +
ttccccacctctcttccttt

SEQ ID NO: 33 - DNA, 20 bp, Artificial Sequence
  Synthetic oligonucleotide; CAG chr11 5150678 5150697 5150694 +
tcctttcagtctctcttttc

SEQ ID NO: 34 - DNA, 20 bp, Artificial Sequence
  Synthetic oligonucleotide; TAG chr11 5150688 5150707 5150704 +
ctctcttttccagaattaca

SEQ ID NO: 35 - DNA, 20 bp, Artificial Sequence
  Synthetic oligonucleotide; AGG chr11 5150689 5150708 5150705 +
tctcttttccagaattacat

SEQ ID NO: 36 - DNA, 20 bp, Artificial Sequence
  Synthetic oligonucleotide; GAG chr11 5150703 5150722 5150719 +
ttacataggtacaaactcat

SEQ ID NO: 37 - DNA, 20 bp, Artificial Sequence
  Synthetic oligonucleotide; CAG chr11 5150721 5150740 5150737 +
atgagaattattcactgtgc

SEQ ID NO: 38 - DNA, 20 bp, Artificial Sequence
  Synthetic oligonucleotide; TAG chr11 5150748 5150767 5150764 +
actattatgtcacgattctg

SEQ ID NO: 39 - DNA, 20 bp, Artificial Sequence
  Synthetic oligonucleotide; TAG chr11 5150753 5150772 5150769 +
tatgtcacgattctgtagta

SEQ ID NO: 40 - DNA, 20 bp, Artificial Sequence
  Synthetic oligonucleotide; CAG chr11 5150770 5150789 5150786 +
gtatagtatttttaatattg

SEQ ID NO: 41 - DNA, 20 bp, Artificial Sequence
  Synthetic oligonucleotide; AGG chr11 5150771 5150790 5150787 +
tatagtatttttaatattgc

SEQ ID NO: 42 - DNA, 20 bp, Artificial Sequence
  Synthetic oligonucleotide; AAG chr11 5150799 5150818 5150815 +
gataaaatgatgaattaata

SEQ ID NO: 43 - DNA, 20 bp, Artificial Sequence
  Synthetic oligonucleotide; AAG chr11 5150802 5150821 5150818 +
aaaatgatgaattaataaag

SEQ ID NO: 44 - DNA, 20 bp, Artificial Sequence
  Synthetic oligonucleotide; GAG chr11 5150813 5150832 5150829 +
ttaataaagaagtaaatttt

SEQ ID NO: 45 - DNA, 20 bp, Artificial Sequence
  Synthetic oligonucleotide; AGG chr11 5150814 5150833 5150830 +
taataaagaagtaaattttg

SEQ ID NO: 46 - DNA, 20 bp, Artificial Sequence
  Synthetic oligonucleotide; TAG chr11 5150818 5150837 5150834 +
aaagaagtaaattttgaggt

SEQ ID NO: 47 - DNA, 20 bp, Artificial Sequence
  Synthetic oligonucleotide; TGG chr11 5150863 5150882 5150879 +
gatgtgtcaaatgcaacacc

SEQ ID NO: 48 - DNA, 20 bp, Artificial Sequence
  Synthetic oligonucleotide; TAG chr11 5150922 5150941 5150938 +
tgaaaatgtatttaaatttt

SEQ ID NO: 49 - DNA, 20 bp, Artificial Sequence
  Synthetic oligonucleotide; AGG chr11 5150923 5150942 5150939 +
gaaaatgtatttaaattttt

SEQ ID NO: 50 - DNA, 20 bp, Artificial Sequence
  Synthetic oligonucleotide; AAG chr11 5150949 5150968 5150965 +
tattgtctcttgatattcat

SEQ ID NO: 51 - DNA, 20 bp, Artificial Sequence
  Synthetic oligonucleotide; AAG chr11 5150964 5150983 5150980 +
ttcataagattttctttgac

SEQ ID NO: 52 - DNA, 20 bp, Artificial Sequence
  Synthetic oligonucleotide; CAG chr11 5150971 5150990 5150987 +
gattttctttgacaagaaca

SEQ ID NO: 53 - DNA, 20 bp, Artificial Sequence
  Synthetic oligonucleotide; AAG chr11 5151005 5151024 5151021 +
ttcctttgattttttttttt

SEQ ID NO: 54 - DNA, 20 bp, Artificial Sequence
  Synthetic oligonucleotide; AGG chr11 5151006 5151025 5151022 +
tcctttgattttttttttta

SEQ ID NO: 55 - DNA, 20 bp, Artificial Sequence
  Synthetic oligonucleotide; CAG chr11 5151009 5151028 5151025 +
tttgatttttttttttaagg

SEQ ID NO: 56 - DNA, 20 bp, Artificial Sequence
  Synthetic oligonucleotide; AGG chr11 5151010 5151029 5151026 +
ttgatttttttttttaaggc

SEQ ID NO: 57 - DNA, 20 bp, Artificial Sequence
  Synthetic oligonucleotide; GGG chr11 5151011 5151030 5151027 +
tgatttttttttttaaggca

SEQ ID NO: 58 - DNA, 20 bp, Artificial Sequence
  Synthetic oligonucleotide; AAG chr11 5151020 5151039 5151036 +
tttttaaggcagggatgatc

SEQ ID NO: 59 - DNA, 20 bp, Artificial Sequence
  Synthetic oligonucleotide; GAG chr11 5151028 5151047 5151044 +
gcagggatgatcaagaaaat

SEQ ID NO: 60 - DNA, 20 bp, Artificial Sequence
  Synthetic oligonucleotide; GAG chr11 5151030 5151049 5151046 +
agggatgatcaagaaaatga

SEQ ID NO: 61 - DNA, 20 bp, Artificial Sequence
  Synthetic oligonucleotide; GAG chr11 5151052 5151071 5151068 +
gtcaacaacttgttttcatt

SEQ ID NO: 62 - DNA, 20 bp, Artificial Sequence
  Synthetic oligonucleotide; TGG chr11 5151059 5151078 5151075 +
acttgttttcattgagtccc

SEQ ID NO: 63 - DNA, 20 bp, Artificial Sequence
  Synthetic oligonucleotide; CAG chr11 5151068 5151087 5151084 +
cattgagtccctggatgttt

SEQ ID NO: 64 - DNA, 20 bp, Artificial Sequence
  Synthetic oligonucleotide; GAG chr11 5151077 5151096 5151093 +
cctggatgtttcagaacaac

SEQ ID NO: 65 - DNA, 20 bp, Artificial Sequence
  Synthetic oligonucleotide; TAG chr11 5151083 5151102 5151099 +
tgtttcagaacaacgagcct

SEQ ID NO: 66 - DNA, 20 bp, Artificial Sequence
  Synthetic oligonucleotide; AGG chr11 5151084 5151103 5151100 +
gtttcagaacaacgagcctt

SEQ ID NO: 67 - DNA, 20 bp, Artificial Sequence
  Synthetic oligonucleotide; CAG chr11 5151099 5151118 5151115 +
gccttaggtgcatttaaatt

SEQ ID NO: 68 - DNA, 20 bp, Artificial Sequence
  Synthetic oligonucleotide; AAG chr11 5151107 5151126 5151123 +
tgcatttaaattcagtgaca

SEQ ID NO: 69 - DNA, 20 bp, Artificial Sequence
  Synthetic oligonucleotide; AGG chr11 5151108 5151127 5151124 +
gcatttaaattcagtgacaa

SEQ ID NO: 70 - DNA, 20 bp, Artificial Sequence
  Synthetic oligonucleotide; TGG chr11 5151130 5151149 5151146 +
gcataatttataaatcctcc

SEQ ID NO: 71 - DNA, 20 bp, Artificial Sequence
  Synthetic oligonucleotide; GAG chr11 5151132 5151151 5151148 +
ataatttataaatcctcctg

SEQ ID NO: 72 - DNA, 20 bp, Artificial Sequence
  Synthetic oligonucleotide; TAG chr11 5151144 5151163 5151160 +
tcctcctggagaaatattct

SEQ ID NO: 73 - DNA, 20 bp, Artificial Sequence
  Synthetic oligonucleotide; AAG chr11 5151147 5151166 5151163 +
tcctggagaaatattcttag

SEQ ID NO: 74 - DNA, 20 bp, Artificial Sequence
  Synthetic oligonucleotide; CAG chr11 5151161 5151180 5151177 +
tcttagaagaataactcaac

SEQ ID NO: 75 - DNA, 20 bp, Artificial Sequence
  Synthetic oligonucleotide; AGG chr11 5151162 5151181 5151178 +
cttagaagaataactcaacc

SEQ ID NO: 76 - DNA, 20 bp, Artificial Sequence
  Synthetic oligonucleotide; GGG chr11 5151163 5151182 5151179 +
ttagaagaataactcaacca

SEQ ID NO: 77 - DNA, 20 bp, Artificial Sequence
  Synthetic oligonucleotide; GGG chr11 5151164 5151183 5151180 +
tagaagaataactcaaccag

SEQ ID NO: 78 - DNA, 20 bp, Artificial Sequence
  Synthetic oligonucleotide; AAG chr11 5151170 5151189 5151186 +
aataactcaaccaggggcta

SEQ ID NO: 79 - DNA, 20 bp, Artificial Sequence
  Synthetic oligonucleotide; AAG chr11 5151178 5151197 5151194 +
aaccaggggctaaagaataa

SEQ ID NO: 80 - DNA, 20 bp, Artificial Sequence
  Synthetic oligonucleotide; GAG chr11 5151180 5151199 5151196 +
ccaggggctaaagaataaaa

SEQ ID NO: 81 - DNA, 20 bp, Artificial Sequence
  Synthetic oligonucleotide; TAG chr11 5151235 5151254 5151251 +
ttcacacttctcactttcat

SEQ ID NO: 82 - DNA, 20 bp, Artificial Sequence
  Synthetic oligonucleotide; TAG chr11 5151243 5151262 5151259 +
tctcactttcattagtcacg

SEQ ID NO: 83 - DNA, 20 bp, Artificial Sequence
  Synthetic oligonucleotide; GAG chr11 5151271 5151290 5151287 +
acaatcccactgattgatat

SEQ ID NO: 84 - DNA, 20 bp, Artificial Sequence
  Synthetic oligonucleotide; CAG chr11 5151291 5151310 5151307 +
gagccatgatgatctaaaac

SEQ ID NO: 85 - DNA, 20 bp, Artificial Sequence
  Synthetic oligonucleotide; TGG chr11 5151303 5151322 5151319 +
tctaaaaccagctattgtgc

SEQ ID NO: 86 - DNA, 20 bp, Artificial Sequence
  Synthetic oligonucleotide; CAG chr11 5151306 5151325 5151322 +
aaaaccagctattgtgctgg

SEQ ID NO: 87 - DNA, 20 bp, Artificial Sequence
  Synthetic oligonucleotide; CAG chr11 5151321 5151340 5151337 +
gctggcagatttcacaaacc

SEQ ID NO: 88 - DNA, 20 bp, Artificial Sequence
  Synthetic oligonucleotide; TGG chr11 5151360 5151379 5151376 +
ttttttgttttgttttgata

SEQ ID NO: 89 - DNA, 20 bp, Artificial Sequence
  Synthetic oligonucleotide; AAG chr11 5151375 5151394 5151391 +
tgatatggttactactgcaa

SEQ ID NO: 90 - DNA, 20 bp, Artificial Sequence
  Synthetic oligonucleotide; AAG chr11 5151382 5151401 5151398 +
gttactactgcaaaagaaaa

SEQ ID NO: 91 - DNA, 20 bp, Artificial Sequence
  Synthetic oligonucleotide; TAG chr11 5151389 5151408 5151405 +
ctgcaaaagaaaaaagcatg

SEQ ID NO: 92 - DNA, 20 bp, Artificial Sequence
  Synthetic oligonucleotide; AGG chr11 5151390 5151409 5151406 +
tgcaaaagaaaaaagcatgt

SEQ ID NO: 93 - DNA, 20 bp, Artificial Sequence
  Synthetic oligonucleotide; AAG chr11 5151401 5151420 5151417 +
aaagcatgtaggcattaatt

SEQ ID NO: 94 - DNA, 20 bp, Artificial Sequence
  Synthetic oligonucleotide; AGG chr11 5151402 5151421 5151418 +
aagcatgtaggcattaatta

SEQ ID NO: 95 - DNA, 20 bp, Artificial Sequence
  Synthetic oligonucleotide; TGG chr11 5151405 5151424 5151421 +
catgtaggcattaattaagg

SEQ ID NO: 96 - DNA, 20 bp, Artificial Sequence
  Synthetic oligonucleotide; CAG chr11 5151418 5151437 5151434 +
attaaggtggattttatgaa

SEQ ID NO: 97 - DNA, 20 bp, Artificial Sequence
  Synthetic oligonucleotide; TGG chr11 5151452 5151471 5151468 +
cacatgaatgcgaatctgtg

SEQ ID NO: 98 - DNA, 20 bp, Artificial Sequence
  Synthetic oligonucleotide; TAG chr11 5151466 5151485 5151482 +
tctgtgtggtctttgcacca

SEQ ID NO: 99 - DNA, 20 bp, Artificial Sequence
  Synthetic oligonucleotide; AAG chr11 5151471 5151490 5151487 +
gtggtctttgcaccatagac

SEQ ID NO: 100 - DNA, 20 bp, Artificial Sequence
  Synthetic oligonucleotide; TGG chr11 5151474 5151493 5151490 +
gtctttgcaccatagacaag

SEQ ID NO: 101 - DNA, 20 bp, Artificial Sequence
  Synthetic oligonucleotide; GAG chr11 5151480 5151499 5151496 +
gcaccatagacaagtggatt

SEQ ID NO: 102 - DNA, 20 bp, Artificial Sequence
  Synthetic oligonucleotide; TGG chr11 5151486 5151505 5151502 +
tagacaagtggattgagaaa

SEQ ID NO: 103 - DNA, 20 bp, Artificial Sequence
  Synthetic oligonucleotide; GAG chr11 5151488 5151507 5151504 +
gacaagtggattgagaaatg

SEQ ID NO: 104 - DNA, 20 bp, Artificial Sequence
  Synthetic oligonucleotide; AGG chr11 5151489 5151508 5151505 +
acaagtggattgagaaatgg

SEQ ID NO: 105 - DNA, 20 bp, Artificial Sequence
  Synthetic oligonucleotide; GGG chr11 5151490 5151509 5151506 +
caagtggattgagaaatgga

SEQ ID NO: 106 - DNA, 20 bp, Artificial Sequence
  Synthetic oligonucleotide; CAG chr11 5151495 5151514 5151511 +
ggattgagaaatggagggac

SEQ ID NO: 107 - DNA, 20 bp, Artificial Sequence
  Synthetic oligonucleotide; AAG chr11 5151499 5151518 5151515 +
tgagaaatggagggaccagc

SEQ ID NO: 108 - DNA, 20 bp, Artificial Sequence
  Synthetic oligonucleotide; TAG chr11 5151509 5151528 5151525 +
agggaccagcaagtaaatgc

SEQ ID NO: 109 - DNA, 20 bp, Artificial Sequence
  Synthetic oligonucleotide; AAG chr11 5151514 5151533 5151530 +
ccagcaagtaaatgctagaa

SEQ ID NO: 110 - DNA, 20 bp, Artificial Sequence
  Synthetic oligonucleotide; GAG chr11 5151516 5151535 5151532 +
agcaagtaaatgctagaaaa

SEQ ID NO: 111 - DNA, 20 bp, Artificial Sequence
  Synthetic oligonucleotide; TGG chr11 5151523 5151542 5151539 +
aaatgctagaaaagagaata

SEQ ID NO: 112 - DNA, 20 bp, Artificial Sequence
  Synthetic oligonucleotide; AAG chr11 5151530 5151549 5151546 +
agaaaagagaatatggatat

SEQ ID NO: 113 - DNA, 20 bp, Artificial Sequence
  Synthetic oligonucleotide; AGG chr11 5151531 5151550 5151547 +
gaaaagagaatatggatata

SEQ ID NO: 114 - DNA, 20 bp, Artificial Sequence
  Synthetic oligonucleotide; GGG chr11 5151532 5151551 5151548 +
aaaagagaatatggatataa

SEQ ID NO: 115 - DNA, 20 bp, Artificial Sequence
  Synthetic oligonucleotide; GGG chr11 5151533 5151552 5151549 +
aaagagaatatggatataag

SEQ ID NO: 116 - DNA, 20 bp, Artificial Sequence
  Synthetic oligonucleotide; GAG chr11 5151535 5151554 5151551 +
agagaatatggatataaggg

SEQ ID NO: 117 - DNA, 20 bp, Artificial Sequence
  Synthetic oligonucleotide; GAG chr11 5151542 5151561 5151558 +
atggatataaggggagatgt

SEQ ID NO: 118 - DNA, 20 bp, Artificial Sequence
  Synthetic oligonucleotide; AAG chr11 5151562 5151581 5151578 +
gagacccaaacctatgtgtg

SEQ ID NO: 119 - DNA, 20 bp, Artificial Sequence
  Synthetic oligonucleotide; AAG chr11 5151565 5151584 5151581 +
acccaaacctatgtgtgaag

SEQ ID NO: 120 - DNA, 20 bp, Artificial Sequence
  Synthetic oligonucleotide; AGG chr11 5151566 5151585 5151582 +
cccaaacctatgtgtgaaga

SEQ ID NO: 121 - DNA, 20 bp, Artificial Sequence
  Synthetic oligonucleotide; GAG chr11 5151568 5151587 5151584 +
caaacctatgtgtgaagaag

SEQ ID NO: 122 - DNA, 20 bp, Artificial Sequence
  Synthetic oligonucleotide; AAG chr11 5151571 5151590 5151587 +
acctatgtgtgaagaaggag

SEQ ID NO: 123 - DNA, 20 bp, Artificial Sequence
  Synthetic oligonucleotide; AAG chr11 5151574 5151593 5151590 +
tatgtgtgaagaaggagaag

SEQ ID NO: 124 - DNA, 20 bp, Artificial Sequence
  Synthetic oligonucleotide; AGG chr11 5151575 5151594 5151591 +
atgtgtgaagaaggagaaga

SEQ ID NO: 125 - DNA, 20 bp, Artificial Sequence
  Synthetic oligonucleotide; AAG chr11 5151579 5151598 5151595 +
gtgaagaaggagaagaaggc

SEQ ID NO: 126 - DNA, 20 bp, Artificial Sequence
  Synthetic oligonucleotide; AGG chr11 5151580 5151599 5151596 +
tgaagaaggagaagaaggca

SEQ ID NO: 127 - DNA, 20 bp, Artificial Sequence
  Synthetic oligonucleotide; GAG chr11 5151582 5151601 5151598 +
aagaaggagaagaaggcaag

SEQ ID NO: 128 - DNA, 20 bp, Artificial Sequence
  Synthetic oligonucleotide; AGG chr11 5151583 5151602 5151599 +
agaaggagaagaaggcaagg

SEQ ID NO: 129 - DNA, 20 bp, Artificial Sequence
  Synthetic oligonucleotide; TAG chr11 5151586 5151605 5151602 +
aggagaagaaggcaaggagg

SEQ ID NO: 130 - DNA, 20 bp, Artificial Sequence
  Synthetic oligonucleotide; TGG chr11 5151592 5151611 5151608 +
agaaggcaaggaggtagaac

SEQ ID NO: 131 - DNA, 20 bp, Artificial Sequence
  Synthetic oligonucleotide; GAG chr11 5151594 5151613 5151610 +
aaggcaaggaggtagaactg

SEQ ID NO: 132 - DNA, 20 bp, Artificial Sequence
  Synthetic oligonucleotide; AGG chr11 5151595 5151614 5151611 +
aggcaaggaggtagaactgg

SEQ ID NO: 133 - DNA, 20 bp, Artificial Sequence
  Synthetic oligonucleotide; AAG chr11 5151598 5151617 5151614 +
caaggaggtagaactggagg

SEQ ID NO: 134 - DNA, 20 bp, Artificial Sequence
  Synthetic oligonucleotide; CAG chr11 5151604 5151623 5151620 +
ggtagaactggaggaagaca

SEQ ID NO: 135 - DNA, 20 bp, Artificial Sequence
  Synthetic oligonucleotide; GAG chr11 5151611 5151630 5151627 +
ctggaggaagacacagatgt

SEQ ID NO: 136 - DNA, 20 bp, Artificial Sequence
  Synthetic oligonucleotide; CAG chr11 5151619 5151638 5151635 +
agacacagatgtgagcaatg

SEQ ID NO: 137 - DNA, 20 bp, Artificial Sequence
  Synthetic oligonucleotide; AGG chr11 5151620 5151639 5151636 +
gacacagatgtgagcaatgc

SEQ ID NO: 138 - DNA, 20 bp, Artificial Sequence
  Synthetic oligonucleotide; TAG chr11 5151641 5151660 5151657 +
ggtattgaatgctttaaacc

SEQ ID NO: 139 - DNA, 20 bp, Artificial Sequence
  Synthetic oligonucleotide; TGG chr11 5151652 5151671 5151668 +
ctttaaacctagcctccttc

SEQ ID NO: 140 - DNA, 20 bp, Artificial Sequence
  Synthetic oligonucleotide; GGG chr11 5151653 5151672 5151669 +
tttaaacctagcctccttct

SEQ ID NO: 141 - DNA, 20 bp, Artificial Sequence
  Synthetic oligonucleotide; GGG chr11 5151654 5151673 5151670 +
ttaaacctagcctccttctg

SEQ ID NO: 142 - DNA, 20 bp, Artificial Sequence
  Synthetic oligonucleotide; TGG chr11 5151682 5151701 5151698 +
gaaaaactgtgataaatatc

SEQ ID NO: 143 - DNA, 20 bp, Artificial Sequence
  Synthetic oligonucleotide; TAG chr11 5151688 5151707 5151704 +
ctgtgataaatatctggatg

SEQ ID NO: 144 - DNA, 20 bp, Artificial Sequence
  Synthetic oligonucleotide; AGG chr11 5151689 5151708 5151705 +
tgtgataaatatctggatgt

SEQ ID NO: 145 - DNA, 20 bp, Artificial Sequence
  Synthetic oligonucleotide; GAG chr11 5151708 5151727 5151724 +
taggacaatgtgatgaatgt

SEQ ID NO: 146 - DNA, 20 bp, Artificial Sequence
  Synthetic oligonucleotide; AGG chr11 5151709 5151728 5151725 +
aggacaatgtgatgaatgtg

SEQ ID NO: 147 - DNA, 20 bp, Artificial Sequence
  Synthetic oligonucleotide; CAG chr11 5151725 5151744 5151741 +
tgtgaggtcaaatcctgcta

SEQ ID NO: 148 - DNA, 20 bp, Artificial Sequence
  Synthetic oligonucleotide; AAG chr11 5151730 5151749 5151746 +
ggtcaaatcctgctacagtg

SEQ ID NO: 149 - DNA, 20 bp, Artificial Sequence
  Synthetic oligonucleotide; AGG chr11 5151731 5151750 5151747 +
gtcaaatcctgctacagtga

SEQ ID NO: 150 - DNA, 20 bp, Artificial Sequence
  Synthetic oligonucleotide; TAG chr11 5151748 5151767 5151764 +
tgaaggccacaaacaaacca

SEQ ID NO: 151 - DNA, 20 bp, Artificial Sequence
  Synthetic oligonucleotide; TAG chr11 5151780 5151799 5151796 +
acttgaacatttgctgctgc

SEQ ID NO: 152 - DNA, 20 bp, Artificial Sequence
  Synthetic oligonucleotide; TGG chr11 5151791 5151810 5151807 +
tgctgctgctagtttcacaa

SEQ ID NO: 153 - DNA, 20 bp, Artificial Sequence
  Synthetic oligonucleotide; CAG chr11 5151805 5151824 5151821 +
tcacaatggccatatgctca

SEQ ID NO: 154 - DNA, 20 bp, Artificial Sequence
  Synthetic oligonucleotide; TAG chr11 5151808 5151827 5151824 +
caatggccatatgctcacag

SEQ ID NO: 155 - DNA, 20 bp, Artificial Sequence
  Synthetic oligonucleotide; AGG chr11 5151809 5151828 5151825 +
aatggccatatgctcacagt

SEQ ID NO: 156 - DNA, 20 bp, Artificial Sequence
  Synthetic oligonucleotide; GAG chr11 5151811 5151830 5151827 +
tggccatatgctcacagtag

SEQ ID NO: 157 - DNA, 20 bp, Artificial Sequence
  Synthetic oligonucleotide; TGG chr11 5151814 5151833 5151830 +
ccatatgctcacagtaggag

SEQ ID NO: 158 - DNA, 20 bp, Artificial Sequence
  Synthetic oligonucleotide; GGG chr11 5151815 5151834 5151831 +
catatgctcacagtaggagt

SEQ ID NO: 159 - DNA, 20 bp, Artificial Sequence
  Synthetic oligonucleotide; GAG chr11 5151817 5151836 5151833 +
tatgctcacagtaggagtgg

SEQ ID NO: 160 - DNA, 20 bp, Artificial Sequence
  Synthetic oligonucleotide; CGG chr11 5151847 5151866 5151863 +
ttgtgtgataaaattgaaac

SEQ ID NO: 161 - DNA, 20 bp, Artificial Sequence
  Synthetic oligonucleotide; CAG chr11 5151858 5151877 5151874 +
aattgaaaccggcactttat

SEQ ID NO: 162 - DNA, 20 bp, Artificial Sequence
  Synthetic oligonucleotide; TAG chr11 5151864 5151883 5151880 +
aaccggcactttatcagtac

SEQ ID NO: 163 - DNA, 20 bp, Artificial Sequence
  Synthetic oligonucleotide; AGG chr11 5151865 5151884 5151881 +
accggcactttatcagtact

SEQ ID NO: 164 - DNA, 20 bp, Artificial Sequence
  Synthetic oligonucleotide; TGG chr11 5151870 5151889 5151886 +
cactttatcagtactaggca

SEQ ID NO: 165 - DNA, 20 bp, Artificial Sequence
  Synthetic oligonucleotide; GGG chr11 5151871 5151890 5151887 +
actttatcagtactaggcat

SEQ ID NO: 166 - DNA, 20 bp, Artificial Sequence
  Synthetic oligonucleotide; GGG chr11 5151872 5151891 5151888 +
ctttatcagtactaggcatg

SEQ ID NO: 167 - DNA, 20 bp, Artificial Sequence
  Synthetic oligonucleotide; AAG chr11 5151879 5151898 5151895 +
agtactaggcatggggctac

SEQ ID NO: 168 - DNA, 20 bp, Artificial Sequence
  Synthetic oligonucleotide; TAG chr11 5151884 5151903 5151900 +
taggcatggggctacaagaa

SEQ ID NO: 169 - DNA, 20 bp, Artificial Sequence
  Synthetic oligonucleotide; CAG chr11 5151887 5151906 5151903 +
gcatggggctacaagaatag

SEQ ID NO: 170 - DNA, 20 bp, Artificial Sequence
  Synthetic oligonucleotide; GAG chr11 5151894 5151913 5151910 +
gctacaagaatagcagccct

SEQ ID NO: 171 - DNA, 20 bp, Artificial Sequence
  Synthetic oligonucleotide; TAG chr11 5151905 5151924 5151921 +
agcagccctgagtacgacca

SEQ ID NO: 172 - DNA, 20 bp, Artificial Sequence
  Synthetic oligonucleotide; AAG chr11 5151924 5151943 5151940 +
atagttcctatctgaatgac

SEQ ID NO: 173 - DNA, 20 bp, Artificial Sequence
  Synthetic oligonucleotide; TGG chr11 5151928 5151947 5151944 +
ttcctatctgaatgacaagc

SEQ ID NO: 174 - DNA, 20 bp, Artificial Sequence
  Synthetic oligonucleotide; TGG chr11 5151931 5151950 5151947 +
ctatctgaatgacaagctgg

SEQ ID NO: 175 - DNA, 20 bp, Artificial Sequence
  Synthetic oligonucleotide; GGG chr11 5151932 5151951 5151948 +
tatctgaatgacaagctggt

SEQ ID NO: 176 - DNA, 20 bp, Artificial Sequence
  Synthetic oligonucleotide; AAG chr11 5151937 5151956 5151953 +
gaatgacaagctggtgggtg

SEQ ID NO: 177 - DNA, 20 bp, Artificial Sequence
  Synthetic oligonucleotide; TGG chr11 5151944 5151963 5151960 +
aagctggtgggtgaagatgt

SEQ ID NO: 178 - DNA, 20 bp, Artificial Sequence
  Synthetic oligonucleotide; TAG chr11 5151954 5151973 5151970 +
gtgaagatgttggcatgtct

SEQ ID NO: 179 - DNA, 20 bp, Artificial Sequence
  Synthetic oligonucleotide; TGG chr11 5151957 5151976 5151973 +
aagatgttggcatgtcttag

SEQ ID NO: 180 - DNA, 20 bp, Artificial Sequence
  Synthetic oligonucleotide; CAG chr11 5151964 5151983 5151980 +
tggcatgtcttagtggataa

SEQ ID NO: 181 - DNA, 20 bp, Artificial Sequence
  Synthetic oligonucleotide; TGG chr11 5151968 5151987 5151984 +
atgtcttagtggataacaga

SEQ ID NO: 182 - DNA, 20 bp, Artificial Sequence
  Synthetic oligonucleotide; CGG chr11 5151979 5151998 5151995 +
gataacagatggccacataa

SEQ ID NO: 183 - DNA, 20 bp, Artificial Sequence
  Synthetic oligonucleotide; CAG chr11 5151984 5152003 5152000 +
cagatggccacataacggtc

SEQ ID NO: 184 - DNA, 20 bp, Artificial Sequence
  Synthetic oligonucleotide; AGG chr11 5151985 5152004 5152001 +
agatggccacataacggtcc

SEQ ID NO: 185 - DNA, 20 bp, Artificial Sequence
  Synthetic oligonucleotide; GGG chr11 5151986 5152005 5152002 +
gatggccacataacggtcca

SEQ ID NO: 186 - DNA, 20 bp, Artificial Sequence
  Synthetic oligonucleotide; TGG chr11 5151992 5152011 5152008 +
cacataacggtccagggcca

SEQ ID NO: 187 - DNA, 20 bp, Artificial Sequence
  Synthetic oligonucleotide; AAG chr11 5151999 5152018 5152015 +
cggtccagggccatggccac

SEQ ID NO: 188 - DNA, 20 bp, Artificial Sequence
  Synthetic oligonucleotide; AGG chr11 5152000 5152019 5152016 +
ggtccagggccatggccaca

SEQ ID NO: 189 - DNA, 20 bp, Artificial Sequence
  Synthetic oligonucleotide; TGG chr11 5152030 5152049 5152046 +
actctataccctgcaatgtg

SEQ ID NO: 190 - DNA, 20 bp, Artificial Sequence
  Synthetic oligonucleotide; AAG chr11 5152047 5152066 5152063 +
gtgtggatgaaccacatttg

SEQ ID NO: 191 - DNA, 20 bp, Artificial Sequence
  Synthetic oligonucleotide; AAG chr11 5152051 5152070 5152067 +
ggatgaaccacatttgaagc

SEQ ID NO: 192 - DNA, 20 bp, Artificial Sequence
  Synthetic oligonucleotide; CAG chr11 5152054 5152073 5152070 +
tgaaccacatttgaagcaag

SEQ ID NO: 193 - DNA, 20 bp, Artificial Sequence
  Synthetic oligonucleotide; AGG chr11 5152055 5152074 5152071 +
gaaccacatttgaagcaagc

SEQ ID NO: 194 - DNA, 20 bp, Artificial Sequence
  Synthetic oligonucleotide; TAG chr11 5152066 5152085 5152082 +
gaagcaagcaggaatcaaaa

SEQ ID NO: 195 - DNA, 20 bp, Artificial Sequence
  Synthetic oligonucleotide; CAG chr11 5152073 5152092 5152089 +
gcaggaatcaaaatagattt

SEQ ID NO: 196 - DNA, 20 bp, Artificial Sequence
  Synthetic oligonucleotide; AGG chr11 5152074 5152093 5152090 +
caggaatcaaaatagatttc

SEQ ID NO: 197 - DNA, 20 bp, Artificial Sequence
  Synthetic oligonucleotide; CAG chr11 5152087 5152106 5152103 +
agatttcaggcacattaaac

SEQ ID NO: 198 - DNA, 20 bp, Artificial Sequence
  Synthetic oligonucleotide; AAG chr11 5152098 5152117 5152114 +
acattaaaccagaatattcc

SEQ ID NO: 199 - DNA, 20 bp, Artificial Sequence
  Synthetic oligonucleotide; TGG chr11 5152107 5152126 5152123 +
cagaatattccaagcatctt

SEQ ID NO: 200 - DNA, 20 bp, Artificial Sequence
  Synthetic oligonucleotide; TAG chr11 5152121 5152140 5152137 +
catctttggcataatgctgc

SEQ ID NO: 201 - DNA, 20 bp, Artificial Sequence
  Synthetic oligonucleotide; AAG chr11 5152125 5152144 5152141 +
tttggcataatgctgctagc

SEQ ID NO: 202 - DNA, 20 bp, Artificial Sequence
  Synthetic oligonucleotide; TGG chr11 5152139 5152158 5152155 +
gctagcaagtgcaatgtctg

SEQ ID NO: 203 - DNA, 20 bp, Artificial Sequence
  Synthetic oligonucleotide; TAG chr11 5152146 5152165 5152162 +
agtgcaatgtctgtggctcc

SEQ ID NO: 204 - DNA, 20 bp, Artificial Sequence
  Synthetic oligonucleotide; AAG chr11 5152156 5152175 5152172 +
ctgtggctcctagcatgcct

SEQ ID NO: 205 - DNA, 20 bp, Artificial Sequence
  Synthetic oligonucleotide; AAG chr11 5152168 5152187 5152184 +
gcatgcctaagaaaatgtac

SEQ ID NO: 206 - DNA, 20 bp, Artificial Sequence
  Synthetic oligonucleotide; AGG chr11 5152169 5152188 5152185 +
catgcctaagaaaatgtaca

SEQ ID NO: 207 - DNA, 20 bp, Artificial Sequence
  Synthetic oligonucleotide; GGG chr11 5152170 5152189 5152186 +
atgcctaagaaaatgtacaa

SEQ ID NO: 208 - DNA, 20 bp, Artificial Sequence
  Synthetic oligonucleotide; TGG chr11 5152177 5152196 5152193 +
agaaaatgtacaagggctca

SEQ ID NO: 209 - DNA, 20 bp, Artificial Sequence
  Synthetic oligonucleotide; GAG chr11 5152179 5152198 5152195 +
aaaatgtacaagggctcatg

SEQ ID NO: 210 - DNA, 20 bp, Artificial Sequence
  Synthetic oligonucleotide; CAG chr11 5152190 5152209 5152206 +
gggctcatggagactgcgct

SEQ ID NO: 211 - DNA, 20 bp, Artificial Sequence
  Synthetic oligonucleotide; CAG chr11 5152206 5152225 5152222 +
cgctcagatttgatgatgct

SEQ ID NO: 212 - DNA, 20 bp, Artificial Sequence
  Synthetic oligonucleotide; AAG chr11 5152209 5152228 5152225 +
tcagatttgatgatgctcag

SEQ ID NO: 213 - DNA, 20 bp, Artificial Sequence
  Synthetic oligonucleotide; AAG chr11 5152213 5152232 5152229 +
atttgatgatgctcagaagc

SEQ ID NO: 214 - DNA, 20 bp, Artificial Sequence
  Synthetic oligonucleotide; AGG chr11 5152214 5152233 5152230 +
tttgatgatgctcagaagca

SEQ ID NO: 215 - DNA, 20 bp, Artificial Sequence
  Synthetic oligonucleotide; TAG chr11 5152229 5152248 5152245 +
aagcaaggaatttccaatca

SEQ ID NO: 216 - DNA, 20 bp, Artificial Sequence
  Synthetic oligonucleotide; GAG chr11 5152236 5152255 5152252 +
gaatttccaatcatagcaat

SEQ ID NO: 217 - DNA, 20 bp, Artificial Sequence
  Synthetic oligonucleotide; TGG chr11 5152244 5152263 5152260 +
aatcatagcaatgagataaa

SEQ ID NO: 218 - DNA, 20 bp, Artificial Sequence
  Synthetic oligonucleotide; CAG chr11 5152249 5152268 5152265 +
tagcaatgagataaatggca

SEQ ID NO: 219 - DNA, 20 bp, Artificial Sequence
  Synthetic oligonucleotide; TGG chr11 5152254 5152273 5152270 +
atgagataaatggcacagaa

SEQ ID NO: 220 - DNA, 20 bp, Artificial Sequence
  Synthetic oligonucleotide; CAG chr11 5152267 5152286 5152283 +
cacagaatggaatcccaatc

SEQ ID NO: 221 - DNA, 20 bp, Artificial Sequence
  Synthetic oligonucleotide; CAG chr11 5152277 5152296 5152293 +
aatcccaatccagcactgca

SEQ ID NO: 222 - DNA, 20 bp, Artificial Sequence
  Synthetic oligonucleotide; TAG chr11 5152284 5152303 5152300 +
atccagcactgcacagattc

SEQ ID NO: 223 - DNA, 20 bp, Artificial Sequence
  Synthetic oligonucleotide; AGG chr11 5152285 5152304 5152301 +
tccagcactgcacagattct

SEQ ID NO: 224 - DNA, 20 bp, Artificial Sequence
  Synthetic oligonucleotide; TGG chr11 5152290 5152309 5152306 +
cactgcacagattctaggcc

SEQ ID NO: 225 - DNA, 20 bp, Artificial Sequence
  Synthetic oligonucleotide; GGG chr11 5152291 5152310 5152307 +
actgcacagattctaggcct

SEQ ID NO: 226 - DNA, 20 bp, Artificial Sequence
  Synthetic oligonucleotide; TAG chr11 5152302 5152321 5152318 +
tctaggcctgggatccctac

SEQ ID NO: 227 - DNA, 20 bp, Artificial Sequence
  Synthetic oligonucleotide; CAG chr11 5152313 5152332 5152329 +
gatccctactagtgtcaaca

SEQ ID NO: 228 - DNA, 20 bp, Artificial Sequence
  Synthetic oligonucleotide; GAG chr11 5152315 5152334 5152331 +
tccctactagtgtcaacaca

SEQ ID NO: 229 - DNA, 20 bp, Artificial Sequence
  Synthetic oligonucleotide; AGG chr11 5152316 5152335 5152332 +
ccctactagtgtcaacacag

SEQ ID NO: 230 - DNA, 20 bp, Artificial Sequence
  Synthetic oligonucleotide; GGG chr11 5152317 5152336 5152333 +
cctactagtgtcaacacaga

SEQ ID NO: 231 - DNA, 20 bp, Artificial Sequence
  Synthetic oligonucleotide; TAG chr11 5152324 5152343 5152340 +
gtgtcaacacagagggcatg

SEQ ID NO: 232 - DNA, 20 bp, Artificial Sequence
  Synthetic oligonucleotide; TGG chr11 5152337 5152356 5152353 +
gggcatgtagactgtgatgt

SEQ ID NO: 233 - DNA, 20 bp, Artificial Sequence
  Synthetic oligonucleotide; TGG chr11 5152343 5152362 5152359 +
gtagactgtgatgttggaaa

SEQ ID NO: 234 - DNA, 20 bp, Artificial Sequence
  Synthetic oligonucleotide; TAG chr11 5152349 5152368 5152365 +
tgtgatgttggaaatggaca

SEQ ID NO: 235 - DNA, 20 bp, Artificial Sequence
  Synthetic oligonucleotide; TGG chr11 5152358 5152377 5152374 +
ggaaatggacatagtgtcgt

SEQ ID NO: 236 - DNA, 20 bp, Artificial Sequence
  Synthetic oligonucleotide; GGG chr11 5152359 5152378 5152375 +
gaaatggacatagtgtcgtt

SEQ ID NO: 237 - DNA, 20 bp, Artificial Sequence
  Synthetic oligonucleotide; AAG chr11 5152379 5152398 5152395 +
gggtctcctgatgcaaacaa

SEQ ID NO: 238 - DNA, 20 bp, Artificial Sequence
  Synthetic oligonucleotide; AAG chr11 5152382 5152401 5152398 +
tctcctgatgcaaacaaaag

SEQ ID NO: 239 - DNA, 20 bp, Artificial Sequence
  Synthetic oligonucleotide; CAG chr11 5152390 5152409 5152406 +
tgcaaacaaaagaagtttct

SEQ ID NO: 240 - DNA, 20 bp, Artificial Sequence
  Synthetic oligonucleotide; CAG chr11 5152394 5152413 5152410 +
aacaaaagaagtttctcagt

SEQ ID NO: 241 - DNA, 20 bp, Artificial Sequence
  Synthetic oligonucleotide; GAG chr11 5152446 5152465 5152462 +
ttctccaaactcattatatt

SEQ ID NO: 242 - DNA, 20 bp, Artificial Sequence
  Synthetic oligonucleotide; TGG chr11 5152460 5152479 5152476 +
tatattgagtctgtctgatt

SEQ ID NO: 243 - DNA, 20 bp, Artificial Sequence
  Synthetic oligonucleotide; GGG chr11 5152461 5152480 5152477 +
atattgagtctgtctgattt

SEQ ID NO: 244 - DNA, 20 bp, Artificial Sequence
  Synthetic oligonucleotide; CAG chr11 5152493 5152512 5152509 +
aaaatcatccatcttattca

SEQ ID NO: 245 - DNA, 20 bp, Artificial Sequence
  Synthetic oligonucleotide; AAG chr11 5152502 5152521 5152518 +
catcttattcacagttttga

SEQ ID NO: 246 - DNA, 20 bp, Artificial Sequence
  Synthetic oligonucleotide; AGG chr11 5152503 5152522 5152519 +
atcttattcacagttttgaa

SEQ ID NO: 247 - DNA, 20 bp, Artificial Sequence
  Synthetic oligonucleotide; AAG chr11 5152508 5152527 5152524 +
attcacagttttgaaaggaa

SEQ ID NO: 248 - DNA, 20 bp, Artificial Sequence
  Synthetic oligonucleotide; TGG chr11 5152512 5152531 5152528 +
acagttttgaaaggaaaaga

SEQ ID NO: 249 - DNA, 20 bp, Artificial Sequence
  Synthetic oligonucleotide; TGG chr11 5152520 5152539 5152536 +
gaaaggaaaagatggattca

SEQ ID NO: 250 - DNA, 20 bp, Artificial Sequence
  Synthetic oligonucleotide; GAG chr11 5152522 5152541 5152538 +
aaggaaaagatggattcatg

SEQ ID NO: 251 - DNA, 20 bp, Artificial Sequence
  Synthetic oligonucleotide; CAG chr11 5152540 5152559 5152556 +
tggagatacatcactgtttt

SEQ ID NO: 252 - DNA, 20 bp, Artificial Sequence
  Synthetic oligonucleotide; AGG chr11 5152541 5152560 5152557 +
ggagatacatcactgttttc

SEQ ID NO: 253 - DNA, 20 bp, Artificial Sequence
  Synthetic oligonucleotide; TGG chr11 5152544 5152563 5152560 +
gatacatcactgttttcagg

SEQ ID NO: 254 - DNA, 20 bp, Artificial Sequence
  Synthetic oligonucleotide; GGG chr11 5152545 5152564 5152561 +
atacatcactgttttcaggt

SEQ ID NO: 255 - DNA, 20 bp, Artificial Sequence
  Synthetic oligonucleotide; GGG chr11 5152546 5152565 5152562 +
tacatcactgttttcaggtg

SEQ ID NO: 256 - DNA, 20 bp, Artificial Sequence
  Synthetic oligonucleotide; CAG chr11 5152555 5152574 5152571 +
gttttcaggtggggcattca

SEQ ID NO: 257 - DNA, 20 bp, Artificial Sequence
  Synthetic oligonucleotide; AGG chr11 5152556 5152575 5152572 +
ttttcaggtggggcattcac

SEQ ID NO: 258 - DNA, 20 bp, Artificial Sequence
  Synthetic oligonucleotide; TAG chr11 5152572 5152591 5152588 +
tcacaggcactgtgccataa

SEQ ID NO: 259 - DNA, 20 bp, Artificial Sequence
  Synthetic oligonucleotide; AGG chr11 5152573 5152592 5152589 +
cacaggcactgtgccataat

SEQ ID NO: 260 - DNA, 20 bp, Artificial Sequence
  Synthetic oligonucleotide; TGG chr11 5152588 5152607 5152604 +
ataataggatgttatgtgca

SEQ ID NO: 261 - DNA, 20 bp, Artificial Sequence
  Synthetic oligonucleotide; TAG chr11 5152605 5152624 5152621 +
gcatggcaatccaaatacat

SEQ ID NO: 262 - DNA, 20 bp, Artificial Sequence
  Synthetic oligonucleotide; CAG chr11 5152611 5152630 5152627 +
caatccaaatacattagaac

SEQ ID NO: 263 - DNA, 20 bp, Artificial Sequence
  Synthetic oligonucleotide; TGG chr11 5152624 5152643 5152640 +
ttagaaccagcaaaatcacc

SEQ ID NO: 264 - DNA, 20 bp, Artificial Sequence
  Synthetic oligonucleotide; CAG chr11 5152628 5152647 5152644 +
aaccagcaaaatcacctgga

SEQ ID NO: 265 - DNA, 20 bp, Artificial Sequence
  Synthetic oligonucleotide; AGG chr11 5152629 5152648 5152645 +
accagcaaaatcacctggac

SEQ ID NO: 266 - DNA, 20 bp, Artificial Sequence
  Synthetic oligonucleotide; GGG chr11 5152630 5152649 5152646 +
ccagcaaaatcacctggaca

SEQ ID NO: 267 - DNA, 20 bp, Artificial Sequence
  Synthetic oligonucleotide; GGG chr11 5152631 5152650 5152647 +
cagcaaaatcacctggacag

SEQ ID NO: 268 - DNA, 20 bp, Artificial Sequence
  Synthetic oligonucleotide; TGG chr11 5152636 5152655 5152652 +
aaatcacctggacaggggat

SEQ ID NO: 269 - DNA, 20 bp, Artificial Sequence
  Synthetic oligonucleotide; TGG chr11 5152644 5152663 5152660 +
tggacaggggattggactac

SEQ ID NO: 270 - DNA, 20 bp, Artificial Sequence
  Synthetic oligonucleotide; CAG chr11 5152648 5152667 5152664 +
caggggattggactactggc

SEQ ID NO: 271 - DNA, 20 bp, Artificial Sequence
  Synthetic oligonucleotide; CAG chr11 5152666 5152685 5152682 +
gccagtctgttatttctttc

SEQ ID NO: 272 - DNA, 20 bp, Artificial Sequence
  Synthetic oligonucleotide; TGG chr11 5152674 5152693 5152690 +
gttatttctttccagacctg

SEQ ID NO: 273 - DNA, 20 bp, Artificial Sequence
  Synthetic oligonucleotide; AAG chr11 5152688 5152707 5152704 +
gacctgtggacaaaaaaaaa

SEQ ID NO: 274 - DNA, 20 bp, Artificial Sequence
  Synthetic oligonucleotide; AAG chr11 5152691 5152710 5152707 +
ctgtggacaaaaaaaaaaag

SEQ ID NO: 275 - DNA, 20 bp, Artificial Sequence
  Synthetic oligonucleotide; TGG chr11 5152705 5152724 5152721 +
aaaaagaagtttatttttat

SEQ ID NO: 276 - DNA, 20 bp, Artificial Sequence
  Synthetic oligonucleotide; TGG chr11 5152724 5152743 5152740 +
ttggacattgcattttaatt

SEQ ID NO: 277 - DNA, 20 bp, Artificial Sequence
  Synthetic oligonucleotide; CAG chr11 5152755 5152774 5152771 +
cctctccatatttcacattt

SEQ ID NO: 278 - DNA, 20 bp, Artificial Sequence
  Synthetic oligonucleotide; TAG chr11 5152767 5152786 5152783 +
tcacatttcagctattcctc

SEQ ID NO: 279 - DNA, 20 bp, Artificial Sequence
  Synthetic oligonucleotide; AAG chr11 5152795 5152814 5152811 +
aactatttccaattttcttt

SEQ ID NO: 280 - DNA, 20 bp, Artificial Sequence
  Synthetic oligonucleotide; TAG chr11 5152805 5152824 5152821 +
aattttctttaagaacattt

SEQ ID NO: 281 - DNA, 20 bp, Artificial Sequence
  Synthetic oligonucleotide; AAG chr11 5152810 5152829 5152826 +
tctttaagaacattttagac

SEQ ID NO: 282 - DNA, 20 bp, Artificial Sequence
  Synthetic oligonucleotide; CAG chr11 5152821 5152840 5152837 +
attttagacaagcaaattaa

SEQ ID NO: 283 - DNA, 20 bp, Artificial Sequence
  Synthetic oligonucleotide; CAG chr11 5152832 5152851 5152848 +
gcaaattaacagactctgac

SEQ ID NO: 284 - DNA, 20 bp, Artificial Sequence
  Synthetic oligonucleotide; TGG chr11 5152840 5152859 5152856 +
acagactctgaccagtacat

SEQ ID NO: 285 - DNA, 20 bp, Artificial Sequence
  Synthetic oligonucleotide; AAG chr11 5152848 5152867 5152864 +
tgaccagtacattggtgtaa

SEQ ID NO: 286 - DNA, 20 bp, Artificial Sequence
  Synthetic oligonucleotide; AAG chr11 5152862 5152881 5152878 +
gtgtaaaagattcccaatga

SEQ ID NO: 287 - DNA, 20 bp, Artificial Sequence
  Synthetic oligonucleotide; GAG chr11 5152864 5152883 5152880 +
gtaaaagattcccaatgaaa

SEQ ID NO: 288 - DNA, 20 bp, Artificial Sequence
  Synthetic oligonucleotide; TAG chr11 5152869 5152888 5152885 +
agattcccaatgaaagagaa

SEQ ID NO: 289 - DNA, 20 bp, Artificial Sequence
  Synthetic oligonucleotide; GAG chr11 5152871 5152890 5152887 +
attcccaatgaaagagaata

SEQ ID NO: 290 - DNA, 20 bp, Artificial Sequence
  Synthetic oligonucleotide; AGG chr11 5152872 5152891 5152888 +
ttcccaatgaaagagaatag

SEQ ID NO: 291 - DNA, 20 bp, Artificial Sequence
  Synthetic oligonucleotide; TAG chr11 5152875 5152894 5152891 +
ccaatgaaagagaatagagg

SEQ ID NO: 292 - DNA, 20 bp, Artificial Sequence
  Synthetic oligonucleotide; AAG chr11 5152893 5152912 5152909 +
ggtagaaataattgacaccc

SEQ ID NO: 293 - DNA, 20 bp, Artificial Sequence
  Synthetic oligonucleotide; CAG chr11 5152921 5152940 5152937 +
aatatatttctttttatatt

SEQ ID NO: 294 - DNA, 20 bp, Artificial Sequence
  Synthetic oligonucleotide; AAG chr11 5152933 5152952 5152949 +
tttatattcagaataatgta

SEQ ID NO: 295 - DNA, 20 bp, Artificial Sequence
  Synthetic oligonucleotide; GAG chr11 5152935 5152954 5152951 +
tatattcagaataatgtaaa

SEQ ID NO: 296 - DNA, 20 bp, Artificial Sequence
  Synthetic oligonucleotide; TAG chr11 5152945 5152964 5152961 +
ataatgtaaagagaatgctt

SEQ ID NO: 297 - DNA, 20 bp, Artificial Sequence
  Synthetic oligonucleotide; GAG chr11 5152982 5153001 5152998 +
tttatacttttgacaaatct

SEQ ID NO: 298 - DNA, 20 bp, Artificial Sequence
  Synthetic oligonucleotide; AAG chr11 5152988 5153007 5153004 +
cttttgacaaatctgagcca

SEQ ID NO: 299 - DNA, 20 bp, Artificial Sequence
  Synthetic oligonucleotide; TGG chr11 5152995 5153014 5153011 +
caaatctgagccaaagctcc

SEQ ID NO: 300 - DNA, 20 bp, Artificial Sequence
  Synthetic oligonucleotide; AAG chr11 5153018 5153037 5153034 +
ttgctttttatatttcttta

SEQ ID NO: 301 - DNA, 20 bp, Artificial Sequence
  Synthetic oligonucleotide; AAG chr11 5153024 5153043 5153040 +
tttatatttctttaaagtta

SEQ ID NO: 302 - DNA, 20 bp, Artificial Sequence
  Synthetic oligonucleotide; AGG chr11 5153025 5153044 5153041 +
ttatatttctttaaagttaa

SEQ ID NO: 303 - DNA, 20 bp, Artificial Sequence
  Synthetic oligonucleotide; GGG chr11 5153026 5153045 5153042 +
tatatttctttaaagttaaa

SEQ ID NO: 304 - DNA, 20 bp, Artificial Sequence
  Synthetic oligonucleotide; CAG chr11 5153057 5153076 5153073 +
tttttcctatatattttaaa

SEQ ID NO: 305 - DNA, 20 bp, Artificial Sequence
  Synthetic oligonucleotide; GAG chr11 5153081 5153100 5153097 +
tgaaactcttgaaatgttgt

SEQ ID NO: 306 - DNA, 20 bp, Artificial Sequence
  Synthetic oligonucleotide; TGG chr11 5153106 5153125 5153122 +
taaaattttaatacacttta

SEQ ID NO: 307 - DNA, 20 bp, Artificial Sequence
  Synthetic oligonucleotide; TAG chr11 5153115 5153134 5153131 +
aatacactttatggaatatc

SEQ ID NO: 308 - DNA, 20 bp, Artificial Sequence
  Synthetic oligonucleotide; GAG chr11 5153117 5153136 5153133 +
tacactttatggaatatcta

SEQ ID NO: 309 - DNA, 20 bp, Artificial Sequence
  Synthetic oligonucleotide; GAG chr11 5153119 5153138 5153135 +
cactttatggaatatctaga

SEQ ID NO: 310 - DNA, 20 bp, Artificial Sequence
  Synthetic oligonucleotide; AAG chr11 5153122 5153141 5153138 +
tttatggaatatctagagag

SEQ ID NO: 311 - DNA, 20 bp, Artificial Sequence
  Synthetic oligonucleotide; AGG chr11 5153123 5153142 5153139 +
ttatggaatatctagagaga

SEQ ID NO: 312 - DNA, 20 bp, Artificial Sequence
  Synthetic oligonucleotide; AAG chr11 5153133 5153152 5153149 +
tctagagagaaggaactgct

SEQ ID NO: 313 - DNA, 20 bp, Artificial Sequence
  Synthetic oligonucleotide; AGG chr11 5153134 5153153 5153150 +
ctagagagaaggaactgcta

SEQ ID NO: 314 - DNA, 20 bp, Artificial Sequence
  Synthetic oligonucleotide; GGG chr11 5153135 5153154 5153151 +
tagagagaaggaactgctaa

SEQ ID NO: 315 - DNA, 20 bp, Artificial Sequence
  Synthetic oligonucleotide; AAG chr11 5153140 5153159 5153156 +
agaaggaactgctaagggac

SEQ ID NO: 316 - DNA, 20 bp, Artificial Sequence
  Synthetic oligonucleotide; GAG chr11 5153145 5153164 5153161 +
gaactgctaagggacaagat

SEQ ID NO: 317 - DNA, 20 bp, Artificial Sequence
  Synthetic oligonucleotide; CAG chr11 5153148 5153167 5153164 +
ctgctaagggacaagatgag

SEQ ID NO: 318 - DNA, 20 bp, Artificial Sequence
  Synthetic oligonucleotide; CAG chr11 5153151 5153170 5153167 +
ctaagggacaagatgagcag

SEQ ID NO: 319 - DNA, 20 bp, Artificial Sequence
  Synthetic oligonucleotide; CGG chr11 5153163 5153182 5153179 +
atgagcagcagcaatgccta

SEQ ID NO: 320 - DNA, 20 bp, Artificial Sequence
  Synthetic oligonucleotide; AAG chr11 5153167 5153186 5153183 +
gcagcagcaatgcctacggc

SEQ ID NO: 321 - DNA, 20 bp, Artificial Sequence
  Synthetic oligonucleotide; GAG chr11 5153169 5153188 5153185 +
agcagcaatgcctacggcaa

SEQ ID NO: 322 - DNA, 20 bp, Artificial Sequence
  Synthetic oligonucleotide; CAG chr11 5153192 5153211 5153208 +
aacttgctcctgataaacca

SEQ ID NO: 323 - DNA, 20 bp, Artificial Sequence
  Synthetic oligonucleotide; TGG chr11 5153206 5153225 5153222 +
aaaccacagatactgaataa

SEQ ID NO: 324 - DNA, 20 bp, Artificial Sequence
  Synthetic oligonucleotide; GGG chr11 5153207 5153226 5153223 +
aaccacagatactgaataat

SEQ ID NO: 325 - DNA, 20 bp, Artificial Sequence
  Synthetic oligonucleotide; TAG chr11 5153223 5153242 5153239 +
taatgggcaaatgaatcatt

SEQ ID NO: 326 - DNA, 20 bp, Artificial Sequence
  Synthetic oligonucleotide; CAG chr11 5153227 5153246 5153243 +
gggcaaatgaatcatttagc

SEQ ID NO: 327 - DNA, 20 bp, Artificial Sequence
  Synthetic oligonucleotide; TAG chr11 5153232 5153251 5153248 +
aatgaatcatttagccagaa

SEQ ID NO: 328 - DNA, 20 bp, Artificial Sequence
  Synthetic oligonucleotide; GAG chr11 5153234 5153253 5153250 +
tgaatcatttagccagaata

SEQ ID NO: 329 - DNA, 20 bp, Artificial Sequence
  Synthetic oligonucleotide; CAG chr11 5153239 5153258 5153255 +
catttagccagaatagagtc

SEQ ID NO: 330 - DNA, 20 bp, Artificial Sequence
  Synthetic oligonucleotide; TGG chr11 5153247 5153266 5153263 +
cagaatagagtccagtttcc

SEQ ID NO: 331 - DNA, 20 bp, Artificial Sequence
  Synthetic oligonucleotide; CAG chr11 5153262 5153281 5153278 +
tttcctggttttaaaatgtt

SEQ ID NO: 332 - DNA, 20 bp, Artificial Sequence
  Synthetic oligonucleotide; GAG chr11 5153264 5153283 5153280 +
tcctggttttaaaatgttca

SEQ ID NO: 333 - DNA, 20 bp, Artificial Sequence
  Synthetic oligonucleotide; TAG chr11 5153274 5153293 5153290 +
aaaatgttcagagttataat

SEQ ID NO: 334 - DNA, 20 bp, Artificial Sequence
  Synthetic oligonucleotide; TAG chr11 5153284 5153303 5153300 +
gagttataattagcataata

SEQ ID NO: 335 - DNA, 20 bp, Artificial Sequence
  Synthetic oligonucleotide; AAG chr11 5153294 5153313 5153310 +
tagcataatatagcccaata

SEQ ID NO: 336 - DNA, 20 bp, Artificial Sequence
  Synthetic oligonucleotide; AGG chr11 5153295 5153314 5153311 +
agcataatatagcccaataa

SEQ ID NO: 337 - DNA, 20 bp, Artificial Sequence
  Synthetic oligonucleotide; TAG chr11 5153303 5153322 5153319 +
atagcccaataaaggctcat

SEQ ID NO: 338 - DNA, 20 bp, Artificial Sequence
  Synthetic oligonucleotide; TAG chr11 5153320 5153339 5153336 +
cattagttcttaatgaaata

SEQ ID NO: 339 - DNA, 20 bp, Artificial Sequence
  Synthetic oligonucleotide; AGG chr11 5153321 5153340 5153337 +
attagttcttaatgaaatat

SEQ ID NO: 340 - DNA, 20 bp, Artificial Sequence
  Synthetic oligonucleotide; GAG chr11 5153325 5153344 5153341 +
gttcttaatgaaatataggt

SEQ ID NO: 341 - DNA, 20 bp, Artificial Sequence
  Synthetic oligonucleotide; GAG chr11 5153346 5153365 5153362 +
agatgcttatataattttgt

SEQ ID NO: 342 - DNA, 20 bp, Artificial Sequence
  Synthetic oligonucleotide; AAG chr11 5153358 5153377 5153374 +
aattttgtgagctctgacat

SEQ ID NO: 343 - DNA, 20 bp, Artificial Sequence
  Synthetic oligonucleotide; TAG chr11 5153365 5153384 5153381 +
tgagctctgacataagaaat

SEQ ID NO: 344 - DNA, 20 bp, Artificial Sequence
  Synthetic oligonucleotide; AAG chr11 5153379 5153398 5153395 +
agaaattagtaaaaataaaa

SEQ ID NO: 345 - DNA, 20 bp, Artificial Sequence
  Synthetic oligonucleotide; AAG chr11 5153385 5153404 5153401 +
tagtaaaaataaaaaagcta

SEQ ID NO: 346 - DNA, 20 bp, Artificial Sequence
  Synthetic oligonucleotide; AGG chr11 5153386 5153405 5153402 +
agtaaaaataaaaaagctaa

SEQ ID NO: 347 - DNA, 20 bp, Artificial Sequence
  Synthetic oligonucleotide; CAG chr11 5153390 5153409 5153406 +
aaaataaaaaagctaaagga

SEQ ID NO: 348 - DNA, 20 bp, Artificial Sequence
  Synthetic oligonucleotide; TAG chr11 5153399 5153418 5153415 +
aagctaaaggacagatttct

SEQ ID NO: 349 - DNA, 20 bp, Artificial Sequence
  Synthetic oligonucleotide; AAG chr11 5153402 5153421 5153418 +
ctaaaggacagatttcttag

SEQ ID NO: 350 - DNA, 20 bp, Artificial Sequence
  Synthetic oligonucleotide; AAG chr11 5153405 5153424 5153421 +
aaggacagatttcttagaag

SEQ ID NO: 351 - DNA, 20 bp, Artificial Sequence
  Synthetic oligonucleotide; TAG chr11 5153415 5153434 5153431 +
ttcttagaagaagtcaaatg

SEQ ID NO: 352 - DNA, 20 bp, Artificial Sequence
  Synthetic oligonucleotide; TAG chr11 5153421 5153440 5153437 +
gaagaagtcaaatgtagaac

SEQ ID NO: 353 - DNA, 20 bp, Artificial Sequence
  Synthetic oligonucleotide; CAG chr11 5153425 5153444 5153441 +
aagtcaaatgtagaactaga

SEQ ID NO: 354 - DNA, 20 bp, Artificial Sequence
  Synthetic oligonucleotide; AGG chr11 5153426 5153445 5153442 +
agtcaaatgtagaactagac

SEQ ID NO: 355 - DNA, 20 bp, Artificial Sequence
  Synthetic oligonucleotide; GGG chr11 5153427 5153446 5153443 +
gtcaaatgtagaactagaca

SEQ ID NO: 356 - DNA, 20 bp, Artificial Sequence
  Synthetic oligonucleotide; AAG chr11 5153430 5153449 5153446 +
aaatgtagaactagacaggg

SEQ ID NO: 357 - DNA, 20 bp, Artificial Sequence
  Synthetic oligonucleotide; CAG chr11 5153434 5153453 5153450 +
gtagaactagacagggaaga

SEQ ID NO: 358 - DNA, 20 bp, Artificial Sequence
  Synthetic oligonucleotide; AGG chr11 5153435 5153454 5153451 +
tagaactagacagggaagac

SEQ ID NO: 359 - DNA, 20 bp, Artificial Sequence
  Synthetic oligonucleotide; TGG chr11 5153445 5153464 5153461 +
cagggaagacaggacaaact

SEQ ID NO: 360 - DNA, 20 bp, Artificial Sequence
  Synthetic oligonucleotide; GGG chr11 5153446 5153465 5153462 +
agggaagacaggacaaactt

SEQ ID NO: 361 - DNA, 20 bp, Artificial Sequence
  Synthetic oligonucleotide; GGG chr11 5153447 5153466 5153463 +
gggaagacaggacaaacttg

SEQ ID NO: 362 - DNA, 20 bp, Artificial Sequence
  Synthetic oligonucleotide; GAG chr11 5153449 5153468 5153465 +
gaagacaggacaaacttggg

SEQ ID NO: 363 - DNA, 20 bp, Artificial Sequence
  Synthetic oligonucleotide; GAG chr11 5153461 5153480 5153477 +
aacttggggagactaaaatt

SEQ ID NO: 364 - DNA, 20 bp, Artificial Sequence
  Synthetic oligonucleotide; AGG chr11 5153462 5153481 5153478 +
acttggggagactaaaattg

SEQ ID NO: 365 - DNA, 20 bp, Artificial Sequence
  Synthetic oligonucleotide; AAG chr11 5153466 5153485 5153482 +
ggggagactaaaattgagga

SEQ ID NO: 366 - DNA, 20 bp, Artificial Sequence
  Synthetic oligonucleotide; AAG chr11 5153484 5153503 5153500 +
gaaagcactatgaataacca

SEQ ID NO: 367 - DNA, 20 bp, Artificial Sequence
  Synthetic oligonucleotide; TAG chr11 5153493 5153512 5153509 +
atgaataaccaaagaaaatt

SEQ ID NO: 368 - DNA, 20 bp, Artificial Sequence
  Synthetic oligonucleotide; TGG chr11 5153538 5153557 5153554 +
attgaattttctgaaaaacc

SEQ ID NO: 369 - DNA, 20 bp, Artificial Sequence
  Synthetic oligonucleotide; GGG chr11 5153539 5153558 5153555 +
ttgaattttctgaaaaacct

SEQ ID NO: 370 - DNA, 20 bp, Artificial Sequence
  Synthetic oligonucleotide; AAG chr11 5153560 5153579 5153576 +
ggctcttatgctttatataa

SEQ ID NO: 371 - DNA, 20 bp, Artificial Sequence
  Synthetic oligonucleotide; TAG chr11 5153577 5153596 5153593 +
taaaagttctctgatcaaaa

SEQ ID NO: 372 - DNA, 20 bp, Artificial Sequence
  Synthetic oligonucleotide; CAG chr11 5153609 5153628 5153625 +
aaaaattacatattttgaat

SEQ ID NO: 373 - DNA, 20 bp, Artificial Sequence
  Synthetic oligonucleotide; AAG chr11 5153620 5153639 5153636 +
attttgaatcagtacatttt

SEQ ID NO: 374 - DNA, 20 bp, Artificial Sequence
  Synthetic oligonucleotide; TAG chr11 5153631 5153650 5153647 +
gtacattttaagctatacat

SEQ ID NO: 375 - DNA, 20 bp, Artificial Sequence
  Synthetic oligonucleotide; GAG chr11 5153633 5153652 5153649 +
acattttaagctatacatta

SEQ ID NO: 376 - DNA, 20 bp, Artificial Sequence
  Synthetic oligonucleotide; CAG chr11 5153650 5153669 5153666 +
ttagagaaatgtttgtgata

SEQ ID NO: 377 - DNA, 20 bp, Artificial Sequence
  Synthetic oligonucleotide; AAG chr11 5153657 5153676 5153673 +
aatgtttgtgatacagtgaa

SEQ ID NO: 378 - DNA, 20 bp, Artificial Sequence
  Synthetic oligonucleotide; AAG chr11 5153662 5153681 5153678 +
ttgtgatacagtgaaaagta

SEQ ID NO: 379 - DNA, 20 bp, Artificial Sequence
  Synthetic oligonucleotide; TAG chr11 5153681 5153700 5153697 +
aaagttacttcattctttcc

SEQ ID NO: 380 - DNA, 20 bp, Artificial Sequence
  Synthetic oligonucleotide; AAG chr11 5153695 5153714 5153711 +
ctttcctagacacttcaata

SEQ ID NO: 381 - DNA, 20 bp, Artificial Sequence
  Synthetic oligonucleotide; CAG chr11 5153709 5153728 5153725 +
tcaataaagttgttttatct

SEQ ID NO: 382 - DNA, 20 bp, Artificial Sequence
  Synthetic oligonucleotide; AAG chr11 5153713 5153732 5153729 +
taaagttgttttatctcagt

SEQ ID NO: 383 - DNA, 20 bp, Artificial Sequence
  Synthetic oligonucleotide; CAG chr11 5153725 5153744 5153741 +
atctcagtaagctcatgaat

SEQ ID NO: 384 - DNA, 20 bp, Artificial Sequence
  Synthetic oligonucleotide; TGG chr11 5153758 5153777 5153774 +
gcttcatgtcaccaatatgc

SEQ ID NO: 385 - DNA, 20 bp, Artificial Sequence
  Synthetic oligonucleotide; CAG chr11 5153766 5153785 5153782 +
tcaccaatatgctggaaatt

SEQ ID NO: 386 - DNA, 20 bp, Artificial Sequence
  Synthetic oligonucleotide; AGG chr11 5153767 5153786 5153783 +
caccaatatgctggaaattc

SEQ ID NO: 387 - DNA, 20 bp, Artificial Sequence
  Synthetic oligonucleotide; AAG chr11 5153770 5153789 5153786 +
caatatgctggaaattcagg

SEQ ID NO: 388 - DNA, 20 bp, Artificial Sequence
  Synthetic oligonucleotide; TAG chr11 5153773 5153792 5153789 +
tatgctggaaattcaggaag

SEQ ID NO: 389 - DNA, 20 bp, Artificial Sequence
  Synthetic oligonucleotide; AAG chr11 5153787 5153806 5153803 +
aggaagtagctgttctttga

SEQ ID NO: 390 - DNA, 20 bp, Artificial Sequence
  Synthetic oligonucleotide; AAG chr11 5153793 5153812 5153809 +
tagctgttctttgaaagaaa

SEQ ID NO: 391 - DNA, 20 bp, Artificial Sequence
  Synthetic oligonucleotide; CAG chr11 5153796 5153815 5153812 +
ctgttctttgaaagaaaaag

SEQ ID NO: 392 - DNA, 20 bp, Artificial Sequence
  Synthetic oligonucleotide; AAG chr11 5153823 5153842 5153839 +
ttttttttttttttttttga

SEQ ID NO: 393 - DNA, 20 bp, Artificial Sequence
  Synthetic oligonucleotide; AAG chr11 5153828 5153847 5153844 +
tttttttttttttgaaagaa

SEQ ID NO: 394 - DNA, 20 bp, Artificial Sequence
  Synthetic oligonucleotide; AGG chr11 5153829 5153848 5153845 +
ttttttttttttgaaagaaa

SEQ ID NO: 395 - DNA, 20 bp, Artificial Sequence
  Synthetic oligonucleotide; AAG chr11 5153832 5153851 5153848 +
tttttttttgaaagaaaagg

SEQ ID NO: 396 - DNA, 20 bp, Artificial Sequence
  Synthetic oligonucleotide; AGG chr11 5153833 5153852 5153849 +
ttttttttgaaagaaaagga

SEQ ID NO: 397 - DNA, 20 bp, Artificial Sequence
  Synthetic oligonucleotide; AAG chr11 5153837 5153856 5153853 +
ttttgaaagaaaaggaaggt

SEQ ID NO: 398 - DNA, 20 bp, Artificial Sequence
  Synthetic oligonucleotide; AAG chr11 5153844 5153863 5153860 +
agaaaaggaaggtaagtaac

SEQ ID NO: 399 - DNA, 20 bp, Artificial Sequence
  Synthetic oligonucleotide; AGG chr11 5153845 5153864 5153861 +
gaaaaggaaggtaagtaaca

SEQ ID NO: 400 - DNA, 20 bp, Artificial Sequence
  Synthetic oligonucleotide; AAG chr11 5153848 5153867 5153864 +
aaggaaggtaagtaacaagg

SEQ ID NO: 401 - DNA, 20 bp, Artificial Sequence
  Synthetic oligonucleotide; AAG chr11 5153852 5153871 5153868 +
aaggtaagtaacaaggaaga

SEQ ID NO: 402 - DNA, 20 bp, Artificial Sequence
  Synthetic oligonucleotide; GAG chr11 5153854 5153873 5153870 +
ggtaagtaacaaggaagaaa

SEQ ID NO: 403 - DNA, 20 bp, Artificial Sequence
  Synthetic oligonucleotide; AAG chr11 5153859 5153878 5153875 +
gtaacaaggaagaaagagaa

SEQ ID NO: 404 - DNA, 20 bp, Artificial Sequence
  Synthetic oligonucleotide; GAG chr11 5153861 5153880 5153877 +
aacaaggaagaaagagaaaa

SEQ ID NO: 405 - DNA, 20 bp, Artificial Sequence
  Synthetic oligonucleotide; AGG chr11 5153862 5153881 5153878 +
acaaggaagaaagagaaaag

SEQ ID NO: 406 - DNA, 20 bp, Artificial Sequence
  Synthetic oligonucleotide; TGG chr11 5153868 5153887 5153884 +
aagaaagagaaaagaggaaa

SEQ ID NO: 407 - DNA, 20 bp, Artificial Sequence
  Synthetic oligonucleotide; AAG chr11 5153875 5153894 5153891 +
agaaaagaggaaatggatac

SEQ ID NO: 408 - DNA, 20 bp, Artificial Sequence
  Synthetic oligonucleotide; AAG chr11 5153930 5153949 5153946 +
tgctgctaaacttcaaatga

SEQ ID NO: 409 - DNA, 20 bp, Artificial Sequence
  Synthetic oligonucleotide; CAG chr11 5153941 5153960 5153957 +
ttcaaatgaaagaaccaaat

SEQ ID NO: 410 - DNA, 20 bp, Artificial Sequence
  Synthetic oligonucleotide; CAG chr11 5153944 5153963 5153960 +
aaatgaaagaaccaaatcag

SEQ ID NO: 411 - DNA, 20 bp, Artificial Sequence
  Synthetic oligonucleotide; GAG chr11 5153946 5153965 5153962 +
atgaaagaaccaaatcagca

SEQ ID NO: 412 - DNA, 20 bp, Artificial Sequence
  Synthetic oligonucleotide; AGG chr11 5153947 5153966 5153963 +
tgaaagaaccaaatcagcag

SEQ ID NO: 413 - DNA, 20 bp, Artificial Sequence
  Synthetic oligonucleotide; CAG chr11 5153961 5153980 5153977 +
cagcagaggacatttcatga

SEQ ID NO: 414 - DNA, 20 bp, Artificial Sequence
  Synthetic oligonucleotide; AGG chr11 5153962 5153981 5153978 +
agcagaggacatttcatgac

SEQ ID NO: 415 - DNA, 20 bp, Artificial Sequence
  Synthetic oligonucleotide; GGG chr11 5153963 5153982 5153979 +
gcagaggacatttcatgaca

SEQ ID NO: 416 - DNA, 20 bp, Artificial Sequence
  Synthetic oligonucleotide; GAG chr11 5153965 5153984 5153981 +
agaggacatttcatgacagg

SEQ ID NO: 417 - DNA, 20 bp, Artificial Sequence
  Synthetic oligonucleotide; AGG chr11 5153966 5153985 5153982 +
gaggacatttcatgacaggg

SEQ ID NO: 418 - DNA, 20 bp, Artificial Sequence
  Synthetic oligonucleotide; CAG chr11 5153975 5153994 5153991 +
tcatgacagggaggctgtat

SEQ ID NO: 419 - DNA, 20 bp, Artificial Sequence
  Synthetic oligonucleotide; TAG chr11 5154000 5154019 5154016 +
aacatacatttaccgtaaac

SEQ ID NO: 420 - DNA, 20 bp, Artificial Sequence
  Synthetic oligonucleotide; TAG chr11 5154003 5154022 5154019 +
atacatttaccgtaaactag

SEQ ID NO: 421 - DNA, 20 bp, Artificial Sequence
  Synthetic oligonucleotide; AGG chr11 5154004 5154023 5154020 +
tacatttaccgtaaactagt

SEQ ID NO: 422 - DNA, 20 bp, Artificial Sequence
  Synthetic oligonucleotide; CAG chr11 5154030 5154049 5154046 +
attaaatactttgatttcca

SEQ ID NO: 423 - DNA, 20 bp, Artificial Sequence
  Synthetic oligonucleotide; TAG chr11 5154050 5154069 5154066 +
cagatttgatccccaatgct

SEQ ID NO: 424 - DNA, 20 bp, Artificial Sequence
  Synthetic oligonucleotide; AAG chr11 5154074 5154093 5154090 +
tttatgacactcccatccat

SEQ ID NO: 425 - DNA, 20 bp, Artificial Sequence
  Synthetic oligonucleotide; TGG chr11 5154081 5154100 5154097 +
cactcccatccataagtcac

SEQ ID NO: 426 - DNA, 20 bp, Artificial Sequence
  Synthetic oligonucleotide; TAG chr11 5154094 5154113 5154110 +
aagtcactggctttttctaa

SEQ ID NO: 427 - DNA, 20 bp, Artificial Sequence
  Synthetic oligonucleotide; AGG chr11 5154095 5154114 5154111 +
agtcactggctttttctaat

SEQ ID NO: 428 - DNA, 20 bp, Artificial Sequence
  Synthetic oligonucleotide; GGG chr11 5154096 5154115 5154112 +
gtcactggctttttctaata

SEQ ID NO: 429 - DNA, 20 bp, Artificial Sequence
  Synthetic oligonucleotide; GGG chr11 5154097 5154116 5154113 +
tcactggctttttctaatag

SEQ ID NO: 430 - DNA, 20 bp, Artificial Sequence
  Synthetic oligonucleotide; AAG chr11 5154118 5154137 5154134 +
ggcaaattttttcttctcca

SEQ ID NO: 431 - DNA, 20 bp, Artificial Sequence
  Synthetic oligonucleotide; TAG chr11 5154132 5154151 5154148 +
tctccaaagataatcacaat

SEQ ID NO: 432 - DNA, 20 bp, Artificial Sequence
  Synthetic oligonucleotide; AAG chr11 5154138 5154157 5154154 +
aagataatcacaattagaat

SEQ ID NO: 433 - DNA, 20 bp, Artificial Sequence
  Synthetic oligonucleotide; TGG chr11 5154151 5154170 5154167 +
ttagaataagaatcctttaa

SEQ ID NO: 434 - DNA, 20 bp, Artificial Sequence
  Synthetic oligonucleotide; AAG chr11 5154177 5154196 5154193 +
tcacaatgtctgacttattc

SEQ ID NO: 435 - DNA, 20 bp, Artificial Sequence
  Synthetic oligonucleotide; AAG chr11 5154184 5154203 5154200 +
gtctgacttattcaagacca

SEQ ID NO: 436 - DNA, 20 bp, Artificial Sequence
  Synthetic oligonucleotide; GAG chr11 5154186 5154205 5154202 +
ctgacttattcaagaccaaa

SEQ ID NO: 437 - DNA, 20 bp, Artificial Sequence
  Synthetic oligonucleotide; GAG chr11 5154198 5154217 5154214 +
agaccaaagagctgacatgt

SEQ ID NO: 438 - DNA, 20 bp, Artificial Sequence
  Synthetic oligonucleotide; CAG chr11 5154211 5154230 5154227 +
gacatgtgagtactacctga

SEQ ID NO: 439 - DNA, 20 bp, Artificial Sequence
  Synthetic oligonucleotide; AGG chr11 5154212 5154231 5154228 +
acatgtgagtactacctgac

SEQ ID NO: 440 - DNA, 20 bp, Artificial Sequence
  Synthetic oligonucleotide; CAG chr11 5154217 5154236 5154233 +
tgagtactacctgacaggca

SEQ ID NO: 441 - DNA, 20 bp, Artificial Sequence
  Synthetic oligonucleotide; TAG chr11 5154221 5154240 5154237 +
tactacctgacaggcacaga

SEQ ID NO: 442 - DNA, 20 bp, Artificial Sequence
  Synthetic oligonucleotide; CAG chr11 5154224 5154243 5154240 +
tacctgacaggcacagatag

SEQ ID NO: 443 - DNA, 20 bp, Artificial Sequence
  Synthetic oligonucleotide; AGG chr11 5154225 5154244 5154241 +
acctgacaggcacagatagc

SEQ ID NO: 444 - DNA, 20 bp, Artificial Sequence
  Synthetic oligonucleotide; GGG chr11 5154226 5154245 5154242 +
cctgacaggcacagatagca

SEQ ID NO: 445 - DNA, 20 bp, Artificial Sequence
  Synthetic oligonucleotide; CAG chr11 5154232 5154251 5154248 +
aggcacagatagcagggttg

SEQ ID NO: 446 - DNA, 20 bp, Artificial Sequence
  Synthetic oligonucleotide; AGG chr11 5154233 5154252 5154249 +
ggcacagatagcagggttgc

SEQ ID NO: 447 - DNA, 20 bp, Artificial Sequence
  Synthetic oligonucleotide; TGG chr11 5154236 5154255 5154252 +
acagatagcagggttgcagg

SEQ ID NO: 448 - DNA, 20 bp, Artificial Sequence
  Synthetic oligonucleotide; TGG chr11 5154239 5154258 5154255 +
gatagcagggttgcaggtgg

SEQ ID NO: 449 - DNA, 20 bp, Artificial Sequence
  Synthetic oligonucleotide; AAG chr11 5154249 5154268 5154265 +
ttgcaggtggtggtgtatgt

SEQ ID NO: 450 - DNA, 20 bp, Artificial Sequence
  Synthetic oligonucleotide; TGG chr11 5154256 5154275 5154272 +
tggtggtgtatgtaagttcc

SEQ ID NO: 451 - DNA, 20 bp, Artificial Sequence
  Synthetic oligonucleotide; TAG chr11 5154260 5154279 5154276 +
ggtgtatgtaagttcctggt

SEQ ID NO: 452 - DNA, 20 bp, Artificial Sequence
  Synthetic oligonucleotide; TGG chr11 5154264 5154283 5154280 +
tatgtaagttcctggttagt

SEQ ID NO: 453 - DNA, 20 bp, Artificial Sequence
  Synthetic oligonucleotide; TAG chr11 5154268 5154287 5154284 +
taagttcctggttagttgga

SEQ ID NO: 454 - DNA, 20 bp, Artificial Sequence
  Synthetic oligonucleotide; GAG chr11 5154270 5154289 5154286 +
agttcctggttagttggata

SEQ ID NO: 455 - DNA, 20 bp, Artificial Sequence
  Synthetic oligonucleotide; TGG chr11 5154283 5154302 5154299 +
ttggatagagtgattgttat

SEQ ID NO: 456 - DNA, 20 bp, Artificial Sequence
  Synthetic oligonucleotide; GAG chr11 5154285 5154304 5154301 +
ggatagagtgattgttattg

SEQ ID NO: 457 - DNA, 20 bp, Artificial Sequence
  Synthetic oligonucleotide; AAG chr11 5154288 5154307 5154304 +
tagagtgattgttattggag

SEQ ID NO: 458 - DNA, 20 bp, Artificial Sequence
  Synthetic oligonucleotide; TGG chr11 5154292 5154311 5154308 +
gtgattgttattggagaagc

SEQ ID NO: 459 - DNA, 20 bp, Artificial Sequence
  Synthetic oligonucleotide; TGG chr11 5154306 5154325 5154322 +
agaagctggtaattaaatta

SEQ ID NO: 460 - DNA, 20 bp, Artificial Sequence
  Synthetic oligonucleotide; GAG chr11 5154308 5154327 5154324 +
aagctggtaattaaattatg

SEQ ID NO: 461 - DNA, 20 bp, Artificial Sequence
  Synthetic oligonucleotide; GAG chr11 5154310 5154329 5154326 +
gctggtaattaaattatgga

SEQ ID NO: 462 - DNA, 20 bp, Artificial Sequence
  Synthetic oligonucleotide; AGG chr11 5154311 5154330 5154327 +
ctggtaattaaattatggag

SEQ ID NO: 463 - DNA, 20 bp, Artificial Sequence
  Synthetic oligonucleotide; TGG chr11 5154319 5154338 5154335 +
taaattatggagaggaaact

SEQ ID NO: 464 - DNA, 20 bp, Artificial Sequence
  Synthetic oligonucleotide; GAG chr11 5154328 5154347 5154344 +
gagaggaaacttggaatcgt

SEQ ID NO: 465 - DNA, 20 bp, Artificial Sequence
  Synthetic oligonucleotide; GAG chr11 5154352 5154371 5154368 +
cttactcctcaattattatt

SEQ ID NO: 466 - DNA, 20 bp, Artificial Sequence
  Synthetic oligonucleotide; GAG chr11 5154354 5154373 5154370 +
tactcctcaattattattga

SEQ ID NO: 467 - DNA, 20 bp, Artificial Sequence
  Synthetic oligonucleotide; TGG chr11 5154358 5154377 5154374 +
cctcaattattattgagagc

SEQ ID NO: 468 - DNA, 20 bp, Artificial Sequence
  Synthetic oligonucleotide; CAG chr11 5154373 5154392 5154389 +
agagctggttttgctcttac

SEQ ID NO: 469 - DNA, 20 bp, Artificial Sequence
  Synthetic oligonucleotide; AAG chr11 5154383 5154402 5154399 +
ttgctcttaccagatacctg

SEQ ID NO: 470 - DNA, 20 bp, Artificial Sequence
  Synthetic oligonucleotide; AAG chr11 5154442 5154461 5154458 +
ctcaccaatttttcttctcc

SEQ ID NO: 471 - DNA, 20 bp, Artificial Sequence
  Synthetic oligonucleotide; AGG chr11 5154443 5154462 5154459 +
tcaccaatttttcttctcca

SEQ ID NO: 472 - DNA, 20 bp, Artificial Sequence
  Synthetic oligonucleotide; CAG chr11 5154450 5154469 5154466 +
tttttcttctccaaggattc

SEQ ID NO: 473 - DNA, 20 bp, Artificial Sequence
  Synthetic oligonucleotide; AAG chr11 5154465 5154484 5154481 +
gattccagcttcattccctt

SEQ ID NO: 474 - DNA, 20 bp, Artificial Sequence
  Synthetic oligonucleotide; TGG chr11 5154471 5154490 5154487 +
agcttcattcccttaagttg

SEQ ID NO: 475 - DNA, 20 bp, Artificial Sequence
  Synthetic oligonucleotide; GGG chr11 5154472 5154491 5154488 +
gcttcattcccttaagttgt

SEQ ID NO: 476 - DNA, 20 bp, Artificial Sequence
  Synthetic oligonucleotide; TGG chr11 5154483 5154502 5154499 +
ttaagttgtgggttctgtga

SEQ ID NO: 477 - DNA, 20 bp, Artificial Sequence
  Synthetic oligonucleotide; CAG chr11 5154514 5154533 5154530 +
tctgtctgcactctgtgtaa

SEQ ID NO: 478 - DNA, 20 bp, Artificial Sequence
  Synthetic oligonucleotide; CAG chr11 5154521 5154540 5154537 +
gcactctgtgtaacagcatc

SEQ ID NO: 479 - DNA, 20 bp, Artificial Sequence
  Synthetic oligonucleotide; TGG chr11 5154549 5154568 5154565 +
gtcataaattttactctgtt

SEQ ID NO: 480 - DNA, 20 bp, Artificial Sequence
  Synthetic oligonucleotide; CAG chr11 5154555 5154574 5154571 +
aattttactctgtttggtgc

SEQ ID NO: 481 - DNA, 20 bp, Artificial Sequence
  Synthetic oligonucleotide; AGG chr11 5154556 5154575 5154572 +
attttactctgtttggtgcc

SEQ ID NO: 482 - DNA, 20 bp, Artificial Sequence
  Synthetic oligonucleotide; TGG chr11 5154582 5154601 5154598 +
tgtgccaatataatatactg

SEQ ID NO: 483 - DNA, 20 bp, Artificial Sequence
  Synthetic oligonucleotide; CAG chr11 5154593 5154612 5154609 +
aatatactgtggacattttg

SEQ ID NO: 484 - DNA, 20 bp, Artificial Sequence
  Synthetic oligonucleotide; CGG chr11 5154629 5154648 5154645 +
cttttcatttatctctaaca

SEQ ID NO: 485 - DNA, 20 bp, Artificial Sequence
  Synthetic oligonucleotide; TGG chr11 5154649 5154668 5154665 +
cggacatcttcttcttcttc

SEQ ID NO: 486 - DNA, 20 bp, Artificial Sequence
  Synthetic oligonucleotide; AAG chr11 5154652 5154671 5154668 +
acatcttcttcttcttctgg

SEQ ID NO: 487 - DNA, 20 bp, Artificial Sequence
  Synthetic oligonucleotide; CAG chr11 5154662 5154681 5154678 +
cttcttctggaagtctgtct

SEQ ID NO: 488 - DNA, 20 bp, Artificial Sequence
  Synthetic oligonucleotide; CAG chr11 5154688 5154707 5154704 +
atctttgtgtgctcatcccc

SEQ ID NO: 489 - DNA, 20 bp, Artificial Sequence
  Synthetic oligonucleotide; TAG chr11 5154700 5154719 5154716 +
tcatcccccagtaaaactca

SEQ ID NO: 490 - DNA, 20 bp, Artificial Sequence
  Synthetic oligonucleotide; GAG chr11 5154704 5154723 5154720 +
cccccagtaaaactcatagt

SEQ ID NO: 491 - DNA, 20 bp, Artificial Sequence
  Synthetic oligonucleotide; AGG chr11 5154705 5154724 5154721 +
ccccagtaaaactcatagtg

SEQ ID NO: 492 - DNA, 20 bp, Artificial Sequence
  Synthetic oligonucleotide; TAG chr11 5154712 5154731 5154728 +
aaaactcatagtgaggtctg

SEQ ID NO: 493 - DNA, 20 bp, Artificial Sequence
  Synthetic oligonucleotide; CGG chr11 5154727 5154746 5154743 +
gtctgtagcattctgaaaca

SEQ ID NO: 494 - DNA, 20 bp, Artificial Sequence
  Synthetic oligonucleotide; GGG chr11 5154728 5154747 5154744 +
tctgtagcattctgaaacac

SEQ ID NO: 495 - DNA, 20 bp, Artificial Sequence
  Synthetic oligonucleotide; GAG chr11 5154742 5154761 5154758 +
aaacacgggatgaatttatt

SEQ ID NO: 496 - DNA, 20 bp, Artificial Sequence
  Synthetic oligonucleotide; TGG chr11 5154752 5154771 5154768 +
tgaatttattgagctcaaat

SEQ ID NO: 497 - DNA, 20 bp, Artificial Sequence
  Synthetic oligonucleotide; GAG chr11 5154754 5154773 5154770 +
aatttattgagctcaaattg

SEQ ID NO: 498 - DNA, 20 bp, Artificial Sequence
  Synthetic oligonucleotide; AAG chr11 5154761 5154780 5154777 +
tgagctcaaattggagaaaa

SEQ ID NO: 499 - DNA, 20 bp, Artificial Sequence
  Synthetic oligonucleotide; TGG chr11 5154764 5154783 5154780 +
gctcaaattggagaaaaaag

SEQ ID NO: 500 - DNA, 20 bp, Artificial Sequence
  Synthetic oligonucleotide; TGG chr11 5154801 5154820 5154817 +
aatattcctttatgaatgtg

SEQ ID NO: 501 - DNA, 20 bp, Artificial Sequence
  Synthetic oligonucleotide; GAG chr11 5154803 5154822 5154819 +
tattcctttatgaatgtgtg

SEQ ID NO: 502 - DNA, 20 bp, Artificial Sequence
  Synthetic oligonucleotide; AAG chr11 5154806 5154825 5154822 +
tcctttatgaatgtgtggag

SEQ ID NO: 503 - DNA, 20 bp, Artificial Sequence
  Synthetic oligonucleotide; TAG chr11 5154809 5154828 5154825 +
tttatgaatgtgtggagaag

SEQ ID NO: 504 - DNA, 20 bp, Artificial Sequence
  Synthetic oligonucleotide; AGG chr11 5154810 5154829 5154826 +
ttatgaatgtgtggagaagt

SEQ ID NO: 505 - DNA, 20 bp, Artificial Sequence
  Synthetic oligonucleotide; GAG chr11 5154812 5154831 5154828 +
atgaatgtgtggagaagtag

SEQ ID NO: 506 - DNA, 20 bp, Artificial Sequence
  Synthetic oligonucleotide; AGG chr11 5154813 5154832 5154829 +
tgaatgtgtggagaagtagg

SEQ ID NO: 507 - DNA, 20 bp, Artificial Sequence
  Synthetic oligonucleotide; GAG chr11 5154815 5154834 5154831 +
aatgtgtggagaagtaggag

SEQ ID NO: 508 - DNA, 20 bp, Artificial Sequence
  Synthetic oligonucleotide; GAG chr11 5154822 5154841 5154838 +
ggagaagtaggaggagttat

SEQ ID NO: 509 - DNA, 20 bp, Artificial Sequence
  Synthetic oligonucleotide; GAG chr11 5154833 5154852 5154849 +
aggagttatgagcatgaaat

SEQ ID NO: 510 - DNA, 20 bp, Artificial Sequence
  Synthetic oligonucleotide; AGG chr11 5154834 5154853 5154850 +
ggagttatgagcatgaaatg

SEQ ID NO: 511 - DNA, 20 bp, Artificial Sequence
  Synthetic oligonucleotide; GGG chr11 5154835 5154854 5154851 +
gagttatgagcatgaaatga

SEQ ID NO: 512 - DNA, 20 bp, Artificial Sequence
  Synthetic oligonucleotide; TAG chr11 5154844 5154863 5154860 +
gcatgaaatgagggatttcc

SEQ ID NO: 513 - DNA, 20 bp, Artificial Sequence
  Synthetic oligonucleotide; TAG chr11 5154851 5154870 5154867 +
atgagggatttcctagttga

SEQ ID NO: 514 - DNA, 20 bp, Artificial Sequence
  Synthetic oligonucleotide; GAG chr11 5154864 5154883 5154880 +
tagttgatagccaaaaccac

SEQ ID NO: 515 - DNA, 20 bp, Artificial Sequence
  Synthetic oligonucleotide; AGG chr11 5154865 5154884 5154881 +
agttgatagccaaaaccacg

SEQ ID NO: 516 - DNA, 20 bp, Artificial Sequence
  Synthetic oligonucleotide; GGG chr11 5154866 5154885 5154882 +
gttgatagccaaaaccacga

SEQ ID NO: 517 - DNA, 20 bp, Artificial Sequence
  Synthetic oligonucleotide; CAG chr11 5154872 5154891 5154888 +
agccaaaaccacgagggacc

SEQ ID NO: 518 - DNA, 20 bp, Artificial Sequence
  Synthetic oligonucleotide; AAG chr11 5154883 5154902 5154899 +
cgagggacccagcaaatttt

SEQ ID NO: 519 - DNA, 20 bp, Artificial Sequence
  Synthetic oligonucleotide; CAG chr11 5154887 5154906 5154903 +
ggacccagcaaattttaagt

SEQ ID NO: 520 - DNA, 20 bp, Artificial Sequence
  Synthetic oligonucleotide; TGG chr11 5154896 5154915 5154912 +
aaattttaagtcagccctct

SEQ ID NO: 521 - DNA, 20 bp, Artificial Sequence
  Synthetic oligonucleotide; GGG chr11 5154897 5154916 5154913 +
aattttaagtcagccctctt

SEQ ID NO: 522 - DNA, 20 bp, Artificial Sequence
  Synthetic oligonucleotide; TGG chr11 5154905 5154924 5154921 +
gtcagccctcttgggttcac

SEQ ID NO: 523 - DNA, 20 bp, Artificial Sequence
  Synthetic oligonucleotide; CAG chr11 5154941 5154960 5154957 +
cgtaattatttctacacttg

SEQ ID NO: 524 - DNA, 20 bp, Artificial Sequence
  Synthetic oligonucleotide; CAG chr11 5154976 5154995 5154992 +
tctctttttctcttttccca

SEQ ID NO: 525 - DNA, 20 bp, Artificial Sequence
  Synthetic oligonucleotide; AGG chr11 5154977 5154996 5154993 +
ctctttttctcttttcccac

SEQ ID NO: 526 - DNA, 20 bp, Artificial Sequence
  Synthetic oligonucleotide; CAG chr11 5154987 5155006 5155003 +
cttttcccacaggctaaatg

SEQ ID NO: 527 - DNA, 20 bp, Artificial Sequence
  Synthetic oligonucleotide; AAG chr11 5155019 5155038 5155035 +
tatgcaaaaaatttttttac

SEQ ID NO: 528 - DNA, 20 bp, Artificial Sequence
  Synthetic oligonucleotide; AAG chr11 5155061 5155080 5155077 +
tttctatttgcaaaattcta

SEQ ID NO: 529 - DNA, 20 bp, Artificial Sequence
  Synthetic oligonucleotide; TGG chr11 5155116 5155135 5155132 +
tcctatttaaataaatatct

SEQ ID NO: 530 - DNA, 20 bp, Artificial Sequence
  Synthetic oligonucleotide; GAG chr11 5155132 5155151 5155148 +
atcttggtgacattttcact

SEQ ID NO: 531 - DNA, 20 bp, Artificial Sequence
  Synthetic oligonucleotide; AGG chr11 5155133 5155152 5155149 +
tcttggtgacattttcactg

SEQ ID NO: 532 - DNA, 20 bp, Artificial Sequence
  Synthetic oligonucleotide; AAG chr11 5155137 5155156 5155153 +
ggtgacattttcactgaggc

SEQ ID NO: 533 - DNA, 20 bp, Artificial Sequence
  Synthetic oligonucleotide; AGG chr11 5155138 5155157 5155154 +
gtgacattttcactgaggca

SEQ ID NO: 534 - DNA, 20 bp, Artificial Sequence
  Synthetic oligonucleotide; CAG chr11 5155157 5155176 5155173 +
aaggtttttctctttttatt

SEQ ID NO: 535 - DNA, 20 bp, Artificial Sequence
  Synthetic oligonucleotide; AAG chr11 5155162 5155181 5155178 +
ttttctctttttattcagaa

SEQ ID NO: 536 - DNA, 20 bp, Artificial Sequence
  Synthetic oligonucleotide; CAG chr11 5155210 5155229 5155226 +
ttaccacacaattacttcct

SEQ ID NO: 537 - DNA, 20 bp, Artificial Sequence
  Synthetic oligonucleotide; CAG chr11 5155220 5155239 5155236 +
attacttcctcagtcttctt

SEQ ID NO: 538 - DNA, 20 bp, Artificial Sequence
  Synthetic oligonucleotide; AAG chr11 5155250 5155269 5155266 +
cttcccattttattttattg

SEQ ID NO: 539 - DNA, 20 bp, Artificial Sequence
  Synthetic oligonucleotide; TAG chr11 5155267 5155286 5155283 +
ttgaagttttttttatcttt

SEQ ID NO: 540 - DNA, 20 bp, Artificial Sequence
  Synthetic oligonucleotide; AAG chr11 5155276 5155295 5155292 +
tttttatcttttagtaaatt

SEQ ID NO: 541 - DNA, 20 bp, Artificial Sequence
  Synthetic oligonucleotide; TAG chr11 5155290 5155309 5155306 +
taaattaagtaacattctta

SEQ ID NO: 542 - DNA, 20 bp, Artificial Sequence
  Synthetic oligonucleotide; TGG chr11 5155306 5155325 5155322 +
cttatagtgacaaattataa

SEQ ID NO: 543 - DNA, 20 bp, Artificial Sequence
  Synthetic oligonucleotide; AAG chr11 5155317 5155336 5155333 +
aaattataatggacatttct

SEQ ID NO: 544 - DNA, 20 bp, Artificial Sequence
  Synthetic oligonucleotide; AAG chr11 5155333 5155352 5155349 +
ttctaagtcctacaaatgta

SEQ ID NO: 545 - DNA, 20 bp, Artificial Sequence
  Synthetic oligonucleotide; TGG chr11 5155337 5155356 5155353 +
aagtcctacaaatgtaaagc

SEQ ID NO: 546 - DNA, 20 bp, Artificial Sequence
  Synthetic oligonucleotide; AAG chr11 5155340 5155359 5155356 +
tcctacaaatgtaaagctgg

SEQ ID NO: 547 - DNA, 20 bp, Artificial Sequence
  Synthetic oligonucleotide; AAG chr11 5155344 5155363 5155360 +
acaaatgtaaagctggaagc

SEQ ID NO: 548 - DNA, 20 bp, Artificial Sequence
  Synthetic oligonucleotide; GAG chr11 5155360 5155379 5155376 +
aagcaagttgttgaacattt

SEQ ID NO: 549 - DNA, 20 bp, Artificial Sequence
  Synthetic oligonucleotide; TGG chr11 5155368 5155387 5155384 +
tgttgaacatttgagtaaac

SEQ ID NO: 550 - DNA, 20 bp, Artificial Sequence
  Synthetic oligonucleotide; CAG chr11 5155436 5155455 5155452 +
cttctttttctttcaaaaaa

SEQ ID NO: 551 - DNA, 20 bp, Artificial Sequence
  Synthetic oligonucleotide; GAG chr11 5155461 5155480 5155477 +
attatattcctactatttat

SEQ ID NO: 552 - DNA, 20 bp, Artificial Sequence
  Synthetic oligonucleotide; GAG chr11 5155465 5155484 5155481 +
tattcctactatttatgagt

SEQ ID NO: 553 - DNA, 20 bp, Artificial Sequence
  Synthetic oligonucleotide; TAG chr11 5155502 5155521 5155518 +
aaatgaaatgaaaaaaatta

SEQ ID NO: 554 - DNA, 20 bp, Artificial Sequence
  Synthetic oligonucleotide; TAG chr11 5155522 5155541 5155538 +
tagtcttacctttaaattat

SEQ ID NO: 555 - DNA, 20 bp, Artificial Sequence
  Synthetic oligonucleotide; TGG chr11 5155530 5155549 5155546 +
cctttaaattattagtaaaa

SEQ ID NO: 556 - DNA, 20 bp, Artificial Sequence
  Synthetic oligonucleotide; GGG chr11 5155531 5155550 5155547 +
ctttaaattattagtaaaat

SEQ ID NO: 557 - DNA, 20 bp, Artificial Sequence
  Synthetic oligonucleotide; AAG chr11 5155563 5155582 5155579 +
tacaatttcatttatcacgt

SEQ ID NO: 558 - DNA, 20 bp, Artificial Sequence
  Synthetic oligonucleotide; AAG chr11 5155581 5155600 5155597 +
gtaagtatctgataaattct

SEQ ID NO: 559 - DNA, 20 bp, Artificial Sequence
  Synthetic oligonucleotide; AAG chr11 5155585 5155604 5155601 +
gtatctgataaattctaagc

SEQ ID NO: 560 - DNA, 20 bp, Artificial Sequence
  Synthetic oligonucleotide; CAG chr11 5155624 5155643 5155640 +
ctattctccttgacatttta

SEQ ID NO: 561 - DNA, 20 bp, Artificial Sequence
  Synthetic oligonucleotide; TGG chr11 5155628 5155647 5155644 +
tctccttgacattttacagc

SEQ ID NO: 562 - DNA, 20 bp, Artificial Sequence
  Synthetic oligonucleotide; TAG chr11 5155635 5155654 5155651 +
gacattttacagctggtttc

SEQ ID NO: 563 - DNA, 20 bp, Artificial Sequence
  Synthetic oligonucleotide; AGG chr11 5155636 5155655 5155652 +
acattttacagctggtttct

SEQ ID NO: 564 - DNA, 20 bp, Artificial Sequence
  Synthetic oligonucleotide; TAG chr11 5155651 5155670 5155667 +
tttctaggctttcttgaatg

SEQ ID NO: 565 - DNA, 20 bp, Artificial Sequence
  Synthetic oligonucleotide; AAG chr11 5155656 5155675 5155672 +
aggctttcttgaatgtagct

SEQ ID NO: 566 - DNA, 20 bp, Artificial Sequence
  Synthetic oligonucleotide; GAG chr11 5155658 5155677 5155674 +
gctttcttgaatgtagctaa

SEQ ID NO: 567 - DNA, 20 bp, Artificial Sequence
  Synthetic oligonucleotide; TAG chr11 5155678 5155697 5155694 +
gagacacttgatataatgtt

SEQ ID NO: 568 - DNA, 20 bp, Artificial Sequence
  Synthetic oligonucleotide; TGG chr11 5155685 5155704 5155701 +
ttgatataatgtttagacat

SEQ ID NO: 569 - DNA, 20 bp, Artificial Sequence
  Synthetic oligonucleotide; TAG chr11 5155694 5155713 5155710 +
tgtttagacattggcaaatt

SEQ ID NO: 570 - DNA, 20 bp, Artificial Sequence
  Synthetic oligonucleotide; AGG chr11 5155695 5155714 5155711 +
gtttagacattggcaaattt

SEQ ID NO: 571 - DNA, 20 bp, Artificial Sequence
  Synthetic oligonucleotide; AAG chr11 5155698 5155717 5155714 +
tagacattggcaaatttagg

SEQ ID NO: 572 - DNA, 20 bp, Artificial Sequence
  Synthetic oligonucleotide; TGG chr11 5155709 5155728 5155725 +
aaatttaggaagcatactaa

SEQ ID NO: 573 - DNA, 20 bp, Artificial Sequence
  Synthetic oligonucleotide; TGG chr11 5155712 5155731 5155728 +
tttaggaagcatactaatgg

SEQ ID NO: 574 - DNA, 20 bp, Artificial Sequence
  Synthetic oligonucleotide; GAG chr11 5155714 5155733 5155730 +
taggaagcatactaatggtg

SEQ ID NO: 575 - DNA, 20 bp, Artificial Sequence
  Synthetic oligonucleotide; TGG chr11 5155728 5155747 5155744 +
atggtggagaatatttataa

SEQ ID NO: 576 - DNA, 20 bp, Artificial Sequence
  Synthetic oligonucleotide; CAG chr11 5155736 5155755 5155752 +
gaatatttataatggatttc

SEQ ID NO: 577 - DNA, 20 bp, Artificial Sequence
  Synthetic oligonucleotide; AGG chr11 5155737 5155756 5155753 +
aatatttataatggatttcc

SEQ ID NO: 578 - DNA, 20 bp, Artificial Sequence
  Synthetic oligonucleotide; GAG chr11 5155739 5155758 5155755 +
tatttataatggatttccag

SEQ ID NO: 579 - DNA, 20 bp, Artificial Sequence
  Synthetic oligonucleotide; AAG chr11 5155745 5155764 5155761 +
taatggatttccaggagaac

SEQ ID NO: 580 - DNA, 20 bp, Artificial Sequence
  Synthetic oligonucleotide; AGG chr11 5155746 5155765 5155762 +
aatggatttccaggagaaca

SEQ ID NO: 581 - DNA, 20 bp, Artificial Sequence
  Synthetic oligonucleotide; CAG chr11 5155753 5155772 5155769 +
ttccaggagaacaaggaata

SEQ ID NO: 582 - DNA, 20 bp, Artificial Sequence
  Synthetic oligonucleotide; AAG chr11 5155761 5155780 5155777 +
gaacaaggaatacagatgaa

SEQ ID NO: 583 - DNA, 20 bp, Artificial Sequence
  Synthetic oligonucleotide; AGG chr11 5155762 5155781 5155778 +
aacaaggaatacagatgaaa

SEQ ID NO: 584 - DNA, 20 bp, Artificial Sequence
  Synthetic oligonucleotide; AAG chr11 5155766 5155785 5155782 +
aggaatacagatgaaaaggc

SEQ ID NO: 585 - DNA, 20 bp, Artificial Sequence
  Synthetic oligonucleotide; AGG chr11 5155767 5155786 5155783 +
ggaatacagatgaaaaggca

SEQ ID NO: 586 - DNA, 20 bp, Artificial Sequence
  Synthetic oligonucleotide; CAG chr11 5155788 5155807 5155804 +
ggaaccccatgtgctctttc

SEQ ID NO: 587 - DNA, 20 bp, Artificial Sequence
  Synthetic oligonucleotide; AAG chr11 5155804 5155823 5155820 +
tttccagaatttcctctgtg

SEQ ID NO: 588 - DNA, 20 bp, Artificial Sequence
  Synthetic oligonucleotide; AGG chr11 5155805 5155824 5155821 +
ttccagaatttcctctgtga

SEQ ID NO: 589 - DNA, 20 bp, Artificial Sequence
  Synthetic oligonucleotide; GAG chr11 5155807 5155826 5155823 +
ccagaatttcctctgtgaag

SEQ ID NO: 590 - DNA, 20 bp, Artificial Sequence
  Synthetic oligonucleotide; TAG chr11 5155820 5155839 5155836 +
tgtgaaggagcataaaacaa

SEQ ID NO: 591 - DNA, 20 bp, Artificial Sequence
  Synthetic oligonucleotide; CAG chr11 5155851 5155870 5155867 +
catgttgaatgaaattgatt

SEQ ID NO: 592 - DNA, 20 bp, Artificial Sequence
  Synthetic oligonucleotide; GAG chr11 5155853 5155872 5155869 +
tgttgaatgaaattgattca

SEQ ID NO: 593 - DNA, 20 bp, Artificial Sequence
  Synthetic oligonucleotide; GAG chr11 5155855 5155874 5155871 +
ttgaatgaaattgattcaga

SEQ ID NO: 594 - DNA, 20 bp, Artificial Sequence
  Synthetic oligonucleotide; TAG chr11 5155862 5155881 5155878 +
aaattgattcagagagcata

SEQ ID NO: 595 - DNA, 20 bp, Artificial Sequence
  Synthetic oligonucleotide; AGG chr11 5155863 5155882 5155879 +
aattgattcagagagcatat

SEQ ID NO: 596 - DNA, 20 bp, Artificial Sequence
  Synthetic oligonucleotide; CAG chr11 5155866 5155885 5155882 +
tgattcagagagcatatagg

SEQ ID NO: 597 - DNA, 20 bp, Artificial Sequence
  Synthetic oligonucleotide; CAG chr11 5155882 5155901 5155898 +
taggcagctaatctaatatt

SEQ ID NO: 598 - DNA, 20 bp, Artificial Sequence
  Synthetic oligonucleotide; AGG chr11 5155883 5155902 5155899 +
aggcagctaatctaatattc

SEQ ID NO: 599 - DNA, 20 bp, Artificial Sequence
  Synthetic oligonucleotide; AAG chr11 5155902 5155921 5155918 +
caggttattcttttgtcact

SEQ ID NO: 600 - DNA, 20 bp, Artificial Sequence
  Synthetic oligonucleotide; TAG chr11 5155913 5155932 5155929 +
tttgtcactaagaaacaatt

SEQ ID NO: 601 - DNA, 20 bp, Artificial Sequence
  Synthetic oligonucleotide; TAG chr11 5155918 5155937 5155934 +
cactaagaaacaatttagac

SEQ ID NO: 602 - DNA, 20 bp, Artificial Sequence
  Synthetic oligonucleotide; TGG chr11 5155930 5155949 5155946 +
atttagactagtataccatt

SEQ ID NO: 603 - DNA, 20 bp, Artificial Sequence
  Synthetic oligonucleotide; TGG chr11 5155970 5155989 5155986 +
atactgattttatttaaatt

SEQ ID NO: 604 - DNA, 20 bp, Artificial Sequence
  Synthetic oligonucleotide; GGG chr11 5155971 5155990 5155987 +
tactgattttatttaaattt

SEQ ID NO: 605 - DNA, 20 bp, Artificial Sequence
  Synthetic oligonucleotide; GGG chr11 5155972 5155991 5155988 +
actgattttatttaaatttg

SEQ ID NO: 606 - DNA, 20 bp, Artificial Sequence
  Synthetic oligonucleotide; GGG chr11 5155973 5155992 5155989 +
ctgattttatttaaatttgg

SEQ ID NO: 607 - DNA, 20 bp, Artificial Sequence
  Synthetic oligonucleotide; AAG chr11 5155983 5156002 5155999 +
ttaaatttgggggctctcca

SEQ ID NO: 608 - DNA, 20 bp, Artificial Sequence
  Synthetic oligonucleotide; TGG chr11 5155994 5156013 5156010 +
ggctctccaaagttctatct

SEQ ID NO: 609 - DNA, 20 bp, Artificial Sequence
  Synthetic oligonucleotide; GGG chr11 5155995 5156014 5156011 +
gctctccaaagttctatctt

SEQ ID NO: 610 - DNA, 20 bp, Artificial Sequence
  Synthetic oligonucleotide; TGG chr11 5156028 5156047 5156044 +
ctaaaactattcacatgtgc

SEQ ID NO: 611 - DNA, 20 bp, Artificial Sequence
  Synthetic oligonucleotide; TAG chr11 5156055 5156074 5156071 +
tccatctactccaaataatt

SEQ ID NO: 612 - DNA, 20 bp, Artificial Sequence
  Synthetic oligonucleotide; CAG chr11 5156096 5156115 5156112 +
aactcctataacaatatttc

SEQ ID NO: 613 - DNA, 20 bp, Artificial Sequence
  Synthetic oligonucleotide; CAG chr11 5156101 5156120 5156117 +
ctataacaatatttccagcc

SEQ ID NO: 614 - DNA, 20 bp, Artificial Sequence
  Synthetic oligonucleotide; AAG chr11 5156122 5156141 5156138 +
agattttctccctctgttcc

SEQ ID NO: 615 - DNA, 20 bp, Artificial Sequence
  Synthetic oligonucleotide; CAG chr11 5156129 5156148 5156145 +
ctccctctgttccaagtaca

SEQ ID NO: 616 - DNA, 20 bp, Artificial Sequence
  Synthetic oligonucleotide; AGG chr11 5156130 5156149 5156146 +
tccctctgttccaagtacac

SEQ ID NO: 617 - DNA, 20 bp, Artificial Sequence
  Synthetic oligonucleotide; CAG chr11 5156135 5156154 5156151 +
ctgttccaagtacacaggaa

SEQ ID NO: 618 - DNA, 20 bp, Artificial Sequence
  Synthetic oligonucleotide; TAG chr11 5156156 5156175 5156172 +
agcatgtactgcccaaattt

SEQ ID NO: 619 - DNA, 20 bp, Artificial Sequence
  Synthetic oligonucleotide; GAG chr11 5156192 5156211 5156208 +
tcctttgaaacattgtcaat

SEQ ID NO: 620 - DNA, 20 bp, Artificial Sequence
  Synthetic oligonucleotide; AAG chr11 5156210 5156229 5156226 +
atgagttctacacttaattc

SEQ ID NO: 621 - DNA, 20 bp, Artificial Sequence
  Synthetic oligonucleotide; AGG chr11 5156211 5156230 5156227 +
tgagttctacacttaattca

SEQ ID NO: 622 - DNA, 20 bp, Artificial Sequence
  Synthetic oligonucleotide; TGG chr11 5156244 5156263 5156260 +
ttcattgtacttgtaaatat

SEQ ID NO: 623 - DNA, 20 bp, Artificial Sequence
  Synthetic oligonucleotide; AAG chr11 5156247 5156266 5156263 +
attgtacttgtaaatattgg

SEQ ID NO: 624 - DNA, 20 bp, Artificial Sequence
  Synthetic oligonucleotide; TGG chr11 5156279 5156298 5156295 +
tatgcatcaataactatctc

SEQ ID NO: 625 - DNA, 20 bp, Artificial Sequence
  Synthetic oligonucleotide; TAG chr11 5156289 5156308 5156305 +
taactatctctggatttttt

SEQ ID NO: 626 - DNA, 20 bp, Artificial Sequence
  Synthetic oligonucleotide; TAG chr11 5156293 5156312 5156309 +
tatctctggatttttttagc

SEQ ID NO: 627 - DNA, 20 bp, Artificial Sequence
  Synthetic oligonucleotide; GAG chr11 5156324 5156343 5156340 +
attttttttttctttttttt

SEQ ID NO: 628 - DNA, 20 bp, Artificial Sequence
  Synthetic oligonucleotide; CAG chr11 5156328 5156347 5156344 +
tttttttcttttttttgaga

SEQ ID NO: 629 - DNA, 20 bp, Artificial Sequence
  Synthetic oligonucleotide; GAG chr11 5156330 5156349 5156346 +
tttttcttttttttgagaca

SEQ ID NO: 630 - DNA, 20 bp, Artificial Sequence
  Synthetic oligonucleotide; CAG chr11 5156348 5156367 5156364 +
cagagtctctctctgtcgcc

SEQ ID NO: 631 - DNA, 20 bp, Artificial Sequence
  Synthetic oligonucleotide; AGG chr11 5156349 5156368 5156365 +
agagtctctctctgtcgccc

SEQ ID NO: 632 - DNA, 20 bp, Artificial Sequence
  Synthetic oligonucleotide; TGG chr11 5156353 5156372 5156369 +
tctctctctgtcgcccaggc

SEQ ID NO: 633 - DNA, 20 bp, Artificial Sequence
  Synthetic oligonucleotide; GAG chr11 5156355 5156374 5156371 +
tctctctgtcgcccaggctg

SEQ ID NO: 634 - DNA, 20 bp, Artificial Sequence
  Synthetic oligonucleotide; CAG chr11 5156360 5156379 5156376 +
ctgtcgcccaggctggagtg

SEQ ID NO: 635 - DNA, 20 bp, Artificial Sequence
  Synthetic oligonucleotide; TGG chr11 5156363 5156382 5156379 +
tcgcccaggctggagtgcag

SEQ ID NO: 636 - DNA, 20 bp, Artificial Sequence
  Synthetic oligonucleotide; AAG chr11 5156387 5156406 5156403 +
ccctgatctctgctcactgc

SEQ ID NO: 637 - DNA, 20 bp, Artificial Sequence
  Synthetic oligonucleotide; CAG chr11 5156424 5156443 5156440 +
ttcacgccattctcccgcct

SEQ ID NO: 638 - DNA, 20 bp, Artificial Sequence
  Synthetic oligonucleotide; TAG chr11 5156433 5156452 5156449 +
ttctcccgcctcagcctcca

SEQ ID NO: 639 - DNA, 20 bp, Artificial Sequence
  Synthetic oligonucleotide; TAG chr11 5156436 5156455 5156452 +
tcccgcctcagcctccatag

SEQ ID NO: 640 - DNA, 20 bp, Artificial Sequence
  Synthetic oligonucleotide; TGG chr11 5156440 5156459 5156456 +
gcctcagcctccatagtagc

SEQ ID NO: 641 - DNA, 20 bp, Artificial Sequence
  Synthetic oligonucleotide; GGG chr11 5156441 5156460 5156457 +
cctcagcctccatagtagct

SEQ ID NO: 642 - DNA, 20 bp, Artificial Sequence
  Synthetic oligonucleotide; CAG chr11 5156448 5156467 5156464 +
ctccatagtagctgggacta

SEQ ID NO: 643 - DNA, 20 bp, Artificial Sequence
  Synthetic oligonucleotide; AGG chr11 5156449 5156468 5156465 +
tccatagtagctgggactac

SEQ ID NO: 644 - DNA, 20 bp, Artificial Sequence
  Synthetic oligonucleotide; AAG chr11 5156463 5156482 5156479 +
gactacaggcacccgccacc

SEQ ID NO: 645 - DNA, 20 bp, Artificial Sequence
  Synthetic oligonucleotide; CGG chr11 5156468 5156487 5156484 +
caggcacccgccaccaagcc

SEQ ID NO: 646 - DNA, 20 bp, Artificial Sequence
  Synthetic oligonucleotide; TAG chr11 5156490 5156509 5156506 +
gctaattttttgtatttttt

SEQ ID NO: 647 - DNA, 20 bp, Artificial Sequence
  Synthetic oligonucleotide; TAG chr11 5156493 5156512 5156509 +
aattttttgtatttttttag

SEQ ID NO: 648 - DNA, 20 bp, Artificial Sequence
  Synthetic oligonucleotide; GAG chr11 5156495 5156514 5156511 +
ttttttgtatttttttagta

SEQ ID NO: 649 - DNA, 20 bp, Artificial Sequence
  Synthetic oligonucleotide; CGG chr11 5156499 5156518 5156515 +
ttgtatttttttagtagaga

SEQ ID NO: 650 - DNA, 20 bp, Artificial Sequence
  Synthetic oligonucleotide; GGG chr11 5156500 5156519 5156516 +
tgtatttttttagtagagac

SEQ ID NO: 651 - DNA, 20 bp, Artificial Sequence
  Synthetic oligonucleotide; GGG chr11 5156501 5156520 5156517 +
gtatttttttagtagagacg

SEQ ID NO: 652 - DNA, 20 bp, Artificial Sequence
  Synthetic oligonucleotide; TAG chr11 5156515 5156534 5156531 +
gagacggggtttcactgtgt

SEQ ID NO: 653 - DNA, 20 bp, Artificial Sequence
  Synthetic oligonucleotide; CAG chr11 5156519 5156538 5156535 +
cggggtttcactgtgttagc

SEQ ID NO: 654 - DNA, 20 bp, Artificial Sequence
  Synthetic oligonucleotide; AGG chr11 5156520 5156539 5156536 +
ggggtttcactgtgttagcc

SEQ ID NO: 655 - DNA, 20 bp, Artificial Sequence
  Synthetic oligonucleotide; TGG chr11 5156524 5156543 5156540 +
tttcactgtgttagccagga

SEQ ID NO: 656 - DNA, 20 bp, Artificial Sequence
  Synthetic oligonucleotide; AAG chr11 5156570 5156589 5156586 +
ccacccgcctccgcctccca

SEQ ID NO: 657 - DNA, 20 bp, Artificial Sequence
  Synthetic oligonucleotide; TGG chr11 5156576 5156595 5156592 +
gcctccgcctcccaaagtgc

SEQ ID NO: 658 - DNA, 20 bp, Artificial Sequence
  Synthetic oligonucleotide; GGG chr11 5156577 5156596 5156593 +
cctccgcctcccaaagtgct

SEQ ID NO: 659 - DNA, 20 bp, Artificial Sequence
  Synthetic oligonucleotide; CAG chr11 5156584 5156603 5156600 +
ctcccaaagtgctgggatca

SEQ ID NO: 660 - DNA, 20 bp, Artificial Sequence
  Synthetic oligonucleotide; AGG chr11 5156585 5156604 5156601 +
tcccaaagtgctgggatcac

SEQ ID NO: 661 - DNA, 20 bp, Artificial Sequence
  Synthetic oligonucleotide; GAG chr11 5156591 5156610 5156607 +
agtgctgggatcacaggcgt

SEQ ID NO: 662 - DNA, 20 bp, Artificial Sequence
  Synthetic oligonucleotide; CGG chr11 5156604 5156623 5156620 +
caggcgtgagccactgcacc

SEQ ID NO: 663 - DNA, 20 bp, Artificial Sequence
  Synthetic oligonucleotide; AAG chr11 5156639 5156658 5156655 +
tttttaaatttatttttatt

SEQ ID NO: 664 - DNA, 20 bp, Artificial Sequence
  Synthetic oligonucleotide; AGG chr11 5156640 5156659 5156656 +
ttttaaatttatttttatta

SEQ ID NO: 665 - DNA, 20 bp, Artificial Sequence
  Synthetic oligonucleotide; GAG chr11 5156690 5156709 5156706 +
tttactttttttttttcctt

SEQ ID NO: 666 - DNA, 20 bp, Artificial Sequence
  Synthetic oligonucleotide; CGG chr11 5156694 5156713 5156710 +
ctttttttttttccttgaga

SEQ ID NO: 667 - DNA, 20 bp, Artificial Sequence
  Synthetic oligonucleotide; GAG chr11 5156696 5156715 5156712 +
ttttttttttccttgagacg

SEQ ID NO: 668 - DNA, 20 bp, Artificial Sequence
  Synthetic oligonucleotide; CAG chr11 5156714 5156733 5156730 +
cggagtctcgctccgtcatc

SEQ ID NO: 669 - DNA, 20 bp, Artificial Sequence
  Synthetic oligonucleotide; AGG chr11 5156715 5156734 5156731 +
ggagtctcgctccgtcatcc

SEQ ID NO: 670 - DNA, 20 bp, Artificial Sequence
  Synthetic oligonucleotide; TGG chr11 5156719 5156738 5156735 +
tctcgctccgtcatccaggc

SEQ ID NO: 671 - DNA, 20 bp, Artificial Sequence
  Synthetic oligonucleotide; GAG chr11 5156721 5156740 5156737 +
tcgctccgtcatccaggctg

SEQ ID NO: 672 - DNA, 20 bp, Artificial Sequence
  Synthetic oligonucleotide; CAG chr11 5156726 5156745 5156742 +
ccgtcatccaggctggagtg

SEQ ID NO: 673 - DNA, 20 bp, Artificial Sequence
  Synthetic oligonucleotide; TGG chr11 5156729 5156748 5156745 +
tcatccaggctggagtgcag

SEQ ID NO: 674 - DNA, 20 bp, Artificial Sequence
  Synthetic oligonucleotide; TAG chr11 5156732 5156751 5156748 +
tccaggctggagtgcagtgg

SEQ ID NO: 675 - DNA, 20 bp, Artificial Sequence
  Synthetic oligonucleotide; AGG chr11 5156733 5156752 5156749 +
ccaggctggagtgcagtggt

SEQ ID NO: 676 - DNA, 20 bp, Artificial Sequence
  Synthetic oligonucleotide; TGG chr11 5156740 5156759 5156756 +
ggagtgcagtggtaggatct

SEQ ID NO: 677 - DNA, 20 bp, Artificial Sequence
  Synthetic oligonucleotide; CAG chr11 5156766 5156785 5156782 +
actgcaacctccgcccccac

SEQ ID NO: 678 - DNA, 20 bp, Artificial Sequence
  Synthetic oligonucleotide; AGG chr11 5156767 5156786 5156783 +
ctgcaacctccgcccccacc

SEQ ID NO: 679 - DNA, 20 bp, Artificial Sequence
  Synthetic oligonucleotide; AAG chr11 5156773 5156792 5156789 +
cctccgcccccaccaggttc

SEQ ID NO: 680 - DNA, 20 bp, Artificial Sequence
  Synthetic oligonucleotide; AAG chr11 5156790 5156809 5156806 +
ttcaagcgattctcctgccc

SEQ ID NO: 681 - DNA, 20 bp, Artificial Sequence
  Synthetic oligonucleotide; AAG chr11 5156799 5156818 5156815 +
ttctcctgcccaagcctccc

SEQ ID NO: 682 - DNA, 20 bp, Artificial Sequence
  Synthetic oligonucleotide; TAG chr11 5156802 5156821 5156818 +
tcctgcccaagcctcccaag

SEQ ID NO: 683 - DNA, 20 bp, Artificial Sequence
  Synthetic oligonucleotide; AGG chr11 5156803 5156822 5156819 +
cctgcccaagcctcccaagt

SEQ ID NO: 684 - DNA, 20 bp, Artificial Sequence
  Synthetic oligonucleotide; TGG chr11 5156806 5156825 5156822 +
gcccaagcctcccaagtagg

SEQ ID NO: 685 - DNA, 20 bp, Artificial Sequence
  Synthetic oligonucleotide; GGG chr11 5156807 5156826 5156823 +
cccaagcctcccaagtaggt

SEQ ID NO: 686 - DNA, 20 bp, Artificial Sequence
  Synthetic oligonucleotide; CAG chr11 5156814 5156833 5156830 +
ctcccaagtaggtgggatta

SEQ ID NO: 687 - DNA, 20 bp, Artificial Sequence
  Synthetic oligonucleotide; AGG chr11 5156815 5156834 5156831 +
tcccaagtaggtgggattac

SEQ ID NO: 688 - DNA, 20 bp, Artificial Sequence
  Synthetic oligonucleotide; TGG chr11 5156834 5156853 5156850 +
caggcgcctgccaccacgcc

SEQ ID NO: 689 - DNA, 20 bp, Artificial Sequence
  Synthetic oligonucleotide; TAG chr11 5156854 5156873 5156870 +
tggctaattttttgtatttt

SEQ ID NO: 690 - DNA, 20 bp, Artificial Sequence
  Synthetic oligonucleotide; TAG chr11 5156857 5156876 5156873 +
ctaattttttgtatttttag

SEQ ID NO: 691 - DNA, 20 bp, Artificial Sequence
  Synthetic oligonucleotide; GAG chr11 5156859 5156878 5156875 +
aattttttgtatttttagta

SEQ ID NO: 692 - DNA, 20 bp, Artificial Sequence
  Synthetic oligonucleotide; CAG chr11 5156863 5156882 5156879 +
ttttgtatttttagtagaga

SEQ ID NO: 693 - DNA, 20 bp, Artificial Sequence
  Synthetic oligonucleotide; AGG chr11 5156864 5156883 5156880 +
tttgtatttttagtagagac

SEQ ID NO: 694 - DNA, 20 bp, Artificial Sequence
  Synthetic oligonucleotide; GGG chr11 5156865 5156884 5156881 +
ttgtatttttagtagagaca

SEQ ID NO: 695 - DNA, 20 bp, Artificial Sequence
  Synthetic oligonucleotide; TGG chr11 5156879 5156898 5156895 +
gagacagggtttcaccatgt

SEQ ID NO: 696 - DNA, 20 bp, Artificial Sequence
  Synthetic oligonucleotide; CAG chr11 5156883 5156902 5156899 +
cagggtttcaccatgttggt

SEQ ID NO: 697 - DNA, 20 bp, Artificial Sequence
  Synthetic oligonucleotide; AGG chr11 5156884 5156903 5156900 +
agggtttcaccatgttggtc

SEQ ID NO: 698 - DNA, 20 bp, Artificial Sequence
  Synthetic oligonucleotide; TGG chr11 5156888 5156907 5156904 +
tttcaccatgttggtcaggc

SEQ ID NO: 699 - DNA, 20 bp, Artificial Sequence
  Synthetic oligonucleotide; TGG chr11 5156894 5156913 5156910 +
catgttggtcaggctggtct

SEQ ID NO: 700 - DNA, 20 bp, Artificial Sequence
  Synthetic oligonucleotide; TGG chr11 5156924 5156943 5156940 +
acctcatgatccacctgcct

SEQ ID NO: 701 - DNA, 20 bp, Artificial Sequence
  Synthetic oligonucleotide; AAG chr11 5156934 5156953 5156950 +
ccacctgccttggcctccca

SEQ ID NO: 702 - DNA, 20 bp, Artificial Sequence
  Synthetic oligonucleotide; GAG chr11 5156941 5156960 5156957 +
ccttggcctcccaaagtgct

SEQ ID NO: 703 - DNA, 20 bp, Artificial Sequence
  Synthetic oligonucleotide; CAG chr11 5156948 5156967 5156964 +
ctcccaaagtgctgagatta

SEQ ID NO: 704 - DNA, 20 bp, Artificial Sequence
  Synthetic oligonucleotide; AGG chr11 5156949 5156968 5156965 +
tcccaaagtgctgagattac

SEQ ID NO: 705 - DNA, 20 bp, Artificial Sequence
  Synthetic oligonucleotide; TGG chr11 5156955 5156974 5156971 +
agtgctgagattacaggcat

SEQ ID NO: 706 - DNA, 20 bp, Artificial Sequence
  Synthetic oligonucleotide; CAG chr11 5156968 5156987 5156984 +
caggcattggccaccgcacc

SEQ ID NO: 707 - DNA, 20 bp, Artificial Sequence
  Synthetic oligonucleotide; GAG chr11 5156989 5157008 5157005 +
agcccatctttaccattttt

SEQ ID NO: 708 - DNA, 20 bp, Artificial Sequence
  Synthetic oligonucleotide; CGG chr11 5156996 5157015 5157012 +
ctttaccatttttgagtgta

SEQ ID NO: 709 - DNA, 20 bp, Artificial Sequence
  Synthetic oligonucleotide; CAG chr11 5157001 5157020 5157017 +
ccatttttgagtgtacggtt

SEQ ID NO: 710 - DNA, 20 bp, Artificial Sequence
  Synthetic oligonucleotide; TGG chr11 5157004 5157023 5157020 +
tttttgagtgtacggttcag

SEQ ID NO: 711 - DNA, 20 bp, Artificial Sequence
  Synthetic oligonucleotide; CAG chr11 5157104 5157123 5157120 +
tacatatgcacacatacaca

SEQ ID NO: 712 - DNA, 20 bp, Artificial Sequence
  Synthetic oligonucleotide; GAG chr11 5157106 5157125 5157122 +
catatgcacacatacacaca

SEQ ID NO: 713 - DNA, 20 bp, Artificial Sequence
  Synthetic oligonucleotide; AGG chr11 5157107 5157126 5157123 +
atatgcacacatacacacag

SEQ ID NO: 714 - DNA, 20 bp, Artificial Sequence
  Synthetic oligonucleotide; GGG chr11 5157108 5157127 5157124 +
tatgcacacatacacacaga

SEQ ID NO: 715 - DNA, 20 bp, Artificial Sequence
  Synthetic oligonucleotide; GAG chr11 5157110 5157129 5157126 +
tgcacacatacacacagagg

SEQ ID NO: 716 - DNA, 20 bp, Artificial Sequence
  Synthetic oligonucleotide; GAG chr11 5157112 5157131 5157128 +
cacacatacacacagaggga

SEQ ID NO: 717 - DNA, 20 bp, Artificial Sequence
  Synthetic oligonucleotide; GAG chr11 5157114 5157133 5157130 +
cacatacacacagagggaga

SEQ ID NO: 718 - DNA, 20 bp, Artificial Sequence
  Synthetic oligonucleotide; GAG chr11 5157116 5157135 5157132 +
catacacacagagggagaga

SEQ ID NO: 719 - DNA, 20 bp, Artificial Sequence
  Synthetic oligonucleotide; GAG chr11 5157118 5157137 5157134 +
tacacacagagggagagaga

SEQ ID NO: 720 - DNA, 20 bp, Artificial Sequence
  Synthetic oligonucleotide; GAG chr11 5157120 5157139 5157136 +
cacacagagggagagagaga

SEQ ID NO: 721 - DNA, 20 bp, Artificial Sequence
  Synthetic oligonucleotide; TGG chr11 5157123 5157142 5157139 +
acagagggagagagagagag

SEQ ID NO: 722 - DNA, 20 bp, Artificial Sequence
  Synthetic oligonucleotide; GGG chr11 5157124 5157143 5157140 +
cagagggagagagagagagt

SEQ ID NO: 723 - DNA, 20 bp, Artificial Sequence
  Synthetic oligonucleotide; GAG chr11 5157126 5157145 5157142 +
gagggagagagagagagtgg

SEQ ID NO: 724 - DNA, 20 bp, Artificial Sequence
  Synthetic oligonucleotide; AGG chr11 5157127 5157146 5157143 +
agggagagagagagagtggg

SEQ ID NO: 725 - DNA, 20 bp, Artificial Sequence
  Synthetic oligonucleotide; GGG chr11 5157128 5157147 5157144 +
gggagagagagagagtggga

SEQ ID NO: 726 - DNA, 20 bp, Artificial Sequence
  Synthetic oligonucleotide; CGG chr11 5157173 5157192 5157189 +
cctttcttccctcccgccgc

SEQ ID NO: 727 - DNA, 20 bp, Artificial Sequence
  Synthetic oligonucleotide; AAG chr11 5157204 5157223 5157220 +
aatctactctctgtcttcat

SEQ ID NO: 728 - DNA, 20 bp, Artificial Sequence
  Synthetic oligonucleotide; GAG chr11 5157230 5157249 5157246 +
cacgtttttaacttccacac

SEQ ID NO: 729 - DNA, 20 bp, Artificial Sequence
  Synthetic oligonucleotide; TAG chr11 5157234 5157253 5157250 +
tttttaacttccacacgagt

SEQ ID NO: 730 - DNA, 20 bp, Artificial Sequence
  Synthetic oligonucleotide; TGG chr11 5157264 5157283 5157280 +
gatatttttctttctgtgct

SEQ ID NO: 731 - DNA, 20 bp, Artificial Sequence
  Synthetic oligonucleotide; CAG chr11 5157293 5157312 5157309 +
tcacttaacgtaattgcttt

SEQ ID NO: 732 - DNA, 20 bp, Artificial Sequence
  Synthetic oligonucleotide; TGG chr11 5157340 5157359 5157356 +
taatatttcattctttttta

SEQ ID NO: 733 - DNA, 20 bp, Artificial Sequence
  Synthetic oligonucleotide; CAG chr11 5157426 5157445 5157442 +
ttatctgttgacgaatacat

SEQ ID NO: 734 - DNA, 20 bp, Artificial Sequence
  Synthetic oligonucleotide; TGG chr11 5157443 5157462 5157459 +
catcagttgatttcaaatct

SEQ ID NO: 735 - DNA, 20 bp, Artificial Sequence
  Synthetic oligonucleotide; TAG chr11 5157456 5157475 5157472 +
caaatcttggcgtttgtgaa

SEQ ID NO: 736 - DNA, 20 bp, Artificial Sequence
  Synthetic oligonucleotide; AAG chr11 5157469 5157488 5157485 +
ttgtgaatagtgctataata

SEQ ID NO: 737 - DNA, 20 bp, Artificial Sequence
  Synthetic oligonucleotide; TGG chr11 5157473 5157492 5157489 +
gaatagtgctataataaaga

SEQ ID NO: 738 - DNA, 20 bp, Artificial Sequence
  Synthetic oligonucleotide; GGG chr11 5157474 5157493 5157490 +
aatagtgctataataaagat

SEQ ID NO: 739 - DNA, 20 bp, Artificial Sequence
  Synthetic oligonucleotide; GAG chr11 5157476 5157495 5157492 +
tagtgctataataaagatgg

SEQ ID NO: 740 - DNA, 20 bp, Artificial Sequence
  Synthetic oligonucleotide; AAG chr11 5157515 5157534 5157531 +
acatactaatttattctttt

SEQ ID NO: 741 - DNA, 20 bp, Artificial Sequence
  Synthetic oligonucleotide; AGG chr11 5157516 5157535 5157532 +
catactaatttattctttta

SEQ ID NO: 742 - DNA, 20 bp, Artificial Sequence
  Synthetic oligonucleotide; GGG chr11 5157517 5157536 5157533 +
atactaatttattcttttaa

SEQ ID NO: 743 - DNA, 20 bp, Artificial Sequence
  Synthetic oligonucleotide; TAG chr11 5157528 5157547 5157544 +
ttcttttaagggtatatacc

SEQ ID NO: 744 - DNA, 20 bp, Artificial Sequence
  Synthetic oligonucleotide; AGG chr11 5157529 5157548 5157545 +
tcttttaagggtatatacct

SEQ ID NO: 745 - DNA, 20 bp, Artificial Sequence
  Synthetic oligonucleotide; GAG chr11 5157531 5157550 5157547 +
ttttaagggtatatacctag

SEQ ID NO: 746 - DNA, 20 bp, Artificial Sequence
  Synthetic oligonucleotide; TGG chr11 5157543 5157562 5157559 +
atacctaggagtgatattgc

SEQ ID NO: 747 - DNA, 20 bp, Artificial Sequence
  Synthetic oligonucleotide; TGG chr11 5157552 5157571 5157568 +
agtgatattgctggatcata

SEQ ID NO: 748 - DNA, 20 bp, Artificial Sequence
  Synthetic oligonucleotide; TAG chr11 5157555 5157574 5157571 +
gatattgctggatcatatgg

SEQ ID NO: 749 - DNA, 20 bp, Artificial Sequence
  Synthetic oligonucleotide; CAG chr11 5157630 5157649 5157646 +
ccaatttgtactcccaccaa

SEQ ID NO: 750 - DNA, 20 bp, Artificial Sequence
  Synthetic oligonucleotide; AAG chr11 5157636 5157655 5157652 +
tgtactcccaccaacagtgt

SEQ ID NO: 751 - DNA, 20 bp, Artificial Sequence
  Synthetic oligonucleotide; GAG chr11 5157638 5157657 5157654 +
tactcccaccaacagtgtaa

SEQ ID NO: 752 - DNA, 20 bp, Artificial Sequence
  Synthetic oligonucleotide; AGG chr11 5157639 5157658 5157655 +
actcccaccaacagtgtaag

SEQ ID NO: 753 - DNA, 20 bp, Artificial Sequence
  Synthetic oligonucleotide; GGG chr11 5157640 5157659 5157656 +
ctcccaccaacagtgtaaga

SEQ ID NO: 754 - DNA, 20 bp, Artificial Sequence
  Synthetic oligonucleotide; AAG chr11 5157666 5157685 5157682 +
ccctttgtccacatccacac

SEQ ID NO: 755 - DNA, 20 bp, Artificial Sequence
  Synthetic oligonucleotide; AAG chr11 5157697 5157716 5157713 +
atttccttttgttttgttat

SEQ ID NO: 756 - DNA, 20 bp, Artificial Sequence
  Synthetic oligonucleotide; AAG chr11 5157711 5157730 5157727 +
tgttataagctattttaact

SEQ ID NO: 757 - DNA, 20 bp, Artificial Sequence
  Synthetic oligonucleotide; AGG chr11 5157712 5157731 5157728 +
gttataagctattttaacta

SEQ ID NO: 758 - DNA, 20 bp, Artificial Sequence
  Synthetic oligonucleotide; GAG chr11 5157716 5157735 5157732 +
taagctattttaactaaggt

SEQ ID NO: 759 - DNA, 20 bp, Artificial Sequence
  Synthetic oligonucleotide; TGG chr11 5157733 5157752 5157749 +
ggtgagatgatatcacattg

SEQ ID NO: 760 - DNA, 20 bp, Artificial Sequence
  Synthetic oligonucleotide; TGG chr11 5157748 5157767 5157764 +
cattgtggttttgatttatc

SEQ ID NO: 761 - DNA, 20 bp, Artificial Sequence
  Synthetic oligonucleotide; TAG chr11 5157755 5157774 5157771 +
gttttgatttatctggtgat

SEQ ID NO: 762 - DNA, 20 bp, Artificial Sequence
  Synthetic oligonucleotide; TGG chr11 5157786 5157805 5157802 +
aacattttttcaaatacctc

SEQ ID NO: 763 - DNA, 20 bp, Artificial Sequence
  Synthetic oligonucleotide; GGG chr11 5157787 5157806 5157803 +
acattttttcaaatacctct

SEQ ID NO: 764 - DNA, 20 bp, Artificial Sequence
  Synthetic oligonucleotide; TGG chr11 5157799 5157818 5157815 +
atacctctgggccatttgta

SEQ ID NO: 765 - DNA, 20 bp, Artificial Sequence
  Synthetic oligonucleotide; GAG chr11 5157810 5157829 5157826 +
ccatttgtatggcttctttt

SEQ ID NO: 766 - DNA, 20 bp, Artificial Sequence
  Synthetic oligonucleotide; CAG chr11 5157824 5157843 5157840 +
tcttttgagaaatatctatt

SEQ ID NO: 767 - DNA, 20 bp, Artificial Sequence
  Synthetic oligonucleotide; AGG chr11 5157825 5157844 5157841 +
cttttgagaaatatctattc

SEQ ID NO: 768 - DNA, 20 bp, Artificial Sequence
  Synthetic oligonucleotide; TGG chr11 5157833 5157852 5157849 +
aaatatctattcaggtcttt

SEQ ID NO: 769 - DNA, 20 bp, Artificial Sequence
  Synthetic oligonucleotide; GAG chr11 5157867 5157886 5157883 +
ttatttatttattttctgtt

SEQ ID NO: 770 - DNA, 20 bp, Artificial Sequence
  Synthetic oligonucleotide; GAG chr11 5157876 5157895 5157892 +
tattttctgttgagttgctt

SEQ ID NO: 771 - DNA, 20 bp, Artificial Sequence
  Synthetic oligonucleotide; TGG chr11 5157893 5157912 5157909 +
cttgagtttcttgcatattc

SEQ ID NO: 772 - DNA, 20 bp, Artificial Sequence
  Synthetic oligonucleotide; TAG chr11 5157919 5157938 5157935 +
tcaattccttgtaaaatata

SEQ ID NO: 773 - DNA, 20 bp, Artificial Sequence
  Synthetic oligonucleotide; TGG chr11 5157947 5157966 5157963 +
aaatattttctcccattctt

SEQ ID NO: 774 - DNA, 20 bp, Artificial Sequence
  Synthetic oligonucleotide; GGG chr11 5157948 5157967 5157964 +
aatattttctcccattcttt

SEQ ID NO: 775 - DNA, 20 bp, Artificial Sequence
  Synthetic oligonucleotide; CAG chr11 5157984 5158003 5158000 +
ttattattttctttgctgtg

SEQ ID NO: 776 - DNA, 20 bp, Artificial Sequence
  Synthetic oligonucleotide; GAG chr11 5157986 5158005 5158002 +
attattttctttgctgtgca

SEQ ID NO: 777 - DNA, 20 bp, Artificial Sequence
  Synthetic oligonucleotide; TGG chr11 5158021 5158040 5158037 +
ccaattgtctatttttgttt

SEQ ID NO: 778 - DNA, 20 bp, Artificial Sequence
  Synthetic oligonucleotide; AAG chr11 5158039 5158058 5158055 +
tttggttatttgtgcttttg

SEQ ID NO: 779 - DNA, 20 bp, Artificial Sequence
  Synthetic oligonucleotide; TAG chr11 5158047 5158066 5158063 +
tttgtgcttttgaagtctca

SEQ ID NO: 780 - DNA, 20 bp, Artificial Sequence
  Synthetic oligonucleotide; CAG chr11 5158051 5158070 5158067 +
tgcttttgaagtctcataga

SEQ ID NO: 781 - DNA, 20 bp, Artificial Sequence
  Synthetic oligonucleotide; TGG chr11 5158079 5158098 5158095 +
gcccaaatcaatgaatgccc

SEQ ID NO: 782 - DNA, 20 bp, Artificial Sequence
  Synthetic oligonucleotide; GAG chr11 5158081 5158100 5158097 +
ccaaatcaatgaatgccctg

SEQ ID NO: 783 - DNA, 20 bp, Artificial Sequence
  Synthetic oligonucleotide; AGG chr11 5158082 5158101 5158098 +
caaatcaatgaatgccctgg

SEQ ID NO: 784 - DNA, 20 bp, Artificial Sequence
  Synthetic oligonucleotide; GGG chr11 5158083 5158102 5158099 +
aaatcaatgaatgccctgga

SEQ ID NO: 785 - DNA, 20 bp, Artificial Sequence
  Synthetic oligonucleotide; CAG chr11 5158105 5158124 5158121 +
gtttccccactgttttcttc

SEQ ID NO: 786 - DNA, 20 bp, Artificial Sequence
  Synthetic oligonucleotide; TAG chr11 5158108 5158127 5158124 +
tccccactgttttcttccag

SEQ ID NO: 787 - DNA, 20 bp, Artificial Sequence
  Synthetic oligonucleotide; CAG chr11 5158122 5158141 5158138 +
ttccagtagtttcataattt

SEQ ID NO: 788 - DNA, 20 bp, Artificial Sequence
  Synthetic oligonucleotide; AGG chr11 5158123 5158142 5158139 +
tccagtagtttcataatttc

SEQ ID NO: 789 - DNA, 20 bp, Artificial Sequence
  Synthetic oligonucleotide; TGG chr11 5158129 5158148 5158145 +
agtttcataatttcaggtat

SEQ ID NO: 790 - DNA, 20 bp, Artificial Sequence
  Synthetic oligonucleotide; AAG chr11 5158136 5158155 5158152 +
taatttcaggtattggattc

SEQ ID NO: 791 - DNA, 20 bp, Artificial Sequence
  Synthetic oligonucleotide; TAG chr11 5158171 5158190 5158187 +
cttgatttgatttttgtata

SEQ ID NO: 792 - DNA, 20 bp, Artificial Sequence
  Synthetic oligonucleotide; GAG chr11 5158175 5158194 5158191 +
atttgatttttgtatatagt

SEQ ID NO: 793 - DNA, 20 bp, Artificial Sequence
  Synthetic oligonucleotide; GAG chr11 5158177 5158196 5158193 +
ttgatttttgtatatagtga

SEQ ID NO: 794 - DNA, 20 bp, Artificial Sequence
  Synthetic oligonucleotide; TAG chr11 5158181 5158200 5158197 +
tttttgtatatagtgagaga

SEQ ID NO: 795 - DNA, 20 bp, Artificial Sequence
  Synthetic oligonucleotide; AGG chr11 5158182 5158201 5158198 +
ttttgtatatagtgagagat

SEQ ID NO: 796 - DNA, 20 bp, Artificial Sequence
  Synthetic oligonucleotide; GGG chr11 5158183 5158202 5158199 +
tttgtatatagtgagagata

SEQ ID NO: 797 - DNA, 20 bp, Artificial Sequence
  Synthetic oligonucleotide; GGG chr11 5158184 5158203 5158200 +
ttgtatatagtgagagatag

SEQ ID NO: 798 - DNA, 20 bp, Artificial Sequence
  Synthetic oligonucleotide; TGG chr11 5158209 5158228 5158225 +
cgattttactcttttgcaaa

SEQ ID NO: 799 - DNA, 20 bp, Artificial Sequence
  Synthetic oligonucleotide; CAG chr11 5158217 5158236 5158233 +
ctcttttgcaaatggatatc

SEQ ID NO: 800 - DNA, 20 bp, Artificial Sequence
  Synthetic oligonucleotide; TAG chr11 5158226 5158245 5158242 +
aaatggatatccagttttcc

SEQ ID NO: 801 - DNA, 20 bp, Artificial Sequence
  Synthetic oligonucleotide; AAG chr11 5158243 5158262 5158259 +
tcctagcactgtttcttgaa

SEQ ID NO: 802 - DNA, 20 bp, Artificial Sequence
  Synthetic oligonucleotide; GAG chr11 5158276 5158295 5158292 +
cctttttttttttttttttt

SEQ ID NO: 803 - DNA, 20 bp, Artificial Sequence
  Synthetic oligonucleotide; TGG chr11 5158280 5158299 5158296 +
ttttttttttttttttgaga

SEQ ID NO: 804 - DNA, 20 bp, Artificial Sequence
  Synthetic oligonucleotide; GAG chr11 5158282 5158301 5158298 +
ttttttttttttttgagatg

SEQ ID NO: 805 - DNA, 20 bp, Artificial Sequence
  Synthetic oligonucleotide; CAG chr11 5158298 5158317 5158314 +
gatggagtctcactgttgcc

SEQ ID NO: 806 - DNA, 20 bp, Artificial Sequence
  Synthetic oligonucleotide; AGG chr11 5158299 5158318 5158315 +
atggagtctcactgttgccc

SEQ ID NO: 807 - DNA, 20 bp, Artificial Sequence
  Synthetic oligonucleotide; TGG chr11 5158303 5158322 5158319 +
agtctcactgttgcccaggc

SEQ ID NO: 808 - DNA, 20 bp, Artificial Sequence
  Synthetic oligonucleotide; GAG chr11 5158305 5158324 5158321 +
tctcactgttgcccaggctg

SEQ ID NO: 809 - DNA, 20 bp, Artificial Sequence
  Synthetic oligonucleotide; CAG chr11 5158310 5158329 5158326 +
ctgttgcccaggctggagtg

SEQ ID NO: 810 - DNA, 20 bp, Artificial Sequence
  Synthetic oligonucleotide; TGG chr11 5158313 5158332 5158329 +
ttgcccaggctggagtgcag

SEQ ID NO: 811 - DNA, 20 bp, Artificial Sequence
  Synthetic oligonucleotide; CAG chr11 5158316 5158335 5158332 +
cccaggctggagtgcagtgg

SEQ ID NO: 812 - DNA, 20 bp, Artificial Sequence
  Synthetic oligonucleotide; TGG chr11 5158327 5158346 5158343 +
gtgcagtggcagcacaatct

SEQ ID NO: 813 - DNA, 20 bp, Artificial Sequence
  Synthetic oligonucleotide; CAG chr11 5158351 5158370 5158367 +
tcactgcaacttctgcctcc

SEQ ID NO: 814 - DNA, 20 bp, Artificial Sequence
  Synthetic oligonucleotide; AGG chr11 5158352 5158371 5158368 +
cactgcaacttctgcctccc

SEQ ID NO: 815 - DNA, 20 bp, Artificial Sequence
  Synthetic oligonucleotide; AAG chr11 5158358 5158377 5158374 +
aacttctgcctcccaggttc

SEQ ID NO: 816 - DNA, 20 bp, Artificial Sequence
  Synthetic oligonucleotide; CAG chr11 5158375 5158394 5158391 +
ttcaagcgattctcctgcct

SEQ ID NO: 817 - DNA, 20 bp, Artificial Sequence
  Synthetic oligonucleotide; GAG chr11 5158384 5158403 5158400 +
ttctcctgcctcagcctcct

SEQ ID NO: 818 - DNA, 20 bp, Artificial Sequence
  Synthetic oligonucleotide; TGG chr11 5158391 5158410 5158407 +
gcctcagcctcctgagtatc

SEQ ID NO: 819 - DNA, 20 bp, Artificial Sequence
  Synthetic oligonucleotide; GGG chr11 5158392 5158411 5158408 +
cctcagcctcctgagtatct

SEQ ID NO: 820 - DNA, 20 bp, Artificial Sequence
  Synthetic oligonucleotide; CAG chr11 5158399 5158418 5158415 +
ctcctgagtatctgggatta

SEQ ID NO: 821 - DNA, 20 bp, Artificial Sequence
  Synthetic oligonucleotide; AGG chr11 5158400 5158419 5158416 +
tcctgagtatctgggattac

SEQ ID NO: 822 - DNA, 20 bp, Artificial Sequence
  Synthetic oligonucleotide; GAG chr11 5158402 5158421 5158418 +
ctgagtatctgggattacag

SEQ ID NO: 823 - DNA, 20 bp, Artificial Sequence
  Synthetic oligonucleotide; TGG chr11 5158419 5158438 5158435 +
caggagcgccccaccatgcc

SEQ ID NO: 824 - DNA, 20 bp, Artificial Sequence
  Synthetic oligonucleotide; TAG chr11 5158438 5158457 5158454 +
ctggctaatttttgtatttt

SEQ ID NO: 825 - DNA, 20 bp, Artificial Sequence
  Synthetic oligonucleotide; TAG chr11 5158441 5158460 5158457 +
gctaatttttgtatttttag

SEQ ID NO: 826 - DNA, 20 bp, Artificial Sequence
  Synthetic oligonucleotide; GAG chr11 5158443 5158462 5158459 +
taatttttgtatttttagta

SEQ ID NO: 827 - DNA, 20 bp, Artificial Sequence
  Synthetic oligonucleotide; CGG chr11 5158447 5158466 5158463 +
ttttgtatttttagtagaga

SEQ ID NO: 828 - DNA, 20 bp, Artificial Sequence
  Synthetic oligonucleotide; GAG chr11 5158449 5158468 5158465 +
ttgtatttttagtagagacg

SEQ ID NO: 829 - DNA, 20 bp, Artificial Sequence
  Synthetic oligonucleotide; TGG chr11 5158463 5158482 5158479 +
gagacggagtgtcaccacgt

SEQ ID NO: 830 - DNA, 20 bp, Artificial Sequence
  Synthetic oligonucleotide; CAG chr11 5158467 5158486 5158483 +
cggagtgtcaccacgttggt

SEQ ID NO: 831 - DNA, 20 bp, Artificial Sequence
  Synthetic oligonucleotide; AGG chr11 5158468 5158487 5158484 +
ggagtgtcaccacgttggtc

SEQ ID NO: 832 - DNA, 20 bp, Artificial Sequence
  Synthetic oligonucleotide; TGG chr11 5158472 5158491 5158488 +
tgtcaccacgttggtcaggc

SEQ ID NO: 833 - DNA, 20 bp, Artificial Sequence
  Synthetic oligonucleotide; CAG chr11 5158508 5158527 5158524 +
acctcgtgatccccccacct

SEQ ID NO: 834 - DNA, 20 bp, Artificial Sequence
  Synthetic oligonucleotide; AAG chr11 5158518 5158537 5158534 +
ccccccacctcagcctcaca

SEQ ID NO: 835 - DNA, 20 bp, Artificial Sequence
  Synthetic oligonucleotide; TGG chr11 5158524 5158543 5158540 +
acctcagcctcacaaagtgc

SEQ ID NO: 836 - DNA, 20 bp, Artificial Sequence
  Synthetic oligonucleotide; GGG chr11 5158525 5158544 5158541 +
cctcagcctcacaaagtgct

SEQ ID NO: 837 - DNA, 20 bp, Artificial Sequence
  Synthetic oligonucleotide; CAG chr11 5158532 5158551 5158548 +
ctcacaaagtgctgggatta

SEQ ID NO: 838 - DNA, 20 bp, Artificial Sequence
  Synthetic oligonucleotide; AGG chr11 5158533 5158552 5158549 +
tcacaaagtgctgggattac

SEQ ID NO: 839 - DNA, 20 bp, Artificial Sequence
  Synthetic oligonucleotide; GAG chr11 5158539 5158558 5158555 +
agtgctgggattacaggtgt

SEQ ID NO: 840 - DNA, 20 bp, Artificial Sequence
  Synthetic oligonucleotide; TGG chr11 5158552 5158571 5158568 +
caggtgtgagccactgcacc

SEQ ID NO: 841 - DNA, 20 bp, Artificial Sequence
  Synthetic oligonucleotide; AAG chr11 5158595 5158614 5158611 +
tgttcttgatgcctttgtta

SEQ ID NO: 842 - DNA, 20 bp, Artificial Sequence
  Synthetic oligonucleotide; TGG chr11 5158604 5158623 5158620 +
tgcctttgttaaagatgact

SEQ ID NO: 843 - DNA, 20 bp, Artificial Sequence
  Synthetic oligonucleotide; AAG chr11 5158612 5158631 5158628 +
ttaaagatgacttggttgtt

SEQ ID NO: 844 - DNA, 20 bp, Artificial Sequence
  Synthetic oligonucleotide; TGG chr11 5158619 5158638 5158635 +
tgacttggttgttaagtgcc

SEQ ID NO: 845 - DNA, 20 bp, Artificial Sequence
  Synthetic oligonucleotide; TGG chr11 5158631 5158650 5158647 +
taagtgcctggatttgcatc

SEQ ID NO: 846 - DNA, 20 bp, Artificial Sequence
  Synthetic oligonucleotide; GGG chr11 5158632 5158651 5158648 +
aagtgcctggatttgcatct

SEQ ID NO: 847 - DNA, 20 bp, Artificial Sequence
  Synthetic oligonucleotide; TGG chr11 5158653 5158672 5158669 +
ggttctctatgctgttccat

SEQ ID NO: 848 - DNA, 20 bp, Artificial Sequence
  Synthetic oligonucleotide; GGG chr11 5158654 5158673 5158670 +
gttctctatgctgttccatt

SEQ ID NO: 849 - DNA, 20 bp, Artificial Sequence
  Synthetic oligonucleotide; CAG chr11 5158676 5158695 5158692 +
gctgtatgtctgtctttatg

SEQ ID NO: 850 - DNA, 20 bp, Artificial Sequence
  Synthetic oligonucleotide; TGG chr11 5158691 5158710 5158707 +
ttatgcagtactgtgctgtt

SEQ ID NO: 851 - DNA, 20 bp, Artificial Sequence
  Synthetic oligonucleotide; TAG chr11 5158700 5158719 5158716 +
actgtgctgtttggctactg

SEQ ID NO: 852 - DNA, 20 bp, Artificial Sequence
  Synthetic oligonucleotide; TAG chr11 5158708 5158727 5158724 +
gtttggctactgtagctttg

SEQ ID NO: 853 - DNA, 20 bp, Artificial Sequence
  Synthetic oligonucleotide; TAG chr11 5158711 5158730 5158727 +
tggctactgtagctttgtag

SEQ ID NO: 854 - DNA, 20 bp, Artificial Sequence
  Synthetic oligonucleotide; AAG chr11 5158720 5158739 5158736 +
tagctttgtagtagattttg

SEQ ID NO: 855 - DNA, 20 bp, Artificial Sequence
  Synthetic oligonucleotide; TAG chr11 5158728 5158747 5158744 +
tagtagattttgaagtcata

SEQ ID NO: 856 - DNA, 20 bp, Artificial Sequence
  Synthetic oligonucleotide; TAG chr11 5158736 5158755 5158752 +
tttgaagtcatatagtgtga

SEQ ID NO: 857 - DNA, 20 bp, Artificial Sequence
  Synthetic oligonucleotide; TGG chr11 5158742 5158761 5158758 +
gtcatatagtgtgatagctt

SEQ ID NO: 858 - DNA, 20 bp, Artificial Sequence
  Synthetic oligonucleotide; CAG chr11 5158761 5158780 5158777 +
ttggttttgttctttttgct

SEQ ID NO: 859 - DNA, 20 bp, Artificial Sequence
  Synthetic oligonucleotide; AGG chr11 5158762 5158781 5158778 +
tggttttgttctttttgctc

SEQ ID NO: 860 - DNA, 20 bp, Artificial Sequence
  Synthetic oligonucleotide; TAG chr11 5158772 5158791 5158788 +
ctttttgctcaggattgctt

SEQ ID NO: 861 - DNA, 20 bp, Artificial Sequence
  Synthetic oligonucleotide; TGG chr11 5158779 5158798 5158795 +
ctcaggattgctttagctat

SEQ ID NO: 862 - DNA, 20 bp, Artificial Sequence
  Synthetic oligonucleotide; GGG chr11 5158780 5158799 5158796 +
tcaggattgctttagctatt

SEQ ID NO: 863 - DNA, 20 bp, Artificial Sequence
  Synthetic oligonucleotide; GGG chr11 5158781 5158800 5158797 +
caggattgctttagctattg

SEQ ID NO: 864 - DNA, 20 bp, Artificial Sequence
  Synthetic oligonucleotide; TGG chr11 5158792 5158811 5158808 +
tagctattggggatcttttg

SEQ ID NO: 865 - DNA, 20 bp, Artificial Sequence
  Synthetic oligonucleotide; TAG chr11 5158809 5158828 5158825 +
ttgtggttccatataaatat

SEQ ID NO: 866 - DNA, 20 bp, Artificial Sequence
  Synthetic oligonucleotide; AGG chr11 5158810 5158829 5158826 +
tgtggttccatataaatatt

SEQ ID NO: 867 - DNA, 20 bp, Artificial Sequence
  Synthetic oligonucleotide; TGG chr11 5158841 5158860 5158857 +
tctatttctgtgaatgccat

SEQ ID NO: 868 - DNA, 20 bp, Artificial Sequence
  Synthetic oligonucleotide; CAG chr11 5158852 5158871 5158868 +
gaatgccattggtattttga

SEQ ID NO: 869 - DNA, 20 bp, Artificial Sequence
  Synthetic oligonucleotide; TGG chr11 5158882 5158901 5158898 +
actgaatctgtacattgctt

SEQ ID NO: 870 - DNA, 20 bp, Artificial Sequence
  Synthetic oligonucleotide; GGG chr11 5158883 5158902 5158899 +
ctgaatctgtacattgcttt

SEQ ID NO: 871 - DNA, 20 bp, Artificial Sequence
  Synthetic oligonucleotide; TAG chr11 5158886 5158905 5158902 +
aatctgtacattgctttggg

SEQ ID NO: 872 - DNA, 20 bp, Artificial Sequence
  Synthetic oligonucleotide; TAG chr11 5158915 5158934 5158931 +
cattttaatattaattcttc

SEQ ID NO: 873 - DNA, 20 bp, Artificial Sequence
  Synthetic oligonucleotide; GAG chr11 5158923 5158942 5158939 +
tattaattcttctagttcat

SEQ ID NO: 874 - DNA, 20 bp, Artificial Sequence
  Synthetic oligonucleotide; TGG chr11 5158928 5158947 5158944 +
attcttctagttcatgagca

SEQ ID NO: 875 - DNA, 20 bp, Artificial Sequence
  Synthetic oligonucleotide; CAG chr11 5158976 5158995 5158992 +
ccctcttctatttctttcac

SEQ ID NO: 876 - DNA, 20 bp, Artificial Sequence
  Synthetic oligonucleotide; GAG chr11 5158978 5158997 5158994 +
ctcttctatttctttcacca

SEQ ID NO: 877 - DNA, 20 bp, Artificial Sequence
  Synthetic oligonucleotide; TAG chr11 5158998 5159017 5159014 +
gagttttataatttttctta

SEQ ID NO: 878 - DNA, 20 bp, Artificial Sequence
  Synthetic oligonucleotide; GAG chr11 5159000 5159019 5159016 +
gttttataatttttcttata

SEQ ID NO: 879 - DNA, 20 bp, Artificial Sequence
  Synthetic oligonucleotide; TGG chr11 5159016 5159035 5159032 +
tatagagatcttttacttct

SEQ ID NO: 880 - DNA, 20 bp, Artificial Sequence
  Synthetic oligonucleotide; GGG chr11 5159017 5159036 5159033 +
atagagatcttttacttctt

SEQ ID NO: 881 - DNA, 20 bp, Artificial Sequence
  Synthetic oligonucleotide; TAG chr11 5159021 5159040 5159037 +
agatcttttacttcttgggt

SEQ ID NO: 882 - DNA, 20 bp, Artificial Sequence
  Synthetic oligonucleotide; TGG chr11 5159033 5159052 5159049 +
tcttgggttagattgactcc

SEQ ID NO: 883 - DNA, 20 bp, Artificial Sequence
  Synthetic oligonucleotide; GGG chr11 5159034 5159053 5159050 +
cttgggttagattgactcct

SEQ ID NO: 884 - DNA, 20 bp, Artificial Sequence
  Synthetic oligonucleotide; AAG chr11 5159066 5159085 5159082 +
tttttattgctattgtaaat

SEQ ID NO: 885 - DNA, 20 bp, Artificial Sequence
  Synthetic oligonucleotide; CAG chr11 5159091 5159110 5159107 +
tgttttattgattttttttg

SEQ ID NO: 886 - DNA, 20 bp, Artificial Sequence
  Synthetic oligonucleotide; TAG chr11 5159183 5159202 5159199 +
atttttttaaatcgttttaa

SEQ ID NO: 887 - DNA, 20 bp, Artificial Sequence
  Synthetic oligonucleotide; TAG chr11 5159190 5159209 5159206 +
taaatcgttttaatagtatt

SEQ ID NO: 888 - DNA, 20 bp, Artificial Sequence
  Synthetic oligonucleotide; AAG chr11 5159195 5159214 5159211 +
cgttttaatagtatttagtg

SEQ ID NO: 889 - DNA, 20 bp, Artificial Sequence
  Synthetic oligonucleotide; TAG chr11 5159202 5159221 5159218 +
atagtatttagtgaagtttt

SEQ ID NO: 890 - DNA, 20 bp, Artificial Sequence
  Synthetic oligonucleotide; AGG chr11 5159203 5159222 5159219 +
tagtatttagtgaagttttt

SEQ ID NO: 891 - DNA, 20 bp, Artificial Sequence
  Synthetic oligonucleotide; AAG chr11 5159214 5159233 5159230 +
gaagtttttaggttttttct

SEQ ID NO: 892 - DNA, 20 bp, Artificial Sequence
  Synthetic oligonucleotide; AAG chr11 5159220 5159239 5159236 +
tttaggttttttctaagtat

SEQ ID NO: 893 - DNA, 20 bp, Artificial Sequence
  Synthetic oligonucleotide; TAG chr11 5159241 5159260 5159257 +
agatcatgtcatctacaaac

SEQ ID NO: 894 - DNA, 20 bp, Artificial Sequence
  Synthetic oligonucleotide; AGG chr11 5159242 5159261 5159258 +
gatcatgtcatctacaaact

SEQ ID NO: 895 - DNA, 20 bp, Artificial Sequence
  Synthetic oligonucleotide; TGG chr11 5159271 5159290 5159287 +
taacttcttcctttccaatt

SEQ ID NO: 896 - DNA, 20 bp, Artificial Sequence
  Synthetic oligonucleotide; AAG chr11 5159309 5159328 5159325 +
cttcctgaatttctctttcc

SEQ ID NO: 897 - DNA, 20 bp, Artificial Sequence
  Synthetic oligonucleotide; TGG chr11 5159335 5159354 5159351 +
tccaatattatgttaaataa

SEQ ID NO: 898 - DNA, 20 bp, Artificial Sequence
  Synthetic oligonucleotide; AAG chr11 5159344 5159363 5159360 +
atgttaaataatggcaatga

SEQ ID NO: 899 - DNA, 20 bp, Artificial Sequence
  Synthetic oligonucleotide; GAG chr11 5159348 5159367 5159364 +
taaataatggcaatgaaagt

SEQ ID NO: 900 - DNA, 20 bp, Artificial Sequence
  Synthetic oligonucleotide; CAG chr11 5159367 5159386 5159383 +
tgagcattcttgccttattt

SEQ ID NO: 901 - DNA, 20 bp, Artificial Sequence
  Synthetic oligonucleotide; TAG chr11 5159374 5159393 5159390 +
tcttgccttatttcagtcct

SEQ ID NO: 902 - DNA, 20 bp, Artificial Sequence
  Synthetic oligonucleotide; GAG chr11 5159376 5159395 5159392 +
ttgccttatttcagtcctta

SEQ ID NO: 903 - DNA, 20 bp, Artificial Sequence
  Synthetic oligonucleotide; AGG chr11 5159377 5159396 5159393 +
tgccttatttcagtccttag

SEQ ID NO: 904 - DNA, 20 bp, Artificial Sequence
  Synthetic oligonucleotide; AAG chr11 5159381 5159400 5159397 +
ttatttcagtccttagagga

SEQ ID NO: 905 - DNA, 20 bp, Artificial Sequence
  Synthetic oligonucleotide; AGG chr11 5159382 5159401 5159398 +
tatttcagtccttagaggaa

SEQ ID NO: 906 - DNA, 20 bp, Artificial Sequence
  Synthetic oligonucleotide; CAG chr11 5159404 5159423 5159420 +
gccttcaatgtttctctgtt

SEQ ID NO: 907 - DNA, 20 bp, Artificial Sequence
  Synthetic oligonucleotide; TAG chr11 5159415 5159434 5159431 +
ttctctgttcagcataatgt

SEQ ID NO: 908 - DNA, 20 bp, Artificial Sequence
  Synthetic oligonucleotide; TGG chr11 5159422 5159441 5159438 +
ttcagcataatgttagcact

SEQ ID NO: 909 - DNA, 20 bp, Artificial Sequence
  Synthetic oligonucleotide; TGG chr11 5159436 5159455 5159452 +
agcacttggtttgtcctata

SEQ ID NO: 910 - DNA, 20 bp, Artificial Sequence
  Synthetic oligonucleotide; GAG chr11 5159452 5159471 5159468 +
tatatggtttttattatttt

SEQ ID NO: 911 - DNA, 20 bp, Artificial Sequence
  Synthetic oligonucleotide; AGG chr11 5159453 5159472 5159469 +
atatggtttttattattttg

SEQ ID NO: 912 - DNA, 20 bp, Artificial Sequence
  Synthetic oligonucleotide; GAG chr11 5159479 5159498 5159495 +
gttcctactgtacctccttt

SEQ ID NO: 913 - DNA, 20 bp, Artificial Sequence
  Synthetic oligonucleotide; AGG chr11 5159480 5159499 5159496 +
ttcctactgtacctcctttg

SEQ ID NO: 914 - DNA, 20 bp, Artificial Sequence
  Synthetic oligonucleotide; TGG chr11 5159502 5159521 5159518 +
gtgcatttgttgttgtgtcc

SEQ ID NO: 915 - DNA, 20 bp, Artificial Sequence
  Synthetic oligonucleotide; TGG chr11 5159507 5159526 5159523 +
tttgttgttgtgtcctggtc

SEQ ID NO: 916 - DNA, 20 bp, Artificial Sequence
  Synthetic oligonucleotide; TGG chr11 5159512 5159531 5159528 +
tgttgtgtcctggtctggtt

SEQ ID NO: 917 - DNA, 20 bp, Artificial Sequence
  Synthetic oligonucleotide; GGG chr11 5159513 5159532 5159529 +
gttgtgtcctggtctggttt

SEQ ID NO: 918 - DNA, 20 bp, Artificial Sequence
  Synthetic oligonucleotide; TAG chr11 5159521 5159540 5159537 +
ctggtctggtttgggtatat

SEQ ID NO: 919 - DNA, 20 bp, Artificial Sequence
  Synthetic oligonucleotide; GAG chr11 5159523 5159542 5159539 +
ggtctggtttgggtatatta

SEQ ID NO: 920 - DNA, 20 bp, Artificial Sequence
  Synthetic oligonucleotide; TAG chr11 5159540 5159559 5159556 +
ttagagtaatgcttgcctca

SEQ ID NO: 921 - DNA, 20 bp, Artificial Sequence
  Synthetic oligonucleotide; AAG chr11 5159546 5159565 5159562 +
taatgcttgcctcatagaat

SEQ ID NO: 922 - DNA, 20 bp, Artificial Sequence
  Synthetic oligonucleotide; TAG chr11 5159551 5159570 5159567 +
cttgcctcatagaataagtt

SEQ ID NO: 923 - DNA, 20 bp, Artificial Sequence
  Synthetic oligonucleotide; AAG chr11 5159554 5159573 5159570 +
gcctcatagaataagtttag

SEQ ID NO: 924 - DNA, 20 bp, Artificial Sequence
  Synthetic oligonucleotide; TAG chr11 5159557 5159576 5159573 +
tcatagaataagtttagaag

SEQ ID NO: 925 - DNA, 20 bp, Artificial Sequence
  Synthetic oligonucleotide; AGG chr11 5159558 5159577 5159574 +
catagaataagtttagaagt

SEQ ID NO: 926 - DNA, 20 bp, Artificial Sequence
  Synthetic oligonucleotide; CAG chr11 5159571 5159590 5159587 +
tagaagtaggcccttctttt

SEQ ID NO: 927 - DNA, 20 bp, Artificial Sequence
  Synthetic oligonucleotide; GAG chr11 5159595 5159614 5159611 +
ttttatttgtttgtttgttt

SEQ ID NO: 928 - DNA, 20 bp, Artificial Sequence
  Synthetic oligonucleotide; AGG chr11 5159596 5159615 5159612 +
tttatttgtttgtttgtttg

SEQ ID NO: 929 - DNA, 20 bp, Artificial Sequence
  Synthetic oligonucleotide; GAG chr11 5159604 5159623 5159620 +
tttgtttgtttgaggaattt

SEQ ID NO: 930 - DNA, 20 bp, Artificial Sequence
  Synthetic oligonucleotide; TAG chr11 5159613 5159632 5159629 +
ttgaggaatttgagtacgat

SEQ ID NO: 931 - DNA, 20 bp, Artificial Sequence
  Synthetic oligonucleotide; TAG chr11 5159619 5159638 5159635 +
aatttgagtacgattagtat

SEQ ID NO: 932 - DNA, 20 bp, Artificial Sequence
  Synthetic oligonucleotide; TGG chr11 5159638 5159657 5159654 +
ttagttctacttgaaatgtt

SEQ ID NO: 933 - DNA, 20 bp, Artificial Sequence
  Synthetic oligonucleotide; TAG chr11 5159641 5159660 5159657 +
gttctacttgaaatgtttgg

SEQ ID NO: 934 - DNA, 20 bp, Artificial Sequence
  Synthetic oligonucleotide; GAG chr11 5159650 5159669 5159666 +
gaaatgtttggtagcccatc

SEQ ID NO: 935 - DNA, 20 bp, Artificial Sequence
  Synthetic oligonucleotide; TGG chr11 5159656 5159675 5159672 +
tttggtagcccatcgagtcc

SEQ ID NO: 936 - DNA, 20 bp, Artificial Sequence
  Synthetic oligonucleotide; GGG chr11 5159657 5159676 5159673 +
ttggtagcccatcgagtcct

SEQ ID NO: 937 - DNA, 20 bp, Artificial Sequence
  Synthetic oligonucleotide; TAG chr11 5159671 5159690 5159687 +
agtcctgggcttttctttaa

SEQ ID NO: 938 - DNA, 20 bp, Artificial Sequence
  Synthetic oligonucleotide; AGG chr11 5159672 5159691 5159688 +
gtcctgggcttttctttaat

SEQ ID NO: 939 - DNA, 20 bp, Artificial Sequence
  Synthetic oligonucleotide; GAG chr11 5159722 5159741 5159738 +
ttattcattattgttctatt

SEQ ID NO: 940 - DNA, 20 bp, Artificial Sequence
  Synthetic oligonucleotide; AGG chr11 5159723 5159742 5159739 +
tattcattattgttctattg

SEQ ID NO: 941 - DNA, 20 bp, Artificial Sequence
  Synthetic oligonucleotide; CAG chr11 5159746 5159765 5159762 +
ttttctgtttctacatgctt

SEQ ID NO: 942 - DNA, 20 bp, Artificial Sequence
  Synthetic oligonucleotide; TAG chr11 5159755 5159774 5159771 +
tctacatgcttcagtcttgc

SEQ ID NO: 943 - DNA, 20 bp, Artificial Sequence
  Synthetic oligonucleotide; AGG chr11 5159756 5159775 5159772 +
ctacatgcttcagtcttgct

SEQ ID NO: 944 - DNA, 20 bp, Artificial Sequence
  Synthetic oligonucleotide; CAG chr11 5159770 5159789 5159786 +
cttgctaggctgtatgtgtc

SEQ ID NO: 945 - DNA, 20 bp, Artificial Sequence
  Synthetic oligonucleotide; AGG chr11 5159771 5159790 5159787 +
ttgctaggctgtatgtgtcc

SEQ ID NO: 946 - DNA, 20 bp, Artificial Sequence
  Synthetic oligonucleotide; TAG chr11 5159791 5159810 5159807 +
aggaatttatccatttattc

SEQ ID NO: 947 - DNA, 20 bp, Artificial Sequence
  Synthetic oligonucleotide; TGG chr11 5159808 5159827 5159824 +
ttctagattttccaatttgt

SEQ ID NO: 948 - DNA, 20 bp, Artificial Sequence
  Synthetic oligonucleotide; CAG chr11 5159815 5159834 5159831 +
ttttccaatttgttggaata

SEQ ID NO: 949 - DNA, 20 bp, Artificial Sequence
  Synthetic oligonucleotide; TAG chr11 5159828 5159847 5159844 +
tggaatacagttgttcataa

SEQ ID NO: 950 - DNA, 20 bp, Artificial Sequence
  Synthetic oligonucleotide; GAG chr11 5159839 5159858 5159855 +
tgttcataatagtatctaat

SEQ ID NO: 951 - DNA, 20 bp, Artificial Sequence
  Synthetic oligonucleotide; GAG chr11 5159855 5159874 5159871 +
taatgagtctttgtgttgct

SEQ ID NO: 952 - DNA, 20 bp, Artificial Sequence
  Synthetic oligonucleotide; AGG chr11 5159856 5159875 5159872 +
aatgagtctttgtgttgctg

SEQ ID NO: 953 - DNA, 20 bp, Artificial Sequence
  Synthetic oligonucleotide; AAG chr11 5159916 5159935 5159932 +
tatttgactcttttttctta

SEQ ID NO: 954 - DNA, 20 bp, Artificial Sequence
  Synthetic oligonucleotide; AAG chr11 5159944 5159963 5159960 +
ttgattttgtttacctttcc

SEQ ID NO: 955 - DNA, 20 bp, Artificial Sequence
  Synthetic oligonucleotide; AAG chr11 5159948 5159967 5159964 +
ttttgtttacctttccaaga

SEQ ID NO: 956 - DNA, 20 bp, Artificial Sequence
  Synthetic oligonucleotide; TGG chr11 5159985 5160004 5160001 +
taatgattttctgtattttt

SEQ ID NO: 957 - DNA, 20 bp, Artificial Sequence
  Synthetic oligonucleotide; TGG chr11 5160051 5160070 5160067 +
ccttctattaattttgcatt

SEQ ID NO: 958 - DNA, 20 bp, Artificial Sequence
  Synthetic oligonucleotide; GAG chr11 5160079 5160098 5160095 +
tcttgctttcctatttcctt

SEQ ID NO: 959 - DNA, 20 bp, Artificial Sequence
  Synthetic oligonucleotide; AGG chr11 5160080 5160099 5160096 +
cttgctttcctatttccttg

SEQ ID NO: 960 - DNA, 20 bp, Artificial Sequence
  Synthetic oligonucleotide; TGG chr11 5160092 5160111 5160108 +
tttccttgaggtacattgtt

SEQ ID NO: 961 - DNA, 20 bp, Artificial Sequence
  Synthetic oligonucleotide; TAG chr11 5160100 5160119 5160116 +
aggtacattgtttggttgct

SEQ ID NO: 962 - DNA, 20 bp, Artificial Sequence
  Synthetic oligonucleotide; AAG chr11 5160106 5160125 5160122 +
attgtttggttgcttagttg

SEQ ID NO: 963 - DNA, 20 bp, Artificial Sequence
  Synthetic oligonucleotide; TGG chr11 5160123 5160142 5160139 +
ttgaagcctttctacttttt

SEQ ID NO: 964 - DNA, 20 bp, Artificial Sequence
  Synthetic oligonucleotide; TAG chr11 5160129 5160148 5160145 +
cctttctacttttttggata

SEQ ID NO: 965 - DNA, 20 bp, Artificial Sequence
  Synthetic oligonucleotide; AGG chr11 5160130 5160149 5160146 +
ctttctacttttttggatat

SEQ ID NO: 966 - DNA, 20 bp, Artificial Sequence
  Synthetic oligonucleotide; AAG chr11 5160158 5160177 5160174 +
attgctatgaacttccctct

SEQ ID NO: 967 - DNA, 20 bp, Artificial Sequence
  Synthetic oligonucleotide; TAG chr11 5160182 5160201 5160198 +
actgcttttgccatatcctg

SEQ ID NO: 968 - DNA, 20 bp, Artificial Sequence
  Synthetic oligonucleotide; AGG chr11 5160183 5160202 5160199 +
ctgcttttgccatatcctgt

SEQ ID NO: 969 - DNA, 20 bp, Artificial Sequence
  Synthetic oligonucleotide; TGG chr11 5160189 5160208 5160205 +
ttgccatatcctgtaggttt

SEQ ID NO: 970 - DNA, 20 bp, Artificial Sequence
  Synthetic oligonucleotide; AAG chr11 5160221 5160240 5160237 +
tttccattttcacttgtttc

SEQ ID NO: 971 - DNA, 20 bp, Artificial Sequence
  Synthetic oligonucleotide; AAG chr11 5160224 5160243 5160240 +
ccattttcacttgtttcaag

SEQ ID NO: 972 - DNA, 20 bp, Artificial Sequence
  Synthetic oligonucleotide; TAG chr11 5160253 5160272 5160269 +
aatttccttcttaatttctt

SEQ ID NO: 973 - DNA, 20 bp, Artificial Sequence
  Synthetic oligonucleotide; TGG chr11 5160264 5160283 5160280 +
taatttctttagtgactcat

SEQ ID NO: 974 - DNA, 20 bp, Artificial Sequence
  Synthetic oligonucleotide; CAG chr11 5160272 5160291 5160288 +
ttagtgactcattggttatt

SEQ ID NO: 975 - DNA, 20 bp, Artificial Sequence
  Synthetic oligonucleotide; GAG chr11 5160293 5160312 5160309 +
agtttcatgcgcatccctgt

SEQ ID NO: 976 - DNA, 20 bp, Artificial Sequence
  Synthetic oligonucleotide; AGG chr11 5160294 5160313 5160310 +
gtttcatgcgcatccctgtg

SEQ ID NO: 977 - DNA, 20 bp, Artificial Sequence
  Synthetic oligonucleotide; GAG chr11 5160296 5160315 5160312 +
ttcatgcgcatccctgtgag

SEQ ID NO: 978 - DNA, 20 bp, Artificial Sequence
  Synthetic oligonucleotide; CAG chr11 5160308 5160327 5160324 +
cctgtgaggagactaccaaa

SEQ ID NO: 979 - DNA, 20 bp, Artificial Sequence
  Synthetic oligonucleotide; AGG chr11 5160309 5160328 5160325 +
ctgtgaggagactaccaaac

SEQ ID NO: 980 - DNA, 20 bp, Artificial Sequence
  Synthetic oligonucleotide; GAG chr11 5160320 5160339 5160336 +
ctaccaaacaggctttgtgt

SEQ ID NO: 981 - DNA, 20 bp, Artificial Sequence
  Synthetic oligonucleotide; AAG chr11 5160328 5160347 5160344 +
caggctttgtgtgagcaata

SEQ ID NO: 982 - DNA, 20 bp, Artificial Sequence
  Synthetic oligonucleotide; TGG chr11 5160343 5160362 5160359 +
caataaagctttttatcacc

SEQ ID NO: 983 - DNA, 20 bp, Artificial Sequence
  Synthetic oligonucleotide; GGG chr11 5160344 5160363 5160360 +
aataaagctttttatcacct

SEQ ID NO: 984 - DNA, 20 bp, Artificial Sequence
  Synthetic oligonucleotide; CAG chr11 5160349 5160368 5160365 +
agctttttatcacctgggtg

SEQ ID NO: 985 - DNA, 20 bp, Artificial Sequence
  Synthetic oligonucleotide; AGG chr11 5160350 5160369 5160366 +
gctttttatcacctgggtgc

SEQ ID NO: 986 - DNA, 20 bp, Artificial Sequence
  Synthetic oligonucleotide; CGG chr11 5160353 5160372 5160369 +
ttttatcacctgggtgcagg

SEQ ID NO: 987 - DNA, 20 bp, Artificial Sequence
  Synthetic oligonucleotide; GGG chr11 5160354 5160373 5160370 +
tttatcacctgggtgcaggc

SEQ ID NO: 988 - DNA, 20 bp, Artificial Sequence
  Synthetic oligonucleotide; GAG chr11 5160359 5160378 5160375 +
cacctgggtgcaggcgggct

SEQ ID NO: 989 - DNA, 20 bp, Artificial Sequence
  Synthetic oligonucleotide; AAG chr11 5160368 5160387 5160384 +
gcaggcgggctgagtccgaa

SEQ ID NO: 990 - DNA, 20 bp, Artificial Sequence
  Synthetic oligonucleotide; GAG chr11 5160370 5160389 5160386 +
aggcgggctgagtccgaaaa

SEQ ID NO: 991 - DNA, 20 bp, Artificial Sequence
  Synthetic oligonucleotide; GAG chr11 5160372 5160391 5160388 +
gcgggctgagtccgaaaaga

SEQ ID NO: 992 - DNA, 20 bp, Artificial Sequence
  Synthetic oligonucleotide; CAG chr11 5160376 5160395 5160392 +
gctgagtccgaaaagagagt

SEQ ID NO: 993 - DNA, 20 bp, Artificial Sequence
  Synthetic oligonucleotide; AAG chr11 5160381 5160400 5160397 +
gtccgaaaagagagtcagca

SEQ ID NO: 994 - DNA, 20 bp, Artificial Sequence
  Synthetic oligonucleotide; AGG chr11 5160382 5160401 5160398 +
tccgaaaagagagtcagcaa

SEQ ID NO: 995 - DNA, 20 bp, Artificial Sequence
  Synthetic oligonucleotide; GGG chr11 5160383 5160402 5160399 +
ccgaaaagagagtcagcaaa

SEQ ID NO: 996 - DNA, 20 bp, Artificial Sequence
  Synthetic oligonucleotide; GAG chr11 5160385 5160404 5160401 +
gaaaagagagtcagcaaagg

SEQ ID NO: 997 - DNA, 20 bp, Artificial Sequence
  Synthetic oligonucleotide; TAG chr11 5160389 5160408 5160405 +
agagagtcagcaaagggaga

SEQ ID NO: 998 - DNA, 20 bp, Artificial Sequence
  Synthetic oligonucleotide; AGG chr11 5160390 5160409 5160406 +
gagagtcagcaaagggagat

SEQ ID NO: 999 - DNA, 20 bp, Artificial Sequence
  Synthetic oligonucleotide; GAG chr11 5160392 5160411 5160408 +
gagtcagcaaagggagatag

SEQ ID NO: 1000 - DNA, 20 bp, Artificial Sequence
  Synthetic oligonucleotide; TGG chr11 5160395 5160414 5160411 +
tcagcaaagggagataggag

SEQ ID NO: 1001 - DNA, 20 bp, Artificial Sequence
  Synthetic oligonucleotide; GGG chr11 5160396 5160415 5160412 +
cagcaaagggagataggagt

SEQ ID NO: 1002 - DNA, 20 bp, Artificial Sequence
  Synthetic oligonucleotide; GGG chr11 5160397 5160416 5160413 +
agcaaagggagataggagtg

SEQ ID NO: 1003 - DNA, 20 bp, Artificial Sequence
  Synthetic oligonucleotide; AAG chr11 5160409 5160428 5160425 +
taggagtggggctgttttat

SEQ ID NO: 1004 - DNA, 20 bp, Artificial Sequence
  Synthetic oligonucleotide; TGG chr11 5160415 5160434 5160431 +
tggggctgttttataagatt

SEQ ID NO: 1005 - DNA, 20 bp, Artificial Sequence
  Synthetic oligonucleotide; GGG chr11 5160416 5160435 5160432 +
ggggctgttttataagattt

SEQ ID NO: 1006 - DNA, 20 bp, Artificial Sequence
  Synthetic oligonucleotide; TAG chr11 5160419 5160438 5160435 +
gctgttttataagatttggg

SEQ ID NO: 1007 - DNA, 20 bp, Artificial Sequence
  Synthetic oligonucleotide; AGG chr11 5160420 5160439 5160436 +
ctgttttataagatttgggt

SEQ ID NO: 1008 - DNA, 20 bp, Artificial Sequence
  Synthetic oligonucleotide; AAG chr11 5160425 5160444 5160441 +
ttataagatttgggtaggta

SEQ ID NO: 1009 - DNA, 20 bp, Artificial Sequence
  Synthetic oligonucleotide; AGG chr11 5160426 5160445 5160442 +
tataagatttgggtaggtaa

SEQ ID NO: 1010 - DNA, 20 bp, Artificial Sequence
  Synthetic oligonucleotide; CAG chr11 5160436 5160455 5160452 +
gggtaggtaaaggaaaatta

SEQ ID NO: 1011 - DNA, 20 bp, Artificial Sequence
  Synthetic oligonucleotide; AAG chr11 5160442 5160461 5160458 +
gtaaaggaaaattacagtca

SEQ ID NO: 1012 - DNA, 20 bp, Artificial Sequence
  Synthetic oligonucleotide; AGG chr11 5160443 5160462 5160459 +
taaaggaaaattacagtcaa

SEQ ID NO: 1013 - DNA, 20 bp, Artificial Sequence
  Synthetic oligonucleotide; GGG chr11 5160444 5160463 5160460 +
aaaggaaaattacagtcaaa

SEQ ID NO: 1014 - DNA, 20 bp, Artificial Sequence
  Synthetic oligonucleotide; GGG chr11 5160445 5160464 5160461 +
aaggaaaattacagtcaaag

SEQ ID NO: 1015 - DNA, 20 bp, Artificial Sequence
  Synthetic oligonucleotide; GGG chr11 5160446 5160465 5160462 +
aggaaaattacagtcaaagg

SEQ ID NO: 1016 - DNA, 20 bp, Artificial Sequence
  Synthetic oligonucleotide; GGG chr11 5160447 5160466 5160463 +
ggaaaattacagtcaaaggg

SEQ ID NO: 1017 - DNA, 20 bp, Artificial Sequence
  Synthetic oligonucleotide; TGG chr11 5160458 5160477 5160474 +
gtcaaaggggggttgttctc

SEQ ID NO: 1018 - DNA, 20 bp, Artificial Sequence
  Synthetic oligonucleotide; CGG chr11 5160461 5160480 5160477 +
aaaggggggttgttctctgg

SEQ ID NO: 1019 - DNA, 20 bp, Artificial Sequence
  Synthetic oligonucleotide; GGG chr11 5160462 5160481 5160478 +
aaggggggttgttctctggc

SEQ ID NO: 1020 - DNA, 20 bp, Artificial Sequence
  Synthetic oligonucleotide; CAG chr11 5160465 5160484 5160481 +
gggggttgttctctggcggg

SEQ ID NO: 1021 - DNA, 20 bp, Artificial Sequence
  Synthetic oligonucleotide; AGG chr11 5160466 5160485 5160482 +
ggggttgttctctggcgggc

SEQ ID NO: 1022 - DNA, 20 bp, Artificial Sequence
  Synthetic oligonucleotide; GAG chr11 5160468 5160487 5160484 +
ggttgttctctggcgggcag

SEQ ID NO: 1023 - DNA, 20 bp, Artificial Sequence
  Synthetic oligonucleotide; TGG chr11 5160471 5160490 5160487 +
tgttctctggcgggcaggag

SEQ ID NO: 1024 - DNA, 20 bp, Artificial Sequence
  Synthetic oligonucleotide; GGG chr11 5160472 5160491 5160488 +
gttctctggcgggcaggagt

SEQ ID NO: 1025 - DNA, 20 bp, Artificial Sequence
  Synthetic oligonucleotide; GGG chr11 5160473 5160492 5160489 +
ttctctggcgggcaggagtg

SEQ ID NO: 1026 - DNA, 20 bp, Artificial Sequence
  Synthetic oligonucleotide; GGG chr11 5160474 5160493 5160490 +
tctctggcgggcaggagtgg

SEQ ID NO: 1027 - DNA, 20 bp, Artificial Sequence
  Synthetic oligonucleotide; GGG chr11 5160475 5160494 5160491 +
ctctggcgggcaggagtggg

SEQ ID NO: 1028 - DNA, 20 bp, Artificial Sequence
  Synthetic oligonucleotide; AAG chr11 5160482 5160501 5160498 +
gggcaggagtggggggtcac

SEQ ID NO: 1029 - DNA, 20 bp, Artificial Sequence
  Synthetic oligonucleotide; AGG chr11 5160483 5160502 5160499 +
ggcaggagtggggggtcaca

SEQ ID NO: 1030 - DNA, 20 bp, Artificial Sequence
  Synthetic oligonucleotide; CAG chr11 5160490 5160509 5160506 +
gtggggggtcacaaggtgct

SEQ ID NO: 1031 - DNA, 20 bp, Artificial Sequence
  Synthetic oligonucleotide; TAG chr11 5160493 5160512 5160509 +
gggggtcacaaggtgctcag

SEQ ID NO: 1032 - DNA, 20 bp, Artificial Sequence
  Synthetic oligonucleotide; AGG chr11 5160494 5160513 5160510 +
ggggtcacaaggtgctcagt

SEQ ID NO: 1033 - DNA, 20 bp, Artificial Sequence
  Synthetic oligonucleotide; GGG chr11 5160495 5160514 5160511 +
gggtcacaaggtgctcagta

SEQ ID NO: 1034 - DNA, 20 bp, Artificial Sequence
  Synthetic oligonucleotide; GGG chr11 5160496 5160515 5160512 +
ggtcacaaggtgctcagtag

SEQ ID NO: 1035 - DNA, 20 bp, Artificial Sequence
  Synthetic oligonucleotide; GAG chr11 5160498 5160517 5160514 +
tcacaaggtgctcagtaggg

SEQ ID NO: 1036 - DNA, 20 bp, Artificial Sequence
  Synthetic oligonucleotide; GAG chr11 5160506 5160525 5160522 +
tgctcagtaggggagctttt

SEQ ID NO: 1037 - DNA, 20 bp, Artificial Sequence
  Synthetic oligonucleotide; CAG chr11 5160510 5160529 5160526 +
cagtaggggagcttttgagc

SEQ ID NO: 1038 - DNA, 20 bp, Artificial Sequence
  Synthetic oligonucleotide; AGG chr11 5160511 5160530 5160527 +
agtaggggagcttttgagcc

SEQ ID NO: 1039 - DNA, 20 bp, Artificial Sequence
  Synthetic oligonucleotide; GAG chr11 5160516 5160535 5160532 +
gggagcttttgagccaggat

SEQ ID NO: 1040 - DNA, 20 bp, Artificial Sequence
  Synthetic oligonucleotide; CAG chr11 5160520 5160539 5160536 +
gcttttgagccaggatgagc

SEQ ID NO: 1041 - DNA, 20 bp, Artificial Sequence
  Synthetic oligonucleotide; AGG chr11 5160521 5160540 5160537 +
cttttgagccaggatgagcc

SEQ ID NO: 1042 - DNA, 20 bp, Artificial Sequence
  Synthetic oligonucleotide; GAG chr11 5160523 5160542 5160539 +
tttgagccaggatgagccag

SEQ ID NO: 1043 - DNA, 20 bp, Artificial Sequence
  Synthetic oligonucleotide; AAG chr11 5160526 5160545 5160542 +
gagccaggatgagccaggag

SEQ ID NO: 1044 - DNA, 20 bp, Artificial Sequence
  Synthetic oligonucleotide; AGG chr11 5160527 5160546 5160543 +
agccaggatgagccaggaga

SEQ ID NO: 1045 - DNA, 20 bp, Artificial Sequence
  Synthetic oligonucleotide; AAG chr11 5160538 5160557 5160554 +
gccaggagaaggactttcac

SEQ ID NO: 1046 - DNA, 20 bp, Artificial Sequence
  Synthetic oligonucleotide; CAG chr11 5160551 5160570 5160567 +
ctttcacaagacaatgtcat

SEQ ID NO: 1047 - DNA, 20 bp, Artificial Sequence
  Synthetic oligonucleotide; AAG chr11 5160556 5160575 5160572 +
acaagacaatgtcatcagtt

SEQ ID NO: 1048 - DNA, 20 bp, Artificial Sequence
  Synthetic oligonucleotide; AGG chr11 5160557 5160576 5160573 +
caagacaatgtcatcagtta

SEQ ID NO: 1049 - DNA, 20 bp, Artificial Sequence
  Synthetic oligonucleotide; CAG chr11 5160560 5160579 5160576 +
gacaatgtcatcagttaagg

SEQ ID NO: 1050 - DNA, 20 bp, Artificial Sequence
  Synthetic oligonucleotide; AGG chr11 5160561 5160580 5160577 +
acaatgtcatcagttaaggc

SEQ ID NO: 1051 - DNA, 20 bp, Artificial Sequence
  Synthetic oligonucleotide; CAG chr11 5160566 5160585 5160582 +
gtcatcagttaaggcaggaa

SEQ ID NO: 1052 - DNA, 20 bp, Artificial Sequence
  Synthetic oligonucleotide; AGG chr11 5160567 5160586 5160583 +
tcatcagttaaggcaggaac

SEQ ID NO: 1053 - DNA, 20 bp, Artificial Sequence
  Synthetic oligonucleotide; TGG chr11 5160588 5160607 5160604 +
ggccattttcacttcttttg

SEQ ID NO: 1054 - DNA, 20 bp, Artificial Sequence
  Synthetic oligonucleotide; TGG chr11 5160591 5160610 5160607 +
cattttcacttcttttgtgg

SEQ ID NO: 1055 - DNA, 20 bp, Artificial Sequence
  Synthetic oligonucleotide; CAG chr11 5160602 5160621 5160618 +
cttttgtggtggaatgtcat

SEQ ID NO: 1056 - DNA, 20 bp, Artificial Sequence
  Synthetic oligonucleotide; AAG chr11 5160607 5160626 5160623 +
gtggtggaatgtcatcagtt

SEQ ID NO: 1057 - DNA, 20 bp, Artificial Sequence
  Synthetic oligonucleotide; AGG chr11 5160608 5160627 5160624 +
tggtggaatgtcatcagtta

SEQ ID NO: 1058 - DNA, 20 bp, Artificial Sequence
  Synthetic oligonucleotide; CAG chr11 5160611 5160630 5160627 +
tggaatgtcatcagttaagg

SEQ ID NO: 1059 - DNA, 20 bp, Artificial Sequence
  Synthetic oligonucleotide; AGG chr11 5160612 5160631 5160628 +
ggaatgtcatcagttaaggc

SEQ ID NO: 1060 - DNA, 20 bp, Artificial Sequence
  Synthetic oligonucleotide; TGG chr11 5160618 5160637 5160634 +
tcatcagttaaggcaggaac

SEQ ID NO: 1061 - DNA, 20 bp, Artificial Sequence
  Synthetic oligonucleotide; CAG chr11 5160640 5160659 5160656 +
gccatctgtatgtgtacctg

SEQ ID NO: 1062 - DNA, 20 bp, Artificial Sequence
  Synthetic oligonucleotide; AGG chr11 5160641 5160660 5160657 +
ccatctgtatgtgtacctgc

SEQ ID NO: 1063 - DNA, 20 bp, Artificial Sequence
  Synthetic oligonucleotide; CAG chr11 5160647 5160666 5160663 +
gtatgtgtacctgcaggtca

SEQ ID NO: 1064 - DNA, 20 bp, Artificial Sequence
  Synthetic oligonucleotide; AGG chr11 5160648 5160667 5160664 +
tatgtgtacctgcaggtcac

SEQ ID NO: 1065 - DNA, 20 bp, Artificial Sequence
  Synthetic oligonucleotide; GGG chr11 5160649 5160668 5160665 +
atgtgtacctgcaggtcaca

SEQ ID NO: 1066 - DNA, 20 bp, Artificial Sequence
  Synthetic oligonucleotide; GGG chr11 5160650 5160669 5160666 +
tgtgtacctgcaggtcacag

SEQ ID NO: 1067 - DNA, 20 bp, Artificial Sequence
  Synthetic oligonucleotide; TGG chr11 5160659 5160678 5160675 +
gcaggtcacaggggacatga

SEQ ID NO: 1068 - DNA, 20 bp, Artificial Sequence
  Synthetic oligonucleotide; TAG chr11 5160664 5160683 5160680 +
tcacaggggacatgatggct

SEQ ID NO: 1069 - DNA, 20 bp, Artificial Sequence
  Synthetic oligonucleotide; TGG chr11 5160669 5160688 5160685 +
ggggacatgatggcttagct

SEQ ID NO: 1070 - DNA, 20 bp, Artificial Sequence
  Synthetic oligonucleotide; GGG chr11 5160670 5160689 5160686 +
gggacatgatggcttagctt

SEQ ID NO: 1071 - DNA, 20 bp, Artificial Sequence
  Synthetic oligonucleotide; CAG chr11 5160675 5160694 5160691 +
atgatggcttagcttgggct

SEQ ID NO: 1072 - DNA, 20 bp, Artificial Sequence
  Synthetic oligonucleotide; GAG chr11 5160677 5160696 5160693 +
gatggcttagcttgggctca

SEQ ID NO: 1073 - DNA, 20 bp, Artificial Sequence
  Synthetic oligonucleotide; AGG chr11 5160678 5160697 5160694 +
atggcttagcttgggctcag

SEQ ID NO: 1074 - DNA, 20 bp, Artificial Sequence
  Synthetic oligonucleotide; AAG chr11 5160709 5160728 5160725 +
tcctgtcttcttatattaat

SEQ ID NO: 1075 - DNA, 20 bp, Artificial Sequence
  Synthetic oligonucleotide; TAG chr11 5160727 5160746 5160743 +
ataagaaaaataaaacataa

SEQ ID NO: 1076 - DNA, 20 bp, Artificial Sequence
  Synthetic oligonucleotide; AAG chr11 5160735 5160754 5160751 +
aataaaacataatagtgttg

SEQ ID NO: 1077 - DNA, 20 bp, Artificial Sequence
  Synthetic oligonucleotide; TGG chr11 5160741 5160760 5160757 +
acataatagtgttgaagtgt

SEQ ID NO: 1078 - DNA, 20 bp, Artificial Sequence
  Synthetic oligonucleotide; GGG chr11 5160742 5160761 5160758 +
cataatagtgttgaagtgtt

SEQ ID NO: 1079 - DNA, 20 bp, Artificial Sequence
  Synthetic oligonucleotide; GGG chr11 5160743 5160762 5160759 +
ataatagtgttgaagtgttg

SEQ ID NO: 1080 - DNA, 20 bp, Artificial Sequence
  Synthetic oligonucleotide; CAG chr11 5160746 5160765 5160762 +
atagtgttgaagtgttgggg

SEQ ID NO: 1081 - DNA, 20 bp, Artificial Sequence
  Synthetic oligonucleotide; TGG chr11 5160758 5160777 5160774 +
tgttggggcagcgaaaattt

SEQ ID NO: 1082 - DNA, 20 bp, Artificial Sequence
  Synthetic oligonucleotide; GGG chr11 5160759 5160778 5160775 +
gttggggcagcgaaaatttt

SEQ ID NO: 1083 - DNA, 20 bp, Artificial Sequence
  Synthetic oligonucleotide; GGG chr11 5160760 5160779 5160776 +
ttggggcagcgaaaattttg

SEQ ID NO: 1084 - DNA, 20 bp, Artificial Sequence
  Synthetic oligonucleotide; GGG chr11 5160761 5160780 5160777 +
tggggcagcgaaaattttgg

SEQ ID NO: 1085 - DNA, 20 bp, Artificial Sequence
  Synthetic oligonucleotide; TGG chr11 5160765 5160784 5160781 +
gcagcgaaaattttggggga

SEQ ID NO: 1086 - DNA, 20 bp, Artificial Sequence
  Synthetic oligonucleotide; TGG chr11 5160770 5160789 5160786 +
gaaaattttgggggatggta

SEQ ID NO: 1087 - DNA, 20 bp, Artificial Sequence
  Synthetic oligonucleotide; GAG chr11 5160772 5160791 5160788 +
aaattttgggggatggtatg

SEQ ID NO: 1088 - DNA, 20 bp, Artificial Sequence
  Synthetic oligonucleotide; GAG chr11 5160774 5160793 5160790 +
attttgggggatggtatgga

SEQ ID NO: 1089 - DNA, 20 bp, Artificial Sequence
  Synthetic oligonucleotide; TGG chr11 5160781 5160800 5160797 +
gggatggtatggagagataa

SEQ ID NO: 1090 - DNA, 20 bp, Artificial Sequence
  Synthetic oligonucleotide; GGG chr11 5160782 5160801 5160798 +
ggatggtatggagagataat

SEQ ID NO: 1091 - DNA, 20 bp, Artificial Sequence
  Synthetic oligonucleotide; CAG chr11 5160795 5160814 5160811 +
agataatgggcgatatttct

SEQ ID NO: 1092 - DNA, 20 bp, Artificial Sequence
  Synthetic oligonucleotide; AGG chr11 5160796 5160815 5160812 +
gataatgggcgatatttctc

SEQ ID NO: 1093 - DNA, 20 bp, Artificial Sequence
  Synthetic oligonucleotide; GGG chr11 5160797 5160816 5160813 +
ataatgggcgatatttctca

SEQ ID NO: 1094 - DNA, 20 bp, Artificial Sequence
  Synthetic oligonucleotide; GAG chr11 5160807 5160826 5160823 +
atatttctcagggctgcttc

SEQ ID NO: 1095 - DNA, 20 bp, Artificial Sequence
  Synthetic oligonucleotide; CGG chr11 5160810 5160829 5160826 +
tttctcagggctgcttcgag

SEQ ID NO: 1096 - DNA, 20 bp, Artificial Sequence
  Synthetic oligonucleotide; GGG chr11 5160811 5160830 5160827 +
ttctcagggctgcttcgagc

SEQ ID NO: 1097 - DNA, 20 bp, Artificial Sequence
  Synthetic oligonucleotide; TAG chr11 5160816 5160835 5160832 +
agggctgcttcgagcgggat

SEQ ID NO: 1098 - DNA, 20 bp, Artificial Sequence
  Synthetic oligonucleotide; AGG chr11 5160817 5160836 5160833 +
gggctgcttcgagcgggatt

SEQ ID NO: 1099 - DNA, 20 bp, Artificial Sequence
  Synthetic oligonucleotide; GGG chr11 5160818 5160837 5160834 +
ggctgcttcgagcgggatta

SEQ ID NO: 1100 - DNA, 20 bp, Artificial Sequence
  Synthetic oligonucleotide; GGG chr11 5160819 5160838 5160835 +
gctgcttcgagcgggattag

SEQ ID NO: 1101 - DNA, 20 bp, Artificial Sequence
  Synthetic oligonucleotide; CGG chr11 5160822 5160841 5160838 +
gcttcgagcgggattagggg

SEQ ID NO: 1102 - DNA, 20 bp, Artificial Sequence
  Synthetic oligonucleotide; TGG chr11 5160827 5160846 5160843 +
gagcgggattaggggcggcg

SEQ ID NO: 1103 - DNA, 20 bp, Artificial Sequence
  Synthetic oligonucleotide; GGG chr11 5160828 5160847 5160844 +
agcgggattaggggcggcgt

SEQ ID NO: 1104 - DNA, 20 bp, Artificial Sequence
  Synthetic oligonucleotide; TAG chr11 5160835 5160854 5160851 +
ttaggggcggcgtgggaacc

SEQ ID NO: 1105 - DNA, 20 bp, Artificial Sequence
  Synthetic oligonucleotide; GAG chr11 5160837 5160856 5160853 +
aggggcggcgtgggaaccta

SEQ ID NO: 1106 - DNA, 20 bp, Artificial Sequence
  Synthetic oligonucleotide; TGG chr11 5160840 5160859 5160856 +
ggcggcgtgggaacctagag

SEQ ID NO: 1107 - DNA, 20 bp, Artificial Sequence
  Synthetic oligonucleotide; GGG chr11 5160841 5160860 5160857 +
gcggcgtgggaacctagagt

SEQ ID NO: 1108 - DNA, 20 bp, Artificial Sequence
  Synthetic oligonucleotide; GAG chr11 5160843 5160862 5160859 +
ggcgtgggaacctagagtgg

SEQ ID NO: 1109 - DNA, 20 bp, Artificial Sequence
  Synthetic oligonucleotide; GAG chr11 5160845 5160864 5160861 +
cgtgggaacctagagtggga

SEQ ID NO: 1110 - DNA, 20 bp, Artificial Sequence
  Synthetic oligonucleotide; AAG chr11 5160851 5160870 5160867 +
aacctagagtgggagagatt

SEQ ID NO: 1111 - DNA, 20 bp, Artificial Sequence
  Synthetic oligonucleotide; AAG chr11 5160857 5160876 5160873 +
gagtgggagagattaagctg

SEQ ID NO: 1112 - DNA, 20 bp, Artificial Sequence
  Synthetic oligonucleotide; AGG chr11 5160858 5160877 5160874 +
agtgggagagattaagctga

SEQ ID NO: 1113 - DNA, 20 bp, Artificial Sequence
  Synthetic oligonucleotide; AAG chr11 5160861 5160880 5160877 +
gggagagattaagctgaagg

SEQ ID NO: 1114 - DNA, 20 bp, Artificial Sequence
  Synthetic oligonucleotide; TGG chr11 5160870 5160889 5160886 +
taagctgaaggaagattttg

SEQ ID NO: 1115 - DNA, 20 bp, Artificial Sequence
  Synthetic oligonucleotide; AAG chr11 5160874 5160893 5160890 +
ctgaaggaagattttgtggt

SEQ ID NO: 1116 - DNA, 20 bp, Artificial Sequence
  Synthetic oligonucleotide; AGG chr11 5160875 5160894 5160891 +
tgaaggaagattttgtggta

SEQ ID NO: 1117 - DNA, 20 bp, Artificial Sequence
  Synthetic oligonucleotide; GGG chr11 5160876 5160895 5160892 +
gaaggaagattttgtggtaa

SEQ ID NO: 1118 - DNA, 20 bp, Artificial Sequence
  Synthetic oligonucleotide; GGG chr11 5160877 5160896 5160893 +
aaggaagattttgtggtaag

SEQ ID NO: 1119 - DNA, 20 bp, Artificial Sequence
  Synthetic oligonucleotide; TGG chr11 5160888 5160907 5160904 +
tgtggtaaggggtgatattg

SEQ ID NO: 1120 - DNA, 20 bp, Artificial Sequence
  Synthetic oligonucleotide; GGG chr11 5160889 5160908 5160905 +
gtggtaaggggtgatattgt

SEQ ID NO: 1121 - DNA, 20 bp, Artificial Sequence
  Synthetic oligonucleotide; GGG chr11 5160890 5160909 5160906 +
tggtaaggggtgatattgtg

SEQ ID NO: 1122 - DNA, 20 bp, Artificial Sequence
  Synthetic oligonucleotide; TAG chr11 5160897 5160916 5160913 +
gggtgatattgtggggttgt

SEQ ID NO: 1123 - DNA, 20 bp, Artificial Sequence
  Synthetic oligonucleotide; AAG chr11 5160900 5160919 5160916 +
tgatattgtggggttgttag

SEQ ID NO: 1124 - DNA, 20 bp, Artificial Sequence
  Synthetic oligonucleotide; TAG chr11 5160917 5160936 5160933 +
tagaagaaacatttgtcatg

SEQ ID NO: 1125 - DNA, 20 bp, Artificial Sequence
  Synthetic oligonucleotide; TGG chr11 5160926 5160945 5160942 +
catttgtcatgtagaattat

SEQ ID NO: 1126 - DNA, 20 bp, Artificial Sequence
  Synthetic oligonucleotide; TGG chr11 5160932 5160951 5160948 +
tcatgtagaattattggtga

SEQ ID NO: 1127 - DNA, 20 bp, Artificial Sequence
  Synthetic oligonucleotide; TGG chr11 5160937 5160956 5160953 +
tagaattattggtgatggcc

SEQ ID NO: 1128 - DNA, 20 bp, Artificial Sequence
  Synthetic oligonucleotide; CGG chr11 5160943 5160962 5160959 +
tattggtgatggcctggata

SEQ ID NO: 1129 - DNA, 20 bp, Artificial Sequence
  Synthetic oligonucleotide; TGG chr11 5160953 5160972 5160969 +
ggcctggatacggttttgta

SEQ ID NO: 1130 - DNA, 20 bp, Artificial Sequence
  Synthetic oligonucleotide; TGG chr11 5160970 5160989 5160986 +
gtatggattgaaaaaccaaa

SEQ ID NO: 1131 - DNA, 20 bp, Artificial Sequence
  Synthetic oligonucleotide; AAG chr11 5160976 5160995 5160992 +
attgaaaaaccaaatggaat

SEQ ID NO: 1132 - DNA, 20 bp, Artificial Sequence
  Synthetic oligonucleotide; GAG chr11 5160978 5160997 5160994 +
tgaaaaaccaaatggaataa

SEQ ID NO: 1133 - DNA, 20 bp, Artificial Sequence
  Synthetic oligonucleotide; AAG chr11 5160981 5161000 5160997 +
aaaaccaaatggaataagag

SEQ ID NO: 1134 - DNA, 20 bp, Artificial Sequence
  Synthetic oligonucleotide; AGG chr11 5160982 5161001 5160998 +
aaaccaaatggaataagaga

SEQ ID NO: 1135 - DNA, 20 bp, Artificial Sequence
  Synthetic oligonucleotide; GAG chr11 5160984 5161003 5161000 +
accaaatggaataagagaag

SEQ ID NO: 1136 - DNA, 20 bp, Artificial Sequence
  Synthetic oligonucleotide; CAG chr11 5160992 5161011 5161008 +
gaataagagaaggagaaaaa

SEQ ID NO: 1137 - DNA, 20 bp, Artificial Sequence
  Synthetic oligonucleotide; AGG chr11 5160993 5161012 5161009 +
aataagagaaggagaaaaac

SEQ ID NO: 1138 - DNA, 20 bp, Artificial Sequence
  Synthetic oligonucleotide; AAG chr11 5161001 5161020 5161017 +
aaggagaaaaacaggtatta

SEQ ID NO: 1139 - DNA, 20 bp, Artificial Sequence
  Synthetic oligonucleotide; AGG chr11 5161002 5161021 5161018 +
aggagaaaaacaggtattaa

SEQ ID NO: 1140 - DNA, 20 bp, Artificial Sequence
  Synthetic oligonucleotide; AAG chr11 5161008 5161027 5161024 +
aaaacaggtattaaaggact

SEQ ID NO: 1141 - DNA, 20 bp, Artificial Sequence
  Synthetic oligonucleotide; AAG chr11 5161011 5161030 5161027 +
acaggtattaaaggactaag

SEQ ID NO: 1142 - DNA, 20 bp, Artificial Sequence
  Synthetic oligonucleotide; TGG chr11 5161014 5161033 5161030 +
ggtattaaaggactaagaag

SEQ ID NO: 1143 - DNA, 20 bp, Artificial Sequence
  Synthetic oligonucleotide; GGG chr11 5161015 5161034 5161031 +
gtattaaaggactaagaagt

SEQ ID NO: 1144 - DNA, 20 bp, Artificial Sequence
  Synthetic oligonucleotide; GAG chr11 5161017 5161036 5161033 +
attaaaggactaagaagtgg

SEQ ID NO: 1145 - DNA, 20 bp, Artificial Sequence
  Synthetic oligonucleotide; AGG chr11 5161018 5161037 5161034 +
ttaaaggactaagaagtggg

SEQ ID NO: 1146 - DNA, 20 bp, Artificial Sequence
  Synthetic oligonucleotide; TAG chr11 5161024 5161043 5161040 +
gactaagaagtgggaggacc

SEQ ID NO: 1147 - DNA, 20 bp, Artificial Sequence
  Synthetic oligonucleotide; AGG chr11 5161025 5161044 5161041 +
actaagaagtgggaggacct

SEQ ID NO: 1148 - DNA, 20 bp, Artificial Sequence
  Synthetic oligonucleotide; AAG chr11 5161039 5161058 5161055 +
ggacctaggacatctgatta

SEQ ID NO: 1149 - DNA, 20 bp, Artificial Sequence
  Synthetic oligonucleotide; GAG chr11 5161041 5161060 5161057 +
acctaggacatctgattaaa

SEQ ID NO: 1150 - DNA, 20 bp, Artificial Sequence
  Synthetic oligonucleotide; AAG chr11 5161049 5161068 5161065 +
catctgattaaagagtgcct

SEQ ID NO: 1151 - DNA, 20 bp, Artificial Sequence
  Synthetic oligonucleotide; AGG chr11 5161050 5161069 5161066 +
atctgattaaagagtgccta

SEQ ID NO: 1152 - DNA, 20 bp, Artificial Sequence
  Synthetic oligonucleotide; GAG chr11 5161052 5161071 5161068 +
ctgattaaagagtgcctaag

SEQ ID NO: 1153 - DNA, 20 bp, Artificial Sequence
  Synthetic oligonucleotide; TAG chr11 5161063 5161082 5161079 +
gtgcctaaggagattcaaca

SEQ ID NO: 1154 - DNA, 20 bp, Artificial Sequence
  Synthetic oligonucleotide; CAG chr11 5161072 5161091 5161088 +
gagattcaacatagtcctgc

SEQ ID NO: 1155 - DNA, 20 bp, Artificial Sequence
  Synthetic oligonucleotide; AAG chr11 5161077 5161096 5161093 +
tcaacatagtcctgccagca

SEQ ID NO: 1156 - DNA, 20 bp, Artificial Sequence
  Synthetic oligonucleotide; AAG chr11 5161096 5161115 5161112 +
aaagattatttatttacttc

SEQ ID NO: 1157 - DNA, 20 bp, Artificial Sequence
  Synthetic oligonucleotide; GAG chr11 5161098 5161117 5161114 +
agattatttatttacttcaa

SEQ ID NO: 1158 - DNA, 20 bp, Artificial Sequence
  Synthetic oligonucleotide; AAG chr11 5161103 5161122 5161119 +
atttatttacttcaagagtt

SEQ ID NO: 1159 - DNA, 20 bp, Artificial Sequence
  Synthetic oligonucleotide; GAG chr11 5161105 5161124 5161121 +
ttatttacttcaagagttaa

SEQ ID NO: 1160 - DNA, 20 bp, Artificial Sequence
  Synthetic oligonucleotide; TGG chr11 5161108 5161127 5161124 +
tttacttcaagagttaagag

SEQ ID NO: 1161 - DNA, 20 bp, Artificial Sequence
  Synthetic oligonucleotide; CAG chr11 5161111 5161130 5161127 +
acttcaagagttaagagtgg

SEQ ID NO: 1162 - DNA, 20 bp, Artificial Sequence
  Synthetic oligonucleotide; TGG chr11 5161116 5161135 5161132 +
aagagttaagagtggcagtt

SEQ ID NO: 1163 - DNA, 20 bp, Artificial Sequence
  Synthetic oligonucleotide; GGG chr11 5161117 5161136 5161133 +
agagttaagagtggcagttt

SEQ ID NO: 1164 - DNA, 20 bp, Artificial Sequence
  Synthetic oligonucleotide; GGG chr11 5161118 5161137 5161134 +
gagttaagagtggcagtttg

SEQ ID NO: 1165 - DNA, 20 bp, Artificial Sequence
  Synthetic oligonucleotide; TAG chr11 5161122 5161141 5161138 +
taagagtggcagtttgggga

SEQ ID NO: 1166 - DNA, 20 bp, Artificial Sequence
  Synthetic oligonucleotide; CAG chr11 5161128 5161147 5161144 +
tggcagtttggggatagcac

SEQ ID NO: 1167 - DNA, 20 bp, Artificial Sequence
  Synthetic oligonucleotide; AGG chr11 5161129 5161148 5161145 +
ggcagtttggggatagcacc

SEQ ID NO: 1168 - DNA, 20 bp, Artificial Sequence
  Synthetic oligonucleotide; GAG chr11 5161131 5161150 5161147 +
cagtttggggatagcaccag

SEQ ID NO: 1169 - DNA, 20 bp, Artificial Sequence
  Synthetic oligonucleotide; CAG chr11 5161138 5161157 5161154 +
gggatagcaccaggagatat

SEQ ID NO: 1170 - DNA, 20 bp, Artificial Sequence
  Synthetic oligonucleotide; TGG chr11 5161147 5161166 5161163 +
ccaggagatatcagctgtga

SEQ ID NO: 1171 - DNA, 20 bp, Artificial Sequence
  Synthetic oligonucleotide; TGG chr11 5161152 5161171 5161168 +
agatatcagctgtgatggct

SEQ ID NO: 1172 - DNA, 20 bp, Artificial Sequence
  Synthetic oligonucleotide; CAG chr11 5161160 5161179 5161176 +
gctgtgatggcttggaaaaa

SEQ ID NO: 1173 - DNA, 20 bp, Artificial Sequence
  Synthetic oligonucleotide; CGG chr11 5161170 5161189 5161186 +
cttggaaaaacagtgtaaac

SEQ ID NO: 1174 - DNA, 20 bp, Artificial Sequence
  Synthetic oligonucleotide; CAG chr11 5161173 5161192 5161189 +
ggaaaaacagtgtaaaccgg

SEQ ID NO: 1175 - DNA, 20 bp, Artificial Sequence
  Synthetic oligonucleotide; AAG chr11 5161183 5161202 5161199 +
tgtaaaccggcagtgtaaac

SEQ ID NO: 1176 - DNA, 20 bp, Artificial Sequence
  Synthetic oligonucleotide; GAG chr11 5161185 5161204 5161201 +
taaaccggcagtgtaaacaa

SEQ ID NO: 1177 - DNA, 20 bp, Artificial Sequence
  Synthetic oligonucleotide; CAG chr11 5161188 5161207 5161204 +
accggcagtgtaaacaagag

SEQ ID NO: 1178 - DNA, 20 bp, Artificial Sequence
  Synthetic oligonucleotide; AGG chr11 5161189 5161208 5161205 +
ccggcagtgtaaacaagagc

SEQ ID NO: 1179 - DNA, 20 bp, Artificial Sequence
  Synthetic oligonucleotide; GGG chr11 5161190 5161209 5161206 +
cggcagtgtaaacaagagca

SEQ ID NO: 1180 - DNA, 20 bp, Artificial Sequence
  Synthetic oligonucleotide; GAG chr11 5161200 5161219 5161216 +
aacaagagcagggcatgtat

SEQ ID NO: 1181 - DNA, 20 bp, Artificial Sequence
  Synthetic oligonucleotide; TAG chr11 5161203 5161222 5161219 +
aagagcagggcatgtatgag

SEQ ID NO: 1182 - DNA, 20 bp, Artificial Sequence
  Synthetic oligonucleotide; GAG chr11 5161208 5161227 5161224 +
cagggcatgtatgagtagtt

SEQ ID NO: 1183 - DNA, 20 bp, Artificial Sequence
  Synthetic oligonucleotide; TGG chr11 5161213 5161232 5161229 +
catgtatgagtagttgagaa

SEQ ID NO: 1184 - DNA, 20 bp, Artificial Sequence
  Synthetic oligonucleotide; TAG chr11 5161220 5161239 5161236 +
gagtagttgagaatggtgaa

SEQ ID NO: 1185 - DNA, 20 bp, Artificial Sequence
  Synthetic oligonucleotide; AGG chr11 5161221 5161240 5161237 +
agtagttgagaatggtgaat

SEQ ID NO: 1186 - DNA, 20 bp, Artificial Sequence
  Synthetic oligonucleotide; GAG chr11 5161223 5161242 5161239 +
tagttgagaatggtgaatag

SEQ ID NO: 1187 - DNA, 20 bp, Artificial Sequence
  Synthetic oligonucleotide; TAG chr11 5161232 5161251 5161248 +
atggtgaataggagtatgac

SEQ ID NO: 1188 - DNA, 20 bp, Artificial Sequence
  Synthetic oligonucleotide; CAG chr11 5161236 5161255 5161252 +
tgaataggagtatgactaga

SEQ ID NO: 1189 - DNA, 20 bp, Artificial Sequence
  Synthetic oligonucleotide; AAG chr11 5161239 5161258 5161255 +
ataggagtatgactagacag

SEQ ID NO: 1190 - DNA, 20 bp, Artificial Sequence
  Synthetic oligonucleotide; TAG chr11 5161243 5161262 5161259 +
gagtatgactagacagaaga

SEQ ID NO: 1191 - DNA, 20 bp, Artificial Sequence
  Synthetic oligonucleotide; CAG chr11 5161246 5161265 5161262 +
tatgactagacagaagatag

SEQ ID NO: 1192 - DNA, 20 bp, Artificial Sequence
  Synthetic oligonucleotide; AGG chr11 5161247 5161266 5161263 +
atgactagacagaagatagc

SEQ ID NO: 1193 - DNA, 20 bp, Artificial Sequence
  Synthetic oligonucleotide; GGG chr11 5161248 5161267 5161264 +
tgactagacagaagatagca

SEQ ID NO: 1194 - DNA, 20 bp, Artificial Sequence
  Synthetic oligonucleotide; AAG chr11 5161256 5161275 5161272 +
cagaagatagcagggatgac

SEQ ID NO: 1195 - DNA, 20 bp, Artificial Sequence
  Synthetic oligonucleotide; TGG chr11 5161265 5161284 5161281 +
gcagggatgacaagtttttt

SEQ ID NO: 1196 - DNA, 20 bp, Artificial Sequence
  Synthetic oligonucleotide; GGG chr11 5161266 5161285 5161282 +
cagggatgacaagttttttt

SEQ ID NO: 1197 - DNA, 20 bp, Artificial Sequence
  Synthetic oligonucleotide; GGG chr11 5161267 5161286 5161283 +
agggatgacaagtttttttg

SEQ ID NO: 1198 - DNA, 20 bp, Artificial Sequence
  Synthetic oligonucleotide; AAG chr11 5161278 5161297 5161294 +
gtttttttggggcacattct

SEQ ID NO: 1199 - DNA, 20 bp, Artificial Sequence
  Synthetic oligonucleotide; TGG chr11 5161282 5161301 5161298 +
ttttggggcacattctaagt

SEQ ID NO: 1200 - DNA, 20 bp, Artificial Sequence
  Synthetic oligonucleotide; TGG chr11 5161287 5161306 5161303 +
gggcacattctaagttggtc

SEQ ID NO: 1201 - DNA, 20 bp, Artificial Sequence
  Synthetic oligonucleotide; TGG chr11 5161294 5161313 5161310 +
ttctaagttggtctggtgtc

SEQ ID NO: 1202 - DNA, 20 bp, Artificial Sequence
  Synthetic oligonucleotide; TAG chr11 5161300 5161319 5161316 +
gttggtctggtgtctggaat

SEQ ID NO: 1203 - DNA, 20 bp, Artificial Sequence
  Synthetic oligonucleotide; TGG chr11 5161305 5161324 5161321 +
tctggtgtctggaattagac

SEQ ID NO: 1204 - DNA, 20 bp, Artificial Sequence
  Synthetic oligonucleotide; GGG chr11 5161306 5161325 5161322 +
ctggtgtctggaattagact

SEQ ID NO: 1205 - DNA, 20 bp, Artificial Sequence
  Synthetic oligonucleotide; GGG chr11 5161307 5161326 5161323 +
tggtgtctggaattagactg

SEQ ID NO: 1206 - DNA, 20 bp, Artificial Sequence
  Synthetic oligonucleotide; AAG chr11 5161319 5161338 5161335 +
ttagactggggcctaataaa

SEQ ID NO: 1207 - DNA, 20 bp, Artificial Sequence
  Synthetic oligonucleotide; AGG chr11 5161320 5161339 5161336 +
tagactggggcctaataaaa

SEQ ID NO: 1208 - DNA, 20 bp, Artificial Sequence
  Synthetic oligonucleotide; CAG chr11 5161333 5161352 5161349 +
aataaaaaggcaaatctata

SEQ ID NO: 1209 - DNA, 20 bp, Artificial Sequence
  Synthetic oligonucleotide; AGG chr11 5161334 5161353 5161350 +
ataaaaaggcaaatctatac

SEQ ID NO: 1210 - DNA, 20 bp, Artificial Sequence
  Synthetic oligonucleotide; GAG chr11 5161336 5161355 5161352 +
aaaaaggcaaatctatacag

SEQ ID NO: 1211 - DNA, 20 bp, Artificial Sequence
  Synthetic oligonucleotide; TGG chr11 5161345 5161364 5161361 +
aatctatacaggagctcaaa

SEQ ID NO: 1212 - DNA, 20 bp, Artificial Sequence
  Synthetic oligonucleotide; GGG chr11 5161346 5161365 5161362 +
atctatacaggagctcaaat

SEQ ID NO: 1213 - DNA, 20 bp, Artificial Sequence
  Synthetic oligonucleotide; TAG chr11 5161359 5161378 5161375 +
ctcaaatgggctgtaccctg

SEQ ID NO: 1214 - DNA, 20 bp, Artificial Sequence
  Synthetic oligonucleotide; GAG chr11 5161368 5161387 5161384 +
gctgtaccctgtagcattct

SEQ ID NO: 1215 - DNA, 20 bp, Artificial Sequence
  Synthetic oligonucleotide; AGG chr11 5161369 5161388 5161385 +
ctgtaccctgtagcattctg

SEQ ID NO: 1216 - DNA, 20 bp, Artificial Sequence
  Synthetic oligonucleotide; CAG chr11 5161373 5161392 5161389 +
accctgtagcattctgagga

SEQ ID NO: 1217 - DNA, 20 bp, Artificial Sequence
  Synthetic oligonucleotide; AGG chr11 5161374 5161393 5161390 +
ccctgtagcattctgaggac

SEQ ID NO: 1218 - DNA, 20 bp, Artificial Sequence
  Synthetic oligonucleotide; GAG chr11 5161387 5161406 5161403 +
tgaggacaggtctgacttct

SEQ ID NO: 1219 - DNA, 20 bp, Artificial Sequence
  Synthetic oligonucleotide; AAG chr11 5161391 5161410 5161407 +
gacaggtctgacttctgaga

SEQ ID NO: 1220 - DNA, 20 bp, Artificial Sequence
  Synthetic oligonucleotide; AAG chr11 5161396 5161415 5161412 +
gtctgacttctgagaaagaa

SEQ ID NO: 1221 - DNA, 20 bp, Artificial Sequence
  Synthetic oligonucleotide; TGG chr11 5161399 5161418 5161415 +
tgacttctgagaaagaaaag

SEQ ID NO: 1222 - DNA, 20 bp, Artificial Sequence
  Synthetic oligonucleotide; AAG chr11 5161405 5161424 5161421 +
ctgagaaagaaaagtggtaa

SEQ ID NO: 1223 - DNA, 20 bp, Artificial Sequence
  Synthetic oligonucleotide; CAG chr11 5161415 5161434 5161431 +
aaagtggtaaaagtattgtc

SEQ ID NO: 1224 - DNA, 20 bp, Artificial Sequence
  Synthetic oligonucleotide; AAG chr11 5161426 5161445 5161442 +
agtattgtccagtccttttt

SEQ ID NO: 1225 - DNA, 20 bp, Artificial Sequence
  Synthetic oligonucleotide; TGG chr11 5161430 5161449 5161446 +
ttgtccagtcctttttaagt

SEQ ID NO: 1226 - DNA, 20 bp, Artificial Sequence
  Synthetic oligonucleotide; TGG chr11 5161433 5161452 5161449 +
tccagtcctttttaagttgg

SEQ ID NO: 1227 - DNA, 20 bp, Artificial Sequence
  Synthetic oligonucleotide; GAG chr11 5161438 5161457 5161454 +
tcctttttaagttggtggct

SEQ ID NO: 1228 - DNA, 20 bp, Artificial Sequence
  Synthetic oligonucleotide; TGG chr11 5161443 5161462 5161459 +
tttaagttggtggctgagct

SEQ ID NO: 1229 - DNA, 20 bp, Artificial Sequence
  Synthetic oligonucleotide; GAG chr11 5161447 5161466 5161463 +
agttggtggctgagcttggt

SEQ ID NO: 1230 - DNA, 20 bp, Artificial Sequence
  Synthetic oligonucleotide; AGG chr11 5161448 5161467 5161464 +
gttggtggctgagcttggtg

SEQ ID NO: 1231 - DNA, 20 bp, Artificial Sequence
  Synthetic oligonucleotide; AAG chr11 5161462 5161481 5161478 +
ttggtgaggtgtgtttttaa

SEQ ID NO: 1232 - DNA, 20 bp, Artificial Sequence
  Synthetic oligonucleotide; TAG chr11 5161470 5161489 5161486 +
gtgtgtttttaaaagacatt

SEQ ID NO: 1233 - DNA, 20 bp, Artificial Sequence
  Synthetic oligonucleotide; AAG chr11 5161491 5161510 5161507 +
agtccgttctacttttcctg

SEQ ID NO: 1234 - DNA, 20 bp, Artificial Sequence
  Synthetic oligonucleotide; CGG chr11 5161495 5161514 5161511 +
cgttctacttttcctgaaga

SEQ ID NO: 1235 - DNA, 20 bp, Artificial Sequence
  Synthetic oligonucleotide; GAG chr11 5161497 5161516 5161513 +
ttctacttttcctgaagacg

SEQ ID NO: 1236 - DNA, 20 bp, Artificial Sequence
  Synthetic oligonucleotide; AGG chr11 5161498 5161517 5161514 +
tctacttttcctgaagacgg

SEQ ID NO: 1237 - DNA, 20 bp, Artificial Sequence
  Synthetic oligonucleotide; AAG chr11 5161506 5161525 5161522 +
tcctgaagacggaggaccgt

SEQ ID NO: 1238 - DNA, 20 bp, Artificial Sequence
  Synthetic oligonucleotide; AGG chr11 5161507 5161526 5161523 +
cctgaagacggaggaccgta

SEQ ID NO: 1239 - DNA, 20 bp, Artificial Sequence
  Synthetic oligonucleotide; GGG chr11 5161508 5161527 5161524 +
ctgaagacggaggaccgtaa

SEQ ID NO: 1240 - DNA, 20 bp, Artificial Sequence
  Synthetic oligonucleotide; AAG chr11 5161516 5161535 5161532 +
ggaggaccgtaagggatata

SEQ ID NO: 1241 - DNA, 20 bp, Artificial Sequence
  Synthetic oligonucleotide; AGG chr11 5161517 5161536 5161533 +
gaggaccgtaagggatataa

SEQ ID NO: 1242 - DNA, 20 bp, Artificial Sequence
  Synthetic oligonucleotide; AAG chr11 5161534 5161553 5161550 +
taaaggttttactgaatact

SEQ ID NO: 1243 - DNA, 20 bp, Artificial Sequence
  Synthetic oligonucleotide; GAG chr11 5161536 5161555 5161552 +
aaggttttactgaatactaa

SEQ ID NO: 1244 - DNA, 20 bp, Artificial Sequence
  Synthetic oligonucleotide; TGG chr11 5161553 5161572 5161569 +
taagagcctgaaaaactgct

SEQ ID NO: 1245 - DNA, 20 bp, Artificial Sequence
  Synthetic oligonucleotide; AAG chr11 5161571 5161590 5161587 +
cttggctgatttgactaata

SEQ ID NO: 1246 - DNA, 20 bp, Artificial Sequence
  Synthetic oligonucleotide; AGG chr11 5161572 5161591 5161588 +
ttggctgatttgactaataa

SEQ ID NO: 1247 - DNA, 20 bp, Artificial Sequence
  Synthetic oligonucleotide; TGG chr11 5161576 5161595 5161592 +
ctgatttgactaataaaggc

SEQ ID NO: 1248 - DNA, 20 bp, Artificial Sequence
  Synthetic oligonucleotide; CAG chr11 5161587 5161606 5161603 +
aataaaggctggtctgttat

SEQ ID NO: 1249 - DNA, 20 bp, Artificial Sequence
  Synthetic oligonucleotide; TAG chr11 5161596 5161615 5161612 +
tggtctgttatcagactgta

SEQ ID NO: 1250 - DNA, 20 bp, Artificial Sequence
  Synthetic oligonucleotide; GAG chr11 5161598 5161617 5161614 +
gtctgttatcagactgtata

SEQ ID NO: 1251 - DNA, 20 bp, Artificial Sequence
  Synthetic oligonucleotide; AGG chr11 5161599 5161618 5161615 +
tctgttatcagactgtatag

SEQ ID NO: 1252 - DNA, 20 bp, Artificial Sequence
  Synthetic oligonucleotide; TAG chr11 5161602 5161621 5161618 +
gttatcagactgtatagagg

SEQ ID NO: 1253 - DNA, 20 bp, Artificial Sequence
  Synthetic oligonucleotide; AGG chr11 5161603 5161622 5161619 +
ttatcagactgtatagaggt

SEQ ID NO: 1254 - DNA, 20 bp, Artificial Sequence
  Synthetic oligonucleotide; AAG chr11 5161606 5161625 5161622 +
tcagactgtatagaggtagg

SEQ ID NO: 1255 - DNA, 20 bp, Artificial Sequence
  Synthetic oligonucleotide; AGG chr11 5161607 5161626 5161623 +
cagactgtatagaggtagga

SEQ ID NO: 1256 - DNA, 20 bp, Artificial Sequence
  Synthetic oligonucleotide; GAG chr11 5161617 5161636 5161633 +
agaggtaggaaggctaaact

SEQ ID NO: 1257 - DNA, 20 bp, Artificial Sequence
  Synthetic oligonucleotide; AGG chr11 5161618 5161637 5161634 +
gaggtaggaaggctaaactg

SEQ ID NO: 1258 - DNA, 20 bp, Artificial Sequence
  Synthetic oligonucleotide; CAG chr11 5161633 5161652 5161649 +
aactgaggaattatgtctga

SEQ ID NO: 1259 - DNA, 20 bp, Artificial Sequence
  Synthetic oligonucleotide; AAG chr11 5161636 5161655 5161652 +
tgaggaattatgtctgacag

SEQ ID NO: 1260 - DNA, 20 bp, Artificial Sequence
  Synthetic oligonucleotide; AGG chr11 5161637 5161656 5161653 +
gaggaattatgtctgacaga

SEQ ID NO: 1261 - DNA, 20 bp, Artificial Sequence
  Synthetic oligonucleotide; GGG chr11 5161638 5161657 5161654 +
aggaattatgtctgacagaa

SEQ ID NO: 1262 - DNA, 20 bp, Artificial Sequence
  Synthetic oligonucleotide; AAG chr11 5161641 5161660 5161657 +
aattatgtctgacagaaggg

SEQ ID NO: 1263 - DNA, 20 bp, Artificial Sequence
  Synthetic oligonucleotide; CGG chr11 5161653 5161672 5161669 +
cagaagggaagaaatgactg

SEQ ID NO: 1264 - DNA, 20 bp, Artificial Sequence
  Synthetic oligonucleotide; TGG chr11 5161656 5161675 5161672 +
aagggaagaaatgactgcgg

SEQ ID NO: 1265 - DNA, 20 bp, Artificial Sequence
  Synthetic oligonucleotide; CAG chr11 5161665 5161684 5161681 +
aatgactgcggtggccttct

SEQ ID NO: 1266 - DNA, 20 bp, Artificial Sequence
  Synthetic oligonucleotide; TAG chr11 5161674 5161693 5161690 +
ggtggccttctcagaccctg

SEQ ID NO: 1267 - DNA, 20 bp, Artificial Sequence
  Synthetic oligonucleotide; AGG chr11 5161675 5161694 5161691 +
gtggccttctcagaccctgt

SEQ ID NO: 1268 - DNA, 20 bp, Artificial Sequence
  Synthetic oligonucleotide; AAG chr11 5161679 5161698 5161695 +
ccttctcagaccctgtagga

SEQ ID NO: 1269 - DNA, 20 bp, Artificial Sequence
  Synthetic oligonucleotide; CAG chr11 5161695 5161714 5161711 +
aggaaagacctctacttatc

SEQ ID NO: 1270 - DNA, 20 bp, Artificial Sequence
  Synthetic oligonucleotide; AAG chr11 5161701 5161720 5161717 +
gacctctacttatccagtga

SEQ ID NO: 1271 - DNA, 20 bp, Artificial Sequence
  Synthetic oligonucleotide; TAG chr11 5161712 5161731 5161728 +
atccagtgaaagtgtctacc

SEQ ID NO: 1272 - DNA, 20 bp, Artificial Sequence
  Synthetic oligonucleotide; AAG chr11 5161718 5161737 5161734 +
tgaaagtgtctacctagact

SEQ ID NO: 1273 - DNA, 20 bp, Artificial Sequence
  Synthetic oligonucleotide; GAG chr11 5161720 5161739 5161736 +
aaagtgtctacctagactaa

SEQ ID NO: 1274 - DNA, 20 bp, Artificial Sequence
  Synthetic oligonucleotide; AGG chr11 5161721 5161740 5161737 +
aagtgtctacctagactaag

SEQ ID NO: 1275 - DNA, 20 bp, Artificial Sequence
  Synthetic oligonucleotide; TAG chr11 5161729 5161748 5161745 +
acctagactaagaggtattt

SEQ ID NO: 1276 - DNA, 20 bp, Artificial Sequence
  Synthetic oligonucleotide; CAG chr11 5161742 5161761 5161758 +
ggtattttagttatctgact

SEQ ID NO: 1277 - DNA, 20 bp, Artificial Sequence
  Synthetic oligonucleotide; AGG chr11 5161743 5161762 5161759 +
gtattttagttatctgactc

SEQ ID NO: 1278 - DNA, 20 bp, Artificial Sequence
  Synthetic oligonucleotide; GGG chr11 5161744 5161763 5161760 +
tattttagttatctgactca

SEQ ID NO: 1279 - DNA, 20 bp, Artificial Sequence
  Synthetic oligonucleotide; GAG chr11 5161753 5161772 5161769 +
tatctgactcagggcatgtt

SEQ ID NO: 1280 - DNA, 20 bp, Artificial Sequence
  Synthetic oligonucleotide; CAG chr11 5161770 5161789 5161786 +
gttgagtaaatctaatttgc

SEQ ID NO: 1281 - DNA, 20 bp, Artificial Sequence
  Synthetic oligonucleotide; TGG chr11 5161776 5161795 5161792 +
taaatctaatttgccagtcc

SEQ ID NO: 1282 - DNA, 20 bp, Artificial Sequence
  Synthetic oligonucleotide; GGG chr11 5161777 5161796 5161793 +
aaatctaatttgccagtcct

SEQ ID NO: 1283 - DNA, 20 bp, Artificial Sequence
  Synthetic oligonucleotide; TGG chr11 5161780 5161799 5161796 +
tctaatttgccagtcctggg

SEQ ID NO: 1284 - DNA, 20 bp, Artificial Sequence
  Synthetic oligonucleotide; GGG chr11 5161781 5161800 5161797 +
ctaatttgccagtcctgggt

SEQ ID NO: 1285 - DNA, 20 bp, Artificial Sequence
  Synthetic oligonucleotide; GGG chr11 5161782 5161801 5161798 +
taatttgccagtcctgggtg

SEQ ID NO: 1286 - DNA, 20 bp, Artificial Sequence
  Synthetic oligonucleotide; GGG chr11 5161783 5161802 5161799 +
aatttgccagtcctgggtgg

SEQ ID NO: 1287 - DNA, 20 bp, Artificial Sequence
  Synthetic oligonucleotide; GAG chr11 5161795 5161814 5161811 +
ctgggtgggggcaaatcctc

SEQ ID NO: 1288 - DNA, 20 bp, Artificial Sequence
  Synthetic oligonucleotide; TAG chr11 5161807 5161826 5161823 +
aaatcctcgagcttgatgtg

SEQ ID NO: 1289 - DNA, 20 bp, Artificial Sequence
  Synthetic oligonucleotide; AGG chr11 5161808 5161827 5161824 +
aatcctcgagcttgatgtgt

SEQ ID NO: 1290 - DNA, 20 bp, Artificial Sequence
  Synthetic oligonucleotide; GGG chr11 5161809 5161828 5161825 +
atcctcgagcttgatgtgta

SEQ ID NO: 1291 - DNA, 20 bp, Artificial Sequence
  Synthetic oligonucleotide; AAG chr11 5161812 5161831 5161828 +
ctcgagcttgatgtgtaggg

SEQ ID NO: 1292 - DNA, 20 bp, Artificial Sequence
  Synthetic oligonucleotide; AGG chr11 5161813 5161832 5161829 +
tcgagcttgatgtgtaggga

SEQ ID NO: 1293 - DNA, 20 bp, Artificial Sequence
  Synthetic oligonucleotide; GGG chr11 5161814 5161833 5161830 +
cgagcttgatgtgtagggaa

SEQ ID NO: 1294 - DNA, 20 bp, Artificial Sequence
  Synthetic oligonucleotide; GAG chr11 5161816 5161835 5161832 +
agcttgatgtgtagggaagg

SEQ ID NO: 1295 - DNA, 20 bp, Artificial Sequence
  Synthetic oligonucleotide; AGG chr11 5161817 5161836 5161833 +
gcttgatgtgtagggaaggg

SEQ ID NO: 1296 - DNA, 20 bp, Artificial Sequence
  Synthetic oligonucleotide; GGG chr11 5161818 5161837 5161834 +
cttgatgtgtagggaaggga

SEQ ID NO: 1297 - DNA, 20 bp, Artificial Sequence
  Synthetic oligonucleotide; GGG chr11 5161819 5161838 5161835 +
ttgatgtgtagggaagggag

SEQ ID NO: 1298 - DNA, 20 bp, Artificial Sequence
  Synthetic oligonucleotide; GGG chr11 5161820 5161839 5161836 +
tgatgtgtagggaagggagg

SEQ ID NO: 1299 - DNA, 20 bp, Artificial Sequence
  Synthetic oligonucleotide; GAG chr11 5161837 5161856 5161853 +
agggggcctgaataatccct

SEQ ID NO: 1300 - DNA, 20 bp, Artificial Sequence
  Synthetic oligonucleotide; AGG chr11 5161838 5161857 5161854 +
gggggcctgaataatccctg

SEQ ID NO: 1301 - DNA, 20 bp, Artificial Sequence
  Synthetic oligonucleotide; GAG chr11 5161840 5161859 5161856 +
gggcctgaataatccctgag

SEQ ID NO: 1302 - DNA, 20 bp, Artificial Sequence
  Synthetic oligonucleotide; TAG chr11 5161843 5161862 5161859 +
cctgaataatccctgaggag

SEQ ID NO: 1303 - DNA, 20 bp, Artificial Sequence
  Synthetic oligonucleotide; CAG chr11 5161846 5161865 5161862 +
gaataatccctgaggagtag

SEQ ID NO: 1304 - DNA, 20 bp, Artificial Sequence
  Synthetic oligonucleotide; TAG chr11 5161851 5161870 5161867 +
atccctgaggagtagcagaa

SEQ ID NO: 1305 - DNA, 20 bp, Artificial Sequence
  Synthetic oligonucleotide; CAG chr11 5161854 5161873 5161870 +
cctgaggagtagcagaatag

SEQ ID NO: 1306 - DNA, 20 bp, Artificial Sequence
  Synthetic oligonucleotide; TGG chr11 5161858 5161877 5161874 +
aggagtagcagaatagcaga

SEQ ID NO: 1307 - DNA, 20 bp, Artificial Sequence
  Synthetic oligonucleotide; GAG chr11 5161867 5161886 5161883 +
agaatagcagatggaacact

SEQ ID NO: 1308 - DNA, 20 bp, Artificial Sequence
  Synthetic oligonucleotide; AAG chr11 5161870 5161889 5161886 +
atagcagatggaacactgag

SEQ ID NO: 1309 - DNA, 20 bp, Artificial Sequence
  Synthetic oligonucleotide; GAG chr11 5161883 5161902 5161899 +
cactgagaagttatttcttt

SEQ ID NO: 1310 - DNA, 20 bp, Artificial Sequence
  Synthetic oligonucleotide; AGG chr11 5161884 5161903 5161900 +
actgagaagttatttctttg

SEQ ID NO: 1311 - DNA, 20 bp, Artificial Sequence
  Synthetic oligonucleotide; TAG chr11 5161888 5161907 5161904 +
agaagttatttctttgagga

SEQ ID NO: 1312 - DNA, 20 bp, Artificial Sequence
  Synthetic oligonucleotide; TGG chr11 5161901 5161920 5161917 +
ttgaggatagatttctacga

SEQ ID NO: 1313 - DNA, 20 bp, Artificial Sequence
  Synthetic oligonucleotide; AAG chr11 5161905 5161924 5161921 +
ggatagatttctacgatgga

SEQ ID NO: 1314 - DNA, 20 bp, Artificial Sequence
  Synthetic oligonucleotide; AGG chr11 5161906 5161925 5161922 +
gatagatttctacgatggaa

SEQ ID NO: 1315 - DNA, 20 bp, Artificial Sequence
  Synthetic oligonucleotide; GAG chr11 5161913 5161932 5161929 +
ttctacgatggaaaggaaat

SEQ ID NO: 1316 - DNA, 20 bp, Artificial Sequence
  Synthetic oligonucleotide; GAG chr11 5161915 5161934 5161931 +
ctacgatggaaaggaaatga

SEQ ID NO: 1317 - DNA, 20 bp, Artificial Sequence
  Synthetic oligonucleotide; AGG chr11 5161916 5161935 5161932 +
tacgatggaaaggaaatgag

SEQ ID NO: 1318 - DNA, 20 bp, Artificial Sequence
  Synthetic oligonucleotide; AAG chr11 5161923 5161942 5161939 +
gaaaggaaatgagaggttcg

SEQ ID NO: 1319 - DNA, 20 bp, Artificial Sequence
  Synthetic oligonucleotide; GAG chr11 5161925 5161944 5161941 +
aaggaaatgagaggttcgaa

SEQ ID NO: 1320 - DNA, 20 bp, Artificial Sequence
  Synthetic oligonucleotide; AGG chr11 5161926 5161945 5161942 +
aggaaatgagaggttcgaag

SEQ ID NO: 1321 - DNA, 20 bp, Artificial Sequence
  Synthetic oligonucleotide; CAG chr11 5161929 5161948 5161945 +
aaatgagaggttcgaagagg

SEQ ID NO: 1322 - DNA, 20 bp, Artificial Sequence
  Synthetic oligonucleotide; AGG chr11 5161930 5161949 5161946 +
aatgagaggttcgaagaggc

SEQ ID NO: 1323 - DNA, 20 bp, Artificial Sequence
  Synthetic oligonucleotide; TAG chr11 5161934 5161953 5161950 +
agaggttcgaagaggcaggc

SEQ ID NO: 1324 - DNA, 20 bp, Artificial Sequence
  Synthetic oligonucleotide; TGG chr11 5161937 5161956 5161953 +
ggttcgaagaggcaggctag

SEQ ID NO: 1325 - DNA, 20 bp, Artificial Sequence
  Synthetic oligonucleotide; TAG chr11 5161949 5161968 5161965 +
caggctagtggtttgtacta

SEQ ID NO: 1326 - DNA, 20 bp, Artificial Sequence
  Synthetic oligonucleotide; TAG chr11 5161954 5161973 5161970 +
tagtggtttgtactatagca

SEQ ID NO: 1327 - DNA, 20 bp, Artificial Sequence
  Synthetic oligonucleotide; TGG chr11 5161968 5161987 5161984 +
atagcatagcctgcctttgc

SEQ ID NO: 1328 - DNA, 20 bp, Artificial Sequence
  Synthetic oligonucleotide; TGG chr11 5161975 5161994 5161991 +
agcctgcctttgctggtgtg

SEQ ID NO: 1329 - DNA, 20 bp, Artificial Sequence
  Synthetic oligonucleotide; TAG chr11 5161982 5162001 5161998 +
ctttgctggtgtgtggctat

SEQ ID NO: 1330 - DNA, 20 bp, Artificial Sequence
  Synthetic oligonucleotide; AGG chr11 5161983 5162002 5161999 +
tttgctggtgtgtggctatt

SEQ ID NO: 1331 - DNA, 20 bp, Artificial Sequence
  Synthetic oligonucleotide; TGG chr11 5161988 5162007 5162004 +
tggtgtgtggctattaggcc

SEQ ID NO: 1332 - DNA, 20 bp, Artificial Sequence
  Synthetic oligonucleotide; TGG chr11 5161991 5162010 5162007 +
tgtgtggctattaggcctgg

SEQ ID NO: 1333 - DNA, 20 bp, Artificial Sequence
  Synthetic oligonucleotide; CGG chr11 5161996 5162015 5162012 +
ggctattaggcctggtggaa

SEQ ID NO: 1334 - DNA, 20 bp, Artificial Sequence
  Synthetic oligonucleotide; AAG chr11 5162012 5162031 5162028 +
ggaacggccatcaataaatc

SEQ ID NO: 1335 - DNA, 20 bp, Artificial Sequence
  Synthetic oligonucleotide; CAG chr11 5162021 5162040 5162037 +
atcaataaatcaagtgtgat

SEQ ID NO: 1336 - DNA, 20 bp, Artificial Sequence
  Synthetic oligonucleotide; AGG chr11 5162022 5162041 5162038 +
tcaataaatcaagtgtgatc

SEQ ID NO: 1337 - DNA, 20 bp, Artificial Sequence
  Synthetic oligonucleotide; GGG chr11 5162023 5162042 5162039 +
caataaatcaagtgtgatca

SEQ ID NO: 1338 - DNA, 20 bp, Artificial Sequence
  Synthetic oligonucleotide; GAG chr11 5162027 5162046 5162043 +
aaatcaagtgtgatcagggt

SEQ ID NO: 1339 - DNA, 20 bp, Artificial Sequence
  Synthetic oligonucleotide; AGG chr11 5162028 5162047 5162044 +
aatcaagtgtgatcagggtg

SEQ ID NO: 1340 - DNA, 20 bp, Artificial Sequence
  Synthetic oligonucleotide; CAG chr11 5162033 5162052 5162049 +
agtgtgatcagggtgaggaa

SEQ ID NO: 1341 - DNA, 20 bp, Artificial Sequence
  Synthetic oligonucleotide; AGG chr11 5162034 5162053 5162050 +
gtgtgatcagggtgaggaac

SEQ ID NO: 1342 - DNA, 20 bp, Artificial Sequence
  Synthetic oligonucleotide; AAG chr11 5162038 5162057 5162054 +
gatcagggtgaggaacagga

SEQ ID NO: 1343 - DNA, 20 bp, Artificial Sequence
  Synthetic oligonucleotide; AAG chr11 5162041 5162060 5162057 +
cagggtgaggaacaggaaag

SEQ ID NO: 1344 - DNA, 20 bp, Artificial Sequence
  Synthetic oligonucleotide; AGG chr11 5162042 5162061 5162058 +
agggtgaggaacaggaaaga

SEQ ID NO: 1345 - DNA, 20 bp, Artificial Sequence
  Synthetic oligonucleotide; AAG chr11 5162046 5162065 5162062 +
tgaggaacaggaaagaagga

SEQ ID NO: 1346 - DNA, 20 bp, Artificial Sequence
  Synthetic oligonucleotide; AAG chr11 5162049 5162068 5162065 +
ggaacaggaaagaaggaaag

SEQ ID NO: 1347 - DNA, 20 bp, Artificial Sequence
  Synthetic oligonucleotide; AGG chr11 5162050 5162069 5162066 +
gaacaggaaagaaggaaaga

SEQ ID NO: 1348 - DNA, 20 bp, Artificial Sequence
  Synthetic oligonucleotide; TGG chr11 5162058 5162077 5162074 +
aagaaggaaagaaggaaata

SEQ ID NO: 1349 - DNA, 20 bp, Artificial Sequence
  Synthetic oligonucleotide; GGG chr11 5162059 5162078 5162075 +
agaaggaaagaaggaaatat

SEQ ID NO: 1350 - DNA, 20 bp, Artificial Sequence
  Synthetic oligonucleotide; GGG chr11 5162060 5162079 5162076 +
gaaggaaagaaggaaatatg

SEQ ID NO: 1351 - DNA, 20 bp, Artificial Sequence
  Synthetic oligonucleotide; TGG chr11 5162066 5162085 5162082 +
aagaaggaaatatggggaaa

SEQ ID NO: 1352 - DNA, 20 bp, Artificial Sequence
  Synthetic oligonucleotide; GGG chr11 5162067 5162086 5162083 +
agaaggaaatatggggaaat

SEQ ID NO: 1353 - DNA, 20 bp, Artificial Sequence
  Synthetic oligonucleotide; GGG chr11 5162068 5162087 5162084 +
gaaggaaatatggggaaatg

SEQ ID NO: 1354 - DNA, 20 bp, Artificial Sequence
  Synthetic oligonucleotide; CAG chr11 5162078 5162097 5162094 +
tggggaaatggggtgaatgt

SEQ ID NO: 1355 - DNA, 20 bp, Artificial Sequence
  Synthetic oligonucleotide; AGG chr11 5162079 5162098 5162095 +
ggggaaatggggtgaatgtc

SEQ ID NO: 1356 - DNA, 20 bp, Artificial Sequence
  Synthetic oligonucleotide; TGG chr11 5162082 5162101 5162098 +
gaaatggggtgaatgtcagg

SEQ ID NO: 1357 - DNA, 20 bp, Artificial Sequence
  Synthetic oligonucleotide; CAG chr11 5162087 5162106 5162103 +
ggggtgaatgtcaggtggat

SEQ ID NO: 1358 - DNA, 20 bp, Artificial Sequence
  Synthetic oligonucleotide; GAG chr11 5162089 5162108 5162105 +
ggtgaatgtcaggtggatca

SEQ ID NO: 1359 - DNA, 20 bp, Artificial Sequence
  Synthetic oligonucleotide; GAG chr11 5162091 5162110 5162107 +
tgaatgtcaggtggatcaga

SEQ ID NO: 1360 - DNA, 20 bp, Artificial Sequence
  Synthetic oligonucleotide; TGG chr11 5162103 5162122 5162119 +
ggatcagagagatacaatca

SEQ ID NO: 1361 - DNA, 20 bp, Artificial Sequence
  Synthetic oligonucleotide; GGG chr11 5162104 5162123 5162120 +
gatcagagagatacaatcat

SEQ ID NO: 1362 - DNA, 20 bp, Artificial Sequence
  Synthetic oligonucleotide; GGG chr11 5162105 5162124 5162121 +
atcagagagatacaatcatg

SEQ ID NO: 1363 - DNA, 20 bp, Artificial Sequence
  Synthetic oligonucleotide; GGG chr11 5162106 5162125 5162122 +
tcagagagatacaatcatgg

SEQ ID NO: 1364 - DNA, 20 bp, Artificial Sequence
  Synthetic oligonucleotide; CAG chr11 5162110 5162129 5162126 +
agagatacaatcatgggggt

SEQ ID NO: 1365 - DNA, 20 bp, Artificial Sequence
  Synthetic oligonucleotide; AGG chr11 5162111 5162130 5162127 +
gagatacaatcatgggggtc

SEQ ID NO: 1366 - DNA, 20 bp, Artificial Sequence
  Synthetic oligonucleotide; TGG chr11 5162116 5162135 5162132 +
acaatcatgggggtcaggtg

SEQ ID NO: 1367 - DNA, 20 bp, Artificial Sequence
  Synthetic oligonucleotide; CAG chr11 5162122 5162141 5162138 +
atgggggtcaggtgtggtat

SEQ ID NO: 1368 - DNA, 20 bp, Artificial Sequence
  Synthetic oligonucleotide; AGG chr11 5162123 5162142 5162139 +
tgggggtcaggtgtggtatc

SEQ ID NO: 1369 - DNA, 20 bp, Artificial Sequence
  Synthetic oligonucleotide; TGG chr11 5162133 5162152 5162149 +
gtgtggtatcaggaataatg

SEQ ID NO: 1370 - DNA, 20 bp, Artificial Sequence
  Synthetic oligonucleotide; GGG chr11 5162134 5162153 5162150 +
tgtggtatcaggaataatgt

SEQ ID NO: 1371 - DNA, 20 bp, Artificial Sequence
  Synthetic oligonucleotide; GAG chr11 5162136 5162155 5162152 +
tggtatcaggaataatgtgg

SEQ ID NO: 1372 - DNA, 20 bp, Artificial Sequence
  Synthetic oligonucleotide; AGG chr11 5162137 5162156 5162153 +
ggtatcaggaataatgtggg

SEQ ID NO: 1373 - DNA, 20 bp, Artificial Sequence
  Synthetic oligonucleotide; CGG chr11 5162141 5162160 5162157 +
tcaggaataatgtgggaggc

SEQ ID NO: 1374 - DNA, 20 bp, Artificial Sequence
  Synthetic oligonucleotide; AAG chr11 5162148 5162167 5162164 +
taatgtgggaggccggattg

SEQ ID NO: 1375 - DNA, 20 bp, Artificial Sequence
  Synthetic oligonucleotide; CGG chr11 5162153 5162172 5162169 +
tgggaggccggattgaagtc

SEQ ID NO: 1376 - DNA, 20 bp, Artificial Sequence
  Synthetic oligonucleotide; GGG chr11 5162154 5162173 5162170 +
gggaggccggattgaagtcc

SEQ ID NO: 1377 - DNA, 20 bp, Artificial Sequence
  Synthetic oligonucleotide; CAG chr11 5162158 5162177 5162174 +
ggccggattgaagtccgggc

SEQ ID NO: 1378 - DNA, 20 bp, Artificial Sequence
  Synthetic oligonucleotide; AGG chr11 5162159 5162178 5162175 +
gccggattgaagtccgggcc

SEQ ID NO: 1379 - DNA, 20 bp, Artificial Sequence
  Synthetic oligonucleotide; TGG chr11 5162167 5162186 5162183 +
gaagtccgggccaggaccaa

SEQ ID NO: 1380 - DNA, 20 bp, Artificial Sequence
  Synthetic oligonucleotide; TGG chr11 5162176 5162195 5162192 +
gccaggaccaatggtaattg

SEQ ID NO: 1381 - DNA, 20 bp, Artificial Sequence
  Synthetic oligonucleotide; GGG chr11 5162177 5162196 5162193 +
ccaggaccaatggtaattgt

SEQ ID NO: 1382 - DNA, 20 bp, Artificial Sequence
  Synthetic oligonucleotide; AAG chr11 5162188 5162207 5162204 +
ggtaattgtgggacttaaca

SEQ ID NO: 1383 - DNA, 20 bp, Artificial Sequence
  Synthetic oligonucleotide; GAG chr11 5162190 5162209 5162206 +
taattgtgggacttaacaaa

SEQ ID NO: 1384 - DNA, 20 bp, Artificial Sequence
  Synthetic oligonucleotide; GAG chr11 5162194 5162213 5162210 +
tgtgggacttaacaaagagt

SEQ ID NO: 1385 - DNA, 20 bp, Artificial Sequence
  Synthetic oligonucleotide; CAG chr11 5162199 5162218 5162215 +
gacttaacaaagagtgagta

SEQ ID NO: 1386 - DNA, 20 bp, Artificial Sequence
  Synthetic oligonucleotide; AAG chr11 5162205 5162224 5162221 +
acaaagagtgagtacagctg

SEQ ID NO: 1387 - DNA, 20 bp, Artificial Sequence
  Synthetic oligonucleotide; AGG chr11 5162206 5162225 5162222 +
caaagagtgagtacagctga

SEQ ID NO: 1388 - DNA, 20 bp, Artificial Sequence
  Synthetic oligonucleotide; GAG chr11 5162208 5162227 5162224 +
aagagtgagtacagctgaag

SEQ ID NO: 1389 - DNA, 20 bp, Artificial Sequence
  Synthetic oligonucleotide; CGG chr11 5162212 5162231 5162228 +
gtgagtacagctgaaggagc

SEQ ID NO: 1390 - DNA, 20 bp, Artificial Sequence
  Synthetic oligonucleotide; GGG chr11 5162213 5162232 5162229 +
tgagtacagctgaaggagcc

SEQ ID NO: 1391 - DNA, 20 bp, Artificial Sequence
  Synthetic oligonucleotide; GGG chr11 5162214 5162233 5162230 +
gagtacagctgaaggagccg

SEQ ID NO: 1392 - DNA, 20 bp, Artificial Sequence
  Synthetic oligonucleotide; CAG chr11 5162219 5162238 5162235 +
cagctgaaggagccggggat

SEQ ID NO: 1393 - DNA, 20 bp, Artificial Sequence
  Synthetic oligonucleotide; AAG chr11 5162223 5162242 5162239 +
tgaaggagccggggatcaga

SEQ ID NO: 1394 - DNA, 20 bp, Artificial Sequence
  Synthetic oligonucleotide; CAG chr11 5162235 5162254 5162251 +
ggatcagaaagtatatgcat

SEQ ID NO: 1395 - DNA, 20 bp, Artificial Sequence
  Synthetic oligonucleotide; AGG chr11 5162236 5162255 5162252 +
gatcagaaagtatatgcatc

SEQ ID NO: 1396 - DNA, 20 bp, Artificial Sequence
  Synthetic oligonucleotide; GAG chr11 5162242 5162261 5162258 +
aaagtatatgcatcaggtat

SEQ ID NO: 1397 - DNA, 20 bp, Artificial Sequence
  Synthetic oligonucleotide; AGG chr11 5162243 5162262 5162259 +
aagtatatgcatcaggtatg

SEQ ID NO: 1398 - DNA, 20 bp, Artificial Sequence
  Synthetic oligonucleotide; AAG chr11 5162246 5162265 5162262 +
tatatgcatcaggtatgagg

SEQ ID NO: 1399 - DNA, 20 bp, Artificial Sequence
  Synthetic oligonucleotide; TAG chr11 5162253 5162272 5162269 +
atcaggtatgaggaagaaaa

SEQ ID NO: 1400 - DNA, 20 bp, Artificial Sequence
  Synthetic oligonucleotide; TAG chr11 5162260 5162279 5162276 +
atgaggaagaaaatagattt

SEQ ID NO: 1401 - DNA, 20 bp, Artificial Sequence
  Synthetic oligonucleotide; AAG chr11 5162263 5162282 5162279 +
aggaagaaaatagattttag

SEQ ID NO: 1402 - DNA, 20 bp, Artificial Sequence
  Synthetic oligonucleotide; GAG chr11 5162270 5162289 5162286 +
aaatagattttagaagttat

SEQ ID NO: 1403 - DNA, 20 bp, Artificial Sequence
  Synthetic oligonucleotide; AAG chr11 5162280 5162299 5162296 +
tagaagttatgagaaatgtg

SEQ ID NO: 1404 - DNA, 20 bp, Artificial Sequence
  Synthetic oligonucleotide; GAG chr11 5162282 5162301 5162298 +
gaagttatgagaaatgtgaa

SEQ ID NO: 1405 - DNA, 20 bp, Artificial Sequence
  Synthetic oligonucleotide; GAG chr11 5162286 5162305 5162302 +
ttatgagaaatgtgaagagt

SEQ ID NO: 1406 - DNA, 20 bp, Artificial Sequence
  Synthetic oligonucleotide; AAG chr11 5162291 5162310 5162307 +
agaaatgtgaagagtgagct

SEQ ID NO: 1407 - DNA, 20 bp, Artificial Sequence
  Synthetic oligonucleotide; TAG chr11 5162296 5162315 5162312 +
tgtgaagagtgagctaagca

SEQ ID NO: 1408 - DNA, 20 bp, Artificial Sequence
  Synthetic oligonucleotide; TAG chr11 5162310 5162329 5162326 +
taagcatagtttgtgatttt

SEQ ID NO: 1409 - DNA, 20 bp, Artificial Sequence
  Synthetic oligonucleotide; AGG chr11 5162311 5162330 5162327 +
aagcatagtttgtgattttt

SEQ ID NO: 1410 - DNA, 20 bp, Artificial Sequence
  Synthetic oligonucleotide; GGG chr11 5162312 5162331 5162328 +
agcatagtttgtgattttta

SEQ ID NO: 1411 - DNA, 20 bp, Artificial Sequence
  Synthetic oligonucleotide; AAG chr11 5162322 5162341 5162338 +
gtgatttttagggcctctaa

SEQ ID NO: 1412 - DNA, 20 bp, Artificial Sequence
  Synthetic oligonucleotide; AAG chr11 5162330 5162349 5162346 +
tagggcctctaaaagtatta

SEQ ID NO: 1413 - DNA, 20 bp, Artificial Sequence
  Synthetic oligonucleotide; CAG chr11 5162333 5162352 5162349 +
ggcctctaaaagtattaaag

SEQ ID NO: 1414 - DNA, 20 bp, Artificial Sequence
  Synthetic oligonucleotide; CGG chr11 5162336 5162355 5162352 +
ctctaaaagtattaaagcag

SEQ ID NO: 1415 - DNA, 20 bp, Artificial Sequence
  Synthetic oligonucleotide; CAG chr11 5162339 5162358 5162355 +
taaaagtattaaagcagcgg

SEQ ID NO: 1416 - DNA, 20 bp, Artificial Sequence
  Synthetic oligonucleotide; CAG chr11 5162352 5162371 5162368 +
gcagcggcagccactgcatg

SEQ ID NO: 1417 - DNA, 20 bp, Artificial Sequence
  Synthetic oligonucleotide; GAG chr11 5162359 5162378 5162375 +
cagccactgcatgcagacct

SEQ ID NO: 1418 - DNA, 20 bp, Artificial Sequence
  Synthetic oligonucleotide; AGG chr11 5162360 5162379 5162376 +
agccactgcatgcagacctg

SEQ ID NO: 1419 - DNA, 20 bp, Artificial Sequence
  Synthetic oligonucleotide; GGG chr11 5162361 5162380 5162377 +
gccactgcatgcagacctga

SEQ ID NO: 1420 - DNA, 20 bp, Artificial Sequence
  Synthetic oligonucleotide; TAG chr11 5162365 5162384 5162381 +
ctgcatgcagacctgagggc

SEQ ID NO: 1421 - DNA, 20 bp, Artificial Sequence
  Synthetic oligonucleotide; AGG chr11 5162366 5162385 5162382 +
tgcatgcagacctgagggct

SEQ ID NO: 1422 - DNA, 20 bp, Artificial Sequence
  Synthetic oligonucleotide; CAG chr11 5162375 5162394 5162391 +
acctgagggctaggctaaaa

SEQ ID NO: 1423 - DNA, 20 bp, Artificial Sequence
  Synthetic oligonucleotide; AAG chr11 5162379 5162398 5162395 +
gagggctaggctaaaacagt

SEQ ID NO: 1424 - DNA, 20 bp, Artificial Sequence
  Synthetic oligonucleotide; AGG chr11 5162380 5162399 5162396 +
agggctaggctaaaacagta

SEQ ID NO: 1425 - DNA, 20 bp, Artificial Sequence
  Synthetic oligonucleotide; AAG chr11 5162385 5162404 5162401 +
taggctaaaacagtaaggtc

SEQ ID NO: 1426 - DNA, 20 bp, Artificial Sequence
  Synthetic oligonucleotide; TGG chr11 5162393 5162412 5162409 +
aacagtaaggtcaagttatt

SEQ ID NO: 1427 - DNA, 20 bp, Artificial Sequence
  Synthetic oligonucleotide; CAG chr11 5162397 5162416 5162413 +
gtaaggtcaagttatttgga

SEQ ID NO: 1428 - DNA, 20 bp, Artificial Sequence
  Synthetic oligonucleotide; AAG chr11 5162401 5162420 5162417 +
ggtcaagttatttggacaga

SEQ ID NO: 1429 - DNA, 20 bp, Artificial Sequence
  Synthetic oligonucleotide; AGG chr11 5162402 5162421 5162418 +
gtcaagttatttggacagaa

SEQ ID NO: 1430 - DNA, 20 bp, Artificial Sequence
  Synthetic oligonucleotide; CAG chr11 5162408 5162427 5162424 +
ttatttggacagaaaggcta

SEQ ID NO: 1431 - DNA, 20 bp, Artificial Sequence
  Synthetic oligonucleotide; AGG chr11 5162409 5162428 5162425 +
tatttggacagaaaggctac

SEQ ID NO: 1432 - DNA, 20 bp, Artificial Sequence
  Synthetic oligonucleotide; GGG chr11 5162410 5162429 5162426 +
atttggacagaaaggctaca

SEQ ID NO: 1433 - DNA, 20 bp, Artificial Sequence
  Synthetic oligonucleotide; CAG chr11 5162415 5162434 5162431 +
gacagaaaggctacagggtg

SEQ ID NO: 1434 - DNA, 20 bp, Artificial Sequence
  Synthetic oligonucleotide; TGG chr11 5162421 5162440 5162437 +
aaggctacagggtgcagtcc

SEQ ID NO: 1435 - DNA, 20 bp, Artificial Sequence
  Synthetic oligonucleotide; AAG chr11 5162433 5162452 5162449 +
tgcagtcctggatcttgtgt

SEQ ID NO: 1436 - DNA, 20 bp, Artificial Sequence
  Synthetic oligonucleotide; TAG chr11 5162460 5162479 5162476 +
ctgaccgcactaactatgcc

SEQ ID NO: 1437 - DNA, 20 bp, Artificial Sequence
  Synthetic oligonucleotide; AGG chr11 5162461 5162480 5162477 +
tgaccgcactaactatgcct

SEQ ID NO: 1438 - DNA, 20 bp, Artificial Sequence
  Synthetic oligonucleotide; AAG chr11 5162464 5162483 5162480 +
ccgcactaactatgcctagg

SEQ ID NO: 1439 - DNA, 20 bp, Artificial Sequence
  Synthetic oligonucleotide; AGG chr11 5162465 5162484 5162481 +
cgcactaactatgcctagga

SEQ ID NO: 1440 - DNA, 20 bp, Artificial Sequence
  Synthetic oligonucleotide; AAG chr11 5162469 5162488 5162485 +
ctaactatgcctaggaagga

SEQ ID NO: 1441 - DNA, 20 bp, Artificial Sequence
  Synthetic oligonucleotide; AGG chr11 5162470 5162489 5162486 +
taactatgcctaggaaggaa

SEQ ID NO: 1442 - DNA, 20 bp, Artificial Sequence
  Synthetic oligonucleotide; GAG chr11 5162472 5162491 5162488 +
actatgcctaggaaggaaag

SEQ ID NO: 1443 - DNA, 20 bp, Artificial Sequence
  Synthetic oligonucleotide; TAG chr11 5162486 5162505 5162502 +
ggaaaggagttgttgttttg

SEQ ID NO: 1444 - DNA, 20 bp, Artificial Sequence
  Synthetic oligonucleotide; AAG chr11 5162489 5162508 5162505 +
aaggagttgttgttttgtag

SEQ ID NO: 1445 - DNA, 20 bp, Artificial Sequence
  Synthetic oligonucleotide; AGG chr11 5162490 5162509 5162506 +
aggagttgttgttttgtaga

SEQ ID NO: 1446 - DNA, 20 bp, Artificial Sequence
  Synthetic oligonucleotide; GGG chr11 5162491 5162510 5162507 +
ggagttgttgttttgtagaa

SEQ ID NO: 1447 - DNA, 20 bp, Artificial Sequence
  Synthetic oligonucleotide; GAG chr11 5162497 5162516 5162513 +
gttgttttgtagaagggatt

SEQ ID NO: 1448 - DNA, 20 bp, Artificial Sequence
  Synthetic oligonucleotide; AGG chr11 5162498 5162517 5162514 +
ttgttttgtagaagggattg

SEQ ID NO: 1449 - DNA, 20 bp, Artificial Sequence
  Synthetic oligonucleotide; TGG chr11 5162503 5162522 5162519 +
ttgtagaagggattgaggtt

SEQ ID NO: 1450 - DNA, 20 bp, Artificial Sequence
  Synthetic oligonucleotide; GGG chr11 5162504 5162523 5162520 +
tgtagaagggattgaggttt

SEQ ID NO: 1451 - DNA, 20 bp, Artificial Sequence
  Synthetic oligonucleotide; GAG chr11 5162506 5162525 5162522 +
tagaagggattgaggtttgg

SEQ ID NO: 1452 - DNA, 20 bp, Artificial Sequence
  Synthetic oligonucleotide; CGG chr11 5162515 5162534 5162531 +
ttgaggtttgggagattaat

SEQ ID NO: 1453 - DNA, 20 bp, Artificial Sequence
  Synthetic oligonucleotide; CAG chr11 5162525 5162544 5162541 +
ggagattaatcggacacaat

SEQ ID NO: 1454 - DNA, 20 bp, Artificial Sequence
  Synthetic oligonucleotide; CAG chr11 5162528 5162547 5162544 +
gattaatcggacacaatcag

SEQ ID NO: 1455 - DNA, 20 bp, Artificial Sequence
  Synthetic oligonucleotide; AGG chr11 5162529 5162548 5162545 +
attaatcggacacaatcagc

SEQ ID NO: 1456 - DNA, 20 bp, Artificial Sequence
  Synthetic oligonucleotide; GGG chr11 5162530 5162549 5162546 +
ttaatcggacacaatcagca

SEQ ID NO: 1457 - DNA, 20 bp, Artificial Sequence
  Synthetic oligonucleotide; GAG chr11 5162532 5162551 5162548 +
aatcggacacaatcagcagg

SEQ ID NO: 1458 - DNA, 20 bp, Artificial Sequence
  Synthetic oligonucleotide; GAG chr11 5162534 5162553 5162550 +
tcggacacaatcagcaggga

SEQ ID NO: 1459 - DNA, 20 bp, Artificial Sequence
  Synthetic oligonucleotide; GAG chr11 5162552 5162571 5162568 +
gagagcacgtgtgtttttat

SEQ ID NO: 1460 - DNA, 20 bp, Artificial Sequence
  Synthetic oligonucleotide; GAG chr11 5162564 5162583 5162580 +
gtttttatgagaattatgcc

SEQ ID NO: 1461 - DNA, 20 bp, Artificial Sequence
  Synthetic oligonucleotide; TAG chr11 5162568 5162587 5162584 +
ttatgagaattatgccgaga

SEQ ID NO: 1462 - DNA, 20 bp, Artificial Sequence
  Synthetic oligonucleotide; AGG chr11 5162569 5162588 5162585 +
tatgagaattatgccgagat

SEQ ID NO: 1463 - DNA, 20 bp, Artificial Sequence
  Synthetic oligonucleotide; GAG chr11 5162580 5162599 5162596 +
tgccgagataggtaacacat

SEQ ID NO: 1464 - DNA, 20 bp, Artificial Sequence
  Synthetic oligonucleotide; AGG chr11 5162581 5162600 5162597 +
gccgagataggtaacacatg

SEQ ID NO: 1465 - DNA, 20 bp, Artificial Sequence
  Synthetic oligonucleotide; TGG chr11 5162592 5162611 5162608 +
taacacatgaggatgaaatt

SEQ ID NO: 1466 - DNA, 20 bp, Artificial Sequence
  Synthetic oligonucleotide; GGG chr11 5162593 5162612 5162609 +
aacacatgaggatgaaattt

SEQ ID NO: 1467 - DNA, 20 bp, Artificial Sequence
  Synthetic oligonucleotide; AAG chr11 5162604 5162623 5162620 +
atgaaatttgggcttgactg

SEQ ID NO: 1468 - DNA, 20 bp, Artificial Sequence
  Synthetic oligonucleotide; TGG chr11 5162610 5162629 5162626 +
tttgggcttgactgaagtaa

SEQ ID NO: 1469 - DNA, 20 bp, Artificial Sequence
  Synthetic oligonucleotide; GGG chr11 5162611 5162630 5162627 +
ttgggcttgactgaagtaat

SEQ ID NO: 1470 - DNA, 20 bp, Artificial Sequence
  Synthetic oligonucleotide; GGG chr11 5162612 5162631 5162628 +
tgggcttgactgaagtaatg

SEQ ID NO: 1471 - DNA, 20 bp, Artificial Sequence
  Synthetic oligonucleotide; AAG chr11 5162625 5162644 5162641 +
agtaatggggtctgtctgtg

SEQ ID NO: 1472 - DNA, 20 bp, Artificial Sequence
  Synthetic oligonucleotide; CAG chr11 5162633 5162652 5162649 +
ggtctgtctgtgaagccttg

SEQ ID NO: 1473 - DNA, 20 bp, Artificial Sequence
  Synthetic oligonucleotide; CAG chr11 5162636 5162655 5162652 +
ctgtctgtgaagccttgcag

SEQ ID NO: 1474 - DNA, 20 bp, Artificial Sequence
  Synthetic oligonucleotide; CAG chr11 5162641 5162660 5162657 +
tgtgaagccttgcagcagta

SEQ ID NO: 1475 - DNA, 20 bp, Artificial Sequence
  Synthetic oligonucleotide; CAG chr11 5162646 5162665 5162662 +
agccttgcagcagtacagcc

SEQ ID NO: 1476 - DNA, 20 bp, Artificial Sequence
  Synthetic oligonucleotide; AGG chr11 5162647 5162666 5162663 +
gccttgcagcagtacagccc

SEQ ID NO: 1477 - DNA, 20 bp, Artificial Sequence
  Synthetic oligonucleotide; GAG chr11 5162659 5162678 5162675 +
tacagcccaggtaatttgct

SEQ ID NO: 1478 - DNA, 20 bp, Artificial Sequence
  Synthetic oligonucleotide; TGG chr11 5162667 5162686 5162683 +
aggtaatttgctgagcctaa

SEQ ID NO: 1479 - DNA, 20 bp, Artificial Sequence
  Synthetic oligonucleotide; GGG chr11 5162668 5162687 5162684 +
ggtaatttgctgagcctaat

SEQ ID NO: 1480 - DNA, 20 bp, Artificial Sequence
  Synthetic oligonucleotide; CAG chr11 5162674 5162693 5162690 +
ttgctgagcctaatgggtgt

SEQ ID NO: 1481 - DNA, 20 bp, Artificial Sequence
  Synthetic oligonucleotide; CAG chr11 5162680 5162699 5162696 +
agcctaatgggtgtcagtgt

SEQ ID NO: 1482 - DNA, 20 bp, Artificial Sequence
  Synthetic oligonucleotide; AAG chr11 5162686 5162705 5162702 +
atgggtgtcagtgtcagtcc

SEQ ID NO: 1483 - DNA, 20 bp, Artificial Sequence
  Synthetic oligonucleotide; AAG chr11 5162692 5162711 5162708 +
gtcagtgtcagtccaagtga

SEQ ID NO: 1484 - DNA, 20 bp, Artificial Sequence
  Synthetic oligonucleotide; AAG chr11 5162697 5162716 5162713 +
tgtcagtccaagtgaaagcg

SEQ ID NO: 1485 - DNA, 20 bp, Artificial Sequence
  Synthetic oligonucleotide; GAG chr11 5162699 5162718 5162715 +
tcagtccaagtgaaagcgaa

SEQ ID NO: 1486 - DNA, 20 bp, Artificial Sequence
  Synthetic oligonucleotide; GAG chr11 5162701 5162720 5162717 +
agtccaagtgaaagcgaaga

SEQ ID NO: 1487 - DNA, 20 bp, Artificial Sequence
  Synthetic oligonucleotide; AGG chr11 5162702 5162721 5162718 +
gtccaagtgaaagcgaagag

SEQ ID NO: 1488 - DNA, 20 bp, Artificial Sequence
  Synthetic oligonucleotide; TGG chr11 5162706 5162725 5162722 +
aagtgaaagcgaagagaggc

SEQ ID NO: 1489 - DNA, 20 bp, Artificial Sequence
  Synthetic oligonucleotide; AAG chr11 5162713 5162732 5162729 +
agcgaagagaggctggaatg

SEQ ID NO: 1490 - DNA, 20 bp, Artificial Sequence
  Synthetic oligonucleotide; AGG chr11 5162714 5162733 5162730 +
gcgaagagaggctggaatga

SEQ ID NO: 1491 - DNA, 20 bp, Artificial Sequence
  Synthetic oligonucleotide; GGG chr11 5162715 5162734 5162731 +
cgaagagaggctggaatgaa

SEQ ID NO: 1492 - DNA, 20 bp, Artificial Sequence
  Synthetic oligonucleotide; AAG chr11 5162722 5162741 5162738 +
aggctggaatgaagggtgca

SEQ ID NO: 1493 - DNA, 20 bp, Artificial Sequence
  Synthetic oligonucleotide; AGG chr11 5162723 5162742 5162739 +
ggctggaatgaagggtgcaa

SEQ ID NO: 1494 - DNA, 20 bp, Artificial Sequence
  Synthetic oligonucleotide; TAG chr11 5162728 5162747 5162744 +
gaatgaagggtgcaaaggaa

SEQ ID NO: 1495 - DNA, 20 bp, Artificial Sequence
  Synthetic oligonucleotide; AAG chr11 5162733 5162752 5162749 +
aagggtgcaaaggaatagta

SEQ ID NO: 1496 - DNA, 20 bp, Artificial Sequence
  Synthetic oligonucleotide; AAG chr11 5162737 5162756 5162753 +
gtgcaaaggaatagtaaaga

SEQ ID NO: 1497 - DNA, 20 bp, Artificial Sequence
  Synthetic oligonucleotide; GAG chr11 5162747 5162766 5162763 +
atagtaaagaaagcatgttt

SEQ ID NO: 1498 - DNA, 20 bp, Artificial Sequence
  Synthetic oligonucleotide; CAG chr11 5162753 5162772 5162769 +
aagaaagcatgtttgagatc

SEQ ID NO: 1499 - DNA, 20 bp, Artificial Sequence
  Synthetic oligonucleotide; CAG chr11 5162758 5162777 5162774 +
agcatgtttgagatccagaa

SEQ ID NO: 1500 - DNA, 20 bp, Artificial Sequence
  Synthetic oligonucleotide; TGG chr11 5162766 5162785 5162782 +
tgagatccagaacagaataa

SEQ ID NO: 1501 - DNA, 20 bp, Artificial Sequence
  Synthetic oligonucleotide; GGG chr11 5162767 5162786 5162783 +
gagatccagaacagaataat

SEQ ID NO: 1502 - DNA, 20 bp, Artificial Sequence
  Synthetic oligonucleotide; TAG chr11 5162773 5162792 5162789 +
cagaacagaataatgggtta

SEQ ID NO: 1503 - DNA, 20 bp, Artificial Sequence
  Synthetic oligonucleotide; TGG chr11 5162777 5162796 5162793 +
acagaataatgggttataga

SEQ ID NO: 1504 - DNA, 20 bp, Artificial Sequence
  Synthetic oligonucleotide; GAG chr11 5162779 5162798 5162795 +
agaataatgggttatagatg

SEQ ID NO: 1505 - DNA, 20 bp, Artificial Sequence
  Synthetic oligonucleotide; AGG chr11 5162780 5162799 5162796 +
gaataatgggttatagatgg

SEQ ID NO: 1506 - DNA, 20 bp, Artificial Sequence
  Synthetic oligonucleotide; GAG chr11 5162787 5162806 5162803 +
gggttatagatggaggtatt

SEQ ID NO: 1507 - DNA, 20 bp, Artificial Sequence
  Synthetic oligonucleotide; AGG chr11 5162788 5162807 5162804 +
ggttatagatggaggtattg

SEQ ID NO: 1508 - DNA, 20 bp, Artificial Sequence
  Synthetic oligonucleotide; TAG chr11 5162792 5162811 5162808 +
atagatggaggtattgagga

SEQ ID NO: 1509 - DNA, 20 bp, Artificial Sequence
  Synthetic oligonucleotide; AGG chr11 5162793 5162812 5162809 +
tagatggaggtattgaggat

SEQ ID NO: 1510 - DNA, 20 bp, Artificial Sequence
  Synthetic oligonucleotide; GAG chr11 5162795 5162814 5162811 +
gatggaggtattgaggatag

SEQ ID NO: 1511 - DNA, 20 bp, Artificial Sequence
  Synthetic oligonucleotide; GAG chr11 5162797 5162816 5162813 +
tggaggtattgaggatagga

SEQ ID NO: 1512 - DNA, 20 bp, Artificial Sequence
  Synthetic oligonucleotide; TGG chr11 5162804 5162823 5162820 +
attgaggataggagagtata

SEQ ID NO: 1513 - DNA, 20 bp, Artificial Sequence
  Synthetic oligonucleotide; GGG chr11 5162805 5162824 5162821 +
ttgaggataggagagtatat

SEQ ID NO: 1514 - DNA, 20 bp, Artificial Sequence
  Synthetic oligonucleotide; TGG chr11 5162810 5162829 5162826 +
gataggagagtatatgggtt

SEQ ID NO: 1515 - DNA, 20 bp, Artificial Sequence
  Synthetic oligonucleotide; TGG chr11 5162818 5162837 5162834 +
agtatatgggtttggcacca

SEQ ID NO: 1516 - DNA, 20 bp, Artificial Sequence
  Synthetic oligonucleotide; GGG chr11 5162819 5162838 5162835 +
gtatatgggtttggcaccat

SEQ ID NO: 1517 - DNA, 20 bp, Artificial Sequence
  Synthetic oligonucleotide; GGG chr11 5162820 5162839 5162836 +
tatatgggtttggcaccatg

SEQ ID NO: 1518 - DNA, 20 bp, Artificial Sequence
  Synthetic oligonucleotide; TGG chr11 5162823 5162842 5162839 +
atgggtttggcaccatgggg

SEQ ID NO: 1519 - DNA, 20 bp, Artificial Sequence
  Synthetic oligonucleotide; TAG chr11 5162827 5162846 5162843 +
gtttggcaccatggggtgga

SEQ ID NO: 1520 - DNA, 20 bp, Artificial Sequence
  Synthetic oligonucleotide; AGG chr11 5162828 5162847 5162844 +
tttggcaccatggggtggat

SEQ ID NO: 1521 - DNA, 20 bp, Artificial Sequence
  Synthetic oligonucleotide; TGG chr11 5162841 5162860 5162857 +
ggtggataggcaaaacaatt

SEQ ID NO: 1522 - DNA, 20 bp, Artificial Sequence
  Synthetic oligonucleotide; AAG chr11 5162849 5162868 5162865 +
ggcaaaacaatttggttgat

SEQ ID NO: 1523 - DNA, 20 bp, Artificial Sequence
  Synthetic oligonucleotide; CAG chr11 5162855 5162874 5162871 +
acaatttggttgataagatg

SEQ ID NO: 1524 - DNA, 20 bp, Artificial Sequence
  Synthetic oligonucleotide; AAG chr11 5162875 5162894 5162891 +
cagattctgaactaacctgt

SEQ ID NO: 1525 - DNA, 20 bp, Artificial Sequence
  Synthetic oligonucleotide; AGG chr11 5162876 5162895 5162892 +
agattctgaactaacctgta

SEQ ID NO: 1526 - DNA, 20 bp, Artificial Sequence
  Synthetic oligonucleotide; TGG chr11 5162885 5162904 5162901 +
actaacctgtaaggcttgtc

SEQ ID NO: 1527 - DNA, 20 bp, Artificial Sequence
  Synthetic oligonucleotide; TAG chr11 5162891 5162910 5162907 +
ctgtaaggcttgtctggttt

SEQ ID NO: 1528 - DNA, 20 bp, Artificial Sequence
  Synthetic oligonucleotide; AGG chr11 5162892 5162911 5162908 +
tgtaaggcttgtctggtttt

SEQ ID NO: 1529 - DNA, 20 bp, Artificial Sequence
  Synthetic oligonucleotide; CAG chr11 5162896 5162915 5162912 +
aggcttgtctggttttagga

SEQ ID NO: 1530 - DNA, 20 bp, Artificial Sequence
  Synthetic oligonucleotide; AGG chr11 5162897 5162916 5162913 +
ggcttgtctggttttaggac

SEQ ID NO: 1531 - DNA, 20 bp, Artificial Sequence
  Synthetic oligonucleotide; TGG chr11 5162905 5162924 5162921 +
tggttttaggacaggtaaaa

SEQ ID NO: 1532 - DNA, 20 bp, Artificial Sequence
  Synthetic oligonucleotide; GGG chr11 5162906 5162925 5162922 +
ggttttaggacaggtaaaat

SEQ ID NO: 1533 - DNA, 20 bp, Artificial Sequence
  Synthetic oligonucleotide; GGG chr11 5162907 5162926 5162923 +
gttttaggacaggtaaaatg

SEQ ID NO: 1534 - DNA, 20 bp, Artificial Sequence
  Synthetic oligonucleotide; GGG chr11 5162908 5162927 5162924 +
ttttaggacaggtaaaatgg

SEQ ID NO: 1535 - DNA, 20 bp, Artificial Sequence
  Synthetic oligonucleotide; TGG chr11 5162913 5162932 5162929 +
ggacaggtaaaatgggggaa

SEQ ID NO: 1536 - DNA, 20 bp, Artificial Sequence
  Synthetic oligonucleotide; AAG chr11 5162917 5162936 5162933 +
aggtaaaatgggggaatggt

SEQ ID NO: 1537 - DNA, 20 bp, Artificial Sequence
  Synthetic oligonucleotide; AGG chr11 5162918 5162937 5162934 +
ggtaaaatgggggaatggta

SEQ ID NO: 1538 - DNA, 20 bp, Artificial Sequence
  Synthetic oligonucleotide; GAG chr11 5162920 5162939 5162936 +
taaaatgggggaatggtaag

SEQ ID NO: 1539 - DNA, 20 bp, Artificial Sequence
  Synthetic oligonucleotide; GAG chr11 5162922 5162941 5162938 +
aaatgggggaatggtaagga

SEQ ID NO: 1540 - DNA, 20 bp, Artificial Sequence
  Synthetic oligonucleotide; TAG chr11 5162929 5162948 5162945 +
ggaatggtaaggagagttta

SEQ ID NO: 1541 - DNA, 20 bp, Artificial Sequence
  Synthetic oligonucleotide; AGG chr11 5162930 5162949 5162946 +
gaatggtaaggagagtttat

SEQ ID NO: 1542 - DNA, 20 bp, Artificial Sequence
  Synthetic oligonucleotide; AAG chr11 5162939 5162958 5162955 +
ggagagtttataggctttaa

SEQ ID NO: 1543 - DNA, 20 bp, Artificial Sequence
  Synthetic oligonucleotide; AGG chr11 5162940 5162959 5162956 +
gagagtttataggctttaaa

SEQ ID NO: 1544 - DNA, 20 bp, Artificial Sequence
  Synthetic oligonucleotide; CAG chr11 5162954 5162973 5162970 +
tttaaaaggccatgctgtaa

SEQ ID NO: 1545 - DNA, 20 bp, Artificial Sequence
  Synthetic oligonucleotide; AGG chr11 5162955 5162974 5162971 +
ttaaaaggccatgctgtaac

SEQ ID NO: 1546 - DNA, 20 bp, Artificial Sequence
  Synthetic oligonucleotide; AAG chr11 5162959 5162978 5162975 +
aaggccatgctgtaacaggc

SEQ ID NO: 1547 - DNA, 20 bp, Artificial Sequence
  Synthetic oligonucleotide; CAG chr11 5162968 5162987 5162984 +
ctgtaacaggcaagtaataa

SEQ ID NO: 1548 - DNA, 20 bp, Artificial Sequence
  Synthetic oligonucleotide; AGG chr11 5162969 5162988 5162985 +
tgtaacaggcaagtaataac

SEQ ID NO: 1549 - DNA, 20 bp, Artificial Sequence
  Synthetic oligonucleotide; AAG chr11 5162986 5163005 5163002 +
aacaggctttaatcctttca

SEQ ID NO: 1550 - DNA, 20 bp, Artificial Sequence
  Synthetic oligonucleotide; TGG chr11 5162996 5163015 5163012 +
aatcctttcaaagcatgctg

SEQ ID NO: 1551 - DNA, 20 bp, Artificial Sequence
  Synthetic oligonucleotide; GGG chr11 5162997 5163016 5163013 +
atcctttcaaagcatgctgt

SEQ ID NO: 1552 - DNA, 20 bp, Artificial Sequence
  Synthetic oligonucleotide; TGG chr11 5163001 5163020 5163017 +
tttcaaagcatgctgtggga

SEQ ID NO: 1553 - DNA, 20 bp, Artificial Sequence
  Synthetic oligonucleotide; GGG chr11 5163002 5163021 5163018 +
ttcaaagcatgctgtgggat

SEQ ID NO: 1554 - DNA, 20 bp, Artificial Sequence
  Synthetic oligonucleotide; TGG chr11 5163009 5163028 5163025 +
catgctgtgggatgggatac

SEQ ID NO: 1555 - DNA, 20 bp, Artificial Sequence
  Synthetic oligonucleotide; GAG chr11 5163016 5163035 5163032 +
tgggatgggatactggcatt

SEQ ID NO: 1556 - DNA, 20 bp, Artificial Sequence
  Synthetic oligonucleotide; CGG chr11 5163019 5163038 5163035 +
gatgggatactggcattgag

SEQ ID NO: 1557 - DNA, 20 bp, Artificial Sequence
  Synthetic oligonucleotide; GGG chr11 5163020 5163039 5163036 +
atgggatactggcattgagc

SEQ ID NO: 1558 - DNA, 20 bp, Artificial Sequence
  Synthetic oligonucleotide; GGG chr11 5163021 5163040 5163037 +
tgggatactggcattgagcg

SEQ ID NO: 1559 - DNA, 20 bp, Artificial Sequence
  Synthetic oligonucleotide; AAG chr11 5163025 5163044 5163041 +
atactggcattgagcggggt

SEQ ID NO: 1560 - DNA, 20 bp, Artificial Sequence
  Synthetic oligonucleotide; GAG chr11 5163027 5163046 5163043 +
actggcattgagcggggtaa

SEQ ID NO: 1561 - DNA, 20 bp, Artificial Sequence
  Synthetic oligonucleotide; TAG chr11 5163034 5163053 5163050 +
ttgagcggggtaagagtgat

SEQ ID NO: 1562 - DNA, 20 bp, Artificial Sequence
  Synthetic oligonucleotide; AGG chr11 5163035 5163054 5163051 +
tgagcggggtaagagtgatt

SEQ ID NO: 1563 - DNA, 20 bp, Artificial Sequence
  Synthetic oligonucleotide; TGG chr11 5163044 5163063 5163060 +
taagagtgattaggttttaa

SEQ ID NO: 1564 - DNA, 20 bp, Artificial Sequence
  Synthetic oligonucleotide; GGG chr11 5163045 5163064 5163061 +
aagagtgattaggttttaat

SEQ ID NO: 1565 - DNA, 20 bp, Artificial Sequence
  Synthetic oligonucleotide; TGG chr11 5163049 5163068 5163065 +
gtgattaggttttaatggga

SEQ ID NO: 1566 - DNA, 20 bp, Artificial Sequence
  Synthetic oligonucleotide; AAG chr11 5163053 5163072 5163069 +
ttaggttttaatgggatggt

SEQ ID NO: 1567 - DNA, 20 bp, Artificial Sequence
  Synthetic oligonucleotide; AGG chr11 5163054 5163073 5163070 +
taggttttaatgggatggta

SEQ ID NO: 1568 - DNA, 20 bp, Artificial Sequence
  Synthetic oligonucleotide; GGG chr11 5163055 5163074 5163071 +
aggttttaatgggatggtaa

SEQ ID NO: 1569 - DNA, 20 bp, Artificial Sequence
  Synthetic oligonucleotide; GGG chr11 5163056 5163075 5163072 +
ggttttaatgggatggtaag

SEQ ID NO: 1570 - DNA, 20 bp, Artificial Sequence
  Synthetic oligonucleotide; CGG chr11 5163067 5163086 5163083 +
gatggtaaggggcgcatgat

SEQ ID NO: 1571 - DNA, 20 bp, Artificial Sequence
  Synthetic oligonucleotide; AAG chr11 5163075 5163094 5163091 +
ggggcgcatgatcggtcgcg

SEQ ID NO: 1572 - DNA, 20 bp, Artificial Sequence
  Synthetic oligonucleotide; AGG chr11 5163076 5163095 5163092 +
gggcgcatgatcggtcgcga

SEQ ID NO: 1573 - DNA, 20 bp, Artificial Sequence
  Synthetic oligonucleotide; GAG chr11 5163078 5163097 5163094 +
gcgcatgatcggtcgcgaag

SEQ ID NO: 1574 - DNA, 20 bp, Artificial Sequence
  Synthetic oligonucleotide; AGG chr11 5163079 5163098 5163095 +
cgcatgatcggtcgcgaagg

SEQ ID NO: 1575 - DNA, 20 bp, Artificial Sequence
  Synthetic oligonucleotide; AAG chr11 5163082 5163101 5163098 +
atgatcggtcgcgaaggagg

SEQ ID NO: 1576 - DNA, 20 bp, Artificial Sequence
  Synthetic oligonucleotide; TAG chr11 5163085 5163104 5163101 +
atcggtcgcgaaggaggaag

SEQ ID NO: 1577 - DNA, 20 bp, Artificial Sequence
  Synthetic oligonucleotide; GAG chr11 5163087 5163106 5163103 +
cggtcgcgaaggaggaagta

SEQ ID NO: 1578 - DNA, 20 bp, Artificial Sequence
  Synthetic oligonucleotide; AGG chr11 5163088 5163107 5163104 +
ggtcgcgaaggaggaagtag

SEQ ID NO: 1579 - DNA, 20 bp, Artificial Sequence
  Synthetic oligonucleotide; TGG chr11 5163104 5163123 5163120 +
gtagaggtgtcttatacttg

SEQ ID NO: 1580 - DNA, 20 bp, Artificial Sequence
  Synthetic oligonucleotide; AAG chr11 5163110 5163129 5163126 +
gtgtcttatacttgtggatt

SEQ ID NO: 1581 - DNA, 20 bp, Artificial Sequence
  Synthetic oligonucleotide; AGG chr11 5163111 5163130 5163127 +
tgtcttatacttgtggatta

SEQ ID NO: 1582 - DNA, 20 bp, Artificial Sequence
  Synthetic oligonucleotide; TGG chr11 5163114 5163133 5163130 +
cttatacttgtggattaagg

SEQ ID NO: 1583 - DNA, 20 bp, Artificial Sequence
  Synthetic oligonucleotide; GGG chr11 5163115 5163134 5163131 +
ttatacttgtggattaaggt

SEQ ID NO: 1584 - DNA, 20 bp, Artificial Sequence
  Synthetic oligonucleotide; GGG chr11 5163116 5163135 5163132 +
tatacttgtggattaaggtg

SEQ ID NO: 1585 - DNA, 20 bp, Artificial Sequence
  Synthetic oligonucleotide; GAG chr11 5163118 5163137 5163134 +
tacttgtggattaaggtggg

SEQ ID NO: 1586 - DNA, 20 bp, Artificial Sequence
  Synthetic oligonucleotide; AAG chr11 5163125 5163144 5163141 +
ggattaaggtggggagatac

SEQ ID NO: 1587 - DNA, 20 bp, Artificial Sequence
  Synthetic oligonucleotide; AGG chr11 5163126 5163145 5163142 +
gattaaggtggggagataca

SEQ ID NO: 1588 - DNA, 20 bp, Artificial Sequence
  Synthetic oligonucleotide; GGG chr11 5163127 5163146 5163143 +
attaaggtggggagatacaa

SEQ ID NO: 1589 - DNA, 20 bp, Artificial Sequence
  Synthetic oligonucleotide; GGG chr11 5163128 5163147 5163144 +
ttaaggtggggagatacaag

SEQ ID NO: 1590 - DNA, 20 bp, Artificial Sequence
  Synthetic oligonucleotide; GAG chr11 5163130 5163149 5163146 +
aaggtggggagatacaaggg

SEQ ID NO: 1591 - DNA, 20 bp, Artificial Sequence
  Synthetic oligonucleotide; AGG chr11 5163131 5163150 5163147 +
aggtggggagatacaagggg

SEQ ID NO: 1592 - DNA, 20 bp, Artificial Sequence
  Synthetic oligonucleotide; AAG chr11 5163139 5163158 5163155 +
agatacaaggggaggatgtg

SEQ ID NO: 1593 - DNA, 20 bp, Artificial Sequence
  Synthetic oligonucleotide; AGG chr11 5163140 5163159 5163156 +
gatacaaggggaggatgtga

SEQ ID NO: 1594 - DNA, 20 bp, Artificial Sequence
  Synthetic oligonucleotide; GAG chr11 5163142 5163161 5163158 +
tacaaggggaggatgtgaag

SEQ ID NO: 1595 - DNA, 20 bp, Artificial Sequence
  Synthetic oligonucleotide; AGG chr11 5163143 5163162 5163159 +
acaaggggaggatgtgaagg

SEQ ID NO: 1596 - DNA, 20 bp, Artificial Sequence
  Synthetic oligonucleotide; TGG chr11 5163154 5163173 5163170 +
atgtgaaggaggctttgaac

SEQ ID NO: 1597 - DNA, 20 bp, Artificial Sequence
  Synthetic oligonucleotide; GGG chr11 5163155 5163174 5163171 +
tgtgaaggaggctttgaact

SEQ ID NO: 1598 - DNA, 20 bp, Artificial Sequence
  Synthetic oligonucleotide; GGG chr11 5163156 5163175 5163172 +
gtgaaggaggctttgaactg

SEQ ID NO: 1599 - DNA, 20 bp, Artificial Sequence
  Synthetic oligonucleotide; GGG chr11 5163157 5163176 5163173 +
tgaaggaggctttgaactgg

SEQ ID NO: 1600 - DNA, 20 bp, Artificial Sequence
  Synthetic oligonucleotide; TGG chr11 5163166 5163185 5163182 +
ctttgaactgggggaaaaca

SEQ ID NO: 1601 - DNA, 20 bp, Artificial Sequence
  Synthetic oligonucleotide; GAG chr11 5163173 5163192 5163189 +
ctgggggaaaacatggcaat

SEQ ID NO: 1602 - DNA, 20 bp, Artificial Sequence
  Synthetic oligonucleotide; AGG chr11 5163174 5163193 5163190 +
tgggggaaaacatggcaatg

SEQ ID NO: 1603 - DNA, 20 bp, Artificial Sequence
  Synthetic oligonucleotide; TGG chr11 5163179 5163198 5163195 +
gaaaacatggcaatgaggta

SEQ ID NO: 1604 - DNA, 20 bp, Artificial Sequence
  Synthetic oligonucleotide; TAG chr11 5163185 5163204 5163201 +
atggcaatgaggtatggctg

SEQ ID NO: 1605 - DNA, 20 bp, Artificial Sequence
  Synthetic oligonucleotide; CAG chr11 5163190 5163209 5163206 +
aatgaggtatggctgtagcc

SEQ ID NO: 1606 - DNA, 20 bp, Artificial Sequence
  Synthetic oligonucleotide; AGG chr11 5163191 5163210 5163207 +
atgaggtatggctgtagccc

SEQ ID NO: 1607 - DNA, 20 bp, Artificial Sequence
  Synthetic oligonucleotide; TAG chr11 5163196 5163215 5163212 +
gtatggctgtagcccaggaa

SEQ ID NO: 1608 - DNA, 20 bp, Artificial Sequence
  Synthetic oligonucleotide; CAG chr11 5163200 5163219 5163216 +
ggctgtagcccaggaatagt

SEQ ID NO: 1609 - DNA, 20 bp, Artificial Sequence
  Synthetic oligonucleotide; AGG chr11 5163201 5163220 5163217 +
gctgtagcccaggaatagtc

SEQ ID NO: 1610 - DNA, 20 bp, Artificial Sequence
  Synthetic oligonucleotide; GGG chr11 5163202 5163221 5163218 +
ctgtagcccaggaatagtca

SEQ ID NO: 1611 - DNA, 20 bp, Artificial Sequence
  Synthetic oligonucleotide; AAG chr11 5163205 5163224 5163221 +
tagcccaggaatagtcaggg

SEQ ID NO: 1612 - DNA, 20 bp, Artificial Sequence
  Synthetic oligonucleotide; CAG chr11 5163208 5163227 5163224 +
cccaggaatagtcagggaag

SEQ ID NO: 1613 - DNA, 20 bp, Artificial Sequence
  Synthetic oligonucleotide; TAG chr11 5163217 5163236 5163233 +
agtcagggaagcagataatt

SEQ ID NO: 1614 - DNA, 20 bp, Artificial Sequence
  Synthetic oligonucleotide; AAG chr11 5163223 5163242 5163239 +
ggaagcagataatttagtta

SEQ ID NO: 1615 - DNA, 20 bp, Artificial Sequence
  Synthetic oligonucleotide; CGG chr11 5163231 5163250 5163247 +
ataatttagttaaagtgtct

SEQ ID NO: 1616 - DNA, 20 bp, Artificial Sequence
  Synthetic oligonucleotide; AAG chr11 5163240 5163259 5163256 +
ttaaagtgtctcggcctaat

SEQ ID NO: 1617 - DNA, 20 bp, Artificial Sequence
  Synthetic oligonucleotide; AGG chr11 5163241 5163260 5163257 +
taaagtgtctcggcctaata

SEQ ID NO: 1618 - DNA, 20 bp, Artificial Sequence
  Synthetic oligonucleotide; GGG chr11 5163242 5163261 5163258 +
aaagtgtctcggcctaataa

SEQ ID NO: 1619 - DNA, 20 bp, Artificial Sequence
  Synthetic oligonucleotide; TGG chr11 5163248 5163267 5163264 +
tctcggcctaataagggaac

SEQ ID NO: 1620 - DNA, 20 bp, Artificial Sequence
  Synthetic oligonucleotide; CAG chr11 5163251 5163270 5163267 +
cggcctaataagggaactgg

SEQ ID NO: 1621 - DNA, 20 bp, Artificial Sequence
  Synthetic oligonucleotide; AGG chr11 5163252 5163271 5163268 +
ggcctaataagggaactggc

SEQ ID NO: 1622 - DNA, 20 bp, Artificial Sequence
  Synthetic oligonucleotide; TGG chr11 5163255 5163274 5163271 +
ctaataagggaactggcagg

SEQ ID NO: 1623 - DNA, 20 bp, Artificial Sequence
  Synthetic oligonucleotide; GGG chr11 5163256 5163275 5163272 +
taataagggaactggcaggt

SEQ ID NO: 1624 - DNA, 20 bp, Artificial Sequence
  Synthetic oligonucleotide; GGG chr11 5163257 5163276 5163273 +
aataagggaactggcaggtg

SEQ ID NO: 1625 - DNA, 20 bp, Artificial Sequence
  Synthetic oligonucleotide; AAG chr11 5163269 5163288 5163285 +
ggcaggtggggataatgaaa

SEQ ID NO: 1626 - DNA, 20 bp, Artificial Sequence
  Synthetic oligonucleotide; AGG chr11 5163270 5163289 5163286 +
gcaggtggggataatgaaaa

SEQ ID NO: 1627 - DNA, 20 bp, Artificial Sequence
  Synthetic oligonucleotide; GAG chr11 5163272 5163291 5163288 +
aggtggggataatgaaaaag

SEQ ID NO: 1628 - DNA, 20 bp, Artificial Sequence
  Synthetic oligonucleotide; AAG chr11 5163282 5163301 5163298 +
aatgaaaaaggagtgcttaa

SEQ ID NO: 1629 - DNA, 20 bp, Artificial Sequence
  Synthetic oligonucleotide; GAG chr11 5163284 5163303 5163300 +
tgaaaaaggagtgcttaaaa

SEQ ID NO: 1630 - DNA, 20 bp, Artificial Sequence
  Synthetic oligonucleotide; CGG chr11 5163295 5163314 5163311 +
tgcttaaaagagtatcgtct

SEQ ID NO: 1631 - DNA, 20 bp, Artificial Sequence
  Synthetic oligonucleotide; TAG chr11 5163299 5163318 5163315 +
taaaagagtatcgtctcggt

SEQ ID NO: 1632 - DNA, 20 bp, Artificial Sequence
  Synthetic oligonucleotide; CAG chr11 5163305 5163324 5163321 +
agtatcgtctcggttagcac

SEQ ID NO: 1633 - DNA, 20 bp, Artificial Sequence
  Synthetic oligonucleotide; GAG chr11 5163307 5163326 5163323 +
tatcgtctcggttagcacca

SEQ ID NO: 1634 - DNA, 20 bp, Artificial Sequence
  Synthetic oligonucleotide; TGG chr11 5163311 5163330 5163327 +
gtctcggttagcaccagagt

SEQ ID NO: 1635 - DNA, 20 bp, Artificial Sequence
  Synthetic oligonucleotide; GGG chr11 5163312 5163331 5163328 +
tctcggttagcaccagagtt

SEQ ID NO: 1636 - DNA, 20 bp, Artificial Sequence
  Synthetic oligonucleotide; GGG chr11 5163313 5163332 5163329 +
ctcggttagcaccagagttg

SEQ ID NO: 1637 - DNA, 20 bp, Artificial Sequence
  Synthetic oligonucleotide; AAG chr11 5163322 5163341 5163338 +
caccagagttggggaatttt

SEQ ID NO: 1638 - DNA, 20 bp, Artificial Sequence
  Synthetic oligonucleotide; GAG chr11 5163324 5163343 5163340 +
ccagagttggggaattttaa

SEQ ID NO: 1639 - DNA, 20 bp, Artificial Sequence
  Synthetic oligonucleotide; AGG chr11 5163325 5163344 5163341 +
cagagttggggaattttaag

SEQ ID NO: 1640 - DNA, 20 bp, Artificial Sequence
  Synthetic oligonucleotide; TAG chr11 5163330 5163349 5163346 +
ttggggaattttaagaggtt

SEQ ID NO: 1641 - DNA, 20 bp, Artificial Sequence
  Synthetic oligonucleotide; AAG chr11 5163333 5163352 5163349 +
gggaattttaagaggtttag

SEQ ID NO: 1642 - DNA, 20 bp, Artificial Sequence
  Synthetic oligonucleotide; TGG chr11 5163338 5163357 5163354 +
ttttaagaggtttagaagcc

SEQ ID NO: 1643 - DNA, 20 bp, Artificial Sequence
  Synthetic oligonucleotide; CAG chr11 5163357 5163376 5163373 +
ctggccatcaatacctacaa

SEQ ID NO: 1644 - DNA, 20 bp, Artificial Sequence
  Synthetic oligonucleotide; TGG chr11 5163363 5163382 5163379 +
atcaatacctacaacagtta

SEQ ID NO: 1645 - DNA, 20 bp, Artificial Sequence
  Synthetic oligonucleotide; GAG chr11 5163365 5163384 5163381 +
caatacctacaacagttatg

SEQ ID NO: 1646 - DNA, 20 bp, Artificial Sequence
  Synthetic oligonucleotide; AGG chr11 5163366 5163385 5163382 +
aatacctacaacagttatgg

SEQ ID NO: 1647 - DNA, 20 bp, Artificial Sequence
  Synthetic oligonucleotide; AAG chr11 5163370 5163389 5163386 +
cctacaacagttatggaggc

SEQ ID NO: 1648 - DNA, 20 bp, Artificial Sequence
  Synthetic oligonucleotide; AGG chr11 5163371 5163390 5163387 +
ctacaacagttatggaggca

SEQ ID NO: 1649 - DNA, 20 bp, Artificial Sequence
  Synthetic oligonucleotide; GGG chr11 5163372 5163391 5163388 +
tacaacagttatggaggcaa

SEQ ID NO: 1650 - DNA, 20 bp, Artificial Sequence
  Synthetic oligonucleotide; CAG chr11 5163378 5163397 5163394 +
agttatggaggcaagggaaa

SEQ ID NO: 1651 - DNA, 20 bp, Artificial Sequence
  Synthetic oligonucleotide; AGG chr11 5163379 5163398 5163395 +
gttatggaggcaagggaaac

SEQ ID NO: 1652 - DNA, 20 bp, Artificial Sequence
  Synthetic oligonucleotide; AAG chr11 5163390 5163409 5163406 +
aagggaaacaggcctttgaa

SEQ ID NO: 1653 - DNA, 20 bp, Artificial Sequence
  Synthetic oligonucleotide; AAG chr11 5163393 5163412 5163409 +
ggaaacaggcctttgaaaag

SEQ ID NO: 1654 - DNA, 20 bp, Artificial Sequence
  Synthetic oligonucleotide; AGG chr11 5163394 5163413 5163410 +
gaaacaggcctttgaaaaga

SEQ ID NO: 1655 - DNA, 20 bp, Artificial Sequence
  Synthetic oligonucleotide; TGG chr11 5163402 5163421 5163418 +
cctttgaaaagaaggtaatg

SEQ ID NO: 1656 - DNA, 20 bp, Artificial Sequence
  Synthetic oligonucleotide; GAG chr11 5163404 5163423 5163420 +
tttgaaaagaaggtaatgtg

SEQ ID NO: 1657 - DNA, 20 bp, Artificial Sequence
  Synthetic oligonucleotide; TGG chr11 5163407 5163426 5163423 +
gaaaagaaggtaatgtggag

SEQ ID NO: 1658 - DNA, 20 bp, Artificial Sequence
  Synthetic oligonucleotide; GGG chr11 5163408 5163427 5163424 +
aaaagaaggtaatgtggagt

SEQ ID NO: 1659 - DNA, 20 bp, Artificial Sequence
  Synthetic oligonucleotide; TAG chr11 5163411 5163430 5163427 +
agaaggtaatgtggagtggg

SEQ ID NO: 1660 - DNA, 20 bp, Artificial Sequence
  Synthetic oligonucleotide; AAG chr11 5163428 5163447 5163444 +
gggtagcctccatactgatt

SEQ ID NO: 1661 - DNA, 20 bp, Artificial Sequence
  Synthetic oligonucleotide; AAG chr11 5163431 5163450 5163447 +
tagcctccatactgattaag

SEQ ID NO: 1662 - DNA, 20 bp, Artificial Sequence
  Synthetic oligonucleotide; AGG chr11 5163432 5163451 5163448 +
agcctccatactgattaaga

SEQ ID NO: 1663 - DNA, 20 bp, Artificial Sequence
  Synthetic oligonucleotide; GGG chr11 5163433 5163452 5163449 +
gcctccatactgattaagaa

SEQ ID NO: 1664 - DNA, 20 bp, Artificial Sequence
  Synthetic oligonucleotide; CAG chr11 5163438 5163457 5163454 +
catactgattaagaagggta

SEQ ID NO: 1665 - DNA, 20 bp, Artificial Sequence
  Synthetic oligonucleotide; GAG chr11 5163457 5163476 5163473 +
acagacttaccctccactgt

SEQ ID NO: 1666 - DNA, 20 bp, Artificial Sequence
  Synthetic oligonucleotide; AAG chr11 5163469 5163488 5163485 +
tccactgtgagaattaccta

SEQ ID NO: 1667 - DNA, 20 bp, Artificial Sequence
  Synthetic oligonucleotide; CGG chr11 5163474 5163493 5163490 +
tgtgagaattacctaaagct

SEQ ID NO: 1668 - DNA, 20 bp, Artificial Sequence
  Synthetic oligonucleotide; TGG chr11 5163486 5163505 5163502 +
ctaaagctcggtgtctgtga

SEQ ID NO: 1669 - DNA, 20 bp, Artificial Sequence
  Synthetic oligonucleotide; CAG chr11 5163493 5163512 5163509 +
tcggtgtctgtgatggtcta

SEQ ID NO: 1670 - DNA, 20 bp, Artificial Sequence
  Synthetic oligonucleotide; AGG chr11 5163494 5163513 5163510 +
cggtgtctgtgatggtctac

SEQ ID NO: 1671 - DNA, 20 bp, Artificial Sequence
  Synthetic oligonucleotide; GGG chr11 5163495 5163514 5163511 +
ggtgtctgtgatggtctaca

SEQ ID NO: 1672 - DNA, 20 bp, Artificial Sequence
  Synthetic oligonucleotide; GAG chr11 5163503 5163522 5163519 +
tgatggtctacagggcttcc

SEQ ID NO: 1673 - DNA, 20 bp, Artificial Sequence
  Synthetic oligonucleotide; AGG chr11 5163504 5163523 5163520 +
gatggtctacagggcttccg

SEQ ID NO: 1674 - DNA, 20 bp, Artificial Sequence
  Synthetic oligonucleotide; CAG chr11 5163511 5163530 5163527 +
tacagggcttccgaggcgat

SEQ ID NO: 1675 - DNA, 20 bp, Artificial Sequence
  Synthetic oligonucleotide; AGG chr11 5163512 5163531 5163528 +
acagggcttccgaggcgatc

SEQ ID NO: 1676 - DNA, 20 bp, Artificial Sequence
  Synthetic oligonucleotide; CAG chr11 5163515 5163534 5163531 +
gggcttccgaggcgatcagg

SEQ ID NO: 1677 - DNA, 20 bp, Artificial Sequence
  Synthetic oligonucleotide; TGG chr11 5163518 5163537 5163534 +
cttccgaggcgatcaggcag

SEQ ID NO: 1678 - DNA, 20 bp, Artificial Sequence
  Synthetic oligonucleotide; CAG chr11 5163521 5163540 5163537 +
ccgaggcgatcaggcagtgg

SEQ ID NO: 1679 - DNA, 20 bp, Artificial Sequence
  Synthetic oligonucleotide; CAG chr11 5163528 5163547 5163544 +
gatcaggcagtggcagtctt

SEQ ID NO: 1680 - DNA, 20 bp, Artificial Sequence
  Synthetic oligonucleotide; AAG chr11 5163536 5163555 5163552 +
agtggcagtcttcagctgca

SEQ ID NO: 1681 - DNA, 20 bp, Artificial Sequence
  Synthetic oligonucleotide; GAG chr11 5163541 5163560 5163557 +
cagtcttcagctgcaaagcc

SEQ ID NO: 1682 - DNA, 20 bp, Artificial Sequence
  Synthetic oligonucleotide; AAG chr11 5163544 5163563 5163560 +
tcttcagctgcaaagccgag

SEQ ID NO: 1683 - DNA, 20 bp, Artificial Sequence
  Synthetic oligonucleotide; TGG chr11 5163550 5163569 5163566 +
gctgcaaagccgagaagatc

SEQ ID NO: 1684 - DNA, 20 bp, Artificial Sequence
  Synthetic oligonucleotide; GGG chr11 5163551 5163570 5163567 +
ctgcaaagccgagaagatct

SEQ ID NO: 1685 - DNA, 20 bp, Artificial Sequence
  Synthetic oligonucleotide; AAG chr11 5163554 5163573 5163570 +
caaagccgagaagatctggg

SEQ ID NO: 1686 - DNA, 20 bp, Artificial Sequence
  Synthetic oligonucleotide; AGG chr11 5163555 5163574 5163571 +
aaagccgagaagatctggga

SEQ ID NO: 1687 - DNA, 20 bp, Artificial Sequence
  Synthetic oligonucleotide; GAG chr11 5163557 5163576 5163573 +
agccgagaagatctgggaag

SEQ ID NO: 1688 - DNA, 20 bp, Artificial Sequence
  Synthetic oligonucleotide; CAG chr11 5163561 5163580 5163577 +
gagaagatctgggaaggagt

SEQ ID NO: 1689 - DNA, 20 bp, Artificial Sequence
  Synthetic oligonucleotide; CAG chr11 5163565 5163584 5163581 +
agatctgggaaggagtcagt

SEQ ID NO: 1690 - DNA, 20 bp, Artificial Sequence
  Synthetic oligonucleotide; AGG chr11 5163566 5163585 5163582 +
gatctgggaaggagtcagtc

SEQ ID NO: 1691 - DNA, 20 bp, Artificial Sequence
  Synthetic oligonucleotide; GGG chr11 5163567 5163586 5163583 +
atctgggaaggagtcagtca

SEQ ID NO: 1692 - DNA, 20 bp, Artificial Sequence
  Synthetic oligonucleotide; GAG chr11 5163569 5163588 5163585 +
ctgggaaggagtcagtcagg

SEQ ID NO: 1693 - DNA, 20 bp, Artificial Sequence
  Synthetic oligonucleotide; TGG chr11 5163575 5163594 5163591 +
aggagtcagtcagggagcct

SEQ ID NO: 1694 - DNA, 20 bp, Artificial Sequence
  Synthetic oligonucleotide; GGG chr11 5163576 5163595 5163592 +
ggagtcagtcagggagcctt

SEQ ID NO: 1695 - DNA, 20 bp, Artificial Sequence
  Synthetic oligonucleotide; CAG chr11 5163580 5163599 5163596 +
tcagtcagggagccttgggc

SEQ ID NO: 1696 - DNA, 20 bp, Artificial Sequence
  Synthetic oligonucleotide; GAG chr11 5163582 5163601 5163598 +
agtcagggagccttgggcca

SEQ ID NO: 1697 - DNA, 20 bp, Artificial Sequence
  Synthetic oligonucleotide; CAG chr11 5163588 5163607 5163604 +
ggagccttgggccagagttc

SEQ ID NO: 1698 - DNA, 20 bp, Artificial Sequence
  Synthetic oligonucleotide; AGG chr11 5163589 5163608 5163605 +
gagccttgggccagagttcc

SEQ ID NO: 1699 - DNA, 20 bp, Artificial Sequence
  Synthetic oligonucleotide; GGG chr11 5163590 5163609 5163606 +
agccttgggccagagttcca

SEQ ID NO: 1700 - DNA, 20 bp, Artificial Sequence
  Synthetic oligonucleotide; GGG chr11 5163591 5163610 5163607 +
gccttgggccagagttccag

SEQ ID NO: 1701 - DNA, 20 bp, Artificial Sequence
  Synthetic oligonucleotide; TAG chr11 5163597 5163616 5163613 +
ggccagagttccaggggctc

SEQ ID NO: 1702 - DNA, 20 bp, Artificial Sequence
  Synthetic oligonucleotide; AGG chr11 5163598 5163617 5163614 +
gccagagttccaggggctct

SEQ ID NO: 1703 - DNA, 20 bp, Artificial Sequence
  Synthetic oligonucleotide; GAG chr11 5163600 5163619 5163616 +
cagagttccaggggctctag

SEQ ID NO: 1704 - DNA, 20 bp, Artificial Sequence
  Synthetic oligonucleotide; TGG chr11 5163603 5163622 5163619 +
agttccaggggctctaggag

SEQ ID NO: 1705 - DNA, 20 bp, Artificial Sequence
  Synthetic oligonucleotide; CAG chr11 5163610 5163629 5163626 +
ggggctctaggagtggctgc

SEQ ID NO: 1706 - DNA, 20 bp, Artificial Sequence
  Synthetic oligonucleotide; AGG chr11 5163611 5163630 5163627 +
gggctctaggagtggctgcc

SEQ ID NO: 1707 - DNA, 20 bp, Artificial Sequence
  Synthetic oligonucleotide; GAG chr11 5163615 5163634 5163631 +
tctaggagtggctgccaggt

SEQ ID NO: 1708 - DNA, 20 bp, Artificial Sequence
  Synthetic oligonucleotide; CAG chr11 5163623 5163642 5163639 +
tggctgccaggtgagttgaa

SEQ ID NO: 1709 - DNA, 20 bp, Artificial Sequence
  Synthetic oligonucleotide; TAG chr11 5163635 5163654 5163651 +
gagttgaacagtccgatttc

SEQ ID NO: 1710 - DNA, 20 bp, Artificial Sequence
  Synthetic oligonucleotide; TGG chr11 5163638 5163657 5163654 +
ttgaacagtccgatttctag

SEQ ID NO: 1711 - DNA, 20 bp, Artificial Sequence
  Synthetic oligonucleotide; GGG chr11 5163639 5163658 5163655 +
tgaacagtccgatttctagt

SEQ ID NO: 1712 - DNA, 20 bp, Artificial Sequence
  Synthetic oligonucleotide; GGG chr11 5163640 5163659 5163656 +
gaacagtccgatttctagtg

SEQ ID NO: 1713 - DNA, 20 bp, Artificial Sequence
  Synthetic oligonucleotide; CAG chr11 5163650 5163669 5163666 +
atttctagtggggtcctgca

SEQ ID NO: 1714 - DNA, 20 bp, Artificial Sequence
  Synthetic oligonucleotide; TGG chr11 5163654 5163673 5163670 +
ctagtggggtcctgcacaga

SEQ ID NO: 1715 - DNA, 20 bp, Artificial Sequence
  Synthetic oligonucleotide; GGG chr11 5163655 5163674 5163671 +
tagtggggtcctgcacagat

SEQ ID NO: 1716 - DNA, 20 bp, Artificial Sequence
  Synthetic oligonucleotide; CGG chr11 5163661 5163680 5163677 +
ggtcctgcacagatgggaca

SEQ ID NO: 1717 - DNA, 20 bp, Artificial Sequence
  Synthetic oligonucleotide; TAG chr11 5163666 5163685 5163682 +
tgcacagatgggacacggct

SEQ ID NO: 1718 - DNA, 20 bp, Artificial Sequence
  Synthetic oligonucleotide; AGG chr11 5163667 5163686 5163683 +
gcacagatgggacacggctt

SEQ ID NO: 1719 - DNA, 20 bp, Artificial Sequence
  Synthetic oligonucleotide; GAG chr11 5163669 5163688 5163685 +
acagatgggacacggcttag

SEQ ID NO: 1720 - DNA, 20 bp, Artificial Sequence
  Synthetic oligonucleotide; AGG chr11 5163670 5163689 5163686 +
cagatgggacacggcttagg

SEQ ID NO: 1721 - DNA, 20 bp, Artificial Sequence
  Synthetic oligonucleotide; TGG chr11 5163678 5163697 5163694 +
acacggcttaggaggaatcc

SEQ ID NO: 1722 - DNA, 20 bp, Artificial Sequence
  Synthetic oligonucleotide; GGG chr11 5163679 5163698 5163695 +
cacggcttaggaggaatcct

SEQ ID NO: 1723 - DNA, 20 bp, Artificial Sequence
  Synthetic oligonucleotide; CGG chr11 5163685 5163704 5163701 +
ttaggaggaatcctgggctg

SEQ ID NO: 1724 - DNA, 20 bp, Artificial Sequence
  Synthetic oligonucleotide; GGG chr11 5163686 5163705 5163702 +
taggaggaatcctgggctgc

SEQ ID NO: 1725 - DNA, 20 bp, Artificial Sequence
  Synthetic oligonucleotide; TGG chr11 5163696 5163715 5163712 +
cctgggctgcgggcattcct

SEQ ID NO: 1726 - DNA, 20 bp, Artificial Sequence
  Synthetic oligonucleotide; TGG chr11 5163701 5163720 5163717 +
gctgcgggcattccttggcc

SEQ ID NO: 1727 - DNA, 20 bp, Artificial Sequence
  Synthetic oligonucleotide; TGG chr11 5163704 5163723 5163720 +
gcgggcattccttggcctgg

SEQ ID NO: 1728 - DNA, 20 bp, Artificial Sequence
  Synthetic oligonucleotide; CAG chr11 5163708 5163727 5163724 +
gcattccttggcctggtggc

SEQ ID NO: 1729 - DNA, 20 bp, Artificial Sequence
  Synthetic oligonucleotide; TGG chr11 5163716 5163735 5163732 +
tggcctggtggccagatttc

SEQ ID NO: 1730 - DNA, 20 bp, Artificial Sequence
  Synthetic oligonucleotide; TAG chr11 5163725 5163744 5163741 +
ggccagatttctggcacttg

SEQ ID NO: 1731 - DNA, 20 bp, Artificial Sequence
  Synthetic oligonucleotide; AAG chr11 5163729 5163748 5163745 +
agatttctggcacttgtagc

SEQ ID NO: 1732 - DNA, 20 bp, Artificial Sequence
  Synthetic oligonucleotide; TGG chr11 5163736 5163755 5163752 +
tggcacttgtagcaagctcc

SEQ ID NO: 1733 - DNA, 20 bp, Artificial Sequence
  Synthetic oligonucleotide; GGG chr11 5163737 5163756 5163753 +
ggcacttgtagcaagctcct

SEQ ID NO: 1734 - DNA, 20 bp, Artificial Sequence
  Synthetic oligonucleotide; GGG chr11 5163738 5163757 5163754 +
gcacttgtagcaagctcctg

SEQ ID NO: 1735 - DNA, 20 bp, Artificial Sequence
  Synthetic oligonucleotide; GGG chr11 5163739 5163758 5163755 +
cacttgtagcaagctcctgg

SEQ ID NO: 1736 - DNA, 20 bp, Artificial Sequence
  Synthetic oligonucleotide; GAG chr11 5163741 5163760 5163757 +
cttgtagcaagctcctgggg

SEQ ID NO: 1737 - DNA, 20 bp, Artificial Sequence
  Synthetic oligonucleotide; AGG chr11 5163742 5163761 5163758 +
ttgtagcaagctcctggggg

SEQ ID NO: 1738 - DNA, 20 bp, Artificial Sequence
  Synthetic oligonucleotide; TGG chr11 5163745 5163764 5163761 +
tagcaagctcctgggggagg

SEQ ID NO: 1739 - DNA, 20 bp, Artificial Sequence
  Synthetic oligonucleotide; CGG chr11 5163751 5163770 5163767 +
gctcctgggggaggtggttc

SEQ ID NO: 1740 - DNA, 20 bp, Artificial Sequence
  Synthetic oligonucleotide; GAG chr11 5163753 5163772 5163769 +
tcctgggggaggtggttccg

SEQ ID NO: 1741 - DNA, 20 bp, Artificial Sequence
  Synthetic oligonucleotide; AGG chr11 5163754 5163773 5163770 +
cctgggggaggtggttccgg

SEQ ID NO: 1742 - DNA, 20 bp, Artificial Sequence
  Synthetic oligonucleotide; TGG chr11 5163763 5163782 5163779 +
ggtggttccggaggaacgcc

SEQ ID NO: 1743 - DNA, 20 bp, Artificial Sequence
  Synthetic oligonucleotide; CGG chr11 5163772 5163791 5163788 +
ggaggaacgcctggccactg

SEQ ID NO: 1744 - DNA, 20 bp, Artificial Sequence
  Synthetic oligonucleotide; TAG chr11 5163777 5163796 5163793 +
aacgcctggccactgcggtt

SEQ ID NO: 1745 - DNA, 20 bp, Artificial Sequence
  Synthetic oligonucleotide; AGG chr11 5163778 5163797 5163794 +
acgcctggccactgcggttt

SEQ ID NO: 1746 - DNA, 20 bp, Artificial Sequence
  Synthetic oligonucleotide; TGG chr11 5163785 5163804 5163801 +
gccactgcggtttaggcatt

SEQ ID NO: 1747 - DNA, 20 bp, Artificial Sequence
  Synthetic oligonucleotide; AAG chr11 5163788 5163807 5163804 +
actgcggtttaggcatttgg

SEQ ID NO: 1748 - DNA, 20 bp, Artificial Sequence
  Synthetic oligonucleotide; TGG chr11 5163802 5163821 5163818 +
atttggaagttcttgtgtgc

SEQ ID NO: 1749 - DNA, 20 bp, Artificial Sequence
  Synthetic oligonucleotide; GAG chr11 5163804 5163823 5163820 +
ttggaagttcttgtgtgctg

SEQ ID NO: 1750 - DNA, 20 bp, Artificial Sequence
  Synthetic oligonucleotide; TGG chr11 5163810 5163829 5163826 +
gttcttgtgtgctggagatg

SEQ ID NO: 1751 - DNA, 20 bp, Artificial Sequence
  Synthetic oligonucleotide; TGG chr11 5163814 5163833 5163830 +
ttgtgtgctggagatgtggc

SEQ ID NO: 1752 - DNA, 20 bp, Artificial Sequence
  Synthetic oligonucleotide; GGG chr11 5163815 5163834 5163831 +
tgtgtgctggagatgtggct

SEQ ID NO: 1753 - DNA, 20 bp, Artificial Sequence
  Synthetic oligonucleotide; GGG chr11 5163816 5163835 5163832 +
gtgtgctggagatgtggctg

SEQ ID NO: 1754 - DNA, 20 bp, Artificial Sequence
  Synthetic oligonucleotide; CAG chr11 5163828 5163847 5163844 +
tgtggctggggtttgtctca

SEQ ID NO: 1755 - DNA, 20 bp, Artificial Sequence
  Synthetic oligonucleotide; TGG chr11 5163831 5163850 5163847 +
ggctggggtttgtctcacag

SEQ ID NO: 1756 - DNA, 20 bp, Artificial Sequence
  Synthetic oligonucleotide; GAG chr11 5163833 5163852 5163849 +
ctggggtttgtctcacagtg

SEQ ID NO: 1757 - DNA, 20 bp, Artificial Sequence
  Synthetic oligonucleotide; AGG chr11 5163834 5163853 5163850 +
tggggtttgtctcacagtgg

SEQ ID NO: 1758 - DNA, 20 bp, Artificial Sequence
  Synthetic oligonucleotide; AAG chr11 5163838 5163857 5163854 +
gtttgtctcacagtggaggc

SEQ ID NO: 1759 - DNA, 20 bp, Artificial Sequence
  Synthetic oligonucleotide; AGG chr11 5163839 5163858 5163855 +
tttgtctcacagtggaggca

SEQ ID NO: 1760 - DNA, 20 bp, Artificial Sequence
  Synthetic oligonucleotide; TGG chr11 5163870 5163889 5163886 +
ctcaaaaatatgttgctact

SEQ ID NO: 1761 - DNA, 20 bp, Artificial Sequence
  Synthetic oligonucleotide; AAG chr11 5163902 5163921 5163918 +
ctctattattgtacaccttg

SEQ ID NO: 1762 - DNA, 20 bp, Artificial Sequence
  Synthetic oligonucleotide; AGG chr11 5163903 5163922 5163919 +
tctattattgtacaccttga

SEQ ID NO: 1763 - DNA, 20 bp, Artificial Sequence
  Synthetic oligonucleotide; GAG chr11 5163907 5163926 5163923 +
ttattgtacaccttgaaggt

SEQ ID NO: 1764 - DNA, 20 bp, Artificial Sequence
  Synthetic oligonucleotide; AGG chr11 5163908 5163927 5163924 +
tattgtacaccttgaaggtg

SEQ ID NO: 1765 - DNA, 20 bp, Artificial Sequence
  Synthetic oligonucleotide; GAG chr11 5163917 5163936 5163933 +
ccttgaaggtgaggttaatt

SEQ ID NO: 1766 - DNA, 20 bp, Artificial Sequence
  Synthetic oligonucleotide; TGG chr11 5163928 5163947 5163944 +
aggttaattgagtcctgttg

SEQ ID NO: 1767 - DNA, 20 bp, Artificial Sequence
  Synthetic oligonucleotide; GGG chr11 5163929 5163948 5163945 +
ggttaattgagtcctgttgt

SEQ ID NO: 1768 - DNA, 20 bp, Artificial Sequence
  Synthetic oligonucleotide; GGG chr11 5163930 5163949 5163946 +
gttaattgagtcctgttgtg

SEQ ID NO: 1769 - DNA, 20 bp, Artificial Sequence
  Synthetic oligonucleotide; GAG chr11 5163936 5163955 5163952 +
tgagtcctgttgtggggttt

SEQ ID NO: 1770 - DNA, 20 bp, Artificial Sequence
  Synthetic oligonucleotide; AGG chr11 5163937 5163956 5163953 +
gagtcctgttgtggggtttg

SEQ ID NO: 1771 - DNA, 20 bp, Artificial Sequence
  Synthetic oligonucleotide; CAG chr11 5163942 5163961 5163958 +
ctgttgtggggtttgaggtc

SEQ ID NO: 1772 - DNA, 20 bp, Artificial Sequence
  Synthetic oligonucleotide; TGG chr11 5163956 5163975 5163972 +
gaggtccagaatttaatttt

SEQ ID NO: 1773 - DNA, 20 bp, Artificial Sequence
  Synthetic oligonucleotide; GAG chr11 5163958 5163977 5163974 +
ggtccagaatttaatttttg

SEQ ID NO: 1774 - DNA, 20 bp, Artificial Sequence
  Synthetic oligonucleotide; CAG chr11 5163974 5163993 5163990 +
tttggagttttatttaatgt

SEQ ID NO: 1775 - DNA, 20 bp, Artificial Sequence
  Synthetic oligonucleotide; AGG chr11 5163975 5163994 5163991 +
ttggagttttatttaatgtc

SEQ ID NO: 1776 - DNA, 20 bp, Artificial Sequence
  Synthetic oligonucleotide; GAG chr11 5163977 5163996 5163993 +
ggagttttatttaatgtcag

SEQ ID NO: 1777 - DNA, 20 bp, Artificial Sequence
  Synthetic oligonucleotide; CAG chr11 5163980 5163999 5163996 +
gttttatttaatgtcaggag

SEQ ID NO: 1778 - DNA, 20 bp, Artificial Sequence
  Synthetic oligonucleotide; TGG chr11 5163985 5164004 5164001 +
atttaatgtcaggagcagat

SEQ ID NO: 1779 - DNA, 20 bp, Artificial Sequence
  Synthetic oligonucleotide; GGG chr11 5163986 5164005 5164002 +
tttaatgtcaggagcagatt

SEQ ID NO: 1780 - DNA, 20 bp, Artificial Sequence
  Synthetic oligonucleotide; GAG chr11 5164005 5164024 5164021 +
tgggtaataaaatgtatatt

SEQ ID NO: 1781 - DNA, 20 bp, Artificial Sequence
  Synthetic oligonucleotide; AAG chr11 5164012 5164031 5164028 +
taaaatgtatattgagaata

SEQ ID NO: 1782 - DNA, 20 bp, Artificial Sequence
  Synthetic oligonucleotide; TGG chr11 5164015 5164034 5164031 +
aatgtatattgagaataaag

SEQ ID NO: 1783 - DNA, 20 bp, Artificial Sequence
  Synthetic oligonucleotide; TAG chr11 5164031 5164050 5164047 +
aaagtggccttttgtccttt

SEQ ID NO: 1784 - DNA, 20 bp, Artificial Sequence
  Synthetic oligonucleotide; AGG chr11 5164032 5164051 5164048 +
aagtggccttttgtcctttt

SEQ ID NO: 1785 - DNA, 20 bp, Artificial Sequence
  Synthetic oligonucleotide; GGG chr11 5164033 5164052 5164049 +
agtggccttttgtcctttta

SEQ ID NO: 1786 - DNA, 20 bp, Artificial Sequence
  Synthetic oligonucleotide; TAG chr11 5164038 5164057 5164054 +
ccttttgtccttttagggtc

SEQ ID NO: 1787 - DNA, 20 bp, Artificial Sequence
  Synthetic oligonucleotide; AGG chr11 5164039 5164058 5164055 +
cttttgtccttttagggtct

SEQ ID NO: 1788 - DNA, 20 bp, Artificial Sequence
  Synthetic oligonucleotide; GGG chr11 5164040 5164059 5164056 +
ttttgtccttttagggtcta

SEQ ID NO: 1789 - DNA, 20 bp, Artificial Sequence
  Synthetic oligonucleotide; AAG chr11 5164048 5164067 5164064 +
ttttagggtctagggctgta

SEQ ID NO: 1790 - DNA, 20 bp, Artificial Sequence
  Synthetic oligonucleotide; CAG chr11 5164056 5164075 5164072 +
tctagggctgtaaagcgtct

SEQ ID NO: 1791 - DNA, 20 bp, Artificial Sequence
  Synthetic oligonucleotide; AGG chr11 5164057 5164076 5164073 +
ctagggctgtaaagcgtctc

SEQ ID NO: 1792 - DNA, 20 bp, Artificial Sequence
  Synthetic oligonucleotide; GGG chr11 5164058 5164077 5164074 +
tagggctgtaaagcgtctca

SEQ ID NO: 1793 - DNA, 20 bp, Artificial Sequence
  Synthetic oligonucleotide; GAG chr11 5164073 5164092 5164089 +
tctcagggttgctgccgaac

SEQ ID NO: 1794 - DNA, 20 bp, Artificial Sequence
  Synthetic oligonucleotide; TGG chr11 5164084 5164103 5164100 +
ctgccgaacgagccatgaac

SEQ ID NO: 1795 - DNA, 20 bp, Artificial Sequence
  Synthetic oligonucleotide; GGG chr11 5164085 5164104 5164101 +
tgccgaacgagccatgaact

SEQ ID NO: 1796 - DNA, 20 bp, Artificial Sequence
  Synthetic oligonucleotide; TGG chr11 5164089 5164108 5164105 +
gaacgagccatgaactgggc

SEQ ID NO: 1797 - DNA, 20 bp, Artificial Sequence
  Synthetic oligonucleotide; GGG chr11 5164090 5164109 5164106 +
aacgagccatgaactgggct

SEQ ID NO: 1798 - DNA, 20 bp, Artificial Sequence
  Synthetic oligonucleotide; AAG chr11 5164110 5164129 5164126 +
gggtttttcatatttgatga

SEQ ID NO: 1799 - DNA, 20 bp, Artificial Sequence
  Synthetic oligonucleotide; GAG chr11 5164112 5164131 5164128 +
gtttttcatatttgatgaaa

SEQ ID NO: 1800 - DNA, 20 bp, Artificial Sequence
  Synthetic oligonucleotide; CGG chr11 5164131 5164150 5164147 +
agagcctaaacgctctgatt

SEQ ID NO: 1801 - DNA, 20 bp, Artificial Sequence
  Synthetic oligonucleotide; GGG chr11 5164132 5164151 5164148 +
gagcctaaacgctctgattc

SEQ ID NO: 1802 - DNA, 20 bp, Artificial Sequence
  Synthetic oligonucleotide; GAG chr11 5164134 5164153 5164150 +
gcctaaacgctctgattcgg

SEQ ID NO: 1803 - DNA, 20 bp, Artificial Sequence
  Synthetic oligonucleotide; GAG chr11 5164136 5164155 5164152 +
ctaaacgctctgattcggga

SEQ ID NO: 1804 - DNA, 20 bp, Artificial Sequence
  Synthetic oligonucleotide; AGG chr11 5164137 5164156 5164153 +
taaacgctctgattcgggag

SEQ ID NO: 1805 - DNA, 20 bp, Artificial Sequence
  Synthetic oligonucleotide; CGG chr11 5164141 5164160 5164157 +
cgctctgattcgggagaggt

SEQ ID NO: 1806 - DNA, 20 bp, Artificial Sequence
  Synthetic oligonucleotide; AAG chr11 5164147 5164166 5164163 +
gattcgggagaggtcggata

SEQ ID NO: 1807 - DNA, 20 bp, Artificial Sequence
  Synthetic oligonucleotide; AAG chr11 5164153 5164172 5164169 +
ggagaggtcggataaagaaa

SEQ ID NO: 1808 - DNA, 20 bp, Artificial Sequence
  Synthetic oligonucleotide; AGG chr11 5164154 5164173 5164170 +
gagaggtcggataaagaaaa

SEQ ID NO: 1809 - DNA, 20 bp, Artificial Sequence
  Synthetic oligonucleotide; GAG chr11 5164156 5164175 5164172 +
gaggtcggataaagaaaaag

SEQ ID NO: 1810 - DNA, 20 bp, Artificial Sequence
  Synthetic oligonucleotide; TAG chr11 5164180 5164199 5164196 +
attaaccttgactacgcctt

SEQ ID NO: 1811 - DNA, 20 bp, Artificial Sequence
  Synthetic oligonucleotide; CAG chr11 5164186 5164205 5164202 +
cttgactacgcctttagctt

SEQ ID NO: 1812 - DNA, 20 bp, Artificial Sequence
  Synthetic oligonucleotide; TAG chr11 5164201 5164220 5164217 +
agcttcagccaccttcttaa

SEQ ID NO: 1813 - DNA, 20 bp, Artificial Sequence
  Synthetic oligonucleotide; AGG chr11 5164202 5164221 5164218 +
gcttcagccaccttcttaat

SEQ ID NO: 1814 - DNA, 20 bp, Artificial Sequence
  Synthetic oligonucleotide; TGG chr11 5164212 5164231 5164228 +
ccttcttaataggaaattgc

SEQ ID NO: 1815 - DNA, 20 bp, Artificial Sequence
  Synthetic oligonucleotide; GGG chr11 5164213 5164232 5164229 +
cttcttaataggaaattgct

SEQ ID NO: 1816 - DNA, 20 bp, Artificial Sequence
  Synthetic oligonucleotide; CAG chr11 5164216 5164235 5164232 +
cttaataggaaattgctggg

SEQ ID NO: 1817 - DNA, 20 bp, Artificial Sequence
  Synthetic oligonucleotide; AGG chr11 5164217 5164236 5164233 +
ttaataggaaattgctgggc

SEQ ID NO: 1818 - DNA, 20 bp, Artificial Sequence
  Synthetic oligonucleotide; TGG chr11 5164221 5164240 5164237 +
taggaaattgctgggcaggt

SEQ ID NO: 1819 - DNA, 20 bp, Artificial Sequence
  Synthetic oligonucleotide; GGG chr11 5164222 5164241 5164238 +
aggaaattgctgggcaggtt

SEQ ID NO: 1820 - DNA, 20 bp, Artificial Sequence
  Synthetic oligonucleotide; GGG chr11 5164223 5164242 5164239 +
ggaaattgctgggcaggttg

SEQ ID NO: 1821 - DNA, 20 bp, Artificial Sequence
  Synthetic oligonucleotide; GAG chr11 5164225 5164244 5164241 +
aaattgctgggcaggttggg

SEQ ID NO: 1822 - DNA, 20 bp, Artificial Sequence
  Synthetic oligonucleotide; AGG chr11 5164226 5164245 5164242 +
aattgctgggcaggttgggg

SEQ ID NO: 1823 - DNA, 20 bp, Artificial Sequence
  Synthetic oligonucleotide; GGG chr11 5164227 5164246 5164243 +
attgctgggcaggttgggga

SEQ ID NO: 1824 - DNA, 20 bp, Artificial Sequence
  Synthetic oligonucleotide; TAG chr11 5164231 5164250 5164247 +
ctgggcaggttggggagggc

SEQ ID NO: 1825 - DNA, 20 bp, Artificial Sequence
  Synthetic oligonucleotide; CGG chr11 5164237 5164256 5164253 +
aggttggggagggctagtca

SEQ ID NO: 1826 - DNA, 20 bp, Artificial Sequence
  Synthetic oligonucleotide; CGG chr11 5164255 5164274 5164271 +
cacggaatgaaactgtaaac

SEQ ID NO: 1827 - DNA, 20 bp, Artificial Sequence
  Synthetic oligonucleotide; CGG chr11 5164260 5164279 5164276 +
aatgaaactgtaaaccggac

SEQ ID NO: 1828 - DNA, 20 bp, Artificial Sequence
  Synthetic oligonucleotide; GGG chr11 5164261 5164280 5164277 +
atgaaactgtaaaccggacc

SEQ ID NO: 1829 - DNA, 20 bp, Artificial Sequence
  Synthetic oligonucleotide; GAG chr11 5164267 5164286 5164283 +
ctgtaaaccggaccgggtgt

SEQ ID NO: 1830 - DNA, 20 bp, Artificial Sequence
  Synthetic oligonucleotide; AGG chr11 5164268 5164287 5164284 +
tgtaaaccggaccgggtgtg

SEQ ID NO: 1831 - DNA, 20 bp, Artificial Sequence
  Synthetic oligonucleotide; GAG chr11 5164270 5164289 5164286 +
taaaccggaccgggtgtgag

SEQ ID NO: 1832 - DNA, 20 bp, Artificial Sequence
  Synthetic oligonucleotide; AGG chr11 5164271 5164290 5164287 +
aaaccggaccgggtgtgagg

SEQ ID NO: 1833 - DNA, 20 bp, Artificial Sequence
  Synthetic oligonucleotide; GGG chr11 5164272 5164291 5164288 +
aaccggaccgggtgtgagga

SEQ ID NO: 1834 - DNA, 20 bp, Artificial Sequence
  Synthetic oligonucleotide; GGG chr11 5164273 5164292 5164289 +
accggaccgggtgtgaggag

SEQ ID NO: 1835 - DNA, 20 bp, Artificial Sequence
  Synthetic oligonucleotide; GAG chr11 5164275 5164294 5164291 +
cggaccgggtgtgaggaggg

SEQ ID NO: 1836 - DNA, 20 bp, Artificial Sequence
  Synthetic oligonucleotide; AGG chr11 5164276 5164295 5164292 +
ggaccgggtgtgaggagggg

SEQ ID NO: 1837 - DNA, 20 bp, Artificial Sequence
  Synthetic oligonucleotide; AAG chr11 5164286 5164305 5164302 +
tgaggaggggaggtgataaa

SEQ ID NO: 1838 - DNA, 20 bp, Artificial Sequence
  Synthetic oligonucleotide; CAG chr11 5164293 5164312 5164309 +
gggaggtgataaaaagatta

SEQ ID NO: 1839 - DNA, 20 bp, Artificial Sequence
  Synthetic oligonucleotide; AGG chr11 5164294 5164313 5164310 +
ggaggtgataaaaagattac

SEQ ID NO: 1840 - DNA, 20 bp, Artificial Sequence
  Synthetic oligonucleotide; GGG chr11 5164295 5164314 5164311 +
gaggtgataaaaagattaca

SEQ ID NO: 1841 - DNA, 20 bp, Artificial Sequence
  Synthetic oligonucleotide; TGG chr11 5164298 5164317 5164314 +
gtgataaaaagattacaggg

SEQ ID NO: 1842 - DNA, 20 bp, Artificial Sequence
  Synthetic oligonucleotide; GAG chr11 5164300 5164319 5164316 +
gataaaaagattacagggtg

SEQ ID NO: 1843 - DNA, 20 bp, Artificial Sequence
  Synthetic oligonucleotide; AGG chr11 5164301 5164320 5164317 +
ataaaaagattacagggtgg

SEQ ID NO: 1844 - DNA, 20 bp, Artificial Sequence
  Synthetic oligonucleotide; GAG chr11 5164303 5164322 5164319 +
aaaaagattacagggtggag

SEQ ID NO: 1845 - DNA, 20 bp, Artificial Sequence
  Synthetic oligonucleotide; GAG chr11 5164308 5164327 5164324 +
gattacagggtggaggagct

SEQ ID NO: 1846 - DNA, 20 bp, Artificial Sequence
  Synthetic oligonucleotide; AGG chr11 5164309 5164328 5164325 +
attacagggtggaggagctg

SEQ ID NO: 1847 - DNA, 20 bp, Artificial Sequence
  Synthetic oligonucleotide; GAG chr11 5164314 5164333 5164330 +
agggtggaggagctgaggct

SEQ ID NO: 1848 - DNA, 20 bp, Artificial Sequence
  Synthetic oligonucleotide; AGG chr11 5164315 5164334 5164331 +
gggtggaggagctgaggctg

SEQ ID NO: 1849 - DNA, 20 bp, Artificial Sequence
  Synthetic oligonucleotide; AAG chr11 5164318 5164337 5164334 +
tggaggagctgaggctgagg

SEQ ID NO: 1850 - DNA, 20 bp, Artificial Sequence
  Synthetic oligonucleotide; TGG chr11 5164324 5164343 5164340 +
agctgaggctgaggaagatt

SEQ ID NO: 1851 - DNA, 20 bp, Artificial Sequence
  Synthetic oligonucleotide; GGG chr11 5164325 5164344 5164341 +
gctgaggctgaggaagattt

SEQ ID NO: 1852 - DNA, 20 bp, Artificial Sequence
  Synthetic oligonucleotide; TAG chr11 5164331 5164350 5164347 +
gctgaggaagatttgggacc

SEQ ID NO: 1853 - DNA, 20 bp, Artificial Sequence
  Synthetic oligonucleotide; CGG chr11 5164336 5164355 5164352 +
ggaagatttgggacctagct

SEQ ID NO: 1854 - DNA, 20 bp, Artificial Sequence
  Synthetic oligonucleotide; TGG chr11 5164341 5164360 5164357 +
atttgggacctagctcggcc

SEQ ID NO: 1855 - DNA, 20 bp, Artificial Sequence
  Synthetic oligonucleotide; AAG chr11 5164345 5164364 5164361 +
gggacctagctcggcctggc

SEQ ID NO: 1856 - DNA, 20 bp, Artificial Sequence
  Synthetic oligonucleotide; AGG chr11 5164346 5164365 5164362 +
ggacctagctcggcctggca

SEQ ID NO: 1857 - DNA, 20 bp, Artificial Sequence
  Synthetic oligonucleotide; GAG chr11 5164348 5164367 5164364 +
acctagctcggcctggcaag

SEQ ID NO: 1858 - DNA, 20 bp, Artificial Sequence
  Synthetic oligonucleotide; CAG chr11 5164351 5164370 5164367 +
tagctcggcctggcaaggag

SEQ ID NO: 1859 - DNA, 20 bp, Artificial Sequence
  Synthetic oligonucleotide; TGG chr11 5164356 5164375 5164372 +
cggcctggcaaggagcagcc

SEQ ID NO: 1860 - DNA, 20 bp, Artificial Sequence
  Synthetic oligonucleotide; GGG chr11 5164357 5164376 5164373 +
ggcctggcaaggagcagcct

SEQ ID NO: 1861 - DNA, 20 bp, Artificial Sequence
  Synthetic oligonucleotide; GGG chr11 5164358 5164377 5164374 +
gcctggcaaggagcagcctg

SEQ ID NO: 1862 - DNA, 20 bp, Artificial Sequence
  Synthetic oligonucleotide; GAG chr11 5164360 5164379 5164376 +
ctggcaaggagcagcctggg

SEQ ID NO: 1863 - DNA, 20 bp, Artificial Sequence
  Synthetic oligonucleotide; AGG chr11 5164361 5164380 5164377 +
tggcaaggagcagcctgggg

SEQ ID NO: 1864 - DNA, 20 bp, Artificial Sequence
  Synthetic oligonucleotide; GAG chr11 5164363 5164382 5164379 +
gcaaggagcagcctggggag

SEQ ID NO: 1865 - DNA, 20 bp, Artificial Sequence
  Synthetic oligonucleotide; AGG chr11 5164364 5164383 5164380 +
caaggagcagcctggggagg

SEQ ID NO: 1866 - DNA, 20 bp, Artificial Sequence
  Synthetic oligonucleotide; GGG chr11 5164365 5164384 5164381 +
aaggagcagcctggggagga

SEQ ID NO: 1867 - DNA, 20 bp, Artificial Sequence
  Synthetic oligonucleotide; GGG chr11 5164366 5164385 5164382 +
aggagcagcctggggaggag

SEQ ID NO: 1868 - DNA, 20 bp, Artificial Sequence
  Synthetic oligonucleotide; GAG chr11 5164368 5164387 5164384 +
gagcagcctggggaggaggg

SEQ ID NO: 1869 - DNA, 20 bp, Artificial Sequence
  Synthetic oligonucleotide; CAG chr11 5164375 5164394 5164391 +
ctggggaggaggggagacgt

SEQ ID NO: 1870 - DNA, 20 bp, Artificial Sequence
  Synthetic oligonucleotide; TGG chr11 5164379 5164398 5164395 +
ggaggaggggagacgtcaga

SEQ ID NO: 1871 - DNA, 20 bp, Artificial Sequence
  Synthetic oligonucleotide; GGG chr11 5164380 5164399 5164396 +
gaggaggggagacgtcagat

SEQ ID NO: 1872 - DNA, 20 bp, Artificial Sequence
  Synthetic oligonucleotide; TAG chr11 5164387 5164406 5164403 +
ggagacgtcagatgggtctg

SEQ ID NO: 1873 - DNA, 20 bp, Artificial Sequence
  Synthetic oligonucleotide; AAG chr11 5164392 5164411 5164408 +
cgtcagatgggtctgtagaa

SEQ ID NO: 1874 - DNA, 20 bp, Artificial Sequence
  Synthetic oligonucleotide; AGG chr11 5164393 5164412 5164409 +
gtcagatgggtctgtagaaa

SEQ ID NO: 1875 - DNA, 20 bp, Artificial Sequence
  Synthetic oligonucleotide; AAG chr11 5164396 5164415 5164412 +
agatgggtctgtagaaaagg

SEQ ID NO: 1876 - DNA, 20 bp, Artificial Sequence
  Synthetic oligonucleotide; TAG chr11 5164401 5164420 5164417 +
ggtctgtagaaaaggaagat

SEQ ID NO: 1877 - DNA, 20 bp, Artificial Sequence
  Synthetic oligonucleotide; AAG chr11 5164405 5164424 5164421 +
tgtagaaaaggaagattaga

SEQ ID NO: 1878 - DNA, 20 bp, Artificial Sequence
  Synthetic oligonucleotide; CAG chr11 5164411 5164430 5164427 +
aaaggaagattagaaagact

SEQ ID NO: 1879 - DNA, 20 bp, Artificial Sequence
  Synthetic oligonucleotide; TGG chr11 5164421 5164440 5164437 +
tagaaagactcagcgacgct

SEQ ID NO: 1880 - DNA, 20 bp, Artificial Sequence
  Synthetic oligonucleotide; GAG chr11 5164423 5164442 5164439 +
gaaagactcagcgacgcttg

SEQ ID NO: 1881 - DNA, 20 bp, Artificial Sequence
  Synthetic oligonucleotide; TGG chr11 5164427 5164446 5164443 +
gactcagcgacgcttggagt

SEQ ID NO: 1882 - DNA, 20 bp, Artificial Sequence
  Synthetic oligonucleotide; GGG chr11 5164428 5164447 5164444 +
actcagcgacgcttggagtt

SEQ ID NO: 1883 - DNA, 20 bp, Artificial Sequence
  Synthetic oligonucleotide; GAG chr11 5164434 5164453 5164450 +
cgacgcttggagttgggact

SEQ ID NO: 1884 - DNA, 20 bp, Artificial Sequence
  Synthetic oligonucleotide; AGG chr11 5164435 5164454 5164451 +
gacgcttggagttgggactg

SEQ ID NO: 1885 - DNA, 20 bp, Artificial Sequence
  Synthetic oligonucleotide; GGG chr11 5164436 5164455 5164452 +
acgcttggagttgggactga

SEQ ID NO: 1886 - DNA, 20 bp, Artificial Sequence
  Synthetic oligonucleotide; GGG chr11 5164437 5164456 5164453 +
cgcttggagttgggactgag

SEQ ID NO: 1887 - DNA, 20 bp, Artificial Sequence
  Synthetic oligonucleotide; CAG chr11 5164441 5164460 5164457 +
tggagttgggactgagggga

SEQ ID NO: 1888 - DNA, 20 bp, Artificial Sequence
  Synthetic oligonucleotide; AGG chr11 5164442 5164461 5164458 +
ggagttgggactgaggggac

SEQ ID NO: 1889 - DNA, 20 bp, Artificial Sequence
  Synthetic oligonucleotide; CGG chr11 5164445 5164464 5164461 +
gttgggactgaggggacagg

SEQ ID NO: 1890 - DNA, 20 bp, Artificial Sequence
  Synthetic oligonucleotide; GGG chr11 5164446 5164465 5164462 +
ttgggactgaggggacaggc

SEQ ID NO: 1891 - DNA, 20 bp, Artificial Sequence
  Synthetic oligonucleotide; GAG chr11 5164448 5164467 5164464 +
gggactgaggggacaggcgg

SEQ ID NO: 1892 - DNA, 20 bp, Artificial Sequence
  Synthetic oligonucleotide; AGG chr11 5164449 5164468 5164465 +
ggactgaggggacaggcggg

SEQ ID NO: 1893 - DNA, 20 bp, Artificial Sequence
  Synthetic oligonucleotide; GGG chr11 5164450 5164469 5164466 +
gactgaggggacaggcggga

SEQ ID NO: 1894 - DNA, 20 bp, Artificial Sequence
  Synthetic oligonucleotide; AAG chr11 5164454 5164473 5164470 +
gaggggacaggcgggaggga

SEQ ID NO: 1895 - DNA, 20 bp, Artificial Sequence
  Synthetic oligonucleotide; AAG chr11 5164457 5164476 5164473 +
gggacaggcgggagggaaag

SEQ ID NO: 1896 - DNA, 20 bp, Artificial Sequence
  Synthetic oligonucleotide; AGG chr11 5164458 5164477 5164474 +
ggacaggcgggagggaaaga

SEQ ID NO: 1897 - DNA, 20 bp, Artificial Sequence
  Synthetic oligonucleotide; AAG chr11 5164461 5164480 5164477 +
caggcgggagggaaagaagg

SEQ ID NO: 1898 - DNA, 20 bp, Artificial Sequence
  Synthetic oligonucleotide; TGG chr11 5164467 5164486 5164483 +
ggagggaaagaaggaagatt

SEQ ID NO: 1899 - DNA, 20 bp, Artificial Sequence
  Synthetic oligonucleotide; GGG chr11 5164468 5164487 5164484 +
gagggaaagaaggaagattt

SEQ ID NO: 1900 - DNA, 20 bp, Artificial Sequence
  Synthetic oligonucleotide; AAG chr11 5164473 5164492 5164489 +
aaagaaggaagatttgggac

SEQ ID NO: 1901 - DNA, 20 bp, Artificial Sequence
  Synthetic oligonucleotide; TGG chr11 5164482 5164501 5164498 +
agatttgggacaagttgcat

SEQ ID NO: 1902 - DNA, 20 bp, Artificial Sequence
  Synthetic oligonucleotide; GGG chr11 5164483 5164502 5164499 +
gatttgggacaagttgcatt

SEQ ID NO: 1903 - DNA, 20 bp, Artificial Sequence
  Synthetic oligonucleotide; AAG chr11 5164486 5164505 5164502 +
ttgggacaagttgcattggg

SEQ ID NO: 1904 - DNA, 20 bp, Artificial Sequence
  Synthetic oligonucleotide; GAG chr11 5164488 5164507 5164504 +
gggacaagttgcattgggaa

SEQ ID NO: 1905 - DNA, 20 bp, Artificial Sequence
  Synthetic oligonucleotide; TAG chr11 5164493 5164512 5164509 +
aagttgcattgggaagagac

SEQ ID NO: 1906 - DNA, 20 bp, Artificial Sequence
  Synthetic oligonucleotide; AGG chr11 5164494 5164513 5164510 +
agttgcattgggaagagact

SEQ ID NO: 1907 - DNA, 20 bp, Artificial Sequence
  Synthetic oligonucleotide; GGG chr11 5164495 5164514 5164511 +
gttgcattgggaagagacta

SEQ ID NO: 1908 - DNA, 20 bp, Artificial Sequence
  Synthetic oligonucleotide; GAG chr11 5164497 5164516 5164513 +
tgcattgggaagagactagg

SEQ ID NO: 1909 - DNA, 20 bp, Artificial Sequence
  Synthetic oligonucleotide; AGG chr11 5164498 5164517 5164514 +
gcattgggaagagactaggg

SEQ ID NO: 1910 - DNA, 20 bp, Artificial Sequence
  Synthetic oligonucleotide; GGG chr11 5164499 5164518 5164515 +
cattgggaagagactaggga

SEQ ID NO: 1911 - DNA, 20 bp, Artificial Sequence
  Synthetic oligonucleotide; AAG chr11 5164514 5164533 5164530 +
agggagggaccaatgtgtaa

SEQ ID NO: 1912 - DNA, 20 bp, Artificial Sequence
  Synthetic oligonucleotide; TGG chr11 5164523 5164542 5164539 +
ccaatgtgtaaaagaatgcc

SEQ ID NO: 1913 - DNA, 20 bp, Artificial Sequence
  Synthetic oligonucleotide; CAG chr11 5164530 5164549 5164546 +
gtaaaagaatgcctggacgt

SEQ ID NO: 1914 - DNA, 20 bp, Artificial Sequence
  Synthetic oligonucleotide; AGG chr11 5164531 5164550 5164547 +
taaaagaatgcctggacgtc

SEQ ID NO: 1915 - DNA, 20 bp, Artificial Sequence
  Synthetic oligonucleotide; CAG chr11 5164539 5164558 5164555 +
tgcctggacgtcaggcacct

SEQ ID NO: 1916 - DNA, 20 bp, Artificial Sequence
  Synthetic oligonucleotide; TAG chr11 5164573 5164592 5164589 +
gttttacgacaaaaattatt

SEQ ID NO: 1917 - DNA, 20 bp, Artificial Sequence
  Synthetic oligonucleotide; AAG chr11 5164582 5164601 5164598 +
caaaaattatttagatcttg

SEQ ID NO: 1918 - DNA, 20 bp, Artificial Sequence
  Synthetic oligonucleotide; TGG chr11 5164587 5164606 5164603 +
attatttagatcttgaagaa

SEQ ID NO: 1919 - DNA, 20 bp, Artificial Sequence
  Synthetic oligonucleotide; AAG chr11 5164599 5164618 5164615 +
ttgaagaatggaaaaattga

SEQ ID NO: 1920 - DNA, 20 bp, Artificial Sequence
  Synthetic oligonucleotide; TGG chr11 5164612 5164631 5164628 +
aaattgaaagtgccattttc

SEQ ID NO: 1921 - DNA, 20 bp, Artificial Sequence
  Synthetic oligonucleotide; TGG chr11 5164620 5164639 5164636 +
agtgccattttctggctatt

SEQ ID NO: 1922 - DNA, 20 bp, Artificial Sequence
  Synthetic oligonucleotide; GAG chr11 5164633 5164652 5164649 +
ggctatttggaaccactgtc

SEQ ID NO: 1923 - DNA, 20 bp, Artificial Sequence
  Synthetic oligonucleotide; TGG chr11 5164643 5164662 5164659 +
aaccactgtcgagtttgtat

SEQ ID NO: 1924 - DNA, 20 bp, Artificial Sequence
  Synthetic oligonucleotide; GAG chr11 5164645 5164664 5164661 +
ccactgtcgagtttgtattg

SEQ ID NO: 1925 - DNA, 20 bp, Artificial Sequence
  Synthetic oligonucleotide; AAG chr11 5164650 5164669 5164666 +
gtcgagtttgtattggagtc

SEQ ID NO: 1926 - DNA, 20 bp, Artificial Sequence
  Synthetic oligonucleotide; CGG chr11 5164653 5164672 5164669 +
gagtttgtattggagtcaag

SEQ ID NO: 1927 - DNA, 20 bp, Artificial Sequence
  Synthetic oligonucleotide; CAG chr11 5164661 5164680 5164677 +
attggagtcaagcggccttg

SEQ ID NO: 1928 - DNA, 20 bp, Artificial Sequence
  Synthetic oligonucleotide; AAG chr11 5164664 5164683 5164680 +
ggagtcaagcggccttgcag

SEQ ID NO: 1929 - DNA, 20 bp, Artificial Sequence
  Synthetic oligonucleotide; AAG chr11 5164672 5164691 5164688 +
gcggccttgcagaagaaaat

SEQ ID NO: 1930 - DNA, 20 bp, Artificial Sequence
  Synthetic oligonucleotide; AGG chr11 5164673 5164692 5164689 +
cggccttgcagaagaaaata

SEQ ID NO: 1931 - DNA, 20 bp, Artificial Sequence
  Synthetic oligonucleotide; TAG chr11 5164680 5164699 5164696 +
gcagaagaaaataaggcatt

SEQ ID NO: 1932 - DNA, 20 bp, Artificial Sequence
  Synthetic oligonucleotide; AGG chr11 5164681 5164700 5164697 +
cagaagaaaataaggcattt

SEQ ID NO: 1933 - DNA, 20 bp, Artificial Sequence
  Synthetic oligonucleotide; TAG chr11 5164687 5164706 5164703 +
aaaataaggcatttaggttt

SEQ ID NO: 1934 - DNA, 20 bp, Artificial Sequence
  Synthetic oligonucleotide; AGG chr11 5164688 5164707 5164704 +
aaataaggcatttaggtttt

SEQ ID NO: 1935 - DNA, 20 bp, Artificial Sequence
  Synthetic oligonucleotide; CAG chr11 5164692 5164711 5164708 +
aaggcatttaggttttaggt

SEQ ID NO: 1936 - DNA, 20 bp, Artificial Sequence
  Synthetic oligonucleotide; AGG chr11 5164693 5164712 5164709 +
aggcatttaggttttaggtc

SEQ ID NO: 1937 - DNA, 20 bp, Artificial Sequence
  Synthetic oligonucleotide; GAG chr11 5164699 5164718 5164715 +
ttaggttttaggtcaggtgt

SEQ ID NO: 1938 - DNA, 20 bp, Artificial Sequence
  Synthetic oligonucleotide; AAG chr11 5164705 5164724 5164721 +
tttaggtcaggtgtgagttg

SEQ ID NO: 1939 - DNA, 20 bp, Artificial Sequence
  Synthetic oligonucleotide; GAG chr11 5164707 5164726 5164723 +
taggtcaggtgtgagttgaa

SEQ ID NO: 1940 - DNA, 20 bp, Artificial Sequence
  Synthetic oligonucleotide; AGG chr11 5164708 5164727 5164724 +
aggtcaggtgtgagttgaag

SEQ ID NO: 1941 - DNA, 20 bp, Artificial Sequence
  Synthetic oligonucleotide; AAG chr11 5164715 5164734 5164731 +
gtgtgagttgaagaggtttt

SEQ ID NO: 1942 - DNA, 20 bp, Artificial Sequence
  Synthetic oligonucleotide; GAG chr11 5164723 5164742 5164739 +
tgaagaggttttaagttctt

SEQ ID NO: 1943 - DNA, 20 bp, Artificial Sequence
  Synthetic oligonucleotide; GAG chr11 5164725 5164744 5164741 +
aagaggttttaagttcttga

SEQ ID NO: 1944 - DNA, 20 bp, Artificial Sequence
  Synthetic oligonucleotide; CAG chr11 5164730 5164749 5164746 +
gttttaagttcttgagagca

SEQ ID NO: 1945 - DNA, 20 bp, Artificial Sequence
  Synthetic oligonucleotide; AGG chr11 5164731 5164750 5164747 +
ttttaagttcttgagagcac

SEQ ID NO: 1946 - DNA, 20 bp, Artificial Sequence
  Synthetic oligonucleotide; AAG chr11 5164736 5164755 5164752 +
agttcttgagagcacaggct

SEQ ID NO: 1947 - DNA, 20 bp, Artificial Sequence
  Synthetic oligonucleotide; AGG chr11 5164737 5164756 5164753 +
gttcttgagagcacaggcta

SEQ ID NO: 1948 - DNA, 20 bp, Artificial Sequence
  Synthetic oligonucleotide; GGG chr11 5164738 5164757 5164754 +
ttcttgagagcacaggctaa

SEQ ID NO: 1949 - DNA, 20 bp, Artificial Sequence
  Synthetic oligonucleotide; GAG chr11 5164740 5164759 5164756 +
cttgagagcacaggctaagg

SEQ ID NO: 1950 - DNA, 20 bp, Artificial Sequence
  Synthetic oligonucleotide; GAG chr11 5164742 5164761 5164758 +
tgagagcacaggctaaggga

SEQ ID NO: 1951 - DNA, 20 bp, Artificial Sequence
  Synthetic oligonucleotide; AGG chr11 5164743 5164762 5164759 +
gagagcacaggctaagggag

SEQ ID NO: 1952 - DNA, 20 bp, Artificial Sequence
  Synthetic oligonucleotide; GGG chr11 5164744 5164763 5164760 +
agagcacaggctaagggaga

SEQ ID NO: 1953 - DNA, 20 bp, Artificial Sequence
  Synthetic oligonucleotide; GAG chr11 5164746 5164765 5164762 +
agcacaggctaagggagagg

SEQ ID NO: 1954 - DNA, 20 bp, Artificial Sequence
  Synthetic oligonucleotide; AGG chr11 5164747 5164766 5164763 +
gcacaggctaagggagaggg

SEQ ID NO: 1955 - DNA, 20 bp, Artificial Sequence
  Synthetic oligonucleotide; TGG chr11 5164752 5164771 5164768 +
ggctaagggagagggaggaa

SEQ ID NO: 1956 - DNA, 20 bp, Artificial Sequence
  Synthetic oligonucleotide; GAG chr11 5164754 5164773 5164770 +
ctaagggagagggaggaatg

SEQ ID NO: 1957 - DNA, 20 bp, Artificial Sequence
  Synthetic oligonucleotide; AGG chr11 5164755 5164774 5164771 +
taagggagagggaggaatgg

SEQ ID NO: 1958 - DNA, 20 bp, Artificial Sequence
  Synthetic oligonucleotide; GGG chr11 5164756 5164775 5164772 +
aagggagagggaggaatgga

SEQ ID NO: 1959 - DNA, 20 bp, Artificial Sequence
  Synthetic oligonucleotide; TGG chr11 5164759 5164778 5164775 +
ggagagggaggaatggaggg

SEQ ID NO: 1960 - DNA, 20 bp, Artificial Sequence
  Synthetic oligonucleotide; AAG chr11 5164762 5164781 5164778 +
gagggaggaatggagggtgg

SEQ ID NO: 1961 - DNA, 20 bp, Artificial Sequence
  Synthetic oligonucleotide; AGG chr11 5164763 5164782 5164779 +
agggaggaatggagggtgga

SEQ ID NO: 1962 - DNA, 20 bp, Artificial Sequence
  Synthetic oligonucleotide; TAG chr11 5164773 5164792 5164789 +
ggagggtggaaggttgcccc

SEQ ID NO: 1963 - DNA, 20 bp, Artificial Sequence
  Synthetic oligonucleotide; AAG chr11 5164778 5164797 5164794 +
gtggaaggttgcccctagtg

SEQ ID NO: 1964 - DNA, 20 bp, Artificial Sequence
  Synthetic oligonucleotide; AGG chr11 5164779 5164798 5164795 +
tggaaggttgcccctagtga

SEQ ID NO: 1965 - DNA, 20 bp, Artificial Sequence
  Synthetic oligonucleotide; GAG chr11 5164781 5164800 5164797 +
gaaggttgcccctagtgaag

SEQ ID NO: 1966 - DNA, 20 bp, Artificial Sequence
  Synthetic oligonucleotide; AGG chr11 5164782 5164801 5164798 +
aaggttgcccctagtgaagg

SEQ ID NO: 1967 - DNA, 20 bp, Artificial Sequence
  Synthetic oligonucleotide; AAG chr11 5164786 5164805 5164802 +
ttgcccctagtgaaggaggc

SEQ ID NO: 1968 - DNA, 20 bp, Artificial Sequence
  Synthetic oligonucleotide; CAG chr11 5164791 5164810 5164807 +
cctagtgaaggaggcaagcc

SEQ ID NO: 1969 - DNA, 20 bp, Artificial Sequence
  Synthetic oligonucleotide; GAG chr11 5164793 5164812 5164809 +
tagtgaaggaggcaagccca

SEQ ID NO: 1970 - DNA, 20 bp, Artificial Sequence
  Synthetic oligonucleotide; AAG chr11 5164798 5164817 5164814 +
aaggaggcaagcccagagaa

SEQ ID NO: 1971 - DNA, 20 bp, Artificial Sequence
  Synthetic oligonucleotide; AAG chr11 5164802 5164821 5164818 +
aggcaagcccagagaaaaga

SEQ ID NO: 1972 - DNA, 20 bp, Artificial Sequence
  Synthetic oligonucleotide; GAG chr11 5164804 5164823 5164820 +
gcaagcccagagaaaagaaa

SEQ ID NO: 1973 - DNA, 20 bp, Artificial Sequence
  Synthetic oligonucleotide; CAG chr11 5164809 5164828 5164825 +
cccagagaaaagaaagagta

SEQ ID NO: 1974 - DNA, 20 bp, Artificial Sequence
  Synthetic oligonucleotide; CGG chr11 5164815 5164834 5164831 +
gaaaagaaagagtacagaca

SEQ ID NO: 1975 - DNA, 20 bp, Artificial Sequence
  Synthetic oligonucleotide; GAG chr11 5164817 5164836 5164833 +
aaagaaagagtacagacacg

SEQ ID NO: 1976 - DNA, 20 bp, Artificial Sequence
  Synthetic oligonucleotide; AGG chr11 5164818 5164837 5164834 +
aagaaagagtacagacacgg

SEQ ID NO: 1977 - DNA, 20 bp, Artificial Sequence
  Synthetic oligonucleotide; GGG chr11 5164819 5164838 5164835 +
agaaagagtacagacacgga

SEQ ID NO: 1978 - DNA, 20 bp, Artificial Sequence
  Synthetic oligonucleotide; AAG chr11 5164822 5164841 5164838 +
aagagtacagacacggaggg

SEQ ID NO: 1979 - DNA, 20 bp, Artificial Sequence
  Synthetic oligonucleotide; AGG chr11 5164823 5164842 5164839 +
agagtacagacacggaggga

SEQ ID NO: 1980 - DNA, 20 bp, Artificial Sequence
  Synthetic oligonucleotide; GGG chr11 5164824 5164843 5164840 +
gagtacagacacggagggaa

SEQ ID NO: 1981 - DNA, 20 bp, Artificial Sequence
  Synthetic oligonucleotide; GGG chr11 5164825 5164844 5164841 +
agtacagacacggagggaag

SEQ ID NO: 1982 - DNA, 20 bp, Artificial Sequence
  Synthetic oligonucleotide; CGG chr11 5164830 5164849 5164846 +
agacacggagggaaggggtt

SEQ ID NO: 1983 - DNA, 20 bp, Artificial Sequence
  Synthetic oligonucleotide; GGG chr11 5164831 5164850 5164847 +
gacacggagggaaggggttc

SEQ ID NO: 1984 - DNA, 20 bp, Artificial Sequence
  Synthetic oligonucleotide; GGG chr11 5164832 5164851 5164848 +
acacggagggaaggggttcg

SEQ ID NO: 1985 - DNA, 20 bp, Artificial Sequence
  Synthetic oligonucleotide; GGG chr11 5164833 5164852 5164849 +
cacggagggaaggggttcgg

SEQ ID NO: 1986 - DNA, 20 bp, Artificial Sequence
  Synthetic oligonucleotide; CAG chr11 5164847 5164866 5164863 +
gttcgggggttcttactcac

SEQ ID NO: 1987 - DNA, 20 bp, Artificial Sequence
  Synthetic oligonucleotide; TGG chr11 5164855 5164874 5164871 +
gttcttactcaccagaaaaa

SEQ ID NO: 1988 - DNA, 20 bp, Artificial Sequence
  Synthetic oligonucleotide; GGG chr11 5164856 5164875 5164872 +
ttcttactcaccagaaaaat

SEQ ID NO: 1989 - DNA, 20 bp, Artificial Sequence
  Synthetic oligonucleotide; AAG chr11 5164860 5164879 5164876 +
tactcaccagaaaaatgggc

SEQ ID NO: 1990 - DNA, 20 bp, Artificial Sequence
  Synthetic oligonucleotide; AGG chr11 5164861 5164880 5164877 +
actcaccagaaaaatgggca

SEQ ID NO: 1991 - DNA, 20 bp, Artificial Sequence
  Synthetic oligonucleotide; GGG chr11 5164862 5164881 5164878 +
ctcaccagaaaaatgggcaa

SEQ ID NO: 1992 - DNA, 20 bp, Artificial Sequence
  Synthetic oligonucleotide; GGG chr11 5164863 5164882 5164879 +
tcaccagaaaaatgggcaag

SEQ ID NO: 1993 - DNA, 20 bp, Artificial Sequence
  Synthetic oligonucleotide; TGG chr11 5164867 5164886 5164883 +
cagaaaaatgggcaaggggt

SEQ ID NO: 1994 - DNA, 20 bp, Artificial Sequence
  Synthetic oligonucleotide; GGG chr11 5164868 5164887 5164884 +
agaaaaatgggcaaggggtt

SEQ ID NO: 1995 - DNA, 20 bp, Artificial Sequence
  Synthetic oligonucleotide; GGG chr11 5164869 5164888 5164885 +
gaaaaatgggcaaggggttg

SEQ ID NO: 1996 - DNA, 20 bp, Artificial Sequence
  Synthetic oligonucleotide; CGG chr11 5164874 5164893 5164890 +
atgggcaaggggttggggca

SEQ ID NO: 1997 - DNA, 20 bp, Artificial Sequence
  Synthetic oligonucleotide; AAG chr11 5164881 5164900 5164897 +
aggggttggggcacggaaat

SEQ ID NO: 1998 - DNA, 20 bp, Artificial Sequence
  Synthetic oligonucleotide; AGG chr11 5164882 5164901 5164898 +
ggggttggggcacggaaata

SEQ ID NO: 1999 - DNA, 20 bp, Artificial Sequence
  Synthetic oligonucleotide; GGG chr11 5164883 5164902 5164899 +
gggttggggcacggaaataa

SEQ ID NO: 2000 - DNA, 20 bp, Artificial Sequence
  Synthetic oligonucleotide; GGG chr11 5164884 5164903 5164900 +
ggttggggcacggaaataag

SEQ ID NO: 2001 - DNA, 20 bp, Artificial Sequence
  Synthetic oligonucleotide; TGG chr11 5164888 5164907 5164904 +
ggggcacggaaataaggggt

SEQ ID NO: 2002 - DNA, 20 bp, Artificial Sequence
  Synthetic oligonucleotide; GGG chr11 5164889 5164908 5164905 +
gggcacggaaataaggggtt

SEQ ID NO: 2003 - DNA, 20 bp, Artificial Sequence
  Synthetic oligonucleotide; GGG chr11 5164890 5164909 5164906 +
ggcacggaaataaggggttg

SEQ ID NO: 2004 - DNA, 20 bp, Artificial Sequence
  Synthetic oligonucleotide; CAG chr11 5164895 5164914 5164911 +
ggaaataaggggttggggtg

SEQ ID NO: 2005 - DNA, 20 bp, Artificial Sequence
  Synthetic oligonucleotide; GAG chr11 5164897 5164916 5164913 +
aaataaggggttggggtgca

SEQ ID NO: 2006 - DNA, 20 bp, Artificial Sequence
  Synthetic oligonucleotide; AAG chr11 5164902 5164921 5164918 +
aggggttggggtgcagagat

SEQ ID NO: 2007 - DNA, 20 bp, Artificial Sequence
  Synthetic oligonucleotide; GAG chr11 5164904 5164923 5164920 +
gggttggggtgcagagataa

SEQ ID NO: 2008 - DNA, 20 bp, Artificial Sequence
  Synthetic oligonucleotide; AGG chr11 5164905 5164924 5164921 +
ggttggggtgcagagataag

SEQ ID NO: 2009 - DNA, 20 bp, Artificial Sequence
  Synthetic oligonucleotide; CAG chr11 5164909 5164928 5164925 +
ggggtgcagagataagaggt

SEQ ID NO: 2010 - DNA, 20 bp, Artificial Sequence
  Synthetic oligonucleotide; AGG chr11 5164910 5164929 5164926 +
gggtgcagagataagaggtc

SEQ ID NO: 2011 - DNA, 20 bp, Artificial Sequence
  Synthetic oligonucleotide; GGG chr11 5164911 5164930 5164927 +
ggtgcagagataagaggtca

SEQ ID NO: 2012 - DNA, 20 bp, Artificial Sequence
  Synthetic oligonucleotide; CAG chr11 5164916 5164935 5164932 +
agagataagaggtcagggca

SEQ ID NO: 2013 - DNA, 20 bp, Artificial Sequence
  Synthetic oligonucleotide; AAG chr11 5164923 5164942 5164939 +
agaggtcagggcacagaaat

SEQ ID NO: 2014 - DNA, 20 bp, Artificial Sequence
  Synthetic oligonucleotide; AGG chr11 5164924 5164943 5164940 +
gaggtcagggcacagaaata

SEQ ID NO: 2015 - DNA, 20 bp, Artificial Sequence
  Synthetic oligonucleotide; GGG chr11 5164925 5164944 5164941 +
aggtcagggcacagaaataa

SEQ ID NO: 2016 - DNA, 20 bp, Artificial Sequence
  Synthetic oligonucleotide; GGG chr11 5164926 5164945 5164942 +
ggtcagggcacagaaataag

SEQ ID NO: 2017 - DNA, 20 bp, Artificial Sequence
  Synthetic oligonucleotide; TGG chr11 5164930 5164949 5164946 +
agggcacagaaataaggggt

SEQ ID NO: 2018 - DNA, 20 bp, Artificial Sequence
  Synthetic oligonucleotide; GGG chr11 5164931 5164950 5164947 +
gggcacagaaataaggggtt

SEQ ID NO: 2019 - DNA, 20 bp, Artificial Sequence
  Synthetic oligonucleotide; GGG chr11 5164932 5164951 5164948 +
ggcacagaaataaggggttg

SEQ ID NO: 2020 - DNA, 20 bp, Artificial Sequence
  Synthetic oligonucleotide; CAG chr11 5164937 5164956 5164953 +
agaaataaggggttggggtg

SEQ ID NO: 2021 - DNA, 20 bp, Artificial Sequence
  Synthetic oligonucleotide; GAG chr11 5164939 5164958 5164955 +
aaataaggggttggggtgca

SEQ ID NO: 2022 - DNA, 20 bp, Artificial Sequence
  Synthetic oligonucleotide; AAG chr11 5164944 5164963 5164960 +
aggggttggggtgcagagat

SEQ ID NO: 2023 - DNA, 20 bp, Artificial Sequence
  Synthetic oligonucleotide; GAG chr11 5164946 5164965 5164962 +
gggttggggtgcagagataa

SEQ ID NO: 2024 - DNA, 20 bp, Artificial Sequence
  Synthetic oligonucleotide; AGG chr11 5164947 5164966 5164963 +
ggttggggtgcagagataag

SEQ ID NO: 2025 - DNA, 20 bp, Artificial Sequence
  Synthetic oligonucleotide; TGG chr11 5164951 5164970 5164967 +
ggggtgcagagataagaggt

SEQ ID NO: 2026 - DNA, 20 bp, Artificial Sequence
  Synthetic oligonucleotide; GGG chr11 5164952 5164971 5164968 +
gggtgcagagataagaggtt

SEQ ID NO: 2027 - DNA, 20 bp, Artificial Sequence
  Synthetic oligonucleotide; GGG chr11 5164953 5164972 5164969 +
ggtgcagagataagaggttg

SEQ ID NO: 2028 - DNA, 20 bp, Artificial Sequence
  Synthetic oligonucleotide; CAG chr11 5164958 5164977 5164974 +
agagataagaggttggggca

SEQ ID NO: 2029 - DNA, 20 bp, Artificial Sequence
  Synthetic oligonucleotide; AAG chr11 5164965 5164984 5164981 +
agaggttggggcacagaaat

SEQ ID NO: 2030 - DNA, 20 bp, Artificial Sequence
  Synthetic oligonucleotide; AGG chr11 5164966 5164985 5164982 +
gaggttggggcacagaaata

SEQ ID NO: 2031 - DNA, 20 bp, Artificial Sequence
  Synthetic oligonucleotide; GGG chr11 5164967 5164986 5164983 +
aggttggggcacagaaataa

SEQ ID NO: 2032 - DNA, 20 bp, Artificial Sequence
  Synthetic oligonucleotide; CGG chr11 5164972 5164991 5164988 +
ggggcacagaaataagggat

SEQ ID NO: 2033 - DNA, 20 bp, Artificial Sequence
  Synthetic oligonucleotide; GGG chr11 5164973 5164992 5164989 +
gggcacagaaataagggatc

SEQ ID NO: 2034 - DNA, 20 bp, Artificial Sequence
  Synthetic oligonucleotide; GGG chr11 5164974 5164993 5164990 +
ggcacagaaataagggatcg

SEQ ID NO: 2035 - DNA, 20 bp, Artificial Sequence
  Synthetic oligonucleotide; CAG chr11 5164979 5164998 5164995 +
agaaataagggatcggggtg

SEQ ID NO: 2036 - DNA, 20 bp, Artificial Sequence
  Synthetic oligonucleotide; GAG chr11 5164981 5165000 5164997 +
aaataagggatcggggtgca

SEQ ID NO: 2037 - DNA, 20 bp, Artificial Sequence
  Synthetic oligonucleotide; AAG chr11 5164986 5165005 5165002 +
agggatcggggtgcagagat

SEQ ID NO: 2038 - DNA, 20 bp, Artificial Sequence
  Synthetic oligonucleotide; GAG chr11 5164988 5165007 5165004 +
ggatcggggtgcagagataa

SEQ ID NO: 2039 - DNA, 20 bp, Artificial Sequence
  Synthetic oligonucleotide; AGG chr11 5164989 5165008 5165005 +
gatcggggtgcagagataag

SEQ ID NO: 2040 - DNA, 20 bp, Artificial Sequence
  Synthetic oligonucleotide; TGG chr11 5164993 5165012 5165009 +
ggggtgcagagataagaggt

SEQ ID NO: 2041 - DNA, 20 bp, Artificial Sequence
  Synthetic oligonucleotide; GGG chr11 5164994 5165013 5165010 +
gggtgcagagataagaggtt

SEQ ID NO: 2042 - DNA, 20 bp, Artificial Sequence
  Synthetic oligonucleotide; GGG chr11 5164995 5165014 5165011 +
ggtgcagagataagaggttg

SEQ ID NO: 2043 - DNA, 20 bp, Artificial Sequence
  Synthetic oligonucleotide; CAG chr11 5165000 5165019 5165016 +
agagataagaggttggggtg

SEQ ID NO: 2044 - DNA, 20 bp, Artificial Sequence
  Synthetic oligonucleotide; AAG chr11 5165007 5165026 5165023 +
agaggttggggtgcagaaat

SEQ ID NO: 2045 - DNA, 20 bp, Artificial Sequence
  Synthetic oligonucleotide; AGG chr11 5165008 5165027 5165024 +
gaggttggggtgcagaaata

SEQ ID NO: 2046 - DNA, 20 bp, Artificial Sequence
  Synthetic oligonucleotide; GGG chr11 5165009 5165028 5165025 +
aggttggggtgcagaaataa

SEQ ID NO: 2047 - DNA, 20 bp, Artificial Sequence
  Synthetic oligonucleotide; CAG chr11 5165014 5165033 5165030 +
ggggtgcagaaataagggat

SEQ ID NO: 2048 - DNA, 20 bp, Artificial Sequence
  Synthetic oligonucleotide; AGG chr11 5165015 5165034 5165031 +
gggtgcagaaataagggatc

SEQ ID NO: 2049 - DNA, 20 bp, Artificial Sequence
  Synthetic oligonucleotide; GGG chr11 5165016 5165035 5165032 +
ggtgcagaaataagggatca

SEQ ID NO: 2050 - DNA, 20 bp, Artificial Sequence
  Synthetic oligonucleotide; CAG chr11 5165021 5165040 5165037 +
agaaataagggatcagggtg

SEQ ID NO: 2051 - DNA, 20 bp, Artificial Sequence
  Synthetic oligonucleotide; GAG chr11 5165023 5165042 5165039 +
aaataagggatcagggtgca

SEQ ID NO: 2052 - DNA, 20 bp, Artificial Sequence
  Synthetic oligonucleotide; AAG chr11 5165028 5165047 5165044 +
agggatcagggtgcagagat

SEQ ID NO: 2053 - DNA, 20 bp, Artificial Sequence
  Synthetic oligonucleotide; GAG chr11 5165030 5165049 5165046 +
ggatcagggtgcagagataa

SEQ ID NO: 2054 - DNA, 20 bp, Artificial Sequence
  Synthetic oligonucleotide; AGG chr11 5165031 5165050 5165047 +
gatcagggtgcagagataag

SEQ ID NO: 2055 - DNA, 20 bp, Artificial Sequence
  Synthetic oligonucleotide; CGG chr11 5165035 5165054 5165051 +
agggtgcagagataagaggt

SEQ ID NO: 2056 - DNA, 20 bp, Artificial Sequence
  Synthetic oligonucleotide; GGG chr11 5165036 5165055 5165052 +
gggtgcagagataagaggtc

SEQ ID NO: 2057 - DNA, 20 bp, Artificial Sequence
  Synthetic oligonucleotide; GGG chr11 5165037 5165056 5165053 +
ggtgcagagataagaggtcg

SEQ ID NO: 2058 - DNA, 20 bp, Artificial Sequence
  Synthetic oligonucleotide; CAG chr11 5165042 5165061 5165058 +
agagataagaggtcggggtg

SEQ ID NO: 2059 - DNA, 20 bp, Artificial Sequence
  Synthetic oligonucleotide; AAG chr11 5165049 5165068 5165065 +
agaggtcggggtgcagaaat

SEQ ID NO: 2060 - DNA, 20 bp, Artificial Sequence
  Synthetic oligonucleotide; AGG chr11 5165050 5165069 5165066 +
gaggtcggggtgcagaaata

SEQ ID NO: 2061 - DNA, 20 bp, Artificial Sequence
  Synthetic oligonucleotide; GGG chr11 5165051 5165070 5165067 +
aggtcggggtgcagaaataa

SEQ ID NO: 2062 - DNA, 20 bp, Artificial Sequence
  Synthetic oligonucleotide; TGG chr11 5165056 5165075 5165072 +
ggggtgcagaaataagggat

SEQ ID NO: 2063 - DNA, 20 bp, Artificial Sequence
  Synthetic oligonucleotide; GGG chr11 5165057 5165076 5165073 +
gggtgcagaaataagggatt

SEQ ID NO: 2064 - DNA, 20 bp, Artificial Sequence
  Synthetic oligonucleotide; GGG chr11 5165058 5165077 5165074 +
ggtgcagaaataagggattg

SEQ ID NO: 2065 - DNA, 20 bp, Artificial Sequence
  Synthetic oligonucleotide; CAG chr11 5165063 5165082 5165079 +
agaaataagggattggggtg

SEQ ID NO: 2066 - DNA, 20 bp, Artificial Sequence
  Synthetic oligonucleotide; GAG chr11 5165065 5165084 5165081 +
aaataagggattggggtgca

SEQ ID NO: 2067 - DNA, 20 bp, Artificial Sequence
  Synthetic oligonucleotide; AAG chr11 5165070 5165089 5165086 +
agggattggggtgcagagat

SEQ ID NO: 2068 - DNA, 20 bp, Artificial Sequence
  Synthetic oligonucleotide; GAG chr11 5165072 5165091 5165088 +
ggattggggtgcagagataa

SEQ ID NO: 2069 - DNA, 20 bp, Artificial Sequence
  Synthetic oligonucleotide; AGG chr11 5165073 5165092 5165089 +
gattggggtgcagagataag

SEQ ID NO: 2070 - DNA, 20 bp, Artificial Sequence
  Synthetic oligonucleotide; TGG chr11 5165077 5165096 5165093 +
ggggtgcagagataagagga

SEQ ID NO: 2071 - DNA, 20 bp, Artificial Sequence
  Synthetic oligonucleotide; GGG chr11 5165078 5165097 5165094 +
gggtgcagagataagaggat

SEQ ID NO: 2072 - DNA, 20 bp, Artificial Sequence
  Synthetic oligonucleotide; GGG chr11 5165079 5165098 5165095 +
ggtgcagagataagaggatg

SEQ ID NO: 2073 - DNA, 20 bp, Artificial Sequence
  Synthetic oligonucleotide; TGG chr11 5165084 5165103 5165100 +
agagataagaggatggggcg

SEQ ID NO: 2074 - DNA, 20 bp, Artificial Sequence
  Synthetic oligonucleotide; AAG chr11 5165091 5165110 5165107 +
agaggatggggcgtggaaat

SEQ ID NO: 2075 - DNA, 20 bp, Artificial Sequence
  Synthetic oligonucleotide; AGG chr11 5165092 5165111 5165108 +
gaggatggggcgtggaaata

SEQ ID NO: 2076 - DNA, 20 bp, Artificial Sequence
  Synthetic oligonucleotide; GGG chr11 5165093 5165112 5165109 +
aggatggggcgtggaaataa

SEQ ID NO: 2077 - DNA, 20 bp, Artificial Sequence
  Synthetic oligonucleotide; TGG chr11 5165097 5165116 5165113 +
tggggcgtggaaataaggga

SEQ ID NO: 2078 - DNA, 20 bp, Artificial Sequence
  Synthetic oligonucleotide; GGG chr11 5165098 5165117 5165114 +
ggggcgtggaaataagggat

SEQ ID NO: 2079 - DNA, 20 bp, Artificial Sequence
  Synthetic oligonucleotide; GGG chr11 5165099 5165118 5165115 +
gggcgtggaaataagggatg

SEQ ID NO: 2080 - DNA, 20 bp, Artificial Sequence
  Synthetic oligonucleotide; GAG chr11 5165106 5165125 5165122 +
gaaataagggatggggtgct

SEQ ID NO: 2081 - DNA, 20 bp, Artificial Sequence
  Synthetic oligonucleotide; AAG chr11 5165111 5165130 5165127 +
aagggatggggtgctgagat

SEQ ID NO: 2082 - DNA, 20 bp, Artificial Sequence
  Synthetic oligonucleotide; GAG chr11 5165113 5165132 5165129 +
gggatggggtgctgagataa

SEQ ID NO: 2083 - DNA, 20 bp, Artificial Sequence
  Synthetic oligonucleotide; AGG chr11 5165114 5165133 5165130 +
ggatggggtgctgagataag

SEQ ID NO: 2084 - DNA, 20 bp, Artificial Sequence
  Synthetic oligonucleotide; TGG chr11 5165118 5165137 5165134 +
ggggtgctgagataagaggt

SEQ ID NO: 2085 - DNA, 20 bp, Artificial Sequence
  Synthetic oligonucleotide; GGG chr11 5165119 5165138 5165135 +
gggtgctgagataagaggtt

SEQ ID NO: 2086 - DNA, 20 bp, Artificial Sequence
  Synthetic oligonucleotide; GGG chr11 5165120 5165139 5165136 +
ggtgctgagataagaggttg

SEQ ID NO: 2087 - DNA, 20 bp, Artificial Sequence
  Synthetic oligonucleotide; CAG chr11 5165125 5165144 5165141 +
tgagataagaggttggggca

SEQ ID NO: 2088 - DNA, 20 bp, Artificial Sequence
  Synthetic oligonucleotide; AAG chr11 5165132 5165151 5165148 +
agaggttggggcacagaaat

SEQ ID NO: 2089 - DNA, 20 bp, Artificial Sequence
  Synthetic oligonucleotide; AGG chr11 5165133 5165152 5165149 +
gaggttggggcacagaaata

SEQ ID NO: 2090 - DNA, 20 bp, Artificial Sequence
  Synthetic oligonucleotide; GGG chr11 5165134 5165153 5165150 +
aggttggggcacagaaataa

SEQ ID NO: 2091 - DNA, 20 bp, Artificial Sequence
  Synthetic oligonucleotide; TGG chr11 5165139 5165158 5165155 +
ggggcacagaaataagggat

SEQ ID NO: 2092 - DNA, 20 bp, Artificial Sequence
  Synthetic oligonucleotide; GGG chr11 5165140 5165159 5165156 +
gggcacagaaataagggatt

SEQ ID NO: 2093 - DNA, 20 bp, Artificial Sequence
  Synthetic oligonucleotide; GGG chr11 5165141 5165160 5165157 +
ggcacagaaataagggattg

SEQ ID NO: 2094 - DNA, 20 bp, Artificial Sequence
  Synthetic oligonucleotide; CAG chr11 5165154 5165173 5165170 +
gggattggggttcttgcccc

SEQ ID NO: 2095 - DNA, 20 bp, Artificial Sequence
  Synthetic oligonucleotide; AAG chr11 5165159 5165178 5165175 +
tggggttcttgcccccagaa

SEQ ID NO: 2096 - DNA, 20 bp, Artificial Sequence
  Synthetic oligonucleotide; CAG chr11 5165162 5165181 5165178 +
ggttcttgcccccagaaaag

SEQ ID NO: 2097 - DNA, 20 bp, Artificial Sequence
  Synthetic oligonucleotide; AAG chr11 5165167 5165186 5165183 +
ttgcccccagaaaagcagtg

SEQ ID NO: 2098 - DNA, 20 bp, Artificial Sequence
  Synthetic oligonucleotide; AGG chr11 5165168 5165187 5165184 +
tgcccccagaaaagcagtga

SEQ ID NO: 2099 - DNA, 20 bp, Artificial Sequence
  Synthetic oligonucleotide; GGG chr11 5165169 5165188 5165185 +
gcccccagaaaagcagtgaa

SEQ ID NO: 2100 - DNA, 20 bp, Artificial Sequence
  Synthetic oligonucleotide; GGG chr11 5165170 5165189 5165186 +
cccccagaaaagcagtgaag

SEQ ID NO: 2101 - DNA, 20 bp, Artificial Sequence
  Synthetic oligonucleotide; CAG chr11 5165173 5165192 5165189 +
ccagaaaagcagtgaagggg

SEQ ID NO: 2102 - DNA, 20 bp, Artificial Sequence
  Synthetic oligonucleotide; GAG chr11 5165175 5165194 5165191 +
agaaaagcagtgaaggggca

SEQ ID NO: 2103 - DNA, 20 bp, Artificial Sequence
  Synthetic oligonucleotide; TGG chr11 5165181 5165200 5165197 +
gcagtgaaggggcagagaca

SEQ ID NO: 2104 - DNA, 20 bp, Artificial Sequence
  Synthetic oligonucleotide; GAG chr11 5165183 5165202 5165199 +
agtgaaggggcagagacatg

SEQ ID NO: 2105 - DNA, 20 bp, Artificial Sequence
  Synthetic oligonucleotide; GAG chr11 5165185 5165204 5165201 +
tgaaggggcagagacatgga

SEQ ID NO: 2106 - DNA, 20 bp, Artificial Sequence
  Synthetic oligonucleotide; AAG chr11 5165188 5165207 5165204 +
aggggcagagacatggagag

SEQ ID NO: 2107 - DNA, 20 bp, Artificial Sequence
  Synthetic oligonucleotide; AGG chr11 5165189 5165208 5165205 +
ggggcagagacatggagaga

SEQ ID NO: 2108 - DNA, 20 bp, Artificial Sequence
  Synthetic oligonucleotide; GGG chr11 5165190 5165209 5165206 +
gggcagagacatggagagaa

SEQ ID NO: 2109 - DNA, 20 bp, Artificial Sequence
  Synthetic oligonucleotide; GGG chr11 5165191 5165210 5165207 +
ggcagagacatggagagaag

SEQ ID NO: 2110 - DNA, 20 bp, Artificial Sequence
  Synthetic oligonucleotide; TGG chr11 5165195 5165214 5165211 +
gagacatggagagaaggggt

SEQ ID NO: 2111 - DNA, 20 bp, Artificial Sequence
  Synthetic oligonucleotide; GGG chr11 5165196 5165215 5165212 +
agacatggagagaaggggtt

SEQ ID NO: 2112 - DNA, 20 bp, Artificial Sequence
  Synthetic oligonucleotide; GGG chr11 5165197 5165216 5165213 +
gacatggagagaaggggttg

SEQ ID NO: 2113 - DNA, 20 bp, Artificial Sequence
  Synthetic oligonucleotide; CAG chr11 5165214 5165233 5165230 +
ttggggtacttacccccctc

SEQ ID NO: 2114 - DNA, 20 bp, Artificial Sequence
  Synthetic oligonucleotide; AAG chr11 5165219 5165238 5165235 +
gtacttacccccctccagaa

SEQ ID NO: 2115 - DNA, 20 bp, Artificial Sequence
  Synthetic oligonucleotide; TGG chr11 5165222 5165241 5165238 +
cttacccccctccagaaaag

SEQ ID NO: 2116 - DNA, 20 bp, Artificial Sequence
  Synthetic oligonucleotide; GGG chr11 5165223 5165242 5165239 +
ttacccccctccagaaaagt

SEQ ID NO: 2117 - DNA, 20 bp, Artificial Sequence
  Synthetic oligonucleotide; AAG chr11 5165236 5165255 5165252 +
gaaaagtgggatttgccgct

SEQ ID NO: 2118 - DNA, 20 bp, Artificial Sequence
  Synthetic oligonucleotide; AGG chr11 5165237 5165256 5165253 +
aaaagtgggatttgccgcta

SEQ ID NO: 2119 - DNA, 20 bp, Artificial Sequence
  Synthetic oligonucleotide; GGG chr11 5165238 5165257 5165254 +
aaagtgggatttgccgctaa

SEQ ID NO: 2120 - DNA, 20 bp, Artificial Sequence
  Synthetic oligonucleotide; AAG chr11 5165243 5165262 5165259 +
gggatttgccgctaagggtg

SEQ ID NO: 2121 - DNA, 20 bp, Artificial Sequence
  Synthetic oligonucleotide; AGG chr11 5165244 5165263 5165260 +
ggatttgccgctaagggtga

SEQ ID NO: 2122 - DNA, 20 bp, Artificial Sequence
  Synthetic oligonucleotide; AAG chr11 5165250 5165269 5165266 +
gccgctaagggtgaaggacc

SEQ ID NO: 2123 - DNA, 20 bp, Artificial Sequence
  Synthetic oligonucleotide; AGG chr11 5165251 5165270 5165267 +
ccgctaagggtgaaggacca

SEQ ID NO: 2124 - DNA, 20 bp, Artificial Sequence
  Synthetic oligonucleotide; CAG chr11 5165254 5165273 5165270 +
ctaagggtgaaggaccaagg

SEQ ID NO: 2125 - DNA, 20 bp, Artificial Sequence
  Synthetic oligonucleotide; AGG chr11 5165255 5165274 5165271 +
taagggtgaaggaccaaggc

SEQ ID NO: 2126 - DNA, 20 bp, Artificial Sequence
  Synthetic oligonucleotide; TGG chr11 5165268 5165287 5165284 +
ccaaggcaggcatccctgcg

SEQ ID NO: 2127 - DNA, 20 bp, Artificial Sequence
  Synthetic oligonucleotide; TGG chr11 5165289 5165308 5165305 +
ggtctgacacctctgaaaca

SEQ ID NO: 2128 - DNA, 20 bp, Artificial Sequence
  Synthetic oligonucleotide; CAG chr11 5165301 5165320 5165317 +
ctgaaacatggtttaataat

SEQ ID NO: 2129 - DNA, 20 bp, Artificial Sequence
  Synthetic oligonucleotide; GAG chr11 5165303 5165322 5165319 +
gaaacatggtttaataatca

SEQ ID NO: 2130 - DNA, 20 bp, Artificial Sequence
  Synthetic oligonucleotide; GAG chr11 5165305 5165324 5165321 +
aacatggtttaataatcaga

SEQ ID NO: 2131 - DNA, 20 bp, Artificial Sequence
  Synthetic oligonucleotide; AGG chr11 5165306 5165325 5165322 +
acatggtttaataatcagag

SEQ ID NO: 2132 - DNA, 20 bp, Artificial Sequence
  Synthetic oligonucleotide; AAG chr11 5165332 5165351 5165348 +
ccctgcaatgattaaacacc

SEQ ID NO: 2133 - DNA, 20 bp, Artificial Sequence
  Synthetic oligonucleotide; AGG chr11 5165333 5165352 5165349 +
cctgcaatgattaaacacca

SEQ ID NO: 2134 - DNA, 20 bp, Artificial Sequence
  Synthetic oligonucleotide; GGG chr11 5165334 5165353 5165350 +
ctgcaatgattaaacaccaa

SEQ ID NO: 2135 - DNA, 20 bp, Artificial Sequence
  Synthetic oligonucleotide; AAG chr11 5165337 5165356 5165353 +
caatgattaaacaccaaggg

SEQ ID NO: 2136 - DNA, 20 bp, Artificial Sequence
  Synthetic oligonucleotide; AGG chr11 5165338 5165357 5165354 +
aatgattaaacaccaaggga

SEQ ID NO: 2137 - DNA, 20 bp, Artificial Sequence
  Synthetic oligonucleotide; CAG chr11 5165350 5165369 5165366 +
ccaagggaaggctgccttcc

SEQ ID NO: 2138 - DNA, 20 bp, Artificial Sequence
  Synthetic oligonucleotide; TGG chr11 5165361 5165380 5165377 +
ctgccttcccagtccgtgac

SEQ ID NO: 2139 - DNA, 20 bp, Artificial Sequence
  Synthetic oligonucleotide; CGG chr11 5165367 5165386 5165383 +
tcccagtccgtgactggcac

SEQ ID NO: 2140 - DNA, 20 bp, Artificial Sequence
  Synthetic oligonucleotide; GAG chr11 5165369 5165388 5165385 +
ccagtccgtgactggcaccg

SEQ ID NO: 2141 - DNA, 20 bp, Artificial Sequence
  Synthetic oligonucleotide; TGG chr11 5165375 5165394 5165391 +
cgtgactggcaccggagttt

SEQ ID NO: 2142 - DNA, 20 bp, Artificial Sequence
  Synthetic oligonucleotide; GGG chr11 5165376 5165395 5165392 +
gtgactggcaccggagtttt

SEQ ID NO: 2143 - DNA, 20 bp, Artificial Sequence
  Synthetic oligonucleotide; CGG chr11 5165383 5165402 5165399 +
gcaccggagttttgggtcca

SEQ ID NO: 2144 - DNA, 20 bp, Artificial Sequence
  Synthetic oligonucleotide; TGG chr11 5165412 5165431 5165428 +
catgtctcctttgtctctac

SEQ ID NO: 2145 - DNA, 20 bp, Artificial Sequence
  Synthetic oligonucleotide; AAG chr11 5165422 5165441 5165438 +
ttgtctctactggaaaatga

SEQ ID NO: 2146 - DNA, 20 bp, Artificial Sequence
  Synthetic oligonucleotide; AGG chr11 5165423 5165442 5165439 +
tgtctctactggaaaatgaa

SEQ ID NO: 2147 - DNA, 20 bp, Artificial Sequence
  Synthetic oligonucleotide; AAG chr11 5165436 5165455 5165452 +
aaatgaaaggaattgaaatt

SEQ ID NO: 2148 - DNA, 20 bp, Artificial Sequence
  Synthetic oligonucleotide; GAG chr11 5165438 5165457 5165454 +
atgaaaggaattgaaattaa

SEQ ID NO: 2149 - DNA, 20 bp, Artificial Sequence
  Synthetic oligonucleotide; AAG chr11 5165441 5165460 5165457 +
aaaggaattgaaattaagag

SEQ ID NO: 2150 - DNA, 20 bp, Artificial Sequence
  Synthetic oligonucleotide; AGG chr11 5165442 5165461 5165458 +
aaggaattgaaattaagaga

SEQ ID NO: 2151 - DNA, 20 bp, Artificial Sequence
  Synthetic oligonucleotide; GGG chr11 5165443 5165462 5165459 +
aggaattgaaattaagagaa

SEQ ID NO: 2152 - DNA, 20 bp, Artificial Sequence
  Synthetic oligonucleotide; GAG chr11 5165445 5165464 5165461 +
gaattgaaattaagagaagg

SEQ ID NO: 2153 - DNA, 20 bp, Artificial Sequence
  Synthetic oligonucleotide; AAG chr11 5165454 5165473 5165470 +
ttaagagaagggagaaattg

SEQ ID NO: 2154 - DNA, 20 bp, Artificial Sequence
  Synthetic oligonucleotide; TGG chr11 5165459 5165478 5165475 +
agaagggagaaattgaagtg

SEQ ID NO: 2155 - DNA, 20 bp, Artificial Sequence
  Synthetic oligonucleotide; AAG chr11 5165466 5165485 5165482 +
agaaattgaagtgtggtgcc

SEQ ID NO: 2156 - DNA, 20 bp, Artificial Sequence
  Synthetic oligonucleotide; AAG chr11 5165474 5165493 5165490 +
aagtgtggtgccaagattga

SEQ ID NO: 2157 - DNA, 20 bp, Artificial Sequence
  Synthetic oligonucleotide; AGG chr11 5165475 5165494 5165491 +
agtgtggtgccaagattgaa

SEQ ID NO: 2158 - DNA, 20 bp, Artificial Sequence
  Synthetic oligonucleotide; GAG chr11 5165477 5165496 5165493 +
tgtggtgccaagattgaaag

SEQ ID NO: 2159 - DNA, 20 bp, Artificial Sequence
  Synthetic oligonucleotide; AAG chr11 5165481 5165500 5165497 +
gtgccaagattgaaaggaga

SEQ ID NO: 2160 - DNA, 20 bp, Artificial Sequence
  Synthetic oligonucleotide; AAG chr11 5165484 5165503 5165500 +
ccaagattgaaaggagaaag

SEQ ID NO: 2161 - DNA, 20 bp, Artificial Sequence
  Synthetic oligonucleotide; GAG chr11 5165489 5165508 5165505 +
attgaaaggagaaagaagtt

SEQ ID NO: 2162 - DNA, 20 bp, Artificial Sequence
  Synthetic oligonucleotide; AGG chr11 5165490 5165509 5165506 +
ttgaaaggagaaagaagttg

SEQ ID NO: 2163 - DNA, 20 bp, Artificial Sequence
  Synthetic oligonucleotide; GGG chr11 5165491 5165510 5165507 +
tgaaaggagaaagaagttga

SEQ ID NO: 2164 - DNA, 20 bp, Artificial Sequence
  Synthetic oligonucleotide; TAG chr11 5165495 5165514 5165511 +
aggagaaagaagttgaggga

SEQ ID NO: 2165 - DNA, 20 bp, Artificial Sequence
  Synthetic oligonucleotide; GAG chr11 5165499 5165518 5165515 +
gaaagaagttgagggatagt

SEQ ID NO: 2166 - DNA, 20 bp, Artificial Sequence
  Synthetic oligonucleotide; AGG chr11 5165500 5165519 5165516 +
aaagaagttgagggatagtg

SEQ ID NO: 2167 - DNA, 20 bp, Artificial Sequence
  Synthetic oligonucleotide; GGG chr11 5165501 5165520 5165517 +
aagaagttgagggatagtga

SEQ ID NO: 2168 - DNA, 20 bp, Artificial Sequence
  Synthetic oligonucleotide; GAG chr11 5165503 5165522 5165519 +
gaagttgagggatagtgagg

SEQ ID NO: 2169 - DNA, 20 bp, Artificial Sequence
  Synthetic oligonucleotide; AGG chr11 5165504 5165523 5165520 +
aagttgagggatagtgaggg

SEQ ID NO: 2170 - DNA, 20 bp, Artificial Sequence
  Synthetic oligonucleotide; TGG chr11 5165508 5165527 5165524 +
tgagggatagtgagggaggt

SEQ ID NO: 2171 - DNA, 20 bp, Artificial Sequence
  Synthetic oligonucleotide; GAG chr11 5165510 5165529 5165526 +
agggatagtgagggaggttg

SEQ ID NO: 2172 - DNA, 20 bp, Artificial Sequence
  Synthetic oligonucleotide; AAG chr11 5165513 5165532 5165529 +
gatagtgagggaggttggag

SEQ ID NO: 2173 - DNA, 20 bp, Artificial Sequence
  Synthetic oligonucleotide; CAG chr11 5165517 5165536 5165533 +
gtgagggaggttggagaaga

SEQ ID NO: 2174 - DNA, 20 bp, Artificial Sequence
  Synthetic oligonucleotide; AAG chr11 5165524 5165543 5165540 +
aggttggagaagacagtaaa

SEQ ID NO: 2175 - DNA, 20 bp, Artificial Sequence
  Synthetic oligonucleotide; GAG chr11 5165526 5165545 5165542 +
gttggagaagacagtaaaaa

SEQ ID NO: 2176 - DNA, 20 bp, Artificial Sequence
  Synthetic oligonucleotide; AGG chr11 5165527 5165546 5165543 +
ttggagaagacagtaaaaag

SEQ ID NO: 2177 - DNA, 20 bp, Artificial Sequence
  Synthetic oligonucleotide; CGG chr11 5165538 5165557 5165554 +
agtaaaaagaggccacttac

SEQ ID NO: 2178 - DNA, 20 bp, Artificial Sequence
  Synthetic oligonucleotide; TGG chr11 5165550 5165569 5165566 +
ccacttaccggatttgaaat

SEQ ID NO: 2179 - DNA, 20 bp, Artificial Sequence
  Synthetic oligonucleotide; TGG chr11 5165565 5165584 5165581 +
gaaattggtgaaatgtttct

SEQ ID NO: 2180 - DNA, 20 bp, Artificial Sequence
  Synthetic oligonucleotide; GGG chr11 5165566 5165585 5165582 +
aaattggtgaaatgtttctt

SEQ ID NO: 2181 - DNA, 20 bp, Artificial Sequence
  Synthetic oligonucleotide; TGG chr11 5165570 5165589 5165586 +
tggtgaaatgtttcttgggc

SEQ ID NO: 2182 - DNA, 20 bp, Artificial Sequence
  Synthetic oligonucleotide; CAG chr11 5165574 5165593 5165590 +
gaaatgtttcttgggctggt

SEQ ID NO: 2183 - DNA, 20 bp, Artificial Sequence
  Synthetic oligonucleotide; GAG chr11 5165580 5165599 5165596 +
tttcttgggctggtcagttt

SEQ ID NO: 2184 - DNA, 20 bp, Artificial Sequence
  Synthetic oligonucleotide; AGG chr11 5165581 5165600 5165597 +
ttcttgggctggtcagtttg

SEQ ID NO: 2185 - DNA, 20 bp, Artificial Sequence
  Synthetic oligonucleotide; GAG chr11 5165588 5165607 5165604 +
gctggtcagtttgaggacct

SEQ ID NO: 2186 - DNA, 20 bp, Artificial Sequence
  Synthetic oligonucleotide; AGG chr11 5165589 5165608 5165605 +
ctggtcagtttgaggacctg

SEQ ID NO: 2187 - DNA, 20 bp, Artificial Sequence
  Synthetic oligonucleotide; TAG chr11 5165595 5165614 5165611 +
agtttgaggacctgaggtcg

SEQ ID NO: 2188 - DNA, 20 bp, Artificial Sequence
  Synthetic oligonucleotide; AGG chr11 5165596 5165615 5165612 +
gtttgaggacctgaggtcgt

SEQ ID NO: 2189 - DNA, 20 bp, Artificial Sequence
  Synthetic oligonucleotide; TGG chr11 5165599 5165618 5165615 +
tgaggacctgaggtcgtagg

SEQ ID NO: 2190 - DNA, 20 bp, Artificial Sequence
  Synthetic oligonucleotide; CGG chr11 5165612 5165631 5165628 +
tcgtaggtggatctttctca

SEQ ID NO: 2191 - DNA, 20 bp, Artificial Sequence
  Synthetic oligonucleotide; GAG chr11 5165614 5165633 5165630 +
gtaggtggatctttctcacg

SEQ ID NO: 2192 - DNA, 20 bp, Artificial Sequence
  Synthetic oligonucleotide; AAG chr11 5165619 5165638 5165635 +
tggatctttctcacggagca

SEQ ID NO: 2193 - DNA, 20 bp, Artificial Sequence
  Synthetic oligonucleotide; GAG chr11 5165621 5165640 5165637 +
gatctttctcacggagcaaa

SEQ ID NO: 2194 - DNA, 20 bp, Artificial Sequence
  Synthetic oligonucleotide; CAG chr11 5165624 5165643 5165640 +
ctttctcacggagcaaagag

SEQ ID NO: 2195 - DNA, 20 bp, Artificial Sequence
  Synthetic oligonucleotide; AGG chr11 5165625 5165644 5165641 +
tttctcacggagcaaagagc

SEQ ID NO: 2196 - DNA, 20 bp, Artificial Sequence
  Synthetic oligonucleotide; GAG chr11 5165627 5165646 5165643 +
tctcacggagcaaagagcag

SEQ ID NO: 2197 - DNA, 20 bp, Artificial Sequence
  Synthetic oligonucleotide; AGG chr11 5165628 5165647 5165644 +
ctcacggagcaaagagcagg

SEQ ID NO: 2198 - DNA, 20 bp, Artificial Sequence
  Synthetic oligonucleotide; CAG chr11 5165632 5165651 5165648 +
cggagcaaagagcaggagga

SEQ ID NO: 2199 - DNA, 20 bp, Artificial Sequence
  Synthetic oligonucleotide; AGG chr11 5165633 5165652 5165649 +
ggagcaaagagcaggaggac

SEQ ID NO: 2200 - DNA, 20 bp, Artificial Sequence
  Synthetic oligonucleotide; GGG chr11 5165634 5165653 5165650 +
gagcaaagagcaggaggaca

SEQ ID NO: 2201 - DNA, 20 bp, Artificial Sequence
  Synthetic oligonucleotide; GGG chr11 5165635 5165654 5165651 +
agcaaagagcaggaggacag

SEQ ID NO: 2202 - DNA, 20 bp, Artificial Sequence
  Synthetic oligonucleotide; AAG chr11 5165649 5165668 5165665 +
ggacaggggattgatctccc

SEQ ID NO: 2203 - DNA, 20 bp, Artificial Sequence
  Synthetic oligonucleotide; AGG chr11 5165650 5165669 5165666 +
gacaggggattgatctccca

SEQ ID NO: 2204 - DNA, 20 bp, Artificial Sequence
  Synthetic oligonucleotide; GGG chr11 5165651 5165670 5165667 +
acaggggattgatctcccaa

SEQ ID NO: 2205 - DNA, 20 bp, Artificial Sequence
  Synthetic oligonucleotide; GAG chr11 5165653 5165672 5165669 +
aggggattgatctcccaagg

SEQ ID NO: 2206 - DNA, 20 bp, Artificial Sequence
  Synthetic oligonucleotide; AGG chr11 5165654 5165673 5165670 +
ggggattgatctcccaaggg

SEQ ID NO: 2207 - DNA, 20 bp, Artificial Sequence
  Synthetic oligonucleotide; GAG chr11 5165668 5165687 5165684 +
caagggaggtcccccaatct

SEQ ID NO: 2208 - DNA, 20 bp, Artificial Sequence
  Synthetic oligonucleotide; CGG chr11 5165674 5165693 5165690 +
aggtcccccaatctgagtca

SEQ ID NO: 2209 - DNA, 20 bp, Artificial Sequence
  Synthetic oligonucleotide; AAG chr11 5165703 5165722 5165719 +
atttcatgcgcgtccatatg

SEQ ID NO: 2210 - DNA, 20 bp, Artificial Sequence
  Synthetic oligonucleotide; GAG chr11 5165705 5165724 5165721 +
ttcatgcgcgtccatatgaa

SEQ ID NO: 2211 - DNA, 20 bp, Artificial Sequence
  Synthetic oligonucleotide; CAG chr11 5165717 5165736 5165733 +
catatgaagagactaccaaa

SEQ ID NO: 2212 - DNA, 20 bp, Artificial Sequence
  Synthetic oligonucleotide; AGG chr11 5165718 5165737 5165734 +
atatgaagagactaccaaac

SEQ ID NO: 2213 - DNA, 20 bp, Artificial Sequence
  Synthetic oligonucleotide; AAG chr11 5165729 5165748 5165745 +
ctaccaaacaggctttgtgt

SEQ ID NO: 2214 - DNA, 20 bp, Artificial Sequence
  Synthetic oligonucleotide; AAG chr11 5165736 5165755 5165752 +
acaggctttgtgtaagcaac

SEQ ID NO: 2215 - DNA, 20 bp, Artificial Sequence
  Synthetic oligonucleotide; AGG chr11 5165737 5165756 5165753 +
caggctttgtgtaagcaaca

SEQ ID NO: 2216 - DNA, 20 bp, Artificial Sequence
  Synthetic oligonucleotide; TGG chr11 5165754 5165773 5165770 +
acaaggctgtttatttcacc

SEQ ID NO: 2217 - DNA, 20 bp, Artificial Sequence
  Synthetic oligonucleotide; GGG chr11 5165755 5165774 5165771 +
caaggctgtttatttcacct

SEQ ID NO: 2218 - DNA, 20 bp, Artificial Sequence
  Synthetic oligonucleotide; CAG chr11 5165760 5165779 5165776 +
ctgtttatttcacctgggtg

SEQ ID NO: 2219 - DNA, 20 bp, Artificial Sequence
  Synthetic oligonucleotide; AGG chr11 5165761 5165780 5165777 +
tgtttatttcacctgggtgc

SEQ ID NO: 2220 - DNA, 20 bp, Artificial Sequence
  Synthetic oligonucleotide; CAG chr11 5165764 5165783 5165780 +
ttatttcacctgggtgcagg

SEQ ID NO: 2221 - DNA, 20 bp, Artificial Sequence
  Synthetic oligonucleotide; AGG chr11 5165765 5165784 5165781 +
tatttcacctgggtgcaggc

SEQ ID NO: 2222 - DNA, 20 bp, Artificial Sequence
  Synthetic oligonucleotide; GAG chr11 5165770 5165789 5165786 +
cacctgggtgcaggcaggct

SEQ ID NO: 2223 - DNA, 20 bp, Artificial Sequence
  Synthetic oligonucleotide; AAG chr11 5165779 5165798 5165795 +
gcaggcaggctgagtccaaa

SEQ ID NO: 2224 - DNA, 20 bp, Artificial Sequence
  Synthetic oligonucleotide; GAG chr11 5165781 5165800 5165797 +
aggcaggctgagtccaaaaa

SEQ ID NO: 2225 - DNA, 20 bp, Artificial Sequence
  Synthetic oligonucleotide; GAG chr11 5165783 5165802 5165799 +
gcaggctgagtccaaaaaga

SEQ ID NO: 2226 - DNA, 20 bp, Artificial Sequence
  Synthetic oligonucleotide; CAG chr11 5165787 5165806 5165803 +
gctgagtccaaaaagagagt

SEQ ID NO: 2227 - DNA, 20 bp, Artificial Sequence
  Synthetic oligonucleotide; AAG chr11 5165792 5165811 5165808 +
gtccaaaaagagagtcagca

SEQ ID NO: 2228 - DNA, 20 bp, Artificial Sequence
  Synthetic oligonucleotide; AGG chr11 5165793 5165812 5165809 +
tccaaaaagagagtcagcaa

SEQ ID NO: 2229 - DNA, 20 bp, Artificial Sequence
  Synthetic oligonucleotide; GGG chr11 5165794 5165813 5165810 +
ccaaaaagagagtcagcaaa

SEQ ID NO: 2230 - DNA, 20 bp, Artificial Sequence
  Synthetic oligonucleotide; GAG chr11 5165796 5165815 5165812 +
aaaaagagagtcagcaaagg

SEQ ID NO: 2231 - DNA, 20 bp, Artificial Sequence
  Synthetic oligonucleotide; TAG chr11 5165800 5165819 5165816 +
agagagtcagcaaagggaga

SEQ ID NO: 2232 - DNA, 20 bp, Artificial Sequence
  Synthetic oligonucleotide; AGG chr11 5165801 5165820 5165817 +
gagagtcagcaaagggagat

SEQ ID NO: 2233 - DNA, 20 bp, Artificial Sequence
  Synthetic oligonucleotide; GAG chr11 5165803 5165822 5165819 +
gagtcagcaaagggagatag

SEQ ID NO: 2234 - DNA, 20 bp, Artificial Sequence
  Synthetic oligonucleotide; TGG chr11 5165806 5165825 5165822 +
tcagcaaagggagataggag

SEQ ID NO: 2235 - DNA, 20 bp, Artificial Sequence
  Synthetic oligonucleotide; GGG chr11 5165807 5165826 5165823 +
cagcaaagggagataggagt

SEQ ID NO: 2236 - DNA, 20 bp, Artificial Sequence
  Synthetic oligonucleotide; GGG chr11 5165808 5165827 5165824 +
agcaaagggagataggagtg

SEQ ID NO: 2237 - DNA, 20 bp, Artificial Sequence
  Synthetic oligonucleotide; AAG chr11 5165820 5165839 5165836 +
taggagtggggctgttttat

SEQ ID NO: 2238 - DNA, 20 bp, Artificial Sequence
  Synthetic oligonucleotide; TGG chr11 5165826 5165845 5165842 +
tggggctgttttataagatt

SEQ ID NO: 2239 - DNA, 20 bp, Artificial Sequence
  Synthetic oligonucleotide; GGG chr11 5165827 5165846 5165843 +
ggggctgttttataagattt

SEQ ID NO: 2240 - DNA, 20 bp, Artificial Sequence
  Synthetic oligonucleotide; TAG chr11 5165830 5165849 5165846 +
gctgttttataagatttggg

SEQ ID NO: 2241 - DNA, 20 bp, Artificial Sequence
  Synthetic oligonucleotide; AGG chr11 5165831 5165850 5165847 +
ctgttttataagatttgggt

SEQ ID NO: 2242 - DNA, 20 bp, Artificial Sequence
  Synthetic oligonucleotide; AAG chr11 5165836 5165855 5165852 +
ttataagatttgggtaggta

SEQ ID NO: 2243 - DNA, 20 bp, Artificial Sequence
  Synthetic oligonucleotide; AGG chr11 5165837 5165856 5165853 +
tataagatttgggtaggtaa

SEQ ID NO: 2244 - DNA, 20 bp, Artificial Sequence
  Synthetic oligonucleotide; CAG chr11 5165847 5165866 5165863 +
gggtaggtaaaggaaaatta

SEQ ID NO: 2245 - DNA, 20 bp, Artificial Sequence
  Synthetic oligonucleotide; AAG chr11 5165853 5165872 5165869 +
gtaaaggaaaattacagtca

SEQ ID NO: 2246 - DNA, 20 bp, Artificial Sequence
  Synthetic oligonucleotide; AGG chr11 5165854 5165873 5165870 +
taaaggaaaattacagtcaa

SEQ ID NO: 2247 - DNA, 20 bp, Artificial Sequence
  Synthetic oligonucleotide; GGG chr11 5165855 5165874 5165871 +
aaaggaaaattacagtcaaa

SEQ ID NO: 2248 - DNA, 20 bp, Artificial Sequence
  Synthetic oligonucleotide; GGG chr11 5165856 5165875 5165872 +
aaggaaaattacagtcaaag

SEQ ID NO: 2249 - DNA, 20 bp, Artificial Sequence
  Synthetic oligonucleotide; GGG chr11 5165857 5165876 5165873 +
aggaaaattacagtcaaagg

SEQ ID NO: 2250 - DNA, 20 bp, Artificial Sequence
  Synthetic oligonucleotide; GGG chr11 5165858 5165877 5165874 +
ggaaaattacagtcaaaggg

SEQ ID NO: 2251 - DNA, 20 bp, Artificial Sequence
  Synthetic oligonucleotide; TGG chr11 5165869 5165888 5165885 +
gtcaaaggggggttgttctc

SEQ ID NO: 2252 - DNA, 20 bp, Artificial Sequence
  Synthetic oligonucleotide; CGG chr11 5165872 5165891 5165888 +
aaaggggggttgttctctgg

SEQ ID NO: 2253 - DNA, 20 bp, Artificial Sequence
  Synthetic oligonucleotide; GGG chr11 5165873 5165892 5165889 +
aaggggggttgttctctggc

SEQ ID NO: 2254 - DNA, 20 bp, Artificial Sequence
  Synthetic oligonucleotide; CAG chr11 5165876 5165895 5165892 +
gggggttgttctctggcggg

SEQ ID NO: 2255 - DNA, 20 bp, Artificial Sequence
  Synthetic oligonucleotide; AGG chr11 5165877 5165896 5165893 +
ggggttgttctctggcgggc

SEQ ID NO: 2256 - DNA, 20 bp, Artificial Sequence
  Synthetic oligonucleotide; GAG chr11 5165879 5165898 5165895 +
ggttgttctctggcgggcag

SEQ ID NO: 2257 - DNA, 20 bp, Artificial Sequence
  Synthetic oligonucleotide; TGG chr11 5165882 5165901 5165898 +
tgttctctggcgggcaggag

SEQ ID NO: 2258 - DNA, 20 bp, Artificial Sequence
  Synthetic oligonucleotide; GGG chr11 5165883 5165902 5165899 +
gttctctggcgggcaggagt

SEQ ID NO: 2259 - DNA, 20 bp, Artificial Sequence
  Synthetic oligonucleotide; GGG chr11 5165884 5165903 5165900 +
ttctctggcgggcaggagtg

SEQ ID NO: 2260 - DNA, 20 bp, Artificial Sequence
  Synthetic oligonucleotide; GGG chr11 5165885 5165904 5165901 +
tctctggcgggcaggagtgg

SEQ ID NO: 2261 - DNA, 20 bp, Artificial Sequence
  Synthetic oligonucleotide; AAG chr11 5165892 5165911 5165908 +
cgggcaggagtgggggtcac

SEQ ID NO: 2262 - DNA, 20 bp, Artificial Sequence
  Synthetic oligonucleotide; AGG chr11 5165893 5165912 5165909 +
gggcaggagtgggggtcaca

SEQ ID NO: 2263 - DNA, 20 bp, Artificial Sequence
  Synthetic oligonucleotide; CAG chr11 5165900 5165919 5165916 +
agtgggggtcacaaggtgct

SEQ ID NO: 2264 - DNA, 20 bp, Artificial Sequence
  Synthetic oligonucleotide; TAG chr11 5165903 5165922 5165919 +
gggggtcacaaggtgctcag

SEQ ID NO: 2265 - DNA, 20 bp, Artificial Sequence
  Synthetic oligonucleotide; AGG chr11 5165904 5165923 5165920 +
ggggtcacaaggtgctcagt

SEQ ID NO: 2266 - DNA, 20 bp, Artificial Sequence
  Synthetic oligonucleotide; GGG chr11 5165905 5165924 5165921 +
gggtcacaaggtgctcagta

SEQ ID NO: 2267 - DNA, 20 bp, Artificial Sequence
  Synthetic oligonucleotide; GGG chr11 5165906 5165925 5165922 +
ggtcacaaggtgctcagtag

SEQ ID NO: 2268 - DNA, 20 bp, Artificial Sequence
  Synthetic oligonucleotide; GAG chr11 5165908 5165927 5165924 +
tcacaaggtgctcagtaggg

SEQ ID NO: 2269 - DNA, 20 bp, Artificial Sequence
  Synthetic oligonucleotide; GAG chr11 5165916 5165935 5165932 +
tgctcagtaggggagctttt

SEQ ID NO: 2270 - DNA, 20 bp, Artificial Sequence
  Synthetic oligonucleotide; CAG chr11 5165920 5165939 5165936 +
cagtaggggagcttttgagc

SEQ ID NO: 2271 - DNA, 20 bp, Artificial Sequence
  Synthetic oligonucleotide; AGG chr11 5165921 5165940 5165937 +
agtaggggagcttttgagcc

SEQ ID NO: 2272 - DNA, 20 bp, Artificial Sequence
  Synthetic oligonucleotide; GAG chr11 5165926 5165945 5165942 +
gggagcttttgagccaggat

SEQ ID NO: 2273 - DNA, 20 bp, Artificial Sequence
  Synthetic oligonucleotide; CAG chr11 5165930 5165949 5165946 +
gcttttgagccaggatgagc

SEQ ID NO: 2274 - DNA, 20 bp, Artificial Sequence
  Synthetic oligonucleotide; AGG chr11 5165931 5165950 5165947 +
cttttgagccaggatgagcc

SEQ ID NO: 2275 - DNA, 20 bp, Artificial Sequence
  Synthetic oligonucleotide; GAG chr11 5165933 5165952 5165949 +
tttgagccaggatgagccag

SEQ ID NO: 2276 - DNA, 20 bp, Artificial Sequence
  Synthetic oligonucleotide; AAG chr11 5165936 5165955 5165952 +
gagccaggatgagccaggag

SEQ ID NO: 2277 - DNA, 20 bp, Artificial Sequence
  Synthetic oligonucleotide; AGG chr11 5165937 5165956 5165953 +
agccaggatgagccaggaga

SEQ ID NO: 2278 - DNA, 20 bp, Artificial Sequence
  Synthetic oligonucleotide; AAG chr11 5165948 5165967 5165964 +
gccaggagaaggaatttcac

SEQ ID NO: 2279 - DNA, 20 bp, Artificial Sequence
  Synthetic oligonucleotide; CAG chr11 5165961 5165980 5165977 +
atttcacaagacaatgtcat

SEQ ID NO: 2280 - DNA, 20 bp, Artificial Sequence
  Synthetic oligonucleotide; AAG chr11 5165966 5165985 5165982 +
acaagacaatgtcatcagtt

SEQ ID NO: 2281 - DNA, 20 bp, Artificial Sequence
  Synthetic oligonucleotide; AGG chr11 5165967 5165986 5165983 +
caagacaatgtcatcagtta

SEQ ID NO: 2282 - DNA, 20 bp, Artificial Sequence
  Synthetic oligonucleotide; CAG chr11 5165970 5165989 5165986 +
gacaatgtcatcagttaagg

SEQ ID NO: 2283 - DNA, 20 bp, Artificial Sequence
  Synthetic oligonucleotide; AGG chr11 5165971 5165990 5165987 +
acaatgtcatcagttaaggc

SEQ ID NO: 2284 - DNA, 20 bp, Artificial Sequence
  Synthetic oligonucleotide; CAG chr11 5165976 5165995 5165992 +
gtcatcagttaaggcaggaa

SEQ ID NO: 2285 - DNA, 20 bp, Artificial Sequence
  Synthetic oligonucleotide; AGG chr11 5165977 5165996 5165993 +
tcatcagttaaggcaggaac

SEQ ID NO: 2286 - DNA, 20 bp, Artificial Sequence
  Synthetic oligonucleotide; TGG chr11 5165998 5166017 5166014 +
ggccattttcacttcttttg

SEQ ID NO: 2287 - DNA, 20 bp, Artificial Sequence
  Synthetic oligonucleotide; TGG chr11 5166001 5166020 5166017 +
cattttcacttcttttgtgg

SEQ ID NO: 2288 - DNA, 20 bp, Artificial Sequence
  Synthetic oligonucleotide; CAG chr11 5166012 5166031 5166028 +
cttttgtggtggaatgtcat

SEQ ID NO: 2289 - DNA, 20 bp, Artificial Sequence
  Synthetic oligonucleotide; AAG chr11 5166017 5166036 5166033 +
gtggtggaatgtcatcagtt

SEQ ID NO: 2290 - DNA, 20 bp, Artificial Sequence
  Synthetic oligonucleotide; AGG chr11 5166018 5166037 5166034 +
tggtggaatgtcatcagtta

SEQ ID NO: 2291 - DNA, 20 bp, Artificial Sequence
  Synthetic oligonucleotide; CAG chr11 5166021 5166040 5166037 +
tggaatgtcatcagttaagg

SEQ ID NO: 2292 - DNA, 20 bp, Artificial Sequence
  Synthetic oligonucleotide; TGG chr11 5166028 5166047 5166044 +
tcatcagttaaggcagaaac

SEQ ID NO: 2293 - DNA, 20 bp, Artificial Sequence
  Synthetic oligonucleotide; CAG chr11 5166050 5166069 5166066 +
gccatctgtatgtgtatatg

SEQ ID NO: 2294 - DNA, 20 bp, Artificial Sequence
  Synthetic oligonucleotide; AGG chr11 5166051 5166070 5166067 +
ccatctgtatgtgtatatgc

SEQ ID NO: 2295 - DNA, 20 bp, Artificial Sequence
  Synthetic oligonucleotide; CAG chr11 5166057 5166076 5166073 +
gtatgtgtatatgcaggtca

SEQ ID NO: 2296 - DNA, 20 bp, Artificial Sequence
  Synthetic oligonucleotide; AGG chr11 5166058 5166077 5166074 +
tatgtgtatatgcaggtcac

SEQ ID NO: 2297 - DNA, 20 bp, Artificial Sequence
  Synthetic oligonucleotide; GGG chr11 5166059 5166078 5166075 +
atgtgtatatgcaggtcaca

SEQ ID NO: 2298 - DNA, 20 bp, Artificial Sequence
  Synthetic oligonucleotide; GGG chr11 5166060 5166079 5166076 +
tgtgtatatgcaggtcacag

SEQ ID NO: 2299 - DNA, 20 bp, Artificial Sequence
  Synthetic oligonucleotide; TGG chr11 5166069 5166088 5166085 +
gcaggtcacaggggacatga

SEQ ID NO: 2300 - DNA, 20 bp, Artificial Sequence
  Synthetic oligonucleotide; TAG chr11 5166074 5166093 5166090 +
tcacaggggacatgatggct

SEQ ID NO: 2301 - DNA, 20 bp, Artificial Sequence
  Synthetic oligonucleotide; TGG chr11 5166079 5166098 5166095 +
ggggacatgatggcttagct

SEQ ID NO: 2302 - DNA, 20 bp, Artificial Sequence
  Synthetic oligonucleotide; GGG chr11 5166080 5166099 5166096 +
gggacatgatggcttagctt

SEQ ID NO: 2303 - DNA, 20 bp, Artificial Sequence
  Synthetic oligonucleotide; CAG chr11 5166085 5166104 5166101 +
atgatggcttagcttgggct

SEQ ID NO: 2304 - DNA, 20 bp, Artificial Sequence
  Synthetic oligonucleotide; GAG chr11 5166087 5166106 5166103 +
gatggcttagcttgggctca

SEQ ID NO: 2305 - DNA, 20 bp, Artificial Sequence
  Synthetic oligonucleotide; AGG chr11 5166088 5166107 5166104 +
atggcttagcttgggctcag

SEQ ID NO: 2306 - DNA, 20 bp, Artificial Sequence
  Synthetic oligonucleotide; CAG chr11 5166100 5166119 5166116 +
gggctcagaggcctgacatt

SEQ ID NO: 2307 - DNA, 20 bp, Artificial Sequence
  Synthetic oligonucleotide; AGG chr11 5166101 5166120 5166117 +
ggctcagaggcctgacattc

SEQ ID NO: 2308 - DNA, 20 bp, Artificial Sequence
  Synthetic oligonucleotide; GAG chr11 5166103 5166122 5166119 +
ctcagaggcctgacattcag

SEQ ID NO: 2309 - DNA, 20 bp, Artificial Sequence
  Synthetic oligonucleotide; TAG chr11 5166166 5166185 5166182 +
atcttcttgttattcatttc

SEQ ID NO: 2310 - DNA, 20 bp, Artificial Sequence
  Synthetic oligonucleotide; TGG chr11 5166182 5166201 5166198 +
tttctagttttattccactg

SEQ ID NO: 2311 - DNA, 20 bp, Artificial Sequence
  Synthetic oligonucleotide; CAG chr11 5166186 5166205 5166202 +
tagttttattccactgtggt

SEQ ID NO: 2312 - DNA, 20 bp, Artificial Sequence
  Synthetic oligonucleotide; TGG chr11 5166243 5166262 5166259 +
atttgtacaaacttaccttg

SEQ ID NO: 2313 - DNA, 20 bp, Artificial Sequence
  Synthetic oligonucleotide; TGG chr11 5166255 5166274 5166271 +
ttaccttgtggcctaacata

SEQ ID NO: 2314 - DNA, 20 bp, Artificial Sequence
  Synthetic oligonucleotide; TAG chr11 5166265 5166284 5166281 +
gcctaacatatggccttatt

SEQ ID NO: 2315 - DNA, 20 bp, Artificial Sequence
  Synthetic oligonucleotide; AGG chr11 5166266 5166285 5166282 +
cctaacatatggccttattt

SEQ ID NO: 2316 - DNA, 20 bp, Artificial Sequence
  Synthetic oligonucleotide; AAG chr11 5166292 5166311 5166308 +
atgttgtacatgctgcttta

SEQ ID NO: 2317 - DNA, 20 bp, Artificial Sequence
  Synthetic oligonucleotide; CAG chr11 5166309 5166328 5166325 +
ttaaagaaatgtatcttctt

SEQ ID NO: 2318 - DNA, 20 bp, Artificial Sequence
  Synthetic oligonucleotide; CAG chr11 5166312 5166331 5166328 +
aagaaatgtatcttcttcag

SEQ ID NO: 2319 - DNA, 20 bp, Artificial Sequence
  Synthetic oligonucleotide; TGG chr11 5166316 5166335 5166332 +
aatgtatcttcttcagcagt

SEQ ID NO: 2320 - DNA, 20 bp, Artificial Sequence
  Synthetic oligonucleotide; GGG chr11 5166317 5166336 5166333 +
atgtatcttcttcagcagtt

SEQ ID NO: 2321 - DNA, 20 bp, Artificial Sequence
  Synthetic oligonucleotide; GGG chr11 5166318 5166337 5166334 +
tgtatcttcttcagcagttg

SEQ ID NO: 2322 - DNA, 20 bp, Artificial Sequence
  Synthetic oligonucleotide; GGG chr11 5166319 5166338 5166335 +
gtatcttcttcagcagttgg

SEQ ID NO: 2323 - DNA, 20 bp, Artificial Sequence
  Synthetic oligonucleotide; AAG chr11 5166324 5166343 5166340 +
ttcttcagcagttgggggac

SEQ ID NO: 2324 - DNA, 20 bp, Artificial Sequence
  Synthetic oligonucleotide; CAG chr11 5166339 5166358 5166355 +
gggacaagttctgttaatgt

SEQ ID NO: 2325 - DNA, 20 bp, Artificial Sequence
  Synthetic oligonucleotide; TGG chr11 5166343 5166362 5166359 +
caagttctgttaatgtcagt

SEQ ID NO: 2326 - DNA, 20 bp, Artificial Sequence
  Synthetic oligonucleotide; GGG chr11 5166344 5166363 5166360 +
aagttctgttaatgtcagtt

SEQ ID NO: 2327 - DNA, 20 bp, Artificial Sequence
  Synthetic oligonucleotide; TAG chr11 5166352 5166371 5166368 +
ttaatgtcagttgggtctat

SEQ ID NO: 2328 - DNA, 20 bp, Artificial Sequence
  Synthetic oligonucleotide; TAG chr11 5166358 5166377 5166374 +
tcagttgggtctattagata

SEQ ID NO: 2329 - DNA, 20 bp, Artificial Sequence
  Synthetic oligonucleotide; TGG chr11 5166361 5166380 5166377 +
gttgggtctattagatatag

SEQ ID NO: 2330 - DNA, 20 bp, Artificial Sequence
  Synthetic oligonucleotide; GGG chr11 5166362 5166381 5166378 +
ttgggtctattagatatagt

SEQ ID NO: 2331 - DNA, 20 bp, Artificial Sequence
  Synthetic oligonucleotide; TAG chr11 5166397 5166416 5166413 +
gttgttcatttgttgatttt

SEQ ID NO: 2332 - DNA, 20 bp, Artificial Sequence
  Synthetic oligonucleotide; TGG chr11 5166402 5166421 5166418 +
tcatttgttgatttttagtc

SEQ ID NO: 2333 - DNA, 20 bp, Artificial Sequence
  Synthetic oligonucleotide; GAG chr11 5166422 5166441 5166438 +
tggccgatctgttcattact

SEQ ID NO: 2334 - DNA, 20 bp, Artificial Sequence
  Synthetic oligonucleotide; AAG chr11 5166429 5166448 5166445 +
tctgttcattactgagactg

SEQ ID NO: 2335 - DNA, 20 bp, Artificial Sequence
  Synthetic oligonucleotide; AAG chr11 5166438 5166457 5166454 +
tactgagactgaagtgttta

SEQ ID NO: 2336 - DNA, 20 bp, Artificial Sequence
  Synthetic oligonucleotide; CAG chr11 5166462 5166481 5166478 +
tccctactattattgtattg

SEQ ID NO: 2337 - DNA, 20 bp, Artificial Sequence
  Synthetic oligonucleotide; TAG chr11 5166479 5166498 5166495 +
ttgcagtctgtctcgccctt

SEQ ID NO: 2338 - DNA, 20 bp, Artificial Sequence
  Synthetic oligonucleotide; AGG chr11 5166480 5166499 5166496 +
tgcagtctgtctcgcccttt

SEQ ID NO: 2339 - DNA, 20 bp, Artificial Sequence
  Synthetic oligonucleotide; TGG chr11 5166508 5166527 5166524 +
taatgttttccttatatact

SEQ ID NO: 2340 - DNA, 20 bp, Artificial Sequence
  Synthetic oligonucleotide; GGG chr11 5166509 5166528 5166525 +
aatgttttccttatatactt

SEQ ID NO: 2341 - DNA, 20 bp, Artificial Sequence
  Synthetic oligonucleotide; TGG chr11 5166523 5166542 5166539 +
atacttgggaactttgatgt

SEQ ID NO: 2342 - DNA, 20 bp, Artificial Sequence
  Synthetic oligonucleotide; CAG chr11 5166582 5166601 5166598 +
ttgacccctttattattata

SEQ ID NO: 2343 - DNA, 20 bp, Artificial Sequence
  Synthetic oligonucleotide; CAG chr11 5166607 5166626 5166623 +
accctccttatcttttctta

SEQ ID NO: 2344 - DNA, 20 bp, Artificial Sequence
  Synthetic oligonucleotide; TAG chr11 5166622 5166641 5166638 +
tcttacagtttttaaatttg

SEQ ID NO: 2345 - DNA, 20 bp, Artificial Sequence
  Synthetic oligonucleotide; AAG chr11 5166642 5166661 5166658 +
tagtctattttatctgattt

SEQ ID NO: 2346 - DNA, 20 bp, Artificial Sequence
  Synthetic oligonucleotide; TGG chr11 5166666 5166685 5166682 +
acaattactactgctctttc

SEQ ID NO: 2347 - DNA, 20 bp, Artificial Sequence
  Synthetic oligonucleotide; CAG chr11 5166673 5166692 5166689 +
ctactgctctttctggtttc

SEQ ID NO: 2348 - DNA, 20 bp, Artificial Sequence
  Synthetic oligonucleotide; TGG chr11 5166680 5166699 5166696 +
tctttctggtttccagttca

SEQ ID NO: 2349 - DNA, 20 bp, Artificial Sequence
  Synthetic oligonucleotide; TAG chr11 5166725 5166744 5166741 +
ttcatttatgtgtgccttta

SEQ ID NO: 2350 - DNA, 20 bp, Artificial Sequence
  Synthetic oligonucleotide; AGG chr11 5166726 5166745 5166742 +
tcatttatgtgtgcctttat

SEQ ID NO: 2351 - DNA, 20 bp, Artificial Sequence
  Synthetic oligonucleotide; AAG chr11 5166731 5166750 5166747 +
tatgtgtgcctttataggtg

SEQ ID NO: 2352 - DNA, 20 bp, Artificial Sequence
  Synthetic oligonucleotide; TGG chr11 5166734 5166753 5166750 +
gtgtgcctttataggtgaag

SEQ ID NO: 2353 - DNA, 20 bp, Artificial Sequence
  Synthetic oligonucleotide; GGG chr11 5166735 5166754 5166751 +
tgtgcctttataggtgaagt

SEQ ID NO: 2354 - DNA, 20 bp, Artificial Sequence
  Synthetic oligonucleotide; AAG chr11 5166745 5166764 5166761 +
taggtgaagtgggtttcttg

SEQ ID NO: 2355 - DNA, 20 bp, Artificial Sequence
  Synthetic oligonucleotide; AAG chr11 5166756 5166775 5166772 +
ggtttcttgaagatcgcata

SEQ ID NO: 2356 - DNA, 20 bp, Artificial Sequence
  Synthetic oligonucleotide; TGG chr11 5166760 5166779 5166776 +
tcttgaagatcgcataaagt

SEQ ID NO: 2357 - DNA, 20 bp, Artificial Sequence
  Synthetic oligonucleotide; TGG chr11 5166804 5166823 5166820 +
accattctattacttttaat

SEQ ID NO: 2358 - DNA, 20 bp, Artificial Sequence
  Synthetic oligonucleotide; GGG chr11 5166805 5166824 5166821 +
ccattctattacttttaatt

SEQ ID NO: 2359 - DNA, 20 bp, Artificial Sequence
  Synthetic oligonucleotide; GGG chr11 5166806 5166825 5166822 +
cattctattacttttaattg

SEQ ID NO: 2360 - DNA, 20 bp, Artificial Sequence
  Synthetic oligonucleotide; GAG chr11 5166813 5166832 5166829 +
ttacttttaattggggaact

SEQ ID NO: 2361 - DNA, 20 bp, Artificial Sequence
  Synthetic oligonucleotide; CAG chr11 5166828 5166847 5166844 +
gaactgagactatttacact

SEQ ID NO: 2362 - DNA, 20 bp, Artificial Sequence
  Synthetic oligonucleotide; TAG chr11 5166833 5166852 5166849 +
gagactatttacactcagtg

SEQ ID NO: 2363 - DNA, 20 bp, Artificial Sequence
  Synthetic oligonucleotide; AAG chr11 5166841 5166860 5166857 +
ttacactcagtgtagttact

SEQ ID NO: 2364 - DNA, 20 bp, Artificial Sequence
  Synthetic oligonucleotide; AAG chr11 5166845 5166864 5166861 +
actcagtgtagttactaagt

SEQ ID NO: 2365 - DNA, 20 bp, Artificial Sequence
  Synthetic oligonucleotide; AGG chr11 5166846 5166865 5166862 +
ctcagtgtagttactaagta

SEQ ID NO: 2366 - DNA, 20 bp, Artificial Sequence
  Synthetic oligonucleotide; TGG chr11 5166889 5166908 5166905 +
tttttttttttgcttatttt

SEQ ID NO: 2367 - DNA, 20 bp, Artificial Sequence
  Synthetic oligonucleotide; TGG chr11 5166897 5166916 5166913 +
tttgcttatttttggctgta

SEQ ID NO: 2368 - DNA, 20 bp, Artificial Sequence
  Synthetic oligonucleotide; GAG chr11 5166899 5166918 5166915 +
tgcttatttttggctgtatg

SEQ ID NO: 2369 - DNA, 20 bp, Artificial Sequence
  Synthetic oligonucleotide; TGG chr11 5166929 5166948 5166945 +
tcttccttttttttccttca

SEQ ID NO: 2370 - DNA, 20 bp, Artificial Sequence
  Synthetic oligonucleotide; TGG chr11 5166947 5166966 5166963 +
catggttatgtgattatctc

SEQ ID NO: 2371 - DNA, 20 bp, Artificial Sequence
  Synthetic oligonucleotide; TAG chr11 5166950 5166969 5166966 +
ggttatgtgattatctctgg

SEQ ID NO: 2372 - DNA, 20 bp, Artificial Sequence
  Synthetic oligonucleotide; TAG chr11 5166981 5167000 5166997 +
aatttgttactttttatttt

SEQ ID NO: 2373 - DNA, 20 bp, Artificial Sequence
  Synthetic oligonucleotide; TAG chr11 5166995 5167014 5167011 +
tatttttagtaaatctatta

SEQ ID NO: 2374 - DNA, 20 bp, Artificial Sequence
  Synthetic oligonucleotide; TGG chr11 5167010 5167029 5167026 +
tattatagatttttgtgctg

SEQ ID NO: 2375 - DNA, 20 bp, Artificial Sequence
  Synthetic oligonucleotide; TGG chr11 5167019 5167038 5167035 +
tttttgtgctgtggttacca

SEQ ID NO: 2376 - DNA, 20 bp, Artificial Sequence
  Synthetic oligonucleotide; GGG chr11 5167020 5167039 5167036 +
ttttgtgctgtggttaccat

SEQ ID NO: 2377 - DNA, 20 bp, Artificial Sequence
  Synthetic oligonucleotide; GGG chr11 5167021 5167040 5167037 +
tttgtgctgtggttaccatg

SEQ ID NO: 2378 - DNA, 20 bp, Artificial Sequence
  Synthetic oligonucleotide; AAG chr11 5167029 5167048 5167045 +
gtggttaccatggggcttac

SEQ ID NO: 2379 - DNA, 20 bp, Artificial Sequence
  Synthetic oligonucleotide; TAG chr11 5167048 5167067 5167064 +
caagaaacatcttataaata

SEQ ID NO: 2380 - DNA, 20 bp, Artificial Sequence
  Synthetic oligonucleotide; AAG chr11 5167052 5167071 5167068 +
aaacatcttataaatatagc

SEQ ID NO: 2381 - DNA, 20 bp, Artificial Sequence
  Synthetic oligonucleotide; AAG chr11 5167063 5167082 5167079 +
aaatatagcaagttatttta

SEQ ID NO: 2382 - DNA, 20 bp, Artificial Sequence
  Synthetic oligonucleotide; AGG chr11 5167064 5167083 5167080 +
aatatagcaagttattttaa

SEQ ID NO: 2383 - DNA, 20 bp, Artificial Sequence
  Synthetic oligonucleotide; TAG chr11 5167081 5167100 5167097 +
taaaggatgacgaattatct

SEQ ID NO: 2384 - DNA, 20 bp, Artificial Sequence
  Synthetic oligonucleotide; AAG chr11 5167094 5167113 5167110 +
attatcttagatcgcaaata

SEQ ID NO: 2385 - DNA, 20 bp, Artificial Sequence
  Synthetic oligonucleotide; AGG chr11 5167095 5167114 5167111 +
ttatcttagatcgcaaataa

SEQ ID NO: 2386 - DNA, 20 bp, Artificial Sequence
  Synthetic oligonucleotide; AAG chr11 5167107 5167126 5167123 +
gcaaataaaggaatataaac

SEQ ID NO: 2387 - DNA, 20 bp, Artificial Sequence
  Synthetic oligonucleotide; AGG chr11 5167108 5167127 5167124 +
caaataaaggaatataaaca

SEQ ID NO: 2388 - DNA, 20 bp, Artificial Sequence
  Synthetic oligonucleotide; GGG chr11 5167109 5167128 5167125 +
aaataaaggaatataaacaa

SEQ ID NO: 2389 - DNA, 20 bp, Artificial Sequence
  Synthetic oligonucleotide; CAG chr11 5167118 5167137 5167134 +
aatataaacaagggcaaaaa

SEQ ID NO: 2390 - DNA, 20 bp, Artificial Sequence
  Synthetic oligonucleotide; AGG chr11 5167119 5167138 5167135 +
atataaacaagggcaaaaac

SEQ ID NO: 2391 - DNA, 20 bp, Artificial Sequence
  Synthetic oligonucleotide; AAG chr11 5167209 5167228 5167225 +
ttatattacctacatcttaa

SEQ ID NO: 2392 - DNA, 20 bp, Artificial Sequence
  Synthetic oligonucleotide; AGG chr11 5167210 5167229 5167226 +
tatattacctacatcttaaa

SEQ ID NO: 2393 - DNA, 20 bp, Artificial Sequence
  Synthetic oligonucleotide; TAG chr11 5167219 5167238 5167235 +
tacatcttaaaaggttgcta

SEQ ID NO: 2394 - DNA, 20 bp, Artificial Sequence
  Synthetic oligonucleotide; AAG chr11 5167238 5167257 5167254 +
atagctattactgtttttga

SEQ ID NO: 2395 - DNA, 20 bp, Artificial Sequence
  Synthetic oligonucleotide; TGG chr11 5167251 5167270 5167267 +
tttttgaaagatttgttttt

SEQ ID NO: 2396 - DNA, 20 bp, Artificial Sequence
  Synthetic oligonucleotide; GGG chr11 5167252 5167271 5167268 +
ttttgaaagatttgtttttt

SEQ ID NO: 2397 - DNA, 20 bp, Artificial Sequence
  Synthetic oligonucleotide; TGG chr11 5167263 5167282 5167279 +
ttgttttttgggtttcatac

SEQ ID NO: 2398 - DNA, 20 bp, Artificial Sequence
  Synthetic oligonucleotide; GAG chr11 5167265 5167284 5167281 +
gttttttgggtttcatactg

SEQ ID NO: 2399 - DNA, 20 bp, Artificial Sequence
  Synthetic oligonucleotide; TGG chr11 5167275 5167294 5167291 +
tttcatactggagttctgtg

SEQ ID NO: 2400 - DNA, 20 bp, Artificial Sequence
  Synthetic oligonucleotide; CAG chr11 5167296 5167315 5167312 +
ggattgcacaccaaaaaata

SEQ ID NO: 2401 - DNA, 20 bp, Artificial Sequence
  Synthetic oligonucleotide; TGG chr11 5167302 5167321 5167318 +
cacaccaaaaaatacagtaa

SEQ ID NO: 2402 - DNA, 20 bp, Artificial Sequence
  Synthetic oligonucleotide; GGG chr11 5167303 5167322 5167319 +
acaccaaaaaatacagtaat

SEQ ID NO: 2403 - DNA, 20 bp, Artificial Sequence
  Synthetic oligonucleotide; GGG chr11 5167304 5167323 5167320 +
caccaaaaaatacagtaatg

SEQ ID NO: 2404 - DNA, 20 bp, Artificial Sequence
  Synthetic oligonucleotide; TAG chr11 5167312 5167331 5167328 +
aatacagtaatggggtattc

SEQ ID NO: 2405 - DNA, 20 bp, Artificial Sequence
  Synthetic oligonucleotide; AGG chr11 5167313 5167332 5167329 +
atacagtaatggggtattct

SEQ ID NO: 2406 - DNA, 20 bp, Artificial Sequence
  Synthetic oligonucleotide; CAG chr11 5167339 5167358 5167355 +
gtctatgtacttaattttac

SEQ ID NO: 2407 - DNA, 20 bp, Artificial Sequence
  Synthetic oligonucleotide; TGG chr11 5167342 5167361 5167358 +
tatgtacttaattttaccag

SEQ ID NO: 2408 - DNA, 20 bp, Artificial Sequence
  Synthetic oligonucleotide; GGG chr11 5167343 5167362 5167359 +
atgtacttaattttaccagt

SEQ ID NO: 2409 - DNA, 20 bp, Artificial Sequence
  Synthetic oligonucleotide; AAG chr11 5167360 5167379 5167376 +
agtgggtttcatactttgaa

SEQ ID NO: 2410 - DNA, 20 bp, Artificial Sequence
  Synthetic oligonucleotide; CAG chr11 5167395 5167414 5167411 +
tgttaatgtcttttttcttt

SEQ ID NO: 2411 - DNA, 20 bp, Artificial Sequence
  Synthetic oligonucleotide; TAG chr11 5167414 5167433 5167430 +
tcagattgcataactccctt

SEQ ID NO: 2412 - DNA, 20 bp, Artificial Sequence
  Synthetic oligonucleotide; AAG chr11 5167427 5167446 5167443 +
ctccctttagcattttttgc

SEQ ID NO: 2413 - DNA, 20 bp, Artificial Sequence
  Synthetic oligonucleotide; TGG chr11 5167431 5167450 5167447 +
ctttagcattttttgcaaga

SEQ ID NO: 2414 - DNA, 20 bp, Artificial Sequence
  Synthetic oligonucleotide; TGG chr11 5167436 5167455 5167452 +
gcattttttgcaagatggtc

SEQ ID NO: 2415 - DNA, 20 bp, Artificial Sequence
  Synthetic oligonucleotide; TGG chr11 5167442 5167461 5167458 +
tttgcaagatggtctggtgt

SEQ ID NO: 2416 - DNA, 20 bp, Artificial Sequence
  Synthetic oligonucleotide; TGG chr11 5167470 5167489 5167486 +
tctctcaacttttgtttgtc

SEQ ID NO: 2417 - DNA, 20 bp, Artificial Sequence
  Synthetic oligonucleotide; GGG chr11 5167471 5167490 5167487 +
ctctcaacttttgtttgtct

SEQ ID NO: 2418 - DNA, 20 bp, Artificial Sequence
  Synthetic oligonucleotide; AAG chr11 5167475 5167494 5167491 +
caacttttgtttgtctggga

SEQ ID NO: 2419 - DNA, 20 bp, Artificial Sequence
  Synthetic oligonucleotide; CAG chr11 5167506 5167525 5167522 +
tattgcttatatttgaataa

SEQ ID NO: 2420 - DNA, 20 bp, Artificial Sequence
  Synthetic oligonucleotide; CAG chr11 5167537 5167556 5167553 +
tataaaatattcttgaatat

SEQ ID NO: 2421 - DNA, 20 bp, Artificial Sequence
  Synthetic oligonucleotide; GAG chr11 5167555 5167574 5167571 +
atcagttttcttttatccct

SEQ ID NO: 2422 - DNA, 20 bp, Artificial Sequence
  Synthetic oligonucleotide; TGG chr11 5167587 5167606 5167603 +
aatttcattcgactctctct

SEQ ID NO: 2423 - DNA, 20 bp, Artificial Sequence
  Synthetic oligonucleotide; GAG chr11 5167607 5167626 5167623 +
tggactgtgtgatttctatt

SEQ ID NO: 2424 - DNA, 20 bp, Artificial Sequence
  Synthetic oligonucleotide; CAG chr11 5167623 5167642 5167639 +
tattgagatgtttgttgtca

SEQ ID NO: 2425 - DNA, 20 bp, Artificial Sequence
  Synthetic oligonucleotide; AGG chr11 5167624 5167643 5167640 +
attgagatgtttgttgtcac

SEQ ID NO: 2426 - DNA, 20 bp, Artificial Sequence
  Synthetic oligonucleotide; TGG chr11 5167630 5167649 5167646 +
atgtttgttgtcacaggatt

SEQ ID NO: 2427 - DNA, 20 bp, Artificial Sequence
  Synthetic oligonucleotide; GAG chr11 5167632 5167651 5167648 +
gtttgttgtcacaggatttg

SEQ ID NO: 2428 - DNA, 20 bp, Artificial Sequence
  Synthetic oligonucleotide; TAG chr11 5167674 5167693 5167690 +
tttctcatctcttctgcttt

SEQ ID NO: 2429 - DNA, 20 bp, Artificial Sequence
  Synthetic oligonucleotide; AGG chr11 5167675 5167694 5167691 +
ttctcatctcttctgctttt

SEQ ID NO: 2430 - DNA, 20 bp, Artificial Sequence
  Synthetic oligonucleotide; TGG chr11 5167707 5167726 5167723 +
ttgtccttgacctgatgtct

SEQ ID NO: 2431 - DNA, 20 bp, Artificial Sequence
  Synthetic oligonucleotide; TAG chr11 5167712 5167731 5167728 +
cttgacctgatgtcttggcg

SEQ ID NO: 2432 - DNA, 20 bp, Artificial Sequence
  Synthetic oligonucleotide; TAG chr11 5167729 5167748 5167745 +
gcgtagtactctactatatc

SEQ ID NO: 2433 - DNA, 20 bp, Artificial Sequence
  Synthetic oligonucleotide; AGG chr11 5167730 5167749 5167746 +
cgtagtactctactatatct

SEQ ID NO: 2434 - DNA, 20 bp, Artificial Sequence
  Synthetic oligonucleotide; TAG chr11 5167741 5167760 5167757 +
actatatctaggactacact

SEQ ID NO: 2435 - DNA, 20 bp, Artificial Sequence
  Synthetic oligonucleotide; TAG chr11 5167767 5167786 5167783 +
gaataatatgtaataaaaca

SEQ ID NO: 2436 - DNA, 20 bp, Artificial Sequence
  Synthetic oligonucleotide; AAG chr11 5167771 5167790 5167787 +
aatatgtaataaaacatagt

SEQ ID NO: 2437 - DNA, 20 bp, Artificial Sequence
  Synthetic oligonucleotide; AAG chr11 5167776 5167795 5167792 +
gtaataaaacatagtaagtg

SEQ ID NO: 2438 - DNA, 20 bp, Artificial Sequence
  Synthetic oligonucleotide; AAG chr11 5167781 5167800 5167797 +
aaaacatagtaagtgaagtg

SEQ ID NO: 2439 - DNA, 20 bp, Artificial Sequence
  Synthetic oligonucleotide; TGG chr11 5167788 5167807 5167804 +
agtaagtgaagtgaagttgc

SEQ ID NO: 2440 - DNA, 20 bp, Artificial Sequence
  Synthetic oligonucleotide; AAG chr11 5167797 5167816 5167813 +
agtgaagttgctggcttaaa

SEQ ID NO: 2441 - DNA, 20 bp, Artificial Sequence
  Synthetic oligonucleotide; AAG chr11 5167814 5167833 5167830 +
aaaaagtatttatttattgt

SEQ ID NO: 2442 - DNA, 20 bp, Artificial Sequence
  Synthetic oligonucleotide; AAG chr11 5167820 5167839 5167836 +
tatttatttattgtaagcat

SEQ ID NO: 2443 - DNA, 20 bp, Artificial Sequence
  Synthetic oligonucleotide; TAG chr11 5167844 5167863 5167860 +
aaatttgaccgatgtaatct

SEQ ID NO: 2444 - DNA, 20 bp, Artificial Sequence
  Synthetic oligonucleotide; TAG chr11 5167851 5167870 5167867 +
accgatgtaatcttagatga

SEQ ID NO: 2445 - DNA, 20 bp, Artificial Sequence
  Synthetic oligonucleotide; AAG chr11 5167860 5167879 5167876 +
atcttagatgatagttctaa

SEQ ID NO: 2446 - DNA, 20 bp, Artificial Sequence
  Synthetic oligonucleotide; TGG chr11 5167866 5167885 5167882 +
gatgatagttctaaaagtgt

SEQ ID NO: 2447 - DNA, 20 bp, Artificial Sequence
  Synthetic oligonucleotide; GAG chr11 5167871 5167890 5167887 +
tagttctaaaagtgttggtt

SEQ ID NO: 2448 - DNA, 20 bp, Artificial Sequence
  Synthetic oligonucleotide; AGG chr11 5167872 5167891 5167888 +
agttctaaaagtgttggttg

SEQ ID NO: 2449 - DNA, 20 bp, Artificial Sequence
  Synthetic oligonucleotide; AAG chr11 5167875 5167894 5167891 +
tctaaaagtgttggttgagg

SEQ ID NO: 2450 - DNA, 20 bp, Artificial Sequence
  Synthetic oligonucleotide; TAG chr11 5167878 5167897 5167894 +
aaaagtgttggttgaggaag

SEQ ID NO: 2451 - DNA, 20 bp, Artificial Sequence
  Synthetic oligonucleotide; AAG chr11 5167881 5167900 5167897 +
agtgttggttgaggaagtag

SEQ ID NO: 2452 - DNA, 20 bp, Artificial Sequence
  Synthetic oligonucleotide; GAG chr11 5167883 5167902 5167899 +
tgttggttgaggaagtagaa

SEQ ID NO: 2453 - DNA, 20 bp, Artificial Sequence
  Synthetic oligonucleotide; CAG chr11 5167889 5167908 5167905 +
ttgaggaagtagaagagaat

SEQ ID NO: 2454 - DNA, 20 bp, Artificial Sequence
  Synthetic oligonucleotide; AAG chr11 5167897 5167916 5167913 +
gtagaagagaatcagtacct

SEQ ID NO: 2455 - DNA, 20 bp, Artificial Sequence
  Synthetic oligonucleotide; CAG chr11 5167900 5167919 5167916 +
gaagagaatcagtacctaag

SEQ ID NO: 2456 - DNA, 20 bp, Artificial Sequence
  Synthetic oligonucleotide; TGG chr11 5167914 5167933 5167930 +
cctaagcagttaaactaatg

SEQ ID NO: 2457 - DNA, 20 bp, Artificial Sequence
  Synthetic oligonucleotide; GGG chr11 5167915 5167934 5167931 +
ctaagcagttaaactaatgt

SEQ ID NO: 2458 - DNA, 20 bp, Artificial Sequence
  Synthetic oligonucleotide; AAG chr11 5167918 5167937 5167934 +
agcagttaaactaatgtggg

SEQ ID NO: 2459 - DNA, 20 bp, Artificial Sequence
  Synthetic oligonucleotide; AGG chr11 5167919 5167938 5167935 +
gcagttaaactaatgtggga

SEQ ID NO: 2460 - DNA, 20 bp, Artificial Sequence
  Synthetic oligonucleotide; AAG chr11 5167933 5167952 5167949 +
gtgggaaggccccttttata

SEQ ID NO: 2461 - DNA, 20 bp, Artificial Sequence
  Synthetic oligonucleotide; GAG chr11 5167944 5167963 5167960 +
ccttttataaagatcctctt

SEQ ID NO: 2462 - DNA, 20 bp, Artificial Sequence
  Synthetic oligonucleotide; TAG chr11 5167982 5168001 5167998 +
tattaatatatgactataat

SEQ ID NO: 2463 - DNA, 20 bp, Artificial Sequence
  Synthetic oligonucleotide; GAG chr11 5167984 5168003 5168000 +
ttaatatatgactataatta

SEQ ID NO: 2464 - DNA, 20 bp, Artificial Sequence
  Synthetic oligonucleotide; AGG chr11 5167985 5168004 5168001 +
taatatatgactataattag

SEQ ID NO: 2465 - DNA, 20 bp, Artificial Sequence
  Synthetic oligonucleotide; CAG chr11 5167991 5168010 5168007 +
atgactataattagaggaaa

SEQ ID NO: 2466 - DNA, 20 bp, Artificial Sequence
  Synthetic oligonucleotide; GAG chr11 5167993 5168012 5168009 +
gactataattagaggaaaca

SEQ ID NO: 2467 - DNA, 20 bp, Artificial Sequence
  Synthetic oligonucleotide; AGG chr11 5167994 5168013 5168010 +
actataattagaggaaacag

SEQ ID NO: 2468 - DNA, 20 bp, Artificial Sequence
  Synthetic oligonucleotide; GAG chr11 5167998 5168017 5168014 +
taattagaggaaacagaggt

SEQ ID NO: 2469 - DNA, 20 bp, Artificial Sequence
  Synthetic oligonucleotide; AAG chr11 5168025 5168044 5168041 +
ttttgtcctcatgaatctca

SEQ ID NO: 2470 - DNA, 20 bp, Artificial Sequence
  Synthetic oligonucleotide; AGG chr11 5168026 5168045 5168042 +
tttgtcctcatgaatctcaa

SEQ ID NO: 2471 - DNA, 20 bp, Artificial Sequence
  Synthetic oligonucleotide; GAG chr11 5168028 5168047 5168044 +
tgtcctcatgaatctcaaag

SEQ ID NO: 2472 - DNA, 20 bp, Artificial Sequence
  Synthetic oligonucleotide; TGG chr11 5168035 5168054 5168051 +
atgaatctcaaaggagaaaa

SEQ ID NO: 2473 - DNA, 20 bp, Artificial Sequence
  Synthetic oligonucleotide; CAG chr11 5168042 5168061 5168058 +
tcaaaggagaaaatggttta

SEQ ID NO: 2474 - DNA, 20 bp, Artificial Sequence
  Synthetic oligonucleotide; TGG chr11 5168052 5168071 5168068 +
aaatggtttacagaattgct

SEQ ID NO: 2475 - DNA, 20 bp, Artificial Sequence
  Synthetic oligonucleotide; CAG chr11 5168062 5168081 5168078 +
cagaattgcttggtgttctt

SEQ ID NO: 2476 - DNA, 20 bp, Artificial Sequence
  Synthetic oligonucleotide; AAG chr11 5168077 5168096 5168093 +
ttcttcagattccaatttta

SEQ ID NO: 2477 - DNA, 20 bp, Artificial Sequence
  Synthetic oligonucleotide; AAG chr11 5168095 5168114 5168111 +
taaagtcaaatctgaatttt

SEQ ID NO: 2478 - DNA, 20 bp, Artificial Sequence
  Synthetic oligonucleotide; TGG chr11 5168101 5168120 5168117 +
caaatctgaattttaagtta

SEQ ID NO: 2479 - DNA, 20 bp, Artificial Sequence
  Synthetic oligonucleotide; GGG chr11 5168102 5168121 5168118 +
aaatctgaattttaagttat

SEQ ID NO: 2480 - DNA, 20 bp, Artificial Sequence
  Synthetic oligonucleotide; TGG chr11 5168118 5168137 5168134 +
ttatgggaccactgataata

SEQ ID NO: 2481 - DNA, 20 bp, Artificial Sequence
  Synthetic oligonucleotide; TGG chr11 5168121 5168140 5168137 +
tgggaccactgataatatgg

SEQ ID NO: 2482 - DNA, 20 bp, Artificial Sequence
  Synthetic oligonucleotide; GGG chr11 5168122 5168141 5168138 +
gggaccactgataatatggt

SEQ ID NO: 2483 - DNA, 20 bp, Artificial Sequence
  Synthetic oligonucleotide; AAG chr11 5168128 5168147 5168144 +
actgataatatggtgggcta

SEQ ID NO: 2484 - DNA, 20 bp, Artificial Sequence
  Synthetic oligonucleotide; CAG chr11 5168134 5168153 5168150 +
aatatggtgggctaaagaat

SEQ ID NO: 2485 - DNA, 20 bp, Artificial Sequence
  Synthetic oligonucleotide; AGG chr11 5168135 5168154 5168151 +
atatggtgggctaaagaatc

SEQ ID NO: 2486 - DNA, 20 bp, Artificial Sequence
  Synthetic oligonucleotide; TAG chr11 5168142 5168161 5168158 +
gggctaaagaatcaggtttt

SEQ ID NO: 2487 - DNA, 20 bp, Artificial Sequence
  Synthetic oligonucleotide; TGG chr11 5168146 5168165 5168162 +
taaagaatcaggtttttagt

SEQ ID NO: 2488 - DNA, 20 bp, Artificial Sequence
  Synthetic oligonucleotide; TGG chr11 5168155 5168174 5168171 +
aggtttttagttggattgtc

SEQ ID NO: 2489 - DNA, 20 bp, Artificial Sequence
  Synthetic oligonucleotide; GAG chr11 5168162 5168181 5168178 +
tagttggattgtctggtttt

SEQ ID NO: 2490 - DNA, 20 bp, Artificial Sequence
  Synthetic oligonucleotide; TGG chr11 5168197 5168216 5168213 +
cacttattaactctttgact

SEQ ID NO: 2491 - DNA, 20 bp, Artificial Sequence
  Synthetic oligonucleotide; GGG chr11 5168198 5168217 5168214 +
acttattaactctttgactt

SEQ ID NO: 2492 - DNA, 20 bp, Artificial Sequence
  Synthetic oligonucleotide; GGG chr11 5168199 5168218 5168215 +
cttattaactctttgacttg

SEQ ID NO: 2493 - DNA, 20 bp, Artificial Sequence
  Synthetic oligonucleotide; TAG chr11 5168250 5168269 5168266 +
gtttctacatttgtaacatg

SEQ ID NO: 2494 - DNA, 20 bp, Artificial Sequence
  Synthetic oligonucleotide; TGG chr11 5168286 5168305 5168302 +
ttcttcatatatttgttccg

SEQ ID NO: 2495 - DNA, 20 bp, Artificial Sequence
  Synthetic oligonucleotide; TAG chr11 5168318 5168337 5168334 +
actaatctatataaatcact

SEQ ID NO: 2496 - DNA, 20 bp, Artificial Sequence
  Synthetic oligonucleotide; TGG chr11 5168323 5168342 5168339 +
tctatataaatcacttagta

SEQ ID NO: 2497 - DNA, 20 bp, Artificial Sequence
  Synthetic oligonucleotide; TAG chr11 5168333 5168352 5168349 +
tcacttagtatggtacacta

SEQ ID NO: 2498 - DNA, 20 bp, Artificial Sequence
  Synthetic oligonucleotide; CAG chr11 5168343 5168362 5168359 +
tggtacactatagctcgtga

SEQ ID NO: 2499 - DNA, 20 bp, Artificial Sequence
  Synthetic oligonucleotide; GAG chr11 5168345 5168364 5168361 +
gtacactatagctcgtgaca

SEQ ID NO: 2500 - DNA, 20 bp, Artificial Sequence
  Synthetic oligonucleotide; GAG chr11 5168377 5168396 5168393 +
actttaatttttatgtactt

SEQ ID NO: 2501 - DNA, 20 bp, Artificial Sequence
  Synthetic oligonucleotide; TAG chr11 5168388 5168407 5168404 +
tatgtacttgagtttaaaat

SEQ ID NO: 2502 - DNA, 20 bp, Artificial Sequence
  Synthetic oligonucleotide; TAG chr11 5168395 5168414 5168411 +
ttgagtttaaaattagcatt

SEQ ID NO: 2503 - DNA, 20 bp, Artificial Sequence
  Synthetic oligonucleotide; GAG chr11 5168397 5168416 5168413 +
gagtttaaaattagcattta

SEQ ID NO: 2504 - DNA, 20 bp, Artificial Sequence
  Synthetic oligonucleotide; GAG chr11 5168399 5168418 5168415 +
gtttaaaattagcatttaga

SEQ ID NO: 2505 - DNA, 20 bp, Artificial Sequence
  Synthetic oligonucleotide; CAG chr11 5168407 5168426 5168423 +
ttagcatttagagagactgt

SEQ ID NO: 2506 - DNA, 20 bp, Artificial Sequence
  Synthetic oligonucleotide; AGG chr11 5168408 5168427 5168424 +
tagcatttagagagactgtc

SEQ ID NO: 2507 - DNA, 20 bp, Artificial Sequence
  Synthetic oligonucleotide; TAG chr11 5168444 5168463 5168460 +
gactgtgtattcacgtattg

SEQ ID NO: 2508 - DNA, 20 bp, Artificial Sequence
  Synthetic oligonucleotide; CAG chr11 5168448 5168467 5168464 +
gtgtattcacgtattgtagt

SEQ ID NO: 2509 - DNA, 20 bp, Artificial Sequence
  Synthetic oligonucleotide; TGG chr11 5168454 5168473 5168470 +
tcacgtattgtagtcagatt

SEQ ID NO: 2510 - DNA, 20 bp, Artificial Sequence
  Synthetic oligonucleotide; AAG chr11 5168462 5168481 5168478 +
tgtagtcagatttggtgaaa

SEQ ID NO: 2511 - DNA, 20 bp, Artificial Sequence
  Synthetic oligonucleotide; GAG chr11 5168495 5168514 5168511 +
ataaaatataattacttatt

SEQ ID NO: 2512 - DNA, 20 bp, Artificial Sequence
  Synthetic oligonucleotide; TAG chr11 5168508 5168527 5168524 +
acttattgagcaaattttac

SEQ ID NO: 2513 - DNA, 20 bp, Artificial Sequence
  Synthetic oligonucleotide; AGG chr11 5168509 5168528 5168525 +
cttattgagcaaattttact

SEQ ID NO: 2514 - DNA, 20 bp, Artificial Sequence
  Synthetic oligonucleotide; AAG chr11 5168555 5168574 5168571 +
caccatttcatttaatcttc

SEQ ID NO: 2515 - DNA, 20 bp, Artificial Sequence
  Synthetic oligonucleotide; AAG chr11 5168565 5168584 5168581 +
tttaatcttcaagatcataa

SEQ ID NO: 2516 - DNA, 20 bp, Artificial Sequence
  Synthetic oligonucleotide; TGG chr11 5168569 5168588 5168585 +
atcttcaagatcataaaagc

SEQ ID NO: 2517 - DNA, 20 bp, Artificial Sequence
  Synthetic oligonucleotide; CAG chr11 5168617 5168636 5168633 +
atgaataaattatattcaaa

SEQ ID NO: 2518 - DNA, 20 bp, Artificial Sequence
  Synthetic oligonucleotide; AGG chr11 5168618 5168637 5168634 +
tgaataaattatattcaaac

SEQ ID NO: 2519 - DNA, 20 bp, Artificial Sequence
  Synthetic oligonucleotide; TAG chr11 5168630 5168649 5168646 +
attcaaacaggtcatactac

SEQ ID NO: 2520 - DNA, 20 bp, Artificial Sequence
  Synthetic oligonucleotide; AAG chr11 5168634 5168653 5168650 +
aaacaggtcatactactagc

SEQ ID NO: 2521 - DNA, 20 bp, Artificial Sequence
  Synthetic oligonucleotide; TAG chr11 5168653 5168672 5168669 +
caagatcccacaattactaa

SEQ ID NO: 2522 - DNA, 20 bp, Artificial Sequence
  Synthetic oligonucleotide; AAG chr11 5168657 5168676 5168673 +
atcccacaattactaatagc

SEQ ID NO: 2523 - DNA, 20 bp, Artificial Sequence
  Synthetic oligonucleotide; TAG chr11 5168661 5168680 5168677 +
cacaattactaatagcaaga

SEQ ID NO: 2524 - DNA, 20 bp, Artificial Sequence
  Synthetic oligonucleotide; AAG chr11 5168666 5168685 5168682 +
ttactaatagcaagatagct

SEQ ID NO: 2525 - DNA, 20 bp, Artificial Sequence
  Synthetic oligonucleotide; TAG chr11 5168678 5168697 5168694 +
agatagctaagatttcaacc

SEQ ID NO: 2526 - DNA, 20 bp, Artificial Sequence
  Synthetic oligonucleotide; AGG chr11 5168679 5168698 5168695 +
gatagctaagatttcaacct

SEQ ID NO: 2527 - DNA, 20 bp, Artificial Sequence
  Synthetic oligonucleotide; TGG chr11 5168688 5168707 5168704 +
gatttcaacctaggtacatc

SEQ ID NO: 2528 - DNA, 20 bp, Artificial Sequence
  Synthetic oligonucleotide; AAG chr11 5168694 5168713 5168710 +
aacctaggtacatctggttc

SEQ ID NO: 2529 - DNA, 20 bp, Artificial Sequence
  Synthetic oligonucleotide; GAG chr11 5168713 5168732 5168729 +
caagtgtataacatcacact

SEQ ID NO: 2530 - DNA, 20 bp, Artificial Sequence
  Synthetic oligonucleotide; AGG chr11 5168714 5168733 5168730 +
aagtgtataacatcacactg

SEQ ID NO: 2531 - DNA, 20 bp, Artificial Sequence
  Synthetic oligonucleotide; TGG chr11 5168720 5168739 5168736 +
ataacatcacactgaggact

SEQ ID NO: 2532 - DNA, 20 bp, Artificial Sequence
  Synthetic oligonucleotide; TGG chr11 5168727 5168746 5168743 +
cacactgaggacttggctct

SEQ ID NO: 2533 - DNA, 20 bp, Artificial Sequence
  Synthetic oligonucleotide; GGG chr11 5168728 5168747 5168744 +
acactgaggacttggctctt

SEQ ID NO: 2534 - DNA, 20 bp, Artificial Sequence
  Synthetic oligonucleotide; AAG chr11 5168736 5168755 5168752 +
gacttggctcttgggtgtac

SEQ ID NO: 2535 - DNA, 20 bp, Artificial Sequence
  Synthetic oligonucleotide; AAG chr11 5168762 5168781 5168778 +
tccattgtgtgaacttgata

SEQ ID NO: 2536 - DNA, 20 bp, Artificial Sequence
  Synthetic oligonucleotide; TAG chr11 5168782 5168801 5168798 +
aagttacaaaaattatctct

SEQ ID NO: 2537 - DNA, 20 bp, Artificial Sequence
  Synthetic oligonucleotide; AAG chr11 5168803 5168822 5168819 +
agttttttcatgtataccat

SEQ ID NO: 2538 - DNA, 20 bp, Artificial Sequence
  Synthetic oligonucleotide; TAG chr11 5168808 5168827 5168824 +
tttcatgtataccataagaa

SEQ ID NO: 2539 - DNA, 20 bp, Artificial Sequence
  Synthetic oligonucleotide; CAG chr11 5168816 5168835 5168832 +
ataccataagaatagtaata

SEQ ID NO: 2540 - DNA, 20 bp, Artificial Sequence
  Synthetic oligonucleotide; AGG chr11 5168817 5168836 5168833 +
taccataagaatagtaatac

SEQ ID NO: 2541 - DNA, 20 bp, Artificial Sequence
  Synthetic oligonucleotide; TGG chr11 5168827 5168846 5168843 +
atagtaatacaggactgtaa

SEQ ID NO: 2542 - DNA, 20 bp, Artificial Sequence
  Synthetic oligonucleotide; GAG chr11 5168829 5168848 5168845 +
agtaatacaggactgtaatg

SEQ ID NO: 2543 - DNA, 20 bp, Artificial Sequence
  Synthetic oligonucleotide; AGG chr11 5168830 5168849 5168846 +
gtaatacaggactgtaatgg

SEQ ID NO: 2544 - DNA, 20 bp, Artificial Sequence
  Synthetic oligonucleotide; AAG chr11 5168851 5168870 5168867 +
ggttaccaataattattgtt

SEQ ID NO: 2545 - DNA, 20 bp, Artificial Sequence
  Synthetic oligonucleotide; AGG chr11 5168852 5168871 5168868 +
gttaccaataattattgtta

SEQ ID NO: 2546 - DNA, 20 bp, Artificial Sequence
  Synthetic oligonucleotide; AAG chr11 5168855 5168874 5168871 +
accaataattattgttaagg

SEQ ID NO: 2547 - DNA, 20 bp, Artificial Sequence
  Synthetic oligonucleotide; AGG chr11 5168856 5168875 5168872 +
ccaataattattgttaagga

SEQ ID NO: 2548 - DNA, 20 bp, Artificial Sequence
  Synthetic oligonucleotide; GGG chr11 5168857 5168876 5168873 +
caataattattgttaaggaa

SEQ ID NO: 2549 - DNA, 20 bp, Artificial Sequence
  Synthetic oligonucleotide; GAG chr11 5168883 5168902 5168899 +
ctaaattactctgaaatttt

SEQ ID NO: 2550 - DNA, 20 bp, Artificial Sequence
  Synthetic oligonucleotide; AAG chr11 5168942 5168961 5168958 +
cactacattgaacactttca

SEQ ID NO: 2551 - DNA, 20 bp, Artificial Sequence
  Synthetic oligonucleotide; AGG chr11 5168943 5168962 5168959 +
actacattgaacactttcaa

SEQ ID NO: 2552 - DNA, 20 bp, Artificial Sequence
  Synthetic oligonucleotide; AAG chr11 5168970 5168989 5168986 +
tcatacattaaaaatttttt

SEQ ID NO: 2553 - DNA, 20 bp, Artificial Sequence
  Synthetic oligonucleotide; GAG chr11 5168989 5169008 5169005 +
taagtccataaattaatttc

SEQ ID NO: 2554 - DNA, 20 bp, Artificial Sequence
  Synthetic oligonucleotide; AGG chr11 5168990 5169009 5169006 +
aagtccataaattaatttcg

SEQ ID NO: 2555 - DNA, 20 bp, Artificial Sequence
  Synthetic oligonucleotide; CAG chr11 5168997 5169016 5169013 +
taaattaatttcgaggaaaa

SEQ ID NO: 2556 - DNA, 20 bp, Artificial Sequence
  Synthetic oligonucleotide; TAG chr11 5169063 5169082 5169079 +
tatttgaccaaaccttctat

SEQ ID NO: 2557 - DNA, 20 bp, Artificial Sequence
  Synthetic oligonucleotide; TGG chr11 5169071 5169090 5169087 +
caaaccttctattagttact

SEQ ID NO: 2558 - DNA, 20 bp, Artificial Sequence
  Synthetic oligonucleotide; TGG chr11 5169075 5169094 5169091 +
ccttctattagttacttggt

SEQ ID NO: 2559 - DNA, 20 bp, Artificial Sequence
  Synthetic oligonucleotide; AAG chr11 5169091 5169110 5169107 +
tggttggctgataatcactc

SEQ ID NO: 2560 - DNA, 20 bp, Artificial Sequence
  Synthetic oligonucleotide; TGG chr11 5169100 5169119 5169116 +
gataatcactcaagactgtg

SEQ ID NO: 2561 - DNA, 20 bp, Artificial Sequence
  Synthetic oligonucleotide; TAG chr11 5169108 5169127 5169124 +
ctcaagactgtgtggtttaa

SEQ ID NO: 2562 - DNA, 20 bp, Artificial Sequence
  Synthetic oligonucleotide; AGG chr11 5169109 5169128 5169125 +
tcaagactgtgtggtttaat

SEQ ID NO: 2563 - DNA, 20 bp, Artificial Sequence
  Synthetic oligonucleotide; TGG chr11 5169122 5169141 5169138 +
gtttaataggatattcactg

SEQ ID NO: 2564 - DNA, 20 bp, Artificial Sequence
  Synthetic oligonucleotide; TGG chr11 5169129 5169148 5169145 +
aggatattcactgtggttca

SEQ ID NO: 2565 - DNA, 20 bp, Artificial Sequence
  Synthetic oligonucleotide; AAG chr11 5169149 5169168 5169165 +
tggaaattcaaaattatctg

SEQ ID NO: 2566 - DNA, 20 bp, Artificial Sequence
  Synthetic oligonucleotide; AAG chr11 5169160 5169179 5169176 +
aattatctgaagaaaacaaa

SEQ ID NO: 2567 - DNA, 20 bp, Artificial Sequence
  Synthetic oligonucleotide; TGG chr11 5169164 5169183 5169180 +
atctgaagaaaacaaaaagt

SEQ ID NO: 2568 - DNA, 20 bp, Artificial Sequence
  Synthetic oligonucleotide; GGG chr11 5169165 5169184 5169181 +
tctgaagaaaacaaaaagtt

SEQ ID NO: 2569 - DNA, 20 bp, Artificial Sequence
  Synthetic oligonucleotide; GAG chr11 5169185 5169204 5169201 +
gggctctgcaatccctgtct

SEQ ID NO: 2570 - DNA, 20 bp, Artificial Sequence
  Synthetic oligonucleotide; AGG chr11 5169186 5169205 5169202 +
ggctctgcaatccctgtctg

SEQ ID NO: 2571 - DNA, 20 bp, Artificial Sequence
  Synthetic oligonucleotide; GGG chr11 5169187 5169206 5169203 +
gctctgcaatccctgtctga

SEQ ID NO: 2572 - DNA, 20 bp, Artificial Sequence
  Synthetic oligonucleotide; TAG chr11 5169196 5169215 5169212 +
tccctgtctgagggattttc

SEQ ID NO: 2573 - DNA, 20 bp, Artificial Sequence
  Synthetic oligonucleotide; TGG chr11 5169207 5169226 5169223 +
gggattttctagaattcttc

SEQ ID NO: 2574 - DNA, 20 bp, Artificial Sequence
  Synthetic oligonucleotide; CAG chr11 5169232 5169251 5169248 +
ctccctacctttttgtttgt

SEQ ID NO: 2575 - DNA, 20 bp, Artificial Sequence
  Synthetic oligonucleotide; AAG chr11 5169235 5169254 5169251 +
cctacctttttgtttgtcag

SEQ ID NO: 2576 - DNA, 20 bp, Artificial Sequence
  Synthetic oligonucleotide; GAG chr11 5169251 5169270 5169267 +
tcagaagcttgtctactacc

SEQ ID NO: 2577 - DNA, 20 bp, Artificial Sequence
  Synthetic oligonucleotide; AAG chr11 5169269 5169288 5169285 +
ccgagtgattgatgtcacca

SEQ ID NO: 2578 - DNA, 20 bp, Artificial Sequence
  Synthetic oligonucleotide; CAG chr11 5169279 5169298 5169295 +
gatgtcaccaaagactattg

SEQ ID NO: 2579 - DNA, 20 bp, Artificial Sequence
  Synthetic oligonucleotide; AGG chr11 5169280 5169299 5169296 +
atgtcaccaaagactattgc

SEQ ID NO: 2580 - DNA, 20 bp, Artificial Sequence
  Synthetic oligonucleotide; GAG chr11 5169282 5169301 5169298 +
gtcaccaaagactattgcag

SEQ ID NO: 2581 - DNA, 20 bp, Artificial Sequence
  Synthetic oligonucleotide; TAG chr11 5169285 5169304 5169301 +
accaaagactattgcaggag

SEQ ID NO: 2582 - DNA, 20 bp, Artificial Sequence
  Synthetic oligonucleotide; AGG chr11 5169286 5169305 5169302 +
ccaaagactattgcaggagt

SEQ ID NO: 2583 - DNA, 20 bp, Artificial Sequence
  Synthetic oligonucleotide; TAG chr11 5169308 5169327 5169324 +
gccttgctttttctgttttt

SEQ ID NO: 2584 - DNA, 20 bp, Artificial Sequence
  Synthetic oligonucleotide; CAG chr11 5169327 5169346 5169343 +
ttagttattttcttctaaaa

SEQ ID NO: 2585 - DNA, 20 bp, Artificial Sequence
  Synthetic oligonucleotide; AAG chr11 5169337 5169356 5169353 +
tcttctaaaacagtattttc

SEQ ID NO: 2586 - DNA, 20 bp, Artificial Sequence
  Synthetic oligonucleotide; TAG chr11 5169340 5169359 5169356 +
tctaaaacagtattttcaag

SEQ ID NO: 2587 - DNA, 20 bp, Artificial Sequence
  Synthetic oligonucleotide; TGG chr11 5169346 5169365 5169362 +
acagtattttcaagtagttg

SEQ ID NO: 2588 - DNA, 20 bp, Artificial Sequence
  Synthetic oligonucleotide; TAG chr11 5169362 5169381 5169378 +
gttgtggttttttttctttc

SEQ ID NO: 2589 - DNA, 20 bp, Artificial Sequence
  Synthetic oligonucleotide; TAG chr11 5169388 5169407 5169404 +
tgaactcattaaaaataaaa

SEQ ID NO: 2590 - DNA, 20 bp, Artificial Sequence
  Synthetic oligonucleotide; AAG chr11 5169398 5169417 5169414 +
aaaaataaaatagctttcta

SEQ ID NO: 2591 - DNA, 20 bp, Artificial Sequence
  Synthetic oligonucleotide; CAG chr11 5169406 5169425 5169422 +
aatagctttctaaagccaaa

SEQ ID NO: 2592 - DNA, 20 bp, Artificial Sequence
  Synthetic oligonucleotide; CAG chr11 5169421 5169440 5169437 +
ccaaacagtttcctcctgac

SEQ ID NO: 2593 - DNA, 20 bp, Artificial Sequence
  Synthetic oligonucleotide; AAG chr11 5169428 5169447 5169444 +
gtttcctcctgaccagttaa

SEQ ID NO: 2594 - DNA, 20 bp, Artificial Sequence
  Synthetic oligonucleotide; TGG chr11 5169445 5169464 5169461 +
taaaagttatctctgcttca

SEQ ID NO: 2595 - DNA, 20 bp, Artificial Sequence
  Synthetic oligonucleotide; AAG chr11 5169461 5169480 5169477 +
ttcatggtgcatattcaatt

SEQ ID NO: 2596 - DNA, 20 bp, Artificial Sequence
  Synthetic oligonucleotide; TAG chr11 5169473 5169492 5169489 +
attcaattaagatttaacat

SEQ ID NO: 2597 - DNA, 20 bp, Artificial Sequence
  Synthetic oligonucleotide; GAG chr11 5169482 5169501 5169498 +
agatttaacattagcacact

SEQ ID NO: 2598 - DNA, 20 bp, Artificial Sequence
  Synthetic oligonucleotide; AAG chr11 5169497 5169516 5169513 +
acactgagtataattttttt

SEQ ID NO: 2599 - DNA, 20 bp, Artificial Sequence
  Synthetic oligonucleotide; CAG chr11 5169513 5169532 5169529 +
ttttaagaatctttttatta

SEQ ID NO: 2600 - DNA, 20 bp, Artificial Sequence
  Synthetic oligonucleotide; AAG chr11 5169533 5169552 5169549 +
cagaaattgtaaactacaca

SEQ ID NO: 2601 - DNA, 20 bp, Artificial Sequence
  Synthetic oligonucleotide; CAG chr11 5169540 5169559 5169556 +
tgtaaactacacaaagtaaa

SEQ ID NO: 2602 - DNA, 20 bp, Artificial Sequence
  Synthetic oligonucleotide; CAG chr11 5169561 5169580 5169577 +
agaatattataattaatttc

SEQ ID NO: 2603 - DNA, 20 bp, Artificial Sequence
  Synthetic oligonucleotide; AGG chr11 5169562 5169581 5169578 +
gaatattataattaatttcc

SEQ ID NO: 2604 - DNA, 20 bp, Artificial Sequence
  Synthetic oligonucleotide; CAG chr11 5169692 5169711 5169708 +
tttttgttattattatcatt

SEQ ID NO: 2605 - DNA, 20 bp, Artificial Sequence
  Synthetic oligonucleotide; AAG chr11 5169695 5169714 5169711 +
ttgttattattatcattcag

SEQ ID NO: 2606 - DNA, 20 bp, Artificial Sequence
  Synthetic oligonucleotide; TAG chr11 5169721 5169740 5169737 +
tgatgtaaaattgatgtacc

SEQ ID NO: 2607 - DNA, 20 bp, Artificial Sequence
  Synthetic oligonucleotide; TAG chr11 5169738 5169757 5169754 +
acctagaaatgtgcaaatct

SEQ ID NO: 2608 - DNA, 20 bp, Artificial Sequence
  Synthetic oligonucleotide; CAG chr11 5169812 5169831 5169828 +
acaaaatatttccatctccc

SEQ ID NO: 2609 - DNA, 20 bp, Artificial Sequence
  Synthetic oligonucleotide; CAG chr11 5169859 5169878 5169875 +
tcttccatctttatatccat

SEQ ID NO: 2610 - DNA, 20 bp, Artificial Sequence
  Synthetic oligonucleotide; GAG chr11 5169861 5169880 5169877 +
ttccatctttatatccatca

SEQ ID NO: 2611 - DNA, 20 bp, Artificial Sequence
  Synthetic oligonucleotide; AGG chr11 5169862 5169881 5169878 +
tccatctttatatccatcag

SEQ ID NO: 2612 - DNA, 20 bp, Artificial Sequence
  Synthetic oligonucleotide; AAG chr11 5169866 5169885 5169882 +
tctttatatccatcagaggt

SEQ ID NO: 2613 - DNA, 20 bp, Artificial Sequence
  Synthetic oligonucleotide; CAG chr11 5169869 5169888 5169885 +
ttatatccatcagaggtaag

SEQ ID NO: 2614 - DNA, 20 bp, Artificial Sequence
  Synthetic oligonucleotide; AGG chr11 5169870 5169889 5169886 +
tatatccatcagaggtaagc

SEQ ID NO: 2615 - DNA, 20 bp, Artificial Sequence
  Synthetic oligonucleotide; GGG chr11 5169871 5169890 5169887 +
atatccatcagaggtaagca

SEQ ID NO: 2616 - DNA, 20 bp, Artificial Sequence
  Synthetic oligonucleotide; TAG chr11 5169896 5169915 5169912 +
ctgattttttgacattaaat

SEQ ID NO: 2617 - DNA, 20 bp, Artificial Sequence
  Synthetic oligonucleotide; AAG chr11 5169974 5169993 5169990 +
tcctgattattttccttcac

SEQ ID NO: 2618 - DNA, 20 bp, Artificial Sequence
  Synthetic oligonucleotide; CAG chr11 5170002 5170021 5170018 +
atcactaattttaatataac

SEQ ID NO: 2619 - DNA, 20 bp, Artificial Sequence
  Synthetic oligonucleotide; AAG chr11 5170021 5170040 5170037 +
ccagaaacttaaacctcccc

SEQ ID NO: 2620 - DNA, 20 bp, Artificial Sequence
  Synthetic oligonucleotide; CAG chr11 5170042 5170061 5170058 +
agactctttctacatattcc

SEQ ID NO: 2621 - DNA, 20 bp, Artificial Sequence
  Synthetic oligonucleotide; GAG chr11 5170064 5170083 5170080 +
gaaccaaatgtcactgaatt

SEQ ID NO: 2622 - DNA, 20 bp, Artificial Sequence
  Synthetic oligonucleotide; AAG chr11 5170072 5170091 5170088 +
tgtcactgaattgagtattc

SEQ ID NO: 2623 - DNA, 20 bp, Artificial Sequence
  Synthetic oligonucleotide; AGG chr11 5170073 5170092 5170089 +
gtcactgaattgagtattca

SEQ ID NO: 2624 - DNA, 20 bp, Artificial Sequence
  Synthetic oligonucleotide; CAG chr11 5170079 5170098 5170095 +
gaattgagtattcaaggatt

SEQ ID NO: 2625 - DNA, 20 bp, Artificial Sequence
  Synthetic oligonucleotide; AAG chr11 5170088 5170107 5170104 +
attcaaggattcagcacaca

SEQ ID NO: 2626 - DNA, 20 bp, Artificial Sequence
  Synthetic oligonucleotide; CAG chr11 5170102 5170121 5170118 +
cacacaaagtgtgtcatcac

SEQ ID NO: 2627 - DNA, 20 bp, Artificial Sequence
  Synthetic oligonucleotide; AGG chr11 5170103 5170122 5170119 +
acacaaagtgtgtcatcacc

SEQ ID NO: 2628 - DNA, 20 bp, Artificial Sequence
  Synthetic oligonucleotide; AAG chr11 5170109 5170128 5170125 +
agtgtgtcatcaccaggaca

SEQ ID NO: 2629 - DNA, 20 bp, Artificial Sequence
  Synthetic oligonucleotide; CAG chr11 5170146 5170165 5170162 +
ctcctcccacaattttattt

SEQ ID NO: 2630 - DNA, 20 bp, Artificial Sequence
  Synthetic oligonucleotide; GAG chr11 5170148 5170167 5170164 +
cctcccacaattttatttca

SEQ ID NO: 2631 - DNA, 20 bp, Artificial Sequence
  Synthetic oligonucleotide; CAG chr11 5170170 5170189 5170186 +
gtaatgccatttcctattct

SEQ ID NO: 2632 - DNA, 20 bp, Artificial Sequence
  Synthetic oligonucleotide; AGG chr11 5170171 5170190 5170187 +
taatgccatttcctattctc

SEQ ID NO: 2633 - DNA, 20 bp, Artificial Sequence
  Synthetic oligonucleotide; GGG chr11 5170172 5170191 5170188 +
aatgccatttcctattctca

SEQ ID NO: 2634 - DNA, 20 bp, Artificial Sequence
  Synthetic oligonucleotide; AAG chr11 5170217 5170236 5170233 +
tcttcatctacaaaatgtta

SEQ ID NO: 2635 - DNA, 20 bp, Artificial Sequence
  Synthetic oligonucleotide; AAG chr11 5170229 5170248 5170245 +
aaatgttaaagctcattaac

SEQ ID NO: 2636 - DNA, 20 bp, Artificial Sequence
  Synthetic oligonucleotide; AAG chr11 5170239 5170258 5170255 +
gctcattaacaagcaataat

SEQ ID NO: 2637 - DNA, 20 bp, Artificial Sequence
  Synthetic oligonucleotide; TGG chr11 5170245 5170264 5170261 +
taacaagcaataataagcca

SEQ ID NO: 2638 - DNA, 20 bp, Artificial Sequence
  Synthetic oligonucleotide; AAG chr11 5170265 5170284 5170281 +
tggaatttttcatatttgca

SEQ ID NO: 2639 - DNA, 20 bp, Artificial Sequence
  Synthetic oligonucleotide; CAG chr11 5170276 5170295 5170292 +
atatttgcaaagctaatatt

SEQ ID NO: 2640 - DNA, 20 bp, Artificial Sequence
  Synthetic oligonucleotide; AGG chr11 5170277 5170296 5170293 +
tatttgcaaagctaatattc

SEQ ID NO: 2641 - DNA, 20 bp, Artificial Sequence
  Synthetic oligonucleotide; AAG chr11 5170285 5170304 5170301 +
aagctaatattcaggtaata

SEQ ID NO: 2642 - DNA, 20 bp, Artificial Sequence
  Synthetic oligonucleotide; AAG chr11 5170296 5170315 5170312 +
caggtaataaagcctgatct

SEQ ID NO: 2643 - DNA, 20 bp, Artificial Sequence
  Synthetic oligonucleotide; CAG chr11 5170311 5170330 5170327 +
gatctaagtgcctgtgctgt

SEQ ID NO: 2644 - DNA, 20 bp, Artificial Sequence
  Synthetic oligonucleotide; AGG chr11 5170312 5170331 5170328 +
atctaagtgcctgtgctgtc

SEQ ID NO: 2645 - DNA, 20 bp, Artificial Sequence
  Synthetic oligonucleotide; GGG chr11 5170313 5170332 5170329 +
tctaagtgcctgtgctgtca

SEQ ID NO: 2646 - DNA, 20 bp, Artificial Sequence
  Synthetic oligonucleotide; CAG chr11 5170322 5170341 5170338 +
ctgtgctgtcagggtatctt

SEQ ID NO: 2647 - DNA, 20 bp, Artificial Sequence
  Synthetic oligonucleotide; TAG chr11 5170332 5170351 5170348 +
agggtatcttcagtctccat

SEQ ID NO: 2648 - DNA, 20 bp, Artificial Sequence
  Synthetic oligonucleotide; TGG chr11 5170351 5170370 5170367 +
ttagaactcacccctcttcc

SEQ ID NO: 2649 - DNA, 20 bp, Artificial Sequence
  Synthetic oligonucleotide; TAG chr11 5170355 5170374 5170371 +
aactcacccctcttcctgga

SEQ ID NO: 2650 - DNA, 20 bp, Artificial Sequence
  Synthetic oligonucleotide; AAG chr11 5170361 5170380 5170377 +
cccctcttcctggatagtgt

SEQ ID NO: 2651 - DNA, 20 bp, Artificial Sequence
  Synthetic oligonucleotide; TAG chr11 5170401 5170420 5170417 +
tttctttgattttgatacta

SEQ ID NO: 2652 - DNA, 20 bp, Artificial Sequence
  Synthetic oligonucleotide; TGG chr11 5170408 5170427 5170424 +
gattttgatactatagacaa

SEQ ID NO: 2653 - DNA, 20 bp, Artificial Sequence
  Synthetic oligonucleotide; GGG chr11 5170409 5170428 5170425 +
attttgatactatagacaat

SEQ ID NO: 2654 - DNA, 20 bp, Artificial Sequence
  Synthetic oligonucleotide; GGG chr11 5170410 5170429 5170426 +
ttttgatactatagacaatg

SEQ ID NO: 2655 - DNA, 20 bp, Artificial Sequence
  Synthetic oligonucleotide; CAG chr11 5170420 5170439 5170436 +
atagacaatggggttgacca

SEQ ID NO: 2656 - DNA, 20 bp, Artificial Sequence
  Synthetic oligonucleotide; AGG chr11 5170421 5170440 5170437 +
tagacaatggggttgaccac

SEQ ID NO: 2657 - DNA, 20 bp, Artificial Sequence
  Synthetic oligonucleotide; GAG chr11 5170423 5170442 5170439 +
gacaatggggttgaccacag

SEQ ID NO: 2658 - DNA, 20 bp, Artificial Sequence
  Synthetic oligonucleotide; AGG chr11 5170424 5170443 5170440 +
acaatggggttgaccacagg

SEQ ID NO: 2659 - DNA, 20 bp, Artificial Sequence
  Synthetic oligonucleotide; AAG chr11 5170431 5170450 5170447 +
ggttgaccacaggaggaaaa

SEQ ID NO: 2660 - DNA, 20 bp, Artificial Sequence
  Synthetic oligonucleotide; GAG chr11 5170433 5170452 5170449 +
ttgaccacaggaggaaaaaa

SEQ ID NO: 2661 - DNA, 20 bp, Artificial Sequence
  Synthetic oligonucleotide; AGG chr11 5170434 5170453 5170450 +
tgaccacaggaggaaaaaag

SEQ ID NO: 2662 - DNA, 20 bp, Artificial Sequence
  Synthetic oligonucleotide; AAG chr11 5170438 5170457 5170454 +
cacaggaggaaaaaagaggt

SEQ ID NO: 2663 - DNA, 20 bp, Artificial Sequence
  Synthetic oligonucleotide; TGG chr11 5170444 5170463 5170460 +
aggaaaaaagaggtaagcat

SEQ ID NO: 2664 - DNA, 20 bp, Artificial Sequence
  Synthetic oligonucleotide; CAG chr11 5170453 5170472 5170469 +
gaggtaagcattggccgtga

SEQ ID NO: 2665 - DNA, 20 bp, Artificial Sequence
  Synthetic oligonucleotide; TGG chr11 5170458 5170477 5170474 +
aagcattggccgtgacagtc

SEQ ID NO: 2666 - DNA, 20 bp, Artificial Sequence
  Synthetic oligonucleotide; AAG chr11 5170463 5170482 5170479 +
ttggccgtgacagtctggaa

SEQ ID NO: 2667 - DNA, 20 bp, Artificial Sequence
  Synthetic oligonucleotide; TGG chr11 5170466 5170485 5170482 +
gccgtgacagtctggaaaag

SEQ ID NO: 2668 - DNA, 20 bp, Artificial Sequence
  Synthetic oligonucleotide; GAG chr11 5170468 5170487 5170484 +
cgtgacagtctggaaaagtg

SEQ ID NO: 2669 - DNA, 20 bp, Artificial Sequence
  Synthetic oligonucleotide; AGG chr11 5170469 5170488 5170485 +
gtgacagtctggaaaagtgg

SEQ ID NO: 2670 - DNA, 20 bp, Artificial Sequence
  Synthetic oligonucleotide; AAG chr11 5170485 5170504 5170501 +
gtggaggtaaatgccgtcca

SEQ ID NO: 2671 - DNA, 20 bp, Artificial Sequence
  Synthetic oligonucleotide; CGG chr11 5170488 5170507 5170504 +
gaggtaaatgccgtccaaag

SEQ ID NO: 2672 - DNA, 20 bp, Artificial Sequence
  Synthetic oligonucleotide; CAG chr11 5170496 5170515 5170512 +
tgccgtccaaagcggtgcat

SEQ ID NO: 2673 - DNA, 20 bp, Artificial Sequence
  Synthetic oligonucleotide; AGG chr11 5170497 5170516 5170513 +
gccgtccaaagcggtgcatc

SEQ ID NO: 2674 - DNA, 20 bp, Artificial Sequence
  Synthetic oligonucleotide; GGG chr11 5170498 5170517 5170514 +
ccgtccaaagcggtgcatca

SEQ ID NO: 2675 - DNA, 20 bp, Artificial Sequence
  Synthetic oligonucleotide; GAG chr11 5170500 5170519 5170516 +
gtccaaagcggtgcatcagg

SEQ ID NO: 2676 - DNA, 20 bp, Artificial Sequence
  Synthetic oligonucleotide; GAG chr11 5170502 5170521 5170518 +
ccaaagcggtgcatcaggga

SEQ ID NO: 2677 - DNA, 20 bp, Artificial Sequence
  Synthetic oligonucleotide; AGG chr11 5170503 5170522 5170519 +
caaagcggtgcatcagggag

SEQ ID NO: 2678 - DNA, 20 bp, Artificial Sequence
  Synthetic oligonucleotide; TGG chr11 5170513 5170532 5170529 +
catcagggagaggctgatca

SEQ ID NO: 2679 - DNA, 20 bp, Artificial Sequence
  Synthetic oligonucleotide; GGG chr11 5170514 5170533 5170530 +
atcagggagaggctgatcat

SEQ ID NO: 2680 - DNA, 20 bp, Artificial Sequence
  Synthetic oligonucleotide; TAG chr11 5170521 5170540 5170537 +
agaggctgatcatgggcaca

SEQ ID NO: 2681 - DNA, 20 bp, Artificial Sequence
  Synthetic oligonucleotide; AAG chr11 5170529 5170548 5170545 +
atcatgggcacatagtacac

SEQ ID NO: 2682 - DNA, 20 bp, Artificial Sequence
  Synthetic oligonucleotide; CAG chr11 5170534 5170553 5170550 +
gggcacatagtacacaagca

SEQ ID NO: 2683 - DNA, 20 bp, Artificial Sequence
  Synthetic oligonucleotide; GAG chr11 5170562 5170581 5170578 +
atgtgcgacacacatgtgtt

SEQ ID NO: 2684 - DNA, 20 bp, Artificial Sequence
  Synthetic oligonucleotide; CAG chr11 5170585 5170604 5170601 +
tgcctgccaccgccctgctc

SEQ ID NO: 2685 - DNA, 20 bp, Artificial Sequence
  Synthetic oligonucleotide; AAG chr11 5170588 5170607 5170604 +
ctgccaccgccctgctccag

SEQ ID NO: 2686 - DNA, 20 bp, Artificial Sequence
  Synthetic oligonucleotide; CAG chr11 5170598 5170617 5170614 +
cctgctccagaagctatttc

SEQ ID NO: 2687 - DNA, 20 bp, Artificial Sequence
  Synthetic oligonucleotide; AAG chr11 5170610 5170629 5170626 +
gctatttccagtactgtatg

SEQ ID NO: 2688 - DNA, 20 bp, Artificial Sequence
  Synthetic oligonucleotide; CAG chr11 5170616 5170635 5170632 +
tccagtactgtatgaagaat

SEQ ID NO: 2689 - DNA, 20 bp, Artificial Sequence
  Synthetic oligonucleotide; AAG chr11 5170624 5170643 5170640 +
tgtatgaagaatcagcacat

SEQ ID NO: 2690 - DNA, 20 bp, Artificial Sequence
  Synthetic oligonucleotide; AAG chr11 5170644 5170663 5170660 +
aagaaaccacaatgaacaat

SEQ ID NO: 2691 - DNA, 20 bp, Artificial Sequence
  Synthetic oligonucleotide; CAG chr11 5170649 5170668 5170665 +
accacaatgaacaataagtc

SEQ ID NO: 2692 - DNA, 20 bp, Artificial Sequence
  Synthetic oligonucleotide; AAG chr11 5170662 5170681 5170678 +
ataagtccagtccaaatgtg

SEQ ID NO: 2693 - DNA, 20 bp, Artificial Sequence
  Synthetic oligonucleotide; AGG chr11 5170663 5170682 5170679 +
taagtccagtccaaatgtga

SEQ ID NO: 2694 - DNA, 20 bp, Artificial Sequence
  Synthetic oligonucleotide; TAG chr11 5170676 5170695 5170692 +
aatgtgaaggtaatgacaaa

SEQ ID NO: 2695 - DNA, 20 bp, Artificial Sequence
  Synthetic oligonucleotide; GAG chr11 5170678 5170697 5170694 +
tgtgaaggtaatgacaaata

SEQ ID NO: 2696 - DNA, 20 bp, Artificial Sequence
  Synthetic oligonucleotide; CAG chr11 5170682 5170701 5170698 +
aaggtaatgacaaatagagc

SEQ ID NO: 2697 - DNA, 20 bp, Artificial Sequence
  Synthetic oligonucleotide; AGG chr11 5170683 5170702 5170699 +
aggtaatgacaaatagagcc

SEQ ID NO: 2698 - DNA, 20 bp, Artificial Sequence
  Synthetic oligonucleotide; TGG chr11 5170693 5170712 5170709 +
aaatagagccaggatgctat

SEQ ID NO: 2699 - DNA, 20 bp, Artificial Sequence
  Synthetic oligonucleotide; GGG chr11 5170694 5170713 5170710 +
aatagagccaggatgctatt

SEQ ID NO: 2700 - DNA, 20 bp, Artificial Sequence
  Synthetic oligonucleotide; CAG chr11 5170710 5170729 5170726 +
tattgggacgtgtgtctcca

SEQ ID NO: 2701 - DNA, 20 bp, Artificial Sequence
  Synthetic oligonucleotide; AGG chr11 5170711 5170730 5170727 +
attgggacgtgtgtctccac

SEQ ID NO: 2702 - DNA, 20 bp, Artificial Sequence
  Synthetic oligonucleotide; GGG chr11 5170712 5170731 5170728 +
ttgggacgtgtgtctccaca

SEQ ID NO: 2703 - DNA, 20 bp, Artificial Sequence
  Synthetic oligonucleotide; CAG chr11 5170724 5170743 5170740 +
tctccacagggcaatttgat

SEQ ID NO: 2704 - DNA, 20 bp, Artificial Sequence
  Synthetic oligonucleotide; GAG chr11 5170731 5170750 5170747 +
agggcaatttgatcagatct

SEQ ID NO: 2705 - DNA, 20 bp, Artificial Sequence
  Synthetic oligonucleotide; TGG chr11 5170734 5170753 5170750 +
gcaatttgatcagatctgag

SEQ ID NO: 2706 - DNA, 20 bp, Artificial Sequence
  Synthetic oligonucleotide; GAG chr11 5170736 5170755 5170752 +
aatttgatcagatctgagtg

SEQ ID NO: 2707 - DNA, 20 bp, Artificial Sequence
  Synthetic oligonucleotide; AGG chr11 5170737 5170756 5170753 +
atttgatcagatctgagtgg

SEQ ID NO: 2708 - DNA, 20 bp, Artificial Sequence
  Synthetic oligonucleotide; AAG chr11 5170744 5170763 5170760 +
cagatctgagtggaggcaat

SEQ ID NO: 2709 - DNA, 20 bp, Artificial Sequence
  Synthetic oligonucleotide; GAG chr11 5170746 5170765 5170762 +
gatctgagtggaggcaataa

SEQ ID NO: 2710 - DNA, 20 bp, Artificial Sequence
  Synthetic oligonucleotide; GAG chr11 5170754 5170773 5170770 +
tggaggcaataagagtgtgt

SEQ ID NO: 2711 - DNA, 20 bp, Artificial Sequence
  Synthetic oligonucleotide; AGG chr11 5170755 5170774 5170771 +
ggaggcaataagagtgtgtg

SEQ ID NO: 2712 - DNA, 20 bp, Artificial Sequence
  Synthetic oligonucleotide; GGG chr11 5170756 5170775 5170772 +
gaggcaataagagtgtgtga

SEQ ID NO: 2713 - DNA, 20 bp, Artificial Sequence
  Synthetic oligonucleotide; TGG chr11 5170764 5170783 5170780 +
aagagtgtgtgagggtattg

SEQ ID NO: 2714 - DNA, 20 bp, Artificial Sequence
  Synthetic oligonucleotide; CAG chr11 5170770 5170789 5170786 +
gtgtgagggtattgtggcca

SEQ ID NO: 2715 - DNA, 20 bp, Artificial Sequence
  Synthetic oligonucleotide; AAG chr11 5170774 5170793 5170790 +
gagggtattgtggccacaga

SEQ ID NO: 2716 - DNA, 20 bp, Artificial Sequence
  Synthetic oligonucleotide; AGG chr11 5170775 5170794 5170791 +
agggtattgtggccacagaa

SEQ ID NO: 2717 - DNA, 20 bp, Artificial Sequence
  Synthetic oligonucleotide; CAG chr11 5170778 5170797 5170794 +
gtattgtggccacagaaagg

SEQ ID NO: 2718 - DNA, 20 bp, Artificial Sequence
  Synthetic oligonucleotide; CAG chr11 5170787 5170806 5170803 +
ccacagaaaggcagacgcct

SEQ ID NO: 2719 - DNA, 20 bp, Artificial Sequence
  Synthetic oligonucleotide; AGG chr11 5170788 5170807 5170804 +
cacagaaaggcagacgcctc

SEQ ID NO: 2720 - DNA, 20 bp, Artificial Sequence
  Synthetic oligonucleotide; GAG chr11 5170790 5170809 5170806 +
cagaaaggcagacgcctcag

SEQ ID NO: 2721 - DNA, 20 bp, Artificial Sequence
  Synthetic oligonucleotide; AAG chr11 5170794 5170813 5170810 +
aaggcagacgcctcaggaga

SEQ ID NO: 2722 - DNA, 20 bp, Artificial Sequence
  Synthetic oligonucleotide; GAG chr11 5170796 5170815 5170812 +
ggcagacgcctcaggagaaa

SEQ ID NO: 2723 - DNA, 20 bp, Artificial Sequence
  Synthetic oligonucleotide; CAG chr11 5170799 5170818 5170815 +
agacgcctcaggagaaagag

SEQ ID NO: 2724 - DNA, 20 bp, Artificial Sequence
  Synthetic oligonucleotide; TGG chr11 5170802 5170821 5170818 +
cgcctcaggagaaagagcag

SEQ ID NO: 2725 - DNA, 20 bp, Artificial Sequence
  Synthetic oligonucleotide; GGG chr11 5170803 5170822 5170819 +
gcctcaggagaaagagcagt

SEQ ID NO: 2726 - DNA, 20 bp, Artificial Sequence
  Synthetic oligonucleotide; GAG chr11 5170805 5170824 5170821 +
ctcaggagaaagagcagtgg

SEQ ID NO: 2727 - DNA, 20 bp, Artificial Sequence
  Synthetic oligonucleotide; AAG chr11 5170811 5170830 5170827 +
agaaagagcagtgggagcat

SEQ ID NO: 2728 - DNA, 20 bp, Artificial Sequence
  Synthetic oligonucleotide; AAG chr11 5170827 5170846 5170843 +
gcataagcattacactgcgc

SEQ ID NO: 2729 - DNA, 20 bp, Artificial Sequence
  Synthetic oligonucleotide; AGG chr11 5170828 5170847 5170844 +
cataagcattacactgcgca

SEQ ID NO: 2730 - DNA, 20 bp, Artificial Sequence
  Synthetic oligonucleotide; TGG chr11 5170834 5170853 5170850 +
cattacactgcgcaaggcaa

SEQ ID NO: 2731 - DNA, 20 bp, Artificial Sequence
  Synthetic oligonucleotide; CGG chr11 5170837 5170856 5170853 +
tacactgcgcaaggcaatgg

SEQ ID NO: 2732 - DNA, 20 bp, Artificial Sequence
  Synthetic oligonucleotide; CAG chr11 5170849 5170868 5170865 +
ggcaatggcggcacccgtcc

SEQ ID NO: 2733 - DNA, 20 bp, Artificial Sequence
  Synthetic oligonucleotide; CAG chr11 5170857 5170876 5170873 +
cggcacccgtcccagaaatg

SEQ ID NO: 2734 - DNA, 20 bp, Artificial Sequence
  Synthetic oligonucleotide; AGG chr11 5170858 5170877 5170874 +
ggcacccgtcccagaaatgc

SEQ ID NO: 2735 - DNA, 20 bp, Artificial Sequence
  Synthetic oligonucleotide; CAG chr11 5170868 5170887 5170884 +
ccagaaatgcaggcaattgt

SEQ ID NO: 2736 - DNA, 20 bp, Artificial Sequence
  Synthetic oligonucleotide; TGG chr11 5170873 5170892 5170889 +
aatgcaggcaattgtcagaa

SEQ ID NO: 2737 - DNA, 20 bp, Artificial Sequence
  Synthetic oligonucleotide; TAG chr11 5170881 5170900 5170897 +
caattgtcagaatggttgtg

SEQ ID NO: 2738 - DNA, 20 bp, Artificial Sequence
  Synthetic oligonucleotide; CAG chr11 5170886 5170905 5170902 +
gtcagaatggttgtgtagcg

SEQ ID NO: 2739 - DNA, 20 bp, Artificial Sequence
  Synthetic oligonucleotide; TGG chr11 5170889 5170908 5170905 +
agaatggttgtgtagcgcag

SEQ ID NO: 2740 - DNA, 20 bp, Artificial Sequence
  Synthetic oligonucleotide; GGG chr11 5170890 5170909 5170906 +
gaatggttgtgtagcgcagt

SEQ ID NO: 2741 - DNA, 20 bp, Artificial Sequence
  Synthetic oligonucleotide; TAG chr11 5170896 5170915 5170912 +
ttgtgtagcgcagtgggctg

SEQ ID NO: 2742 - DNA, 20 bp, Artificial Sequence
  Synthetic oligonucleotide; TGG chr11 5170900 5170919 5170916 +
gtagcgcagtgggctgtaga

SEQ ID NO: 2743 - DNA, 20 bp, Artificial Sequence
  Synthetic oligonucleotide; AAG chr11 5170908 5170927 5170924 +
gtgggctgtagatggccaca

SEQ ID NO: 2744 - DNA, 20 bp, Artificial Sequence
  Synthetic oligonucleotide; CGG chr11 5170911 5170930 5170927 +
ggctgtagatggccacaaag

SEQ ID NO: 2745 - DNA, 20 bp, Artificial Sequence
  Synthetic oligonucleotide; CAG chr11 5170928 5170947 5170944 +
aagcggtccactgacattgc

SEQ ID NO: 2746 - DNA, 20 bp, Artificial Sequence
  Synthetic oligonucleotide; AAG chr11 5170931 5170950 5170947 +
cggtccactgacattgccag

SEQ ID NO: 2747 - DNA, 20 bp, Artificial Sequence
  Synthetic oligonucleotide; AGG chr11 5170932 5170951 5170948 +
ggtccactgacattgccaga

SEQ ID NO: 2748 - DNA, 20 bp, Artificial Sequence
  Synthetic oligonucleotide; AAG chr11 5170949 5170968 5170965 +
agaaggacacctgactccat

SEQ ID NO: 2749 - DNA, 20 bp, Artificial Sequence
  Synthetic oligonucleotide; GAG chr11 5170951 5170970 5170967 +
aaggacacctgactccataa

SEQ ID NO: 2750 - DNA, 20 bp, Artificial Sequence
  Synthetic oligonucleotide; AAG chr11 5170957 5170976 5170973 +
acctgactccataagagtga

SEQ ID NO: 2751 - DNA, 20 bp, Artificial Sequence
  Synthetic oligonucleotide; GAG chr11 5170959 5170978 5170975 +
ctgactccataagagtgaaa

SEQ ID NO: 2752 - DNA, 20 bp, Artificial Sequence
  Synthetic oligonucleotide; TAG chr11 5170966 5170985 5170982 +
cataagagtgaaagagtgca

SEQ ID NO: 2753 - DNA, 20 bp, Artificial Sequence
  Synthetic oligonucleotide; TGG chr11 5170977 5170996 5170993 +
aagagtgcatagaaaacatc

SEQ ID NO: 2754 - DNA, 20 bp, Artificial Sequence
  Synthetic oligonucleotide; GAG chr11 5170979 5170998 5170995 +
gagtgcatagaaaacatctg

SEQ ID NO: 2755 - DNA, 20 bp, Artificial Sequence
  Synthetic oligonucleotide; CAG chr11 5170982 5171001 5170998 +
tgcatagaaaacatctggag

SEQ ID NO: 2756 - DNA, 20 bp, Artificial Sequence
  Synthetic oligonucleotide; AGG chr11 5170983 5171002 5170999 +
gcatagaaaacatctggagc

SEQ ID NO: 2757 - DNA, 20 bp, Artificial Sequence
  Synthetic oligonucleotide; AAG chr11 5171016 5171035 5171032 +
aactgacatcgttaatgcca

SEQ ID NO: 2758 - DNA, 20 bp, Artificial Sequence
  Synthetic oligonucleotide; GAG chr11 5171018 5171037 5171034 +
ctgacatcgttaatgccaaa

SEQ ID NO: 2759 - DNA, 20 bp, Artificial Sequence
  Synthetic oligonucleotide; AGG chr11 5171019 5171038 5171035 +
tgacatcgttaatgccaaag

SEQ ID NO: 2760 - DNA, 20 bp, Artificial Sequence
  Synthetic oligonucleotide; CAG chr11 5171035 5171054 5171051 +
aaagaggaatatgcttaaca

SEQ ID NO: 2761 - DNA, 20 bp, Artificial Sequence
  Synthetic oligonucleotide; TGG chr11 5171038 5171057 5171054 +
gaggaatatgcttaacacag

SEQ ID NO: 2762 - DNA, 20 bp, Artificial Sequence
  Synthetic oligonucleotide; GGG chr11 5171039 5171058 5171055 +
aggaatatgcttaacacagt

SEQ ID NO: 2763 - DNA, 20 bp, Artificial Sequence
  Synthetic oligonucleotide; TGG chr11 5171044 5171063 5171060 +
tatgcttaacacagtgggca

SEQ ID NO: 2764 - DNA, 20 bp, Artificial Sequence
  Synthetic oligonucleotide; TGG chr11 5171047 5171066 5171063 +
gcttaacacagtgggcatgg

SEQ ID NO: 2765 - DNA, 20 bp, Artificial Sequence
  Synthetic oligonucleotide; AAG chr11 5171050 5171069 5171066 +
taacacagtgggcatggtgg

SEQ ID NO: 2766 - DNA, 20 bp, Artificial Sequence
  Synthetic oligonucleotide; CAG chr11 5171053 5171072 5171069 +
cacagtgggcatggtggaag

SEQ ID NO: 2767 - DNA, 20 bp, Artificial Sequence
  Synthetic oligonucleotide; GAG chr11 5171055 5171074 5171071 +
cagtgggcatggtggaagca

SEQ ID NO: 2768 - DNA, 20 bp, Artificial Sequence
  Synthetic oligonucleotide; AAG chr11 5171063 5171082 5171079 +
atggtggaagcagagacacc

SEQ ID NO: 2769 - DNA, 20 bp, Artificial Sequence
  Synthetic oligonucleotide; AAG chr11 5171073 5171092 5171089 +
cagagacaccaagttcaaca

SEQ ID NO: 2770 - DNA, 20 bp, Artificial Sequence
  Synthetic oligonucleotide; AGG chr11 5171074 5171093 5171090 +
agagacaccaagttcaacaa

SEQ ID NO: 2771 - DNA, 20 bp, Artificial Sequence
  Synthetic oligonucleotide; CGG chr11 5171078 5171097 5171094 +
acaccaagttcaacaaaggc

SEQ ID NO: 2772 - DNA, 20 bp, Artificial Sequence
  Synthetic oligonucleotide; TGG chr11 5171083 5171102 5171099 +
aagttcaacaaaggccggca

SEQ ID NO: 2773 - DNA, 20 bp, Artificial Sequence
  Synthetic oligonucleotide; CAG chr11 5171087 5171106 5171103 +
tcaacaaaggccggcatggc

SEQ ID NO: 2774 - DNA, 20 bp, Artificial Sequence
  Synthetic oligonucleotide; TAG chr11 5171094 5171113 5171110 +
aggccggcatggccagaaaa

SEQ ID NO: 2775 - DNA, 20 bp, Artificial Sequence
  Synthetic oligonucleotide; TGG chr11 5171101 5171120 5171117 +
catggccagaaaatagtaca

SEQ ID NO: 2776 - DNA, 20 bp, Artificial Sequence
  Synthetic oligonucleotide; GGG chr11 5171102 5171121 5171118 +
atggccagaaaatagtacat

SEQ ID NO: 2777 - DNA, 20 bp, Artificial Sequence
  Synthetic oligonucleotide; TGG chr11 5171106 5171125 5171122 +
ccagaaaatagtacatgggt

SEQ ID NO: 2778 - DNA, 20 bp, Artificial Sequence
  Synthetic oligonucleotide; AAG chr11 5171112 5171131 5171128 +
aatagtacatgggttggtgc

SEQ ID NO: 2779 - DNA, 20 bp, Artificial Sequence
  Synthetic oligonucleotide; AGG chr11 5171113 5171132 5171129 +
atagtacatgggttggtgca

SEQ ID NO: 2780 - DNA, 20 bp, Artificial Sequence
  Synthetic oligonucleotide; AAG chr11 5171116 5171135 5171132 +
gtacatgggttggtgcaagg

SEQ ID NO: 2781 - DNA, 20 bp, Artificial Sequence
  Synthetic oligonucleotide; GAG chr11 5171118 5171137 5171134 +
acatgggttggtgcaaggaa

SEQ ID NO: 2782 - DNA, 20 bp, Artificial Sequence
  Synthetic oligonucleotide; CGG chr11 5171127 5171146 5171143 +
ggtgcaaggaagagtcaatt

SEQ ID NO: 2783 - DNA, 20 bp, Artificial Sequence
  Synthetic oligonucleotide; AAG chr11 5171138 5171157 5171154 +
gagtcaattcggatgatgtg

SEQ ID NO: 2784 - DNA, 20 bp, Artificial Sequence
  Synthetic oligonucleotide; CGG chr11 5171156 5171175 5171172 +
tgaagaatgatgccatttcc

SEQ ID NO: 2785 - DNA, 20 bp, Artificial Sequence
  Synthetic oligonucleotide; AAG chr11 5171160 5171179 5171176 +
gaatgatgccatttcccgga

SEQ ID NO: 2786 - DNA, 20 bp, Artificial Sequence
  Synthetic oligonucleotide; TGG chr11 5171167 5171186 5171183 +
gccatttcccggaaagatga

SEQ ID NO: 2787 - DNA, 20 bp, Artificial Sequence
  Synthetic oligonucleotide; CAG chr11 5171177 5171196 5171193 +
ggaaagatgatggtgtatat

SEQ ID NO: 2788 - DNA, 20 bp, Artificial Sequence
  Synthetic oligonucleotide; AGG chr11 5171178 5171197 5171194 +
gaaagatgatggtgtatatc

SEQ ID NO: 2789 - DNA, 20 bp, Artificial Sequence
  Synthetic oligonucleotide; CAG chr11 5171181 5171200 5171197 +
agatgatggtgtatatcagg

SEQ ID NO: 2790 - DNA, 20 bp, Artificial Sequence
  Synthetic oligonucleotide; AAG chr11 5171184 5171203 5171200 +
tgatggtgtatatcaggcag

SEQ ID NO: 2791 - DNA, 20 bp, Artificial Sequence
  Synthetic oligonucleotide; AGG chr11 5171185 5171204 5171201 +
gatggtgtatatcaggcaga

SEQ ID NO: 2792 - DNA, 20 bp, Artificial Sequence
  Synthetic oligonucleotide; GGG chr11 5171186 5171205 5171202 +
atggtgtatatcaggcagaa

SEQ ID NO: 2793 - DNA, 20 bp, Artificial Sequence
  Synthetic oligonucleotide; GGG chr11 5171187 5171206 5171203 +
tggtgtatatcaggcagaag

SEQ ID NO: 2794 - DNA, 20 bp, Artificial Sequence
  Synthetic oligonucleotide; TGG chr11 5171191 5171210 5171207 +
gtatatcaggcagaagggga

SEQ ID NO: 2795 - DNA, 20 bp, Artificial Sequence
  Synthetic oligonucleotide; CAG chr11 5171217 5171236 5171233 +
tccacataatgttctgcctc

SEQ ID NO: 2796 - DNA, 20 bp, Artificial Sequence
  Synthetic oligonucleotide; CGG chr11 5171223 5171242 5171239 +
taatgttctgcctccagtcc

SEQ ID NO: 2797 - DNA, 20 bp, Artificial Sequence
  Synthetic oligonucleotide; GGG chr11 5171224 5171243 5171240 +
aatgttctgcctccagtccc

SEQ ID NO: 2798 - DNA, 20 bp, Artificial Sequence
  Synthetic oligonucleotide; GAG chr11 5171235 5171254 5171251 +
tccagtcccgggatgccaac

SEQ ID NO: 2799 - DNA, 20 bp, Artificial Sequence
  Synthetic oligonucleotide; GAG chr11 5171237 5171256 5171253 +
cagtcccgggatgccaacga

SEQ ID NO: 2800 - DNA, 20 bp, Artificial Sequence
  Synthetic oligonucleotide; TAG chr11 5171249 5171268 5171265 +
gccaacgagagtgaatgttg

SEQ ID NO: 2801 - DNA, 20 bp, Artificial Sequence
  Synthetic oligonucleotide; AGG chr11 5171250 5171269 5171266 +
ccaacgagagtgaatgttgt

SEQ ID NO: 2802 - DNA, 20 bp, Artificial Sequence
  Synthetic oligonucleotide; TGG chr11 5171264 5171283 5171280 +
tgttgtaggtgtgaatgtta

SEQ ID NO: 2803 - DNA, 20 bp, Artificial Sequence
  Synthetic oligonucleotide; TGG chr11 5171284 5171303 5171300 +
tggaacgtttgaaaacgtca

SEQ ID NO: 2804 - DNA, 20 bp, Artificial Sequence
  Synthetic oligonucleotide; AAG chr11 5171301 5171320 5171317 +
tcatggtgatacttcctctg

SEQ ID NO: 2805 - DNA, 20 bp, Artificial Sequence
  Synthetic oligonucleotide; GAG chr11 5171309 5171328 5171325 +
atacttcctctgaagatatt

SEQ ID NO: 2806 - DNA, 20 bp, Artificial Sequence
  Synthetic oligonucleotide; AAG chr11 5171312 5171331 5171328 +
cttcctctgaagatattgag

SEQ ID NO: 2807 - DNA, 20 bp, Artificial Sequence
  Synthetic oligonucleotide; TGG chr11 5171319 5171338 5171335 +
tgaagatattgagaagcaca

SEQ ID NO: 2808 - DNA, 20 bp, Artificial Sequence
  Synthetic oligonucleotide; GAG chr11 5171321 5171340 5171337 +
aagatattgagaagcacatg

SEQ ID NO: 2809 - DNA, 20 bp, Artificial Sequence
  Synthetic oligonucleotide; TGG chr11 5171326 5171345 5171342 +
attgagaagcacatggagac

SEQ ID NO: 2810 - DNA, 20 bp, Artificial Sequence
  Synthetic oligonucleotide; AAG chr11 5171336 5171355 5171352 +
acatggagactggaatatat

SEQ ID NO: 2811 - DNA, 20 bp, Artificial Sequence
  Synthetic oligonucleotide; CAG chr11 5171347 5171366 5171363 +
ggaatatataagtttctact

SEQ ID NO: 2812 - DNA, 20 bp, Artificial Sequence
  Synthetic oligonucleotide; AAG chr11 5171362 5171381 5171378 +
ctactcagttattgcacatc

SEQ ID NO: 2813 - DNA, 20 bp, Artificial Sequence
  Synthetic oligonucleotide; GAG chr11 5171369 5171388 5171385 +
gttattgcacatcaagttct

SEQ ID NO: 2814 - DNA, 20 bp, Artificial Sequence
  Synthetic oligonucleotide; CAG chr11 5171376 5171395 5171392 +
cacatcaagttctgagctaa

SEQ ID NO: 2815 - DNA, 20 bp, Artificial Sequence
  Synthetic oligonucleotide; AAG chr11 5171387 5171406 5171403 +
ctgagctaacagtcatatct

SEQ ID NO: 2816 - DNA, 20 bp, Artificial Sequence
  Synthetic oligonucleotide; CAG chr11 5171399 5171418 5171415 +
tcatatctaagacatttcct

SEQ ID NO: 2817 - DNA, 20 bp, Artificial Sequence
  Synthetic oligonucleotide; AAG chr11 5171405 5171424 5171421 +
ctaagacatttcctcagaaa

SEQ ID NO: 2818 - DNA, 20 bp, Artificial Sequence
  Synthetic oligonucleotide; AGG chr11 5171406 5171425 5171422 +
taagacatttcctcagaaaa

SEQ ID NO: 2819 - DNA, 20 bp, Artificial Sequence
  Synthetic oligonucleotide; GGG chr11 5171407 5171426 5171423 +
aagacatttcctcagaaaaa

SEQ ID NO: 2820 - DNA, 20 bp, Artificial Sequence
  Synthetic oligonucleotide; AAG chr11 5171432 5171451 5171448 +
aaaaaatttatttctgaaac

SEQ ID NO: 2821 - DNA, 20 bp, Artificial Sequence
  Synthetic oligonucleotide; AGG chr11 5171433 5171452 5171449 +
aaaaatttatttctgaaaca

SEQ ID NO: 2822 - DNA, 20 bp, Artificial Sequence
  Synthetic oligonucleotide; GGG chr11 5171434 5171453 5171450 +
aaaatttatttctgaaacaa

SEQ ID NO: 2823 - DNA, 20 bp, Artificial Sequence
  Synthetic oligonucleotide; CAG chr11 5171439 5171458 5171455 +
ttatttctgaaacaagggca

SEQ ID NO: 2824 - DNA, 20 bp, Artificial Sequence
  Synthetic oligonucleotide; AGG chr11 5171440 5171459 5171456 +
tatttctgaaacaagggcac

SEQ ID NO: 2825 - DNA, 20 bp, Artificial Sequence
  Synthetic oligonucleotide; AAG chr11 5171444 5171463 5171460 +
tctgaaacaagggcacaggt

SEQ ID NO: 2826 - DNA, 20 bp, Artificial Sequence
  Synthetic oligonucleotide; CAG chr11 5171450 5171469 5171466 +
acaagggcacaggtaagcca

SEQ ID NO: 2827 - DNA, 20 bp, Artificial Sequence
  Synthetic oligonucleotide; GAG chr11 5171454 5171473 5171470 +
gggcacaggtaagccacagt

SEQ ID NO: 2828 - DNA, 20 bp, Artificial Sequence
  Synthetic oligonucleotide; TGG chr11 5171457 5171476 5171473 +
cacaggtaagccacagtgag

SEQ ID NO: 2829 - DNA, 20 bp, Artificial Sequence
  Synthetic oligonucleotide; AAG chr11 5171460 5171479 5171476 +
aggtaagccacagtgagtgg

SEQ ID NO: 2830 - DNA, 20 bp, Artificial Sequence
  Synthetic oligonucleotide; GAG chr11 5171462 5171481 5171478 +
gtaagccacagtgagtggaa

SEQ ID NO: 2831 - DNA, 20 bp, Artificial Sequence
  Synthetic oligonucleotide; TGG chr11 5171473 5171492 5171489 +
tgagtggaagagaaacctaa

SEQ ID NO: 2832 - DNA, 20 bp, Artificial Sequence
  Synthetic oligonucleotide; GGG chr11 5171474 5171493 5171490 +
gagtggaagagaaacctaat

SEQ ID NO: 2833 - DNA, 20 bp, Artificial Sequence
  Synthetic oligonucleotide; CAG chr11 5171482 5171501 5171498 +
gagaaacctaatgggtcatg

SEQ ID NO: 2834 - DNA, 20 bp, Artificial Sequence
  Synthetic oligonucleotide; AAG chr11 5171487 5171506 5171503 +
acctaatgggtcatgcagaa

SEQ ID NO: 2835 - DNA, 20 bp, Artificial Sequence
  Synthetic oligonucleotide; TAG chr11 5171500 5171519 5171516 +
tgcagaaaagtattccaaca

SEQ ID NO: 2836 - DNA, 20 bp, Artificial Sequence
  Synthetic oligonucleotide; CAG chr11 5171512 5171531 5171528 +
ttccaacatagcctatatgc

SEQ ID NO: 2837 - DNA, 20 bp, Artificial Sequence
  Synthetic oligonucleotide; AAG chr11 5171517 5171536 5171533 +
acatagcctatatgccagat

SEQ ID NO: 2838 - DNA, 20 bp, Artificial Sequence
  Synthetic oligonucleotide; AGG chr11 5171518 5171537 5171534 +
catagcctatatgccagata

SEQ ID NO: 2839 - DNA, 20 bp, Artificial Sequence
  Synthetic oligonucleotide; TAG chr11 5171527 5171546 5171543 +
tatgccagataaggcattaa

SEQ ID NO: 2840 - DNA, 20 bp, Artificial Sequence
  Synthetic oligonucleotide; AAG chr11 5171537 5171556 5171553 +
aaggcattaatagaaatctc

SEQ ID NO: 2841 - DNA, 20 bp, Artificial Sequence
  Synthetic oligonucleotide; TGG chr11 5171541 5171560 5171557 +
cattaatagaaatctcaagt

SEQ ID NO: 2842 - DNA, 20 bp, Artificial Sequence
  Synthetic oligonucleotide; GGG chr11 5171542 5171561 5171558 +
attaatagaaatctcaagtt

SEQ ID NO: 2843 - DNA, 20 bp, Artificial Sequence
  Synthetic oligonucleotide; TGG chr11 5171552 5171571 5171568 +
atctcaagttgggtcatcta

SEQ ID NO: 2844 - DNA, 20 bp, Artificial Sequence
  Synthetic oligonucleotide; CAG chr11 5171555 5171574 5171571 +
tcaagttgggtcatctatgg

SEQ ID NO: 2845 - DNA, 20 bp, Artificial Sequence
  Synthetic oligonucleotide; CAG chr11 5171565 5171584 5171581 +
tcatctatggcagtgaaaaa

SEQ ID NO: 2846 - DNA, 20 bp, Artificial Sequence
  Synthetic oligonucleotide; AAG chr11 5171575 5171594 5171591 +
cagtgaaaaacagttaaaat

SEQ ID NO: 2847 - DNA, 20 bp, Artificial Sequence
  Synthetic oligonucleotide; TAG chr11 5171580 5171599 5171596 +
aaaaacagttaaaataagca

SEQ ID NO: 2848 - DNA, 20 bp, Artificial Sequence
  Synthetic oligonucleotide; GAG chr11 5171582 5171601 5171598 +
aaacagttaaaataagcata

SEQ ID NO: 2849 - DNA, 20 bp, Artificial Sequence
  Synthetic oligonucleotide; CAG chr11 5171589 5171608 5171605 +
taaaataagcatagagatga

SEQ ID NO: 2850 - DNA, 20 bp, Artificial Sequence
  Synthetic oligonucleotide; TGG chr11 5171599 5171618 5171615 +
atagagatgacagattcaca

SEQ ID NO: 2851 - DNA, 20 bp, Artificial Sequence
  Synthetic oligonucleotide; AAG chr11 5171614 5171633 5171630 +
tcacatggaaattatgactg

SEQ ID NO: 2852 - DNA, 20 bp, Artificial Sequence
  Synthetic oligonucleotide; TAG chr11 5171631 5171650 5171647 +
ctgaagaaactgctaacttg

SEQ ID NO: 2853 - DNA, 20 bp, Artificial Sequence
  Synthetic oligonucleotide; AAG chr11 5171642 5171661 5171658 +
gctaacttgtagtgtttata

SEQ ID NO: 2854 - DNA, 20 bp, Artificial Sequence
  Synthetic oligonucleotide; GAG chr11 5171644 5171663 5171660 +
taacttgtagtgtttataaa

SEQ ID NO: 2855 - DNA, 20 bp, Artificial Sequence
  Synthetic oligonucleotide; GAG chr11 5171646 5171665 5171662 +
acttgtagtgtttataaaga

SEQ ID NO: 2856 - DNA, 20 bp, Artificial Sequence
  Synthetic oligonucleotide; TAG chr11 5171649 5171668 5171665 +
tgtagtgtttataaagagag

SEQ ID NO: 2857 - DNA, 20 bp, Artificial Sequence
  Synthetic oligonucleotide; TAG chr11 5171657 5171676 5171673 +
ttataaagagagtagatgaa

SEQ ID NO: 2858 - DNA, 20 bp, Artificial Sequence
  Synthetic oligonucleotide; AAG chr11 5171663 5171682 5171679 +
agagagtagatgaatagcta

SEQ ID NO: 2859 - DNA, 20 bp, Artificial Sequence
  Synthetic oligonucleotide; AAG chr11 5171682 5171701 5171698 +
aaagtaatataacactaata

SEQ ID NO: 2860 - DNA, 20 bp, Artificial Sequence
  Synthetic oligonucleotide; GAG chr11 5171684 5171703 5171700 +
agtaatataacactaataaa

SEQ ID NO: 2861 - DNA, 20 bp, Artificial Sequence
  Synthetic oligonucleotide; TGG chr11 5171693 5171712 5171709 +
acactaataaagagtattga

SEQ ID NO: 2862 - DNA, 20 bp, Artificial Sequence
  Synthetic oligonucleotide; TGG chr11 5171723 5171742 5171739 +
atttaattgacgtgtaatct

SEQ ID NO: 2863 - DNA, 20 bp, Artificial Sequence
  Synthetic oligonucleotide; GGG chr11 5171724 5171743 5171740 +
tttaattgacgtgtaatctt

SEQ ID NO: 2864 - DNA, 20 bp, Artificial Sequence
  Synthetic oligonucleotide; AAG chr11 5171736 5171755 5171752 +
gtaatcttgggattatatta

SEQ ID NO: 2865 - DNA, 20 bp, Artificial Sequence
  Synthetic oligonucleotide; AAG chr11 5171753 5171772 5171769 +
ttaaagttgatttatattgc

SEQ ID NO: 2866 - DNA, 20 bp, Artificial Sequence
  Synthetic oligonucleotide; GAG chr11 5171762 5171781 5171778 +
atttatattgcaagttatct

SEQ ID NO: 2867 - DNA, 20 bp, Artificial Sequence
  Synthetic oligonucleotide; CAG chr11 5171768 5171787 5171784 +
attgcaagttatctgagacc

SEQ ID NO: 2868 - DNA, 20 bp, Artificial Sequence
  Synthetic oligonucleotide; AAG chr11 5171783 5171802 5171799 +
agacccagatatttgctata

SEQ ID NO: 2869 - DNA, 20 bp, Artificial Sequence
  Synthetic oligonucleotide; TAG chr11 5171793 5171812 5171809 +
atttgctataaagacaataa

SEQ ID NO: 2870 - DNA, 20 bp, Artificial Sequence
  Synthetic oligonucleotide; AAG chr11 5171803 5171822 5171819 +
aagacaataatagtatttta

SEQ ID NO: 2871 - DNA, 20 bp, Artificial Sequence
  Synthetic oligonucleotide; TGG chr11 5171836 5171855 5171852 +
atattgtttatcattatatg

SEQ ID NO: 2872 - DNA, 20 bp, Artificial Sequence
  Synthetic oligonucleotide; TAG chr11 5171843 5171862 5171859 +
ttatcattatatgtggaata

SEQ ID NO: 2873 - DNA, 20 bp, Artificial Sequence
  Synthetic oligonucleotide; TAG chr11 5171861 5171880 5171877 +
tatagtaaatattaaatgta

SEQ ID NO: 2874 - DNA, 20 bp, Artificial Sequence
  Synthetic oligonucleotide; AAG chr11 5171870 5171889 5171886 +
tattaaatgtatagaataaa

SEQ ID NO: 2875 - DNA, 20 bp, Artificial Sequence
  Synthetic oligonucleotide; TAG chr11 5171888 5171907 5171904 +
aaaagaacaatttaatatat

SEQ ID NO: 2876 - DNA, 20 bp, Artificial Sequence
  Synthetic oligonucleotide; AAG chr11 5171896 5171915 5171912 +
aatttaatatattagaacac

SEQ ID NO: 2877 - DNA, 20 bp, Artificial Sequence
  Synthetic oligonucleotide; AGG chr11 5171897 5171916 5171913 +
atttaatatattagaacaca

SEQ ID NO: 2878 - DNA, 20 bp, Artificial Sequence
  Synthetic oligonucleotide; TAG chr11 5171901 5171920 5171917 +
aatatattagaacacaagga

SEQ ID NO: 2879 - DNA, 20 bp, Artificial Sequence
  Synthetic oligonucleotide; TAG chr11 5171911 5171930 5171927 +
aacacaaggatagtttctcc

SEQ ID NO: 2880 - DNA, 20 bp, Artificial Sequence
  Synthetic oligonucleotide; AAG chr11 5171918 5171937 5171934 +
ggatagtttctcctagaata

SEQ ID NO: 2881 - DNA, 20 bp, Artificial Sequence
  Synthetic oligonucleotide; CAG chr11 5171948 5171967 5171964 +
catttttttctttaacttac

SEQ ID NO: 2882 - DNA, 20 bp, Artificial Sequence
  Synthetic oligonucleotide; TAG chr11 5171977 5171996 5171993 +
ctttctccacctgctatcca

SEQ ID NO: 2883 - DNA, 20 bp, Artificial Sequence
  Synthetic oligonucleotide; TAG chr11 5171982 5172001 5171998 +
tccacctgctatccatagat

SEQ ID NO: 2884 - DNA, 20 bp, Artificial Sequence
  Synthetic oligonucleotide; AAG chr11 5171987 5172006 5172003 +
ctgctatccatagattagaa

SEQ ID NO: 2885 - DNA, 20 bp, Artificial Sequence
  Synthetic oligonucleotide; CAG chr11 5172005 5172024 5172021 +
aaaagctcctctgtattttg

SEQ ID NO: 2886 - DNA, 20 bp, Artificial Sequence
  Synthetic oligonucleotide; AAG chr11 5172008 5172027 5172024 +
agctcctctgtattttgcag

SEQ ID NO: 2887 - DNA, 20 bp, Artificial Sequence
  Synthetic oligonucleotide; AGG chr11 5172009 5172028 5172025 +
gctcctctgtattttgcaga

SEQ ID NO: 2888 - DNA, 20 bp, Artificial Sequence
  Synthetic oligonucleotide; GGG chr11 5172010 5172029 5172026 +
ctcctctgtattttgcagaa

SEQ ID NO: 2889 - DNA, 20 bp, Artificial Sequence
  Synthetic oligonucleotide; CAG chr11 5172014 5172033 5172030 +
tctgtattttgcagaagggt

SEQ ID NO: 2890 - DNA, 20 bp, Artificial Sequence
  Synthetic oligonucleotide; TGG chr11 5172025 5172044 5172041 +
cagaagggtcagtcttctgc

SEQ ID NO: 2891 - DNA, 20 bp, Artificial Sequence
  Synthetic oligonucleotide; CGG chr11 5172031 5172050 5172047 +
ggtcagtcttctgctggaac

SEQ ID NO: 2892 - DNA, 20 bp, Artificial Sequence
  Synthetic oligonucleotide; GGG chr11 5172032 5172051 5172048 +
gtcagtcttctgctggaacc

SEQ ID NO: 2893 - DNA, 20 bp, Artificial Sequence
  Synthetic oligonucleotide; CAG chr11 5172036 5172055 5172052 +
gtcttctgctggaaccgggt

SEQ ID NO: 2894 - DNA, 20 bp, Artificial Sequence
  Synthetic oligonucleotide; AGG chr11 5172037 5172056 5172053 +
tcttctgctggaaccgggtc

SEQ ID NO: 2895 - DNA, 20 bp, Artificial Sequence
  Synthetic oligonucleotide; GGG chr11 5172038 5172057 5172054 +
cttctgctggaaccgggtca

SEQ ID NO: 2896 - DNA, 20 bp, Artificial Sequence
  Synthetic oligonucleotide; GAG chr11 5172040 5172059 5172056 +
tctgctggaaccgggtcagg

SEQ ID NO: 2897 - DNA, 20 bp, Artificial Sequence
  Synthetic oligonucleotide; AAG chr11 5172044 5172063 5172060 +
ctggaaccgggtcagggagc

SEQ ID NO: 2898 - DNA, 20 bp, Artificial Sequence
  Synthetic oligonucleotide; CAG chr11 5172049 5172068 5172065 +
accgggtcagggagcaagat

SEQ ID NO: 2899 - DNA, 20 bp, Artificial Sequence
  Synthetic oligonucleotide; AAG chr11 5172052 5172071 5172068 +
gggtcagggagcaagatcag

SEQ ID NO: 2900 - DNA, 20 bp, Artificial Sequence
  Synthetic oligonucleotide; CAG chr11 5172058 5172077 5172074 +
gggagcaagatcagaagcat

SEQ ID NO: 2901 - DNA, 20 bp, Artificial Sequence
  Synthetic oligonucleotide; AAG chr11 5172069 5172088 5172085 +
cagaagcatcagtatctcac

SEQ ID NO: 2902 - DNA, 20 bp, Artificial Sequence
  Synthetic oligonucleotide; TGG chr11 5172082 5172101 5172098 +
atctcacaagtcacatgtga

SEQ ID NO: 2903 - DNA, 20 bp, Artificial Sequence
  Synthetic oligonucleotide; TGG chr11 5172085 5172104 5172101 +
tcacaagtcacatgtgatgg

SEQ ID NO: 2904 - DNA, 20 bp, Artificial Sequence
  Synthetic oligonucleotide; GGG chr11 5172086 5172105 5172102 +
cacaagtcacatgtgatggt

SEQ ID NO: 2905 - DNA, 20 bp, Artificial Sequence
  Synthetic oligonucleotide; GGG chr11 5172087 5172106 5172103 +
acaagtcacatgtgatggtg

SEQ ID NO: 2906 - DNA, 20 bp, Artificial Sequence
  Synthetic oligonucleotide; TAG chr11 5172091 5172110 5172107 +
gtcacatgtgatggtggggc

SEQ ID NO: 2907 - DNA, 20 bp, Artificial Sequence
  Synthetic oligonucleotide; AGG chr11 5172092 5172111 5172108 +
tcacatgtgatggtggggct

SEQ ID NO: 2908 - DNA, 20 bp, Artificial Sequence
  Synthetic oligonucleotide; GGG chr11 5172093 5172112 5172109 +
cacatgtgatggtggggcta

SEQ ID NO: 2909 - DNA, 20 bp, Artificial Sequence
  Synthetic oligonucleotide; CAG chr11 5172098 5172117 5172114 +
gtgatggtggggctagggta

SEQ ID NO: 2910 - DNA, 20 bp, Artificial Sequence
  Synthetic oligonucleotide; AGG chr11 5172099 5172118 5172115 +
tgatggtggggctagggtac

SEQ ID NO: 2911 - DNA, 20 bp, Artificial Sequence
  Synthetic oligonucleotide; TAG chr11 5172104 5172123 5172120 +
gtggggctagggtacaggct

SEQ ID NO: 2912 - DNA, 20 bp, Artificial Sequence
  Synthetic oligonucleotide; GAG chr11 5172106 5172125 5172122 +
ggggctagggtacaggctta

SEQ ID NO: 2913 - DNA, 20 bp, Artificial Sequence
  Synthetic oligonucleotide; TGG chr11 5172118 5172137 5172134 +
caggcttagagatatttatc

SEQ ID NO: 2914 - DNA, 20 bp, Artificial Sequence
  Synthetic oligonucleotide; GGG chr11 5172119 5172138 5172135 +
aggcttagagatatttatct

SEQ ID NO: 2915 - DNA, 20 bp, Artificial Sequence
  Synthetic oligonucleotide; AAG chr11 5172125 5172144 5172141 +
agagatatttatctgggaac

SEQ ID NO: 2916 - DNA, 20 bp, Artificial Sequence
  Synthetic oligonucleotide; AAG chr11 5172141 5172160 5172157 +
gaacaagtttattaacacta

SEQ ID NO: 2917 - DNA, 20 bp, Artificial Sequence
  Synthetic oligonucleotide; CAG chr11 5172157 5172176 5172173 +
actaaagttccacttatctg

SEQ ID NO: 2918 - DNA, 20 bp, Artificial Sequence
  Synthetic oligonucleotide; CAG chr11 5172160 5172179 5172176 +
aaagttccacttatctgcag

SEQ ID NO: 2919 - DNA, 20 bp, Artificial Sequence
  Synthetic oligonucleotide; GAG chr11 5172162 5172181 5172178 +
agttccacttatctgcagca

SEQ ID NO: 2920 - DNA, 20 bp, Artificial Sequence
  Synthetic oligonucleotide; TAG chr11 5172168 5172187 5172184 +
acttatctgcagcagagcct

SEQ ID NO: 2921 - DNA, 20 bp, Artificial Sequence
  Synthetic oligonucleotide; AGG chr11 5172169 5172188 5172185 +
cttatctgcagcagagcctt

SEQ ID NO: 2922 - DNA, 20 bp, Artificial Sequence
  Synthetic oligonucleotide; TGG chr11 5172181 5172200 5172197 +
agagccttaggtattaacgt

SEQ ID NO: 2923 - DNA, 20 bp, Artificial Sequence
  Synthetic oligonucleotide; GAG chr11 5172183 5172202 5172199 +
agccttaggtattaacgttg

SEQ ID NO: 2924 - DNA, 20 bp, Artificial Sequence
  Synthetic oligonucleotide; AGG chr11 5172184 5172203 5172200 +
gccttaggtattaacgttgg

SEQ ID NO: 2925 - DNA, 20 bp, Artificial Sequence
  Synthetic oligonucleotide; CAG chr11 5172188 5172207 5172204 +
taggtattaacgttggaggc

SEQ ID NO: 2926 - DNA, 20 bp, Artificial Sequence
  Synthetic oligonucleotide; TGG chr11 5172194 5172213 5172210 +
ttaacgttggaggccagaaa

SEQ ID NO: 2927 - DNA, 20 bp, Artificial Sequence
  Synthetic oligonucleotide; CAG chr11 5172201 5172220 5172217 +
tggaggccagaaatggaatt

SEQ ID NO: 2928 - DNA, 20 bp, Artificial Sequence
  Synthetic oligonucleotide; AGG chr11 5172202 5172221 5172218 +
ggaggccagaaatggaattc

SEQ ID NO: 2929 - DNA, 20 bp, Artificial Sequence
  Synthetic oligonucleotide; TGG chr11 5172206 5172225 5172222 +
gccagaaatggaattcagga

SEQ ID NO: 2930 - DNA, 20 bp, Artificial Sequence
  Synthetic oligonucleotide; GGG chr11 5172207 5172226 5172223 +
ccagaaatggaattcaggat

SEQ ID NO: 2931 - DNA, 20 bp, Artificial Sequence
  Synthetic oligonucleotide; GGG chr11 5172208 5172227 5172224 +
cagaaatggaattcaggatg

SEQ ID NO: 2932 - DNA, 20 bp, Artificial Sequence
  Synthetic oligonucleotide; CAG chr11 5172213 5172232 5172229 +
atggaattcaggatggggct

SEQ ID NO: 2933 - DNA, 20 bp, Artificial Sequence
  Synthetic oligonucleotide; AAG chr11 5172220 5172239 5172236 +
tcaggatggggctcagaaat

SEQ ID NO: 2934 - DNA, 20 bp, Artificial Sequence
  Synthetic oligonucleotide; AAG chr11 5172232 5172251 5172248 +
tcagaaataagaatgtgacc

SEQ ID NO: 2935 - DNA, 20 bp, Artificial Sequence
  Synthetic oligonucleotide; AGG chr11 5172233 5172252 5172249 +
cagaaataagaatgtgacca

SEQ ID NO: 2936 - DNA, 20 bp, Artificial Sequence
  Synthetic oligonucleotide; TGG chr11 5172256 5172275 5172272 +
ctgaactcttcttcccgtgt

SEQ ID NO: 2937 - DNA, 20 bp, Artificial Sequence
  Synthetic oligonucleotide; GGG chr11 5172257 5172276 5172273 +
tgaactcttcttcccgtgtt

SEQ ID NO: 2938 - DNA, 20 bp, Artificial Sequence
  Synthetic oligonucleotide; CAG chr11 5172261 5172280 5172277 +
ctcttcttcccgtgttgggc

SEQ ID NO: 2939 - DNA, 20 bp, Artificial Sequence
  Synthetic oligonucleotide; AGG chr11 5172262 5172281 5172278 +
tcttcttcccgtgttgggcc

SEQ ID NO: 2940 - DNA, 20 bp, Artificial Sequence
  Synthetic oligonucleotide; GGG chr11 5172263 5172282 5172279 +
cttcttcccgtgttgggcca

SEQ ID NO: 2941 - DNA, 20 bp, Artificial Sequence
  Synthetic oligonucleotide; TAG chr11 5172274 5172293 5172290 +
gttgggccagggctcttcgt

SEQ ID NO: 2942 - DNA, 20 bp, Artificial Sequence
  Synthetic oligonucleotide; AGG chr11 5172275 5172294 5172291 +
ttgggccagggctcttcgtt

SEQ ID NO: 2943 - DNA, 20 bp, Artificial Sequence
  Synthetic oligonucleotide; CAG chr11 5172284 5172303 5172300 +
ggctcttcgttaggcataat

SEQ ID NO: 2944 - DNA, 20 bp, Artificial Sequence
  Synthetic oligonucleotide; TGG chr11 5172287 5172306 5172303 +
tcttcgttaggcataatcag

SEQ ID NO: 2945 - DNA, 20 bp, Artificial Sequence
  Synthetic oligonucleotide; GGG chr11 5172288 5172307 5172304 +
cttcgttaggcataatcagt

SEQ ID NO: 2946 - DNA, 20 bp, Artificial Sequence
  Synthetic oligonucleotide; TAG chr11 5172292 5172311 5172308 +
gttaggcataatcagtggga

SEQ ID NO: 2947 - DNA, 20 bp, Artificial Sequence
  Synthetic oligonucleotide; CAG chr11 5172333 5172352 5172349 +
aaaaatgccctgatttttac

SEQ ID NO: 2948 - DNA, 20 bp, Artificial Sequence
  Synthetic oligonucleotide; CAG chr11 5172380 5172399 5172396 +
actcctaccatgatcaattt

SEQ ID NO: 2949 - DNA, 20 bp, Artificial Sequence
  Synthetic oligonucleotide; AAG chr11 5172390 5172409 5172406 +
tgatcaatttcagactacca

SEQ ID NO: 2950 - DNA, 20 bp, Artificial Sequence
  Synthetic oligonucleotide; GAG chr11 5172392 5172411 5172408 +
atcaatttcagactaccaaa

SEQ ID NO: 2951 - DNA, 20 bp, Artificial Sequence
  Synthetic oligonucleotide; CAG chr11 5172408 5172427 5172424 +
caaagagatgctattaaatg

SEQ ID NO: 2952 - DNA, 20 bp, Artificial Sequence
  Synthetic oligonucleotide; GAG chr11 5172410 5172429 5172426 +
aagagatgctattaaatgca

SEQ ID NO: 2953 - DNA, 20 bp, Artificial Sequence
  Synthetic oligonucleotide; GAG chr11 5172415 5172434 5172431 +
atgctattaaatgcagagct

SEQ ID NO: 2954 - DNA, 20 bp, Artificial Sequence
  Synthetic oligonucleotide; GAG chr11 5172420 5172439 5172436 +
attaaatgcagagctgagat

SEQ ID NO: 2955 - DNA, 20 bp, Artificial Sequence
  Synthetic oligonucleotide; CAG chr11 5172429 5172448 5172445 +
agagctgagatgagcataat

SEQ ID NO: 2956 - DNA, 20 bp, Artificial Sequence
  Synthetic oligonucleotide; AAG chr11 5172439 5172458 5172455 +
tgagcataatcagctttcct

SEQ ID NO: 2957 - DNA, 20 bp, Artificial Sequence
  Synthetic oligonucleotide; TGG chr11 5172443 5172462 5172459 +
cataatcagctttcctaagc

SEQ ID NO: 2958 - DNA, 20 bp, Artificial Sequence
  Synthetic oligonucleotide; AAG chr11 5172449 5172468 5172465 +
cagctttcctaagctggtgc

SEQ ID NO: 2959 - DNA, 20 bp, Artificial Sequence
  Synthetic oligonucleotide; CAG chr11 5172453 5172472 5172469 +
tttcctaagctggtgcaagc

SEQ ID NO: 2960 - DNA, 20 bp, Artificial Sequence
  Synthetic oligonucleotide; TAG chr11 5172469 5172488 5172485 +
aagccagcacattataccat

SEQ ID NO: 2961 - DNA, 20 bp, Artificial Sequence
  Synthetic oligonucleotide; AGG chr11 5172470 5172489 5172486 +
agccagcacattataccatt

SEQ ID NO: 2962 - DNA, 20 bp, Artificial Sequence
  Synthetic oligonucleotide; TAG chr11 5172481 5172500 5172497 +
tataccattaggcataacta

SEQ ID NO: 2963 - DNA, 20 bp, Artificial Sequence
  Synthetic oligonucleotide; TAG chr11 5172491 5172510 5172507 +
ggcataactatagttgatcc

SEQ ID NO: 2964 - DNA, 20 bp, Artificial Sequence
  Synthetic oligonucleotide; CAG chr11 5172498 5172517 5172514 +
ctatagttgatcctagacct

SEQ ID NO: 2965 - DNA, 20 bp, Artificial Sequence
  Synthetic oligonucleotide; TAG chr11 5172510 5172529 5172526 +
ctagacctcagatacttacc

SEQ ID NO: 2966 - DNA, 20 bp, Artificial Sequence
  Synthetic oligonucleotide; AGG chr11 5172511 5172530 5172527 +
tagacctcagatacttacct

SEQ ID NO: 2967 - DNA, 20 bp, Artificial Sequence
  Synthetic oligonucleotide; TGG chr11 5172514 5172533 5172530 +
acctcagatacttacctagg

SEQ ID NO: 2968 - DNA, 20 bp, Artificial Sequence
  Synthetic oligonucleotide; GAG chr11 5172521 5172540 5172537 +
atacttacctaggtggaact

SEQ ID NO: 2969 - DNA, 20 bp, Artificial Sequence
  Synthetic oligonucleotide; GAG chr11 5172523 5172542 5172539 +
acttacctaggtggaactga

SEQ ID NO: 2970 - DNA, 20 bp, Artificial Sequence
  Synthetic oligonucleotide; TGG chr11 5172573 5172592 5172589 +
tgttactgtttactttcaac

SEQ ID NO: 2971 - DNA, 20 bp, Artificial Sequence
  Synthetic oligonucleotide; GGG chr11 5172574 5172593 5172590 +
gttactgtttactttcaact

SEQ ID NO: 2972 - DNA, 20 bp, Artificial Sequence
  Synthetic oligonucleotide; TGG chr11 5172580 5172599 5172596 +
gtttactttcaactgggctg

SEQ ID NO: 2973 - DNA, 20 bp, Artificial Sequence
  Synthetic oligonucleotide; TAG chr11 5172586 5172605 5172602 +
tttcaactgggctgtggaca

SEQ ID NO: 2974 - DNA, 20 bp, Artificial Sequence
  Synthetic oligonucleotide; TAG chr11 5172613 5172632 5172629 +
tacctccctgtatatgtgct

SEQ ID NO: 2975 - DNA, 20 bp, Artificial Sequence
  Synthetic oligonucleotide; TGG chr11 5172621 5172640 5172637 +
tgtatatgtgcttagttgac

SEQ ID NO: 2976 - DNA, 20 bp, Artificial Sequence
  Synthetic oligonucleotide; GAG chr11 5172623 5172642 5172639 +
tatatgtgcttagttgactg

SEQ ID NO: 2977 - DNA, 20 bp, Artificial Sequence
  Synthetic oligonucleotide; AGG chr11 5172624 5172643 5172640 +
atatgtgcttagttgactgg

SEQ ID NO: 2978 - DNA, 20 bp, Artificial Sequence
  Synthetic oligonucleotide; TAG chr11 5172630 5172649 5172646 +
gcttagttgactggaggaca

SEQ ID NO: 2979 - DNA, 20 bp, Artificial Sequence
  Synthetic oligonucleotide; GAG chr11 5172632 5172651 5172648 +
ttagttgactggaggacata

SEQ ID NO: 2980 - DNA, 20 bp, Artificial Sequence
  Synthetic oligonucleotide; CAG chr11 5172636 5172655 5172652 +
ttgactggaggacatagaga

SEQ ID NO: 2981 - DNA, 20 bp, Artificial Sequence
  Synthetic oligonucleotide; CAG chr11 5172646 5172665 5172662 +
gacatagagacagaatgatt

SEQ ID NO: 2982 - DNA, 20 bp, Artificial Sequence
  Synthetic oligonucleotide; AAG chr11 5172657 5172676 5172673 +
agaatgattcagtatccctc

SEQ ID NO: 2983 - DNA, 20 bp, Artificial Sequence
  Synthetic oligonucleotide; AAG chr11 5172660 5172679 5172676 +
atgattcagtatccctcaag

SEQ ID NO: 2984 - DNA, 20 bp, Artificial Sequence
  Synthetic oligonucleotide; AAG chr11 5172672 5172691 5172688 +
ccctcaagaagcaattaacc

SEQ ID NO: 2985 - DNA, 20 bp, Artificial Sequence
  Synthetic oligonucleotide; CAG chr11 5172687 5172706 5172703 +
taaccaagaataattattcc

SEQ ID NO: 2986 - DNA, 20 bp, Artificial Sequence
  Synthetic oligonucleotide; CGG chr11 5172696 5172715 5172712 +
ataattattcccagaaactt

SEQ ID NO: 2987 - DNA, 20 bp, Artificial Sequence
  Synthetic oligonucleotide; GGG chr11 5172697 5172716 5172713 +
taattattcccagaaacttc

SEQ ID NO: 2988 - DNA, 20 bp, Artificial Sequence
  Synthetic oligonucleotide; TAG chr11 5172705 5172724 5172721 +
cccagaaacttcgggtgtat

SEQ ID NO: 2989 - DNA, 20 bp, Artificial Sequence
  Synthetic oligonucleotide; GAG chr11 5172707 5172726 5172723 +
cagaaacttcgggtgtatta

SEQ ID NO: 2990 - DNA, 20 bp, Artificial Sequence
  Synthetic oligonucleotide; GAG chr11 5172709 5172728 5172725 +
gaaacttcgggtgtattaga

SEQ ID NO: 2991 - DNA, 20 bp, Artificial Sequence
  Synthetic oligonucleotide; AAG chr11 5172713 5172732 5172729 +
cttcgggtgtattagagaga

SEQ ID NO: 2992 - DNA, 20 bp, Artificial Sequence
  Synthetic oligonucleotide; AGG chr11 5172714 5172733 5172730 +
ttcgggtgtattagagagaa

SEQ ID NO: 2993 - DNA, 20 bp, Artificial Sequence
  Synthetic oligonucleotide; GGG chr11 5172715 5172734 5172731 +
tcgggtgtattagagagaaa

SEQ ID NO: 2994 - DNA, 20 bp, Artificial Sequence
  Synthetic oligonucleotide; GGG chr11 5172716 5172735 5172732 +
cgggtgtattagagagaaag

SEQ ID NO: 2995 - DNA, 20 bp, Artificial Sequence
  Synthetic oligonucleotide; GGG chr11 5172717 5172736 5172733 +
gggtgtattagagagaaagg

SEQ ID NO: 2996 - DNA, 20 bp, Artificial Sequence
  Synthetic oligonucleotide; GGG chr11 5172718 5172737 5172734 +
ggtgtattagagagaaaggg

SEQ ID NO: 2997 - DNA, 20 bp, Artificial Sequence
  Synthetic oligonucleotide; TAG chr11 5172723 5172742 5172739 +
attagagagaaaggggggaa

SEQ ID NO: 2998 - DNA, 20 bp, Artificial Sequence
  Synthetic oligonucleotide; GAG chr11 5172731 5172750 5172747 +
gaaaggggggaatagttcct

SEQ ID NO: 2999 - DNA, 20 bp, Artificial Sequence
  Synthetic oligonucleotide; AAG chr11 5172734 5172753 5172750 +
aggggggaatagttcctgag

SEQ ID NO: 3000 - DNA, 20 bp, Artificial Sequence
  Synthetic oligonucleotide; TGG chr11 5172742 5172761 5172758 +
atagttcctgagaagcatgc

SEQ ID NO: 3001 - DNA, 20 bp, Artificial Sequence
  Synthetic oligonucleotide; GAG chr11 5172744 5172763 5172760 +
agttcctgagaagcatgctg

SEQ ID NO: 3002 - DNA, 20 bp, Artificial Sequence
  Synthetic oligonucleotide; GAG chr11 5172746 5172765 5172762 +
ttcctgagaagcatgctgga

SEQ ID NO: 3003 - DNA, 20 bp, Artificial Sequence
  Synthetic oligonucleotide; GAG chr11 5172748 5172767 5172764 +
cctgagaagcatgctggaga

SEQ ID NO: 3004 - DNA, 20 bp, Artificial Sequence
  Synthetic oligonucleotide; AAG chr11 5172758 5172777 5172774 +
atgctggagagagtatacat

SEQ ID NO: 3005 - DNA, 20 bp, Artificial Sequence
  Synthetic oligonucleotide; TAG chr11 5172801 5172820 5172817 +
aaacccaaataaacataaaa

SEQ ID NO: 3006 - DNA, 20 bp, Artificial Sequence
  Synthetic oligonucleotide; AAG chr11 5172836 5172855 5172852 +
attaattataatttaaatat

SEQ ID NO: 3007 - DNA, 20 bp, Artificial Sequence
  Synthetic oligonucleotide; TGG chr11 5172843 5172862 5172859 +
ataatttaaatataagacat

SEQ ID NO: 3008 - DNA, 20 bp, Artificial Sequence
  Synthetic oligonucleotide; TAG chr11 5172924 5172943 5172940 +
tcatttacaaaacttttatg

SEQ ID NO: 3009 - DNA, 20 bp, Artificial Sequence
  Synthetic oligonucleotide; CAG chr11 5172928 5172947 5172944 +
ttacaaaacttttatgtagt

SEQ ID NO: 3010 - DNA, 20 bp, Artificial Sequence
  Synthetic oligonucleotide; AGG chr11 5172929 5172948 5172945 +
tacaaaacttttatgtagtc

SEQ ID NO: 3011 - DNA, 20 bp, Artificial Sequence
  Synthetic oligonucleotide; AAG chr11 5172972 5172991 5172988 +
attatatacttttcattctt

SEQ ID NO: 3012 - DNA, 20 bp, Artificial Sequence
  Synthetic oligonucleotide; AAG chr11 5172975 5172994 5172991 +
atatacttttcattcttaag

SEQ ID NO: 3013 - DNA, 20 bp, Artificial Sequence
  Synthetic oligonucleotide; AAG chr11 5172992 5173011 5173008 +
aagaagctattccatataca

SEQ ID NO: 3014 - DNA, 20 bp, Artificial Sequence
  Synthetic oligonucleotide; AAG chr11 5172999 5173018 5173015 +
tattccatatacaaagtaaa

SEQ ID NO: 3015 - DNA, 20 bp, Artificial Sequence
  Synthetic oligonucleotide; TGG chr11 5173002 5173021 5173018 +
tccatatacaaagtaaaaag

SEQ ID NO: 3016 - DNA, 20 bp, Artificial Sequence
  Synthetic oligonucleotide; GAG chr11 5173004 5173023 5173020 +
catatacaaagtaaaaagtg

SEQ ID NO: 3017 - DNA, 20 bp, Artificial Sequence
  Synthetic oligonucleotide; GAG chr11 5173006 5173025 5173022 +
tatacaaagtaaaaagtgga

SEQ ID NO: 3018 - DNA, 20 bp, Artificial Sequence
  Synthetic oligonucleotide; CAG chr11 5173012 5173031 5173028 +
aagtaaaaagtggagagatg

SEQ ID NO: 3019 - DNA, 20 bp, Artificial Sequence
  Synthetic oligonucleotide; GAG chr11 5173014 5173033 5173030 +
gtaaaaagtggagagatgca

SEQ ID NO: 3020 - DNA, 20 bp, Artificial Sequence
  Synthetic oligonucleotide; TGG chr11 5173018 5173037 5173034 +
aaagtggagagatgcagagt

SEQ ID NO: 3021 - DNA, 20 bp, Artificial Sequence
  Synthetic oligonucleotide; TAG chr11 5173024 5173043 5173040 +
gagagatgcagagttggatc

SEQ ID NO: 3022 - DNA, 20 bp, Artificial Sequence
  Synthetic oligonucleotide; GAG chr11 5173026 5173045 5173042 +
gagatgcagagttggatcta

SEQ ID NO: 3023 - DNA, 20 bp, Artificial Sequence
  Synthetic oligonucleotide; TAG chr11 5173030 5173049 5173046 +
tgcagagttggatctagagc

SEQ ID NO: 3024 - DNA, 20 bp, Artificial Sequence
  Synthetic oligonucleotide; GAG chr11 5173032 5173051 5173048 +
cagagttggatctagagcta

SEQ ID NO: 3025 - DNA, 20 bp, Artificial Sequence
  Synthetic oligonucleotide; CGG chr11 5173036 5173055 5173052 +
gttggatctagagctagaga

SEQ ID NO: 3026 - DNA, 20 bp, Artificial Sequence
  Synthetic oligonucleotide; CAG chr11 5173044 5173063 5173060 +
tagagctagagacggaactg

SEQ ID NO: 3027 - DNA, 20 bp, Artificial Sequence
  Synthetic oligonucleotide; TAG chr11 5173048 5173067 5173064 +
gctagagacggaactgcaga

SEQ ID NO: 3028 - DNA, 20 bp, Artificial Sequence
  Synthetic oligonucleotide; AGG chr11 5173049 5173068 5173065 +
ctagagacggaactgcagat

SEQ ID NO: 3029 - DNA, 20 bp, Artificial Sequence
  Synthetic oligonucleotide; GGG chr11 5173050 5173069 5173066 +
tagagacggaactgcagata

SEQ ID NO: 3030 - DNA, 20 bp, Artificial Sequence
  Synthetic oligonucleotide; TAG chr11 5173054 5173073 5173070 +
gacggaactgcagataggga

SEQ ID NO: 3031 - DNA, 20 bp, Artificial Sequence
  Synthetic oligonucleotide; TGG chr11 5173057 5173076 5173073 +
ggaactgcagatagggatag

SEQ ID NO: 3032 - DNA, 20 bp, Artificial Sequence
  Synthetic oligonucleotide; TAG chr11 5173062 5173081 5173078 +
tgcagatagggatagtggtg

SEQ ID NO: 3033 - DNA, 20 bp, Artificial Sequence
  Synthetic oligonucleotide; TAG chr11 5173066 5173085 5173082 +
gatagggatagtggtgtaga

SEQ ID NO: 3034 - DNA, 20 bp, Artificial Sequence
  Synthetic oligonucleotide; AAG chr11 5173074 5173093 5173090 +
tagtggtgtagatagtaata

SEQ ID NO: 3035 - DNA, 20 bp, Artificial Sequence
  Synthetic oligonucleotide; AGG chr11 5173075 5173094 5173091 +
agtggtgtagatagtaataa

SEQ ID NO: 3036 - DNA, 20 bp, Artificial Sequence
  Synthetic oligonucleotide; GGG chr11 5173076 5173095 5173092 +
gtggtgtagatagtaataaa

SEQ ID NO: 3037 - DNA, 20 bp, Artificial Sequence
  Synthetic oligonucleotide; GGG chr11 5173077 5173096 5173093 +
tggtgtagatagtaataaag

SEQ ID NO: 3038 - DNA, 20 bp, Artificial Sequence
  Synthetic oligonucleotide; GGG chr11 5173078 5173097 5173094 +
ggtgtagatagtaataaagg

SEQ ID NO: 3039 - DNA, 20 bp, Artificial Sequence
  Synthetic oligonucleotide; TAG chr11 5173082 5173101 5173098 +
tagatagtaataaaggggga

SEQ ID NO: 3040 - DNA, 20 bp, Artificial Sequence
  Synthetic oligonucleotide; GAG chr11 5173084 5173103 5173100 +
gatagtaataaagggggata

SEQ ID NO: 3041 - DNA, 20 bp, Artificial Sequence
  Synthetic oligonucleotide; CAG chr11 5173088 5173107 5173104 +
gtaataaagggggatagaga

SEQ ID NO: 3042 - DNA, 20 bp, Artificial Sequence
  Synthetic oligonucleotide; AAG chr11 5173102 5173121 5173118 +
tagagacagtaatcatgata

SEQ ID NO: 3043 - DNA, 20 bp, Artificial Sequence
  Synthetic oligonucleotide; CAG chr11 5173106 5173125 5173122 +
gacagtaatcatgataaaga

SEQ ID NO: 3044 - DNA, 20 bp, Artificial Sequence
  Synthetic oligonucleotide; AGG chr11 5173107 5173126 5173123 +
acagtaatcatgataaagac

SEQ ID NO: 3045 - DNA, 20 bp, Artificial Sequence
  Synthetic oligonucleotide; TAG chr11 5173116 5173135 5173132 +
atgataaagacaggtaataa

SEQ ID NO: 3046 - DNA, 20 bp, Artificial Sequence
  Synthetic oligonucleotide; TAG chr11 5173122 5173141 5173138 +
aagacaggtaataatagtgt

SEQ ID NO: 3047 - DNA, 20 bp, Artificial Sequence
  Synthetic oligonucleotide; GAG chr11 5173124 5173143 5173140 +
gacaggtaataatagtgtta

SEQ ID NO: 3048 - DNA, 20 bp, Artificial Sequence
  Synthetic oligonucleotide; TGG chr11 5173153 5173172 5173169 +
gattccacctgaaatttgtt

SEQ ID NO: 3049 - DNA, 20 bp, Artificial Sequence
  Synthetic oligonucleotide; GGG chr11 5173154 5173173 5173170 +
attccacctgaaatttgttt

SEQ ID NO: 3050 - DNA, 20 bp, Artificial Sequence
  Synthetic oligonucleotide; GGG chr11 5173155 5173174 5173171 +
ttccacctgaaatttgtttg

SEQ ID NO: 3051 - DNA, 20 bp, Artificial Sequence
  Synthetic oligonucleotide; GGG chr11 5173156 5173175 5173172 +
tccacctgaaatttgtttgg

SEQ ID NO: 3052 - DNA, 20 bp, Artificial Sequence
  Synthetic oligonucleotide; TGG chr11 5173162 5173181 5173178 +
tgaaatttgtttgggggact

SEQ ID NO: 3053 - DNA, 20 bp, Artificial Sequence
  Synthetic oligonucleotide; GGG chr11 5173163 5173182 5173179 +
gaaatttgtttgggggactt

SEQ ID NO: 3054 - DNA, 20 bp, Artificial Sequence
  Synthetic oligonucleotide; TAG chr11 5173170 5173189 5173186 +
gtttgggggacttgggtaat

SEQ ID NO: 3055 - DNA, 20 bp, Artificial Sequence
  Synthetic oligonucleotide; AAG chr11 5173183 5173202 5173199 +
gggtaattagaattttactt

SEQ ID NO: 3056 - DNA, 20 bp, Artificial Sequence
  Synthetic oligonucleotide; AAG chr11 5173220 5173239 5173236 +
taaacaatttttctaatacc

SEQ ID NO: 3057 - DNA, 20 bp, Artificial Sequence
  Synthetic oligonucleotide; AAG chr11 5173226 5173245 5173242 +
atttttctaataccaagtat

SEQ ID NO: 3058 - DNA, 20 bp, Artificial Sequence
  Synthetic oligonucleotide; AAG chr11 5173232 5173251 5173248 +
ctaataccaagtataagatc

SEQ ID NO: 3059 - DNA, 20 bp, Artificial Sequence
  Synthetic oligonucleotide; AGG chr11 5173233 5173252 5173249 +
taataccaagtataagatca

SEQ ID NO: 3060 - DNA, 20 bp, Artificial Sequence
  Synthetic oligonucleotide; GGG chr11 5173234 5173253 5173250 +
aataccaagtataagatcaa

SEQ ID NO: 3061 - DNA, 20 bp, Artificial Sequence
  Synthetic oligonucleotide; TGG chr11 5173238 5173257 5173254 +
ccaagtataagatcaagggt

SEQ ID NO: 3062 - DNA, 20 bp, Artificial Sequence
  Synthetic oligonucleotide; AAG chr11 5173246 5173265 5173262 +
aagatcaagggttggtctcc

SEQ ID NO: 3063 - DNA, 20 bp, Artificial Sequence
  Synthetic oligonucleotide; GAG chr11 5173255 5173274 5173271 +
ggttggtctccaagcatgat

SEQ ID NO: 3064 - DNA, 20 bp, Artificial Sequence
  Synthetic oligonucleotide; AGG chr11 5173256 5173275 5173272 +
gttggtctccaagcatgatg

SEQ ID NO: 3065 - DNA, 20 bp, Artificial Sequence
  Synthetic oligonucleotide; GGG chr11 5173257 5173276 5173273 +
ttggtctccaagcatgatga

SEQ ID NO: 3066 - DNA, 20 bp, Artificial Sequence
  Synthetic oligonucleotide; TGG chr11 5173296 5173315 5173312 +
tttatatttttatataaata

SEQ ID NO: 3067 - DNA, 20 bp, Artificial Sequence
  Synthetic oligonucleotide; TAG chr11 5173308 5173327 5173324 +
tataaatatggatctaattc

SEQ ID NO: 3068 - DNA, 20 bp, Artificial Sequence
  Synthetic oligonucleotide; TGG chr11 5173401 5173420 5173417 +
tatacaacttcatattcaat

SEQ ID NO: 3069 - DNA, 20 bp, Artificial Sequence
  Synthetic oligonucleotide; AAG chr11 5173406 5173425 5173422 +
aacttcatattcaattggtc

SEQ ID NO: 3070 - DNA, 20 bp, Artificial Sequence
  Synthetic oligonucleotide; AAG chr11 5173450 5173469 5173466 +
aactttgtattctttcaaat

SEQ ID NO: 3071 - DNA, 20 bp, Artificial Sequence
  Synthetic oligonucleotide; AGG chr11 5173451 5173470 5173467 +
actttgtattctttcaaata

SEQ ID NO: 3072 - DNA, 20 bp, Artificial Sequence
  Synthetic oligonucleotide; AAG chr11 5173459 5173478 5173475 +
ttctttcaaataaggattaa

SEQ ID NO: 3073 - DNA, 20 bp, Artificial Sequence
  Synthetic oligonucleotide; CAG chr11 5173463 5173482 5173479 +
ttcaaataaggattaaaagc

SEQ ID NO: 3074 - DNA, 20 bp, Artificial Sequence
  Synthetic oligonucleotide; AAG chr11 5173503 5173522 5173519 +
taatgacctaaattgaacta

SEQ ID NO: 3075 - DNA, 20 bp, Artificial Sequence
  Synthetic oligonucleotide; CGG chr11 5173518 5173537 5173534 +
aactaaagccataacaccct

SEQ ID NO: 3076 - DNA, 20 bp, Artificial Sequence
  Synthetic oligonucleotide; AAG chr11 5173521 5173540 5173537 +
taaagccataacaccctcgg

SEQ ID NO: 3077 - DNA, 20 bp, Artificial Sequence
  Synthetic oligonucleotide; AGG chr11 5173522 5173541 5173538 +
aaagccataacaccctcgga

SEQ ID NO: 3078 - DNA, 20 bp, Artificial Sequence
  Synthetic oligonucleotide; AAG chr11 5173525 5173544 5173541 +
gccataacaccctcggaagg

SEQ ID NO: 3079 - DNA, 20 bp, Artificial Sequence
  Synthetic oligonucleotide; TGG chr11 5173530 5173549 5173546 +
aacaccctcggaaggaagca

SEQ ID NO: 3080 - DNA, 20 bp, Artificial Sequence
  Synthetic oligonucleotide; GGG chr11 5173531 5173550 5173547 +
acaccctcggaaggaagcat

SEQ ID NO: 3081 - DNA, 20 bp, Artificial Sequence
  Synthetic oligonucleotide; TAG chr11 5173562 5173581 5173578 +
catgaactttgattttacaa

SEQ ID NO: 3082 - DNA, 20 bp, Artificial Sequence
  Synthetic oligonucleotide; TAG chr11 5173570 5173589 5173586 +
ttgattttacaatagattct

SEQ ID NO: 3083 - DNA, 20 bp, Artificial Sequence
  Synthetic oligonucleotide; AAG chr11 5173585 5173604 5173601 +
attcttagatatgacacaaa

SEQ ID NO: 3084 - DNA, 20 bp, Artificial Sequence
  Synthetic oligonucleotide; GAG chr11 5173591 5173610 5173607 +
agatatgacacaaaaagtat

SEQ ID NO: 3085 - DNA, 20 bp, Artificial Sequence
  Synthetic oligonucleotide; TGG chr11 5173617 5173636 5173633 +
caaaaaataaatacataaat

SEQ ID NO: 3086 - DNA, 20 bp, Artificial Sequence
  Synthetic oligonucleotide; AAG chr11 5173632 5173651 5173648 +
taaattggatttcatttaaa

SEQ ID NO: 3087 - DNA, 20 bp, Artificial Sequence
  Synthetic oligonucleotide; AAG chr11 5173655 5173674 5173671 +
ttcatgcaacaaacgacttt

SEQ ID NO: 3088 - DNA, 20 bp, Artificial Sequence
  Synthetic oligonucleotide; AAG chr11 5173659 5173678 5173675 +
tgcaacaaacgactttaaga

SEQ ID NO: 3089 - DNA, 20 bp, Artificial Sequence
  Synthetic oligonucleotide; AAG chr11 5173666 5173685 5173682 +
aacgactttaagaaagtaaa

SEQ ID NO: 3090 - DNA, 20 bp, Artificial Sequence
  Synthetic oligonucleotide; AAG chr11 5173678 5173697 5173694 +
aaagtaaaaagacaacctat

SEQ ID NO: 3091 - DNA, 20 bp, Artificial Sequence
  Synthetic oligonucleotide; GAG chr11 5173683 5173702 5173699 +
aaaaagacaacctataagat

SEQ ID NO: 3092 - DNA, 20 bp, Artificial Sequence
  Synthetic oligonucleotide; GAG chr11 5173685 5173704 5173701 +
aaagacaacctataagatga

SEQ ID NO: 3093 - DNA, 20 bp, Artificial Sequence
  Synthetic oligonucleotide; AAG chr11 5173715 5173734 5173731 +
ttgcaaattatgtatttcat

SEQ ID NO: 3094 - DNA, 20 bp, Artificial Sequence
  Synthetic oligonucleotide; CAG chr11 5173727 5173746 5173743 +
tatttcataagtttaatatc

SEQ ID NO: 3095 - DNA, 20 bp, Artificial Sequence
  Synthetic oligonucleotide; AAG chr11 5173741 5173760 5173757 +
aatatccagaatgtatgaaa

SEQ ID NO: 3096 - DNA, 20 bp, Artificial Sequence
  Synthetic oligonucleotide; AAG chr11 5173764 5173783 5173780 +
tcctacaactcaaaaacaaa

SEQ ID NO: 3097 - DNA, 20 bp, Artificial Sequence
  Synthetic oligonucleotide; TGG chr11 5173799 5173818 5173815 +
atttaaaaatatgcaaatga

SEQ ID NO: 3098 - DNA, 20 bp, Artificial Sequence
  Synthetic oligonucleotide; GGG chr11 5173800 5173819 5173816 +
tttaaaaatatgcaaatgat

SEQ ID NO: 3099 - DNA, 20 bp, Artificial Sequence
  Synthetic oligonucleotide; GAG chr11 5173806 5173825 5173822 +
aatatgcaaatgatgggaat

SEQ ID NO: 3100 - DNA, 20 bp, Artificial Sequence
  Synthetic oligonucleotide; TAG chr11 5173816 5173835 5173832 +
tgatgggaatgagtaatttc

SEQ ID NO: 3101 - DNA, 20 bp, Artificial Sequence
  Synthetic oligonucleotide; AAG chr11 5173820 5173839 5173836 +
gggaatgagtaatttctaga

SEQ ID NO: 3102 - DNA, 20 bp, Artificial Sequence
  Synthetic oligonucleotide; AAG chr11 5173823 5173842 5173839 +
aatgagtaatttctagaaag

SEQ ID NO: 3103 - DNA, 20 bp, Artificial Sequence
  Synthetic oligonucleotide; TGG chr11 5173842 5173861 5173858 +
gaagatatacaaatgaacat

SEQ ID NO: 3104 - DNA, 20 bp, Artificial Sequence
  Synthetic oligonucleotide; AAG chr11 5173873 5173892 5173889 +
atgcaaaccaaaaccacaat

SEQ ID NO: 3105 - DNA, 20 bp, Artificial Sequence
  Synthetic oligonucleotide; TAG chr11 5173894 5173913 5173910 +
agacactacttcaaacttac

SEQ ID NO: 3106 - DNA, 20 bp, Artificial Sequence
  Synthetic oligonucleotide; AAG chr11 5173911 5173930 5173927 +
tactagaatgtctatacttt

SEQ ID NO: 3107 - DNA, 20 bp, Artificial Sequence
  Synthetic oligonucleotide; GAG chr11 5173913 5173932 5173929 +
ctagaatgtctatactttaa

SEQ ID NO: 3108 - DNA, 20 bp, Artificial Sequence
  Synthetic oligonucleotide; AAG chr11 5173932 5173951 5173948 +
agagaaacaaaacaaatgaa

SEQ ID NO: 3109 - DNA, 20 bp, Artificial Sequence
  Synthetic oligonucleotide; AAG chr11 5173939 5173958 5173955 +
caaaacaaatgaaaagtaac

SEQ ID NO: 3110 - DNA, 20 bp, Artificial Sequence
  Synthetic oligonucleotide; AAG chr11 5173950 5173969 5173966 +
aaaagtaacaagtgttgaca

SEQ ID NO: 3111 - DNA, 20 bp, Artificial Sequence
  Synthetic oligonucleotide; AAG chr11 5173957 5173976 5173973 +
acaagtgttgacaaagatat

SEQ ID NO: 3112 - DNA, 20 bp, Artificial Sequence
  Synthetic oligonucleotide; TGG chr11 5173965 5173984 5173981 +
tgacaaagatataagaaaat

SEQ ID NO: 3113 - DNA, 20 bp, Artificial Sequence
  Synthetic oligonucleotide; AAG chr11 5173997 5174016 5174013 +
atattgctgctaaaaatgtt

SEQ ID NO: 3114 - DNA, 20 bp, Artificial Sequence
  Synthetic oligonucleotide; TGG chr11 5174000 5174019 5174016 +
ttgctgctaaaaatgttaag

SEQ ID NO: 3115 - DNA, 20 bp, Artificial Sequence
  Synthetic oligonucleotide; TAG chr11 5174014 5174033 5174030 +
gttaagtggtgcaacttctg

SEQ ID NO: 3116 - DNA, 20 bp, Artificial Sequence
  Synthetic oligonucleotide; CAG chr11 5174029 5174048 5174045 +
ttctgtagaaaatattttga

SEQ ID NO: 3117 - DNA, 20 bp, Artificial Sequence
  Synthetic oligonucleotide; TAG chr11 5174045 5174064 5174061 +
ttgacagttcttcaaaaact

SEQ ID NO: 3118 - DNA, 20 bp, Artificial Sequence
  Synthetic oligonucleotide; AGG chr11 5174046 5174065 5174062 +
tgacagttcttcaaaaactt

SEQ ID NO: 3119 - DNA, 20 bp, Artificial Sequence
  Synthetic oligonucleotide; TAG chr11 5174083 5174102 5174099 +
tgaccccaaaattcctctcc

SEQ ID NO: 3120 - DNA, 20 bp, Artificial Sequence
  Synthetic oligonucleotide; AGG chr11 5174084 5174103 5174100 +
gaccccaaaattcctctcct

SEQ ID NO: 3121 - DNA, 20 bp, Artificial Sequence
  Synthetic oligonucleotide; AAG chr11 5174108 5174127 5174124 +
atatattaaaaatatatata

SEQ ID NO: 3122 - DNA, 20 bp, Artificial Sequence
  Synthetic oligonucleotide; CAG chr11 5174118 5174137 5174134 +
aatatatataaagatttaaa

SEQ ID NO: 3123 - DNA, 20 bp, Artificial Sequence
  Synthetic oligonucleotide; AGG chr11 5174119 5174138 5174135 +
atatatataaagatttaaac

SEQ ID NO: 3124 - DNA, 20 bp, Artificial Sequence
  Synthetic oligonucleotide; TAG chr11 5174145 5174164 5174161 +
ttgtactgaaatgttcattg

SEQ ID NO: 3125 - DNA, 20 bp, Artificial Sequence
  Synthetic oligonucleotide; TAG chr11 5174160 5174179 5174176 +
cattgtagcattattcacaa

SEQ ID NO: 3126 - DNA, 20 bp, Artificial Sequence
  Synthetic oligonucleotide; AAG chr11 5174167 5174186 5174183 +
gcattattcacaatagccaa

SEQ ID NO: 3127 - DNA, 20 bp, Artificial Sequence
  Synthetic oligonucleotide; AGG chr11 5174168 5174187 5174184 +
cattattcacaatagccaaa

SEQ ID NO: 3128 - DNA, 20 bp, Artificial Sequence
  Synthetic oligonucleotide; TGG chr11 5174171 5174190 5174187 +
tattcacaatagccaaaagg

SEQ ID NO: 3129 - DNA, 20 bp, Artificial Sequence
  Synthetic oligonucleotide; CAG chr11 5174181 5174200 5174197 +
agccaaaaggtggaaacaac

SEQ ID NO: 3130 - DNA, 20 bp, Artificial Sequence
  Synthetic oligonucleotide; CAG chr11 5174196 5174215 5174212 +
acaaccagaatgtacataaa

SEQ ID NO: 3131 - DNA, 20 bp, Artificial Sequence
  Synthetic oligonucleotide; TGG chr11 5174234 5174253 5174250 +
aatgtgatatatacacacaa

SEQ ID NO: 3132 - DNA, 20 bp, Artificial Sequence
  Synthetic oligonucleotide; TAG chr11 5174246 5174265 5174262 +
acacacaatggaatattatg

SEQ ID NO: 3133 - DNA, 20 bp, Artificial Sequence
  Synthetic oligonucleotide; AAG chr11 5174257 5174276 5174273 +
aatattatgtagcaataaaa

SEQ ID NO: 3134 - DNA, 20 bp, Artificial Sequence
  Synthetic oligonucleotide; AAG chr11 5174264 5174283 5174280 +
tgtagcaataaaaaagaatg

SEQ ID NO: 3135 - DNA, 20 bp, Artificial Sequence
  Synthetic oligonucleotide; CAG chr11 5174269 5174288 5174285 +
caataaaaaagaatgaagta

SEQ ID NO: 3136 - DNA, 20 bp, Artificial Sequence
  Synthetic oligonucleotide; CAG chr11 5174275 5174294 5174291 +
aaaagaatgaagtacagatg

SEQ ID NO: 3137 - DNA, 20 bp, Artificial Sequence
  Synthetic oligonucleotide; AAG chr11 5174279 5174298 5174295 +
gaatgaagtacagatgcagt

SEQ ID NO: 3138 - DNA, 20 bp, Artificial Sequence
  Synthetic oligonucleotide; TAG chr11 5174302 5174321 5174318 +
tccttatttaatgtcatgaa

SEQ ID NO: 3139 - DNA, 20 bp, Artificial Sequence
  Synthetic oligonucleotide; AGG chr11 5174303 5174322 5174319 +
ccttatttaatgtcatgaat

SEQ ID NO: 3140 - DNA, 20 bp, Artificial Sequence
  Synthetic oligonucleotide; TGG chr11 5174310 5174329 5174326 +
taatgtcatgaataggtttt

SEQ ID NO: 3141 - DNA, 20 bp, Artificial Sequence
  Synthetic oligonucleotide; TGG chr11 5174316 5174335 5174332 +
catgaataggtttttggaaa

SEQ ID NO: 3142 - DNA, 20 bp, Artificial Sequence
  Synthetic oligonucleotide; AAG chr11 5174326 5174345 5174342 +
tttttggaaatggcaacttt

SEQ ID NO: 3143 - DNA, 20 bp, Artificial Sequence
  Synthetic oligonucleotide; CAG chr11 5174344 5174363 5174360 +
ttaagtgaaatgatgtaaaa

SEQ ID NO: 3144 - DNA, 20 bp, Artificial Sequence
  Synthetic oligonucleotide; TAG chr11 5174367 5174386 5174383 +
atcctcaaataacactgttt

SEQ ID NO: 3145 - DNA, 20 bp, Artificial Sequence
  Synthetic oligonucleotide; TAG chr11 5174380 5174399 5174396 +
actgttttagccaacactgt

SEQ ID NO: 3146 - DNA, 20 bp, Artificial Sequence
  Synthetic oligonucleotide; GAG chr11 5174385 5174404 5174401 +
tttagccaacactgttagat

SEQ ID NO: 3147 - DNA, 20 bp, Artificial Sequence
  Synthetic oligonucleotide; TGG chr11 5174396 5174415 5174412 +
ctgttagatgagaaaaaaaa

SEQ ID NO: 3148 - DNA, 20 bp, Artificial Sequence
  Synthetic oligonucleotide; TGG chr11 5174417 5174436 5174433 +
ggatatcattatatgtcact

SEQ ID NO: 3149 - DNA, 20 bp, Artificial Sequence
  Synthetic oligonucleotide; AAG chr11 5174424 5174443 5174440 +
attatatgtcacttggctta

SEQ ID NO: 3150 - DNA, 20 bp, Artificial Sequence
  Synthetic oligonucleotide; CAG chr11 5174430 5174449 5174446 +
tgtcacttggcttaaagttt

SEQ ID NO: 3151 - DNA, 20 bp, Artificial Sequence
  Synthetic oligonucleotide; AAG chr11 5174438 5174457 5174454 +
ggcttaaagtttcagtttcc

SEQ ID NO: 3152 - DNA, 20 bp, Artificial Sequence
  Synthetic oligonucleotide; TGG chr11 5174451 5174470 5174467 +
agtttccaagaatctatgaa

SEQ ID NO: 3153 - DNA, 20 bp, Artificial Sequence
  Synthetic oligonucleotide; AAG chr11 5174462 5174481 5174478 +
atctatgaatggacaacatt

SEQ ID NO: 3154 - DNA, 20 bp, Artificial Sequence
  Synthetic oligonucleotide; AAG chr11 5174467 5174486 5174483 +
tgaatggacaacattaagca

SEQ ID NO: 3155 - DNA, 20 bp, Artificial Sequence
  Synthetic oligonucleotide; TGG chr11 5174490 5174509 5174506 +
acttaccactatacatgtta

SEQ ID NO: 3156 - DNA, 20 bp, Artificial Sequence
  Synthetic oligonucleotide; TGG chr11 5174495 5174514 5174511 +
ccactatacatgttatggca

SEQ ID NO: 3157 - DNA, 20 bp, Artificial Sequence
  Synthetic oligonucleotide; TGG chr11 5174499 5174518 5174515 +
tatacatgttatggcatgga

SEQ ID NO: 3158 - DNA, 20 bp, Artificial Sequence
  Synthetic oligonucleotide; TGG chr11 5174519 5174538 5174535 +
tggactttgaaaccttatgt

SEQ ID NO: 3159 - DNA, 20 bp, Artificial Sequence
  Synthetic oligonucleotide; GGG chr11 5174520 5174539 5174536 +
ggactttgaaaccttatgtt

SEQ ID NO: 3160 - DNA, 20 bp, Artificial Sequence
  Synthetic oligonucleotide; AAG chr11 5174529 5174548 5174545 +
aaccttatgttgggtaaaat

SEQ ID NO: 3161 - DNA, 20 bp, Artificial Sequence
  Synthetic oligonucleotide; CAG chr11 5174533 5174552 5174549 +
ttatgttgggtaaaataagc

SEQ ID NO: 3162 - DNA, 20 bp, Artificial Sequence
  Synthetic oligonucleotide; TAG chr11 5174586 5174605 5174602 +
tttatatgaattatctaaaa

SEQ ID NO: 3163 - DNA, 20 bp, Artificial Sequence
  Synthetic oligonucleotide; TAG chr11 5174596 5174615 5174612 +
ttatctaaaatagactgatt

SEQ ID NO: 3164 - DNA, 20 bp, Artificial Sequence
  Synthetic oligonucleotide; GAG chr11 5174598 5174617 5174614 +
atctaaaatagactgattta

SEQ ID NO: 3165 - DNA, 20 bp, Artificial Sequence
  Synthetic oligonucleotide; TAG chr11 5174608 5174627 5174624 +
gactgatttagagaaacata

SEQ ID NO: 3166 - DNA, 20 bp, Artificial Sequence
  Synthetic oligonucleotide; TAG chr11 5174611 5174630 5174627 +
tgatttagagaaacatatag

SEQ ID NO: 3167 - DNA, 20 bp, Artificial Sequence
  Synthetic oligonucleotide; TAG chr11 5174616 5174635 5174632 +
tagagaaacatatagtagat

SEQ ID NO: 3168 - DNA, 20 bp, Artificial Sequence
  Synthetic oligonucleotide; GAG chr11 5174618 5174637 5174634 +
gagaaacatatagtagatta

SEQ ID NO: 3169 - DNA, 20 bp, Artificial Sequence
  Synthetic oligonucleotide; AGG chr11 5174619 5174638 5174635 +
agaaacatatagtagattag

SEQ ID NO: 3170 - DNA, 20 bp, Artificial Sequence
  Synthetic oligonucleotide; TGG chr11 5174628 5174647 5174644 +
tagtagattagaggttacta

SEQ ID NO: 3171 - DNA, 20 bp, Artificial Sequence
  Synthetic oligonucleotide; GGG chr11 5174629 5174648 5174645 +
agtagattagaggttactat

SEQ ID NO: 3172 - DNA, 20 bp, Artificial Sequence
  Synthetic oligonucleotide; TGG chr11 5174634 5174653 5174650 +
attagaggttactatgggac

SEQ ID NO: 3173 - DNA, 20 bp, Artificial Sequence
  Synthetic oligonucleotide; GGG chr11 5174635 5174654 5174651 +
ttagaggttactatgggact

SEQ ID NO: 3174 - DNA, 20 bp, Artificial Sequence
  Synthetic oligonucleotide; GGG chr11 5174636 5174655 5174652 +
tagaggttactatgggactg

SEQ ID NO: 3175 - DNA, 20 bp, Artificial Sequence
  Synthetic oligonucleotide; GAG chr11 5174638 5174657 5174654 +
gaggttactatgggactggg

SEQ ID NO: 3176 - DNA, 20 bp, Artificial Sequence
  Synthetic oligonucleotide; AAG chr11 5174653 5174672 5174669 +
ctggggagttactgcctaac

SEQ ID NO: 3177 - DNA, 20 bp, Artificial Sequence
  Synthetic oligonucleotide; TAG chr11 5174658 5174677 5174674 +
gagttactgcctaacaagta

SEQ ID NO: 3178 - DNA, 20 bp, Artificial Sequence
  Synthetic oligonucleotide; TGG chr11 5174671 5174690 5174687 +
acaagtatagcatttctgct

SEQ ID NO: 3179 - DNA, 20 bp, Artificial Sequence
  Synthetic oligonucleotide; AAG chr11 5174683 5174702 5174699 +
tttctgcttggatgatgaaa

SEQ ID NO: 3180 - DNA, 20 bp, Artificial Sequence
  Synthetic oligonucleotide; TGG chr11 5174689 5174708 5174705 +
cttggatgatgaaaaagttt

SEQ ID NO: 3181 - DNA, 20 bp, Artificial Sequence
  Synthetic oligonucleotide; GAG chr11 5174695 5174714 5174711 +
tgatgaaaaagttttggcat

SEQ ID NO: 3182 - DNA, 20 bp, Artificial Sequence
  Synthetic oligonucleotide; TGG chr11 5174702 5174721 5174718 +
aaagttttggcatgagatca

SEQ ID NO: 3183 - DNA, 20 bp, Artificial Sequence
  Synthetic oligonucleotide; TAG chr11 5174708 5174727 5174724 +
ttggcatgagatcatggtga

SEQ ID NO: 3184 - DNA, 20 bp, Artificial Sequence
  Synthetic oligonucleotide; CGG chr11 5174711 5174730 5174727 +
gcatgagatcatggtgatag

SEQ ID NO: 3185 - DNA, 20 bp, Artificial Sequence
  Synthetic oligonucleotide; TGG chr11 5174760 5174779 5174776 +
cacataattatacttaaaaa

SEQ ID NO: 3186 - DNA, 20 bp, Artificial Sequence
  Synthetic oligonucleotide; TGG chr11 5174769 5174788 5174785 +
atacttaaaaatggttaata

SEQ ID NO: 3187 - DNA, 20 bp, Artificial Sequence
  Synthetic oligonucleotide; GAG chr11 5174773 5174792 5174789 +
ttaaaaatggttaatatggt

SEQ ID NO: 3188 - DNA, 20 bp, Artificial Sequence
  Synthetic oligonucleotide; CGG chr11 5174795 5174814 5174811 +
gctttattatatatgatata

SEQ ID NO: 3189 - DNA, 20 bp, Artificial Sequence
  Synthetic oligonucleotide; TAG chr11 5174807 5174826 5174823 +
atgatatacggtattatatg

SEQ ID NO: 3190 - DNA, 20 bp, Artificial Sequence
  Synthetic oligonucleotide; TGG chr11 5174839 5174858 5174855 +
aaactttatcacaataaaaa

SEQ ID NO: 3191 - DNA, 20 bp, Artificial Sequence
  Synthetic oligonucleotide; AAG chr11 5174843 5174862 5174859 +
tttatcacaataaaaatgga

SEQ ID NO: 3192 - DNA, 20 bp, Artificial Sequence
  Synthetic oligonucleotide; AAG chr11 5174857 5174876 5174873 +
aatggaaagaaatttaaaac

SEQ ID NO: 3193 - DNA, 20 bp, Artificial Sequence
  Synthetic oligonucleotide; TAG chr11 5174878 5174897 5174894 +
agacaaatttttattttgat

SEQ ID NO: 3194 - DNA, 20 bp, Artificial Sequence
  Synthetic oligonucleotide; AGG chr11 5174879 5174898 5174895 +
gacaaatttttattttgatt

SEQ ID NO: 3195 - DNA, 20 bp, Artificial Sequence
  Synthetic oligonucleotide; GGG chr11 5174880 5174899 5174896 +
acaaatttttattttgatta

SEQ ID NO: 3196 - DNA, 20 bp, Artificial Sequence
  Synthetic oligonucleotide; GAG chr11 5174901 5174920 5174917 +
ggttgaattgaatttattat

SEQ ID NO: 3197 - DNA, 20 bp, Artificial Sequence
  Synthetic oligonucleotide; GAG chr11 5174912 5174931 5174928 +
atttattatgagttgtttct

SEQ ID NO: 3198 - DNA, 20 bp, Artificial Sequence
  Synthetic oligonucleotide; GAG chr11 5174914 5174933 5174930 +
ttattatgagttgtttctga

SEQ ID NO: 3199 - DNA, 20 bp, Artificial Sequence
  Synthetic oligonucleotide; TAG chr11 5174964 5174983 5174980 +
aacaattatttcatttattt

SEQ ID NO: 3200 - DNA, 20 bp, Artificial Sequence
  Synthetic oligonucleotide; AGG chr11 5174965 5174984 5174981 +
acaattatttcatttatttt

SEQ ID NO: 3201 - DNA, 20 bp, Artificial Sequence
  Synthetic oligonucleotide; CAG chr11 5174976 5174995 5174992 +
atttattttaggcacatata

SEQ ID NO: 3202 - DNA, 20 bp, Artificial Sequence
  Synthetic oligonucleotide; TGG chr11 5174993 5175012 5175009 +
atacagttctattatcattt

SEQ ID NO: 3203 - DNA, 20 bp, Artificial Sequence
  Synthetic oligonucleotide; GGG chr11 5174994 5175013 5175010 +
tacagttctattatcatttt

SEQ ID NO: 3204 - DNA, 20 bp, Artificial Sequence
  Synthetic oligonucleotide; TGG chr11 5175040 5175059 5175056 +
gtttttgttttacgtatttt

SEQ ID NO: 3205 - DNA, 20 bp, Artificial Sequence
  Synthetic oligonucleotide; GAG chr11 5175050 5175069 5175066 +
tacgtatttttggttttttt

SEQ ID NO: 3206 - DNA, 20 bp, Artificial Sequence
  Synthetic oligonucleotide; TGG chr11 5175054 5175073 5175070 +
tatttttggtttttttgaga

SEQ ID NO: 3207 - DNA, 20 bp, Artificial Sequence
  Synthetic oligonucleotide; GAG chr11 5175056 5175075 5175072 +
tttttggtttttttgagatg

SEQ ID NO: 3208 - DNA, 20 bp, Artificial Sequence
  Synthetic oligonucleotide; TGG chr11 5175069 5175088 5175085 +
tgagatggagtctctctctg

SEQ ID NO: 3209 - DNA, 20 bp, Artificial Sequence
  Synthetic oligonucleotide; CAG chr11 5175074 5175093 5175090 +
tggagtctctctctgtggtc

SEQ ID NO: 3210 - DNA, 20 bp, Artificial Sequence
  Synthetic oligonucleotide; AGG chr11 5175075 5175094 5175091 +
ggagtctctctctgtggtcc

SEQ ID NO: 3211 - DNA, 20 bp, Artificial Sequence
  Synthetic oligonucleotide; TAG chr11 5175079 5175098 5175095 +
tctctctctgtggtccaggc

SEQ ID NO: 3212 - DNA, 20 bp, Artificial Sequence
  Synthetic oligonucleotide; GAG chr11 5175081 5175100 5175097 +
tctctctgtggtccaggcta

SEQ ID NO: 3213 - DNA, 20 bp, Artificial Sequence
  Synthetic oligonucleotide; GAG chr11 5175085 5175104 5175101 +
tctgtggtccaggctagagt

SEQ ID NO: 3214 - DNA, 20 bp, Artificial Sequence
  Synthetic oligonucleotide; AGG chr11 5175086 5175105 5175102 +
ctgtggtccaggctagagtg

SEQ ID NO: 3215 - DNA, 20 bp, Artificial Sequence
  Synthetic oligonucleotide; CGG chr11 5175100 5175119 5175116 +
agagtgaggtgacgcgatct

SEQ ID NO: 3216 - DNA, 20 bp, Artificial Sequence
  Synthetic oligonucleotide; CAG chr11 5175123 5175142 5175139 +
ctcactgcaacctccgcctc

SEQ ID NO: 3217 - DNA, 20 bp, Artificial Sequence
  Synthetic oligonucleotide; CAG chr11 5175148 5175167 5175164 +
ttcaaatcattctcctgcct

SEQ ID NO: 3218 - DNA, 20 bp, Artificial Sequence
  Synthetic oligonucleotide; TAG chr11 5175160 5175179 5175176 +
tcctgcctcagcctcccatg

SEQ ID NO: 3219 - DNA, 20 bp, Artificial Sequence
  Synthetic oligonucleotide; TGG chr11 5175164 5175183 5175180 +
gcctcagcctcccatgtagc

SEQ ID NO: 3220 - DNA, 20 bp, Artificial Sequence
  Synthetic oligonucleotide; GGG chr11 5175165 5175184 5175181 +
cctcagcctcccatgtagct

SEQ ID NO: 3221 - DNA, 20 bp, Artificial Sequence
  Synthetic oligonucleotide; CAG chr11 5175172 5175191 5175188 +
ctcccatgtagctgggatta

SEQ ID NO: 3222 - DNA, 20 bp, Artificial Sequence
  Synthetic oligonucleotide; AGG chr11 5175173 5175192 5175189 +
tcccatgtagctgggattac

SEQ ID NO: 3223 - DNA, 20 bp, Artificial Sequence
  Synthetic oligonucleotide; TGG chr11 5175192 5175211 5175208 +
caggtgtgcgccaccacgtc

SEQ ID NO: 3224 - DNA, 20 bp, Artificial Sequence
  Synthetic oligonucleotide; TGG chr11 5175244 5175263 5175260 +
ttcccattctattttcctat

SEQ ID NO: 3225 - DNA, 20 bp, Artificial Sequence
  Synthetic oligonucleotide; CAG chr11 5175253 5175272 5175269 +
tattttcctattggttcttg

SEQ ID NO: 3226 - DNA, 20 bp, Artificial Sequence
  Synthetic oligonucleotide; CAG chr11 5175310 5175329 5175326 +
tatataactctttttacttt

SEQ ID NO: 3227 - DNA, 20 bp, Artificial Sequence
  Synthetic oligonucleotide; AGG chr11 5175311 5175330 5175327 +
atataactctttttactttc

SEQ ID NO: 3228 - DNA, 20 bp, Artificial Sequence
  Synthetic oligonucleotide; AAG chr11 5175347 5175366 5175363 +
aatgatcatatcatatacaa

SEQ ID NO: 3229 - DNA, 20 bp, Artificial Sequence
  Synthetic oligonucleotide; AAG chr11 5175351 5175370 5175367 +
atcatatcatatacaaaaga

SEQ ID NO: 3230 - DNA, 20 bp, Artificial Sequence
  Synthetic oligonucleotide; AAG chr11 5175364 5175383 5175380 +
caaaagaaagttaaaaaata

SEQ ID NO: 3231 - DNA, 20 bp, Artificial Sequence
  Synthetic oligonucleotide; AGG chr11 5175365 5175384 5175381 +
aaaagaaagttaaaaaataa

SEQ ID NO: 3232 - DNA, 20 bp, Artificial Sequence
  Synthetic oligonucleotide; AAG chr11 5175370 5175389 5175386 +
aaagttaaaaaataaaggca

SEQ ID NO: 3233 - DNA, 20 bp, Artificial Sequence
  Synthetic oligonucleotide; AAG chr11 5175382 5175401 5175398 +
taaaggcaaagatgtaaata

SEQ ID NO: 3234 - DNA, 20 bp, Artificial Sequence
  Synthetic oligonucleotide; CAG chr11 5175395 5175414 5175411 +
gtaaataaagaaatacaccc

SEQ ID NO: 3235 - DNA, 20 bp, Artificial Sequence
  Synthetic oligonucleotide; TGG chr11 5175407 5175426 5175423 +
atacaccccagattacaatt

SEQ ID NO: 3236 - DNA, 20 bp, Artificial Sequence
  Synthetic oligonucleotide; AAG chr11 5175458 5175477 5175474 +
ttgcttgattgatattaact

SEQ ID NO: 3237 - DNA, 20 bp, Artificial Sequence
  Synthetic oligonucleotide; CAG chr11 5175465 5175484 5175481 +
attgatattaactaagacct

SEQ ID NO: 3238 - DNA, 20 bp, Artificial Sequence
  Synthetic oligonucleotide; TAG chr11 5175479 5175498 5175495 +
agacctcagttataaaacaa

SEQ ID NO: 3239 - DNA, 20 bp, Artificial Sequence
  Synthetic oligonucleotide; TAG chr11 5175486 5175505 5175502 +
agttataaaacaatagtctg

SEQ ID NO: 3240 - DNA, 20 bp, Artificial Sequence
  Synthetic oligonucleotide; TGG chr11 5175489 5175508 5175505 +
tataaaacaatagtctgtag

SEQ ID NO: 3241 - DNA, 20 bp, Artificial Sequence
  Synthetic oligonucleotide; TGG chr11 5175495 5175514 5175511 +
acaatagtctgtagtggtac

SEQ ID NO: 3242 - DNA, 20 bp, Artificial Sequence
  Synthetic oligonucleotide; TGG chr11 5175501 5175520 5175517 +
gtctgtagtggtactggtct

SEQ ID NO: 3243 - DNA, 20 bp, Artificial Sequence
  Synthetic oligonucleotide; TAG chr11 5175548 5175567 5175564 +
ttctcaccttatcaatcact

SEQ ID NO: 3244 - DNA, 20 bp, Artificial Sequence
  Synthetic oligonucleotide; TAG chr11 5175591 5175610 5175607 +
ttgtttttgctaattctgtc

SEQ ID NO: 3245 - DNA, 20 bp, Artificial Sequence
  Synthetic oligonucleotide; CAG chr11 5175604 5175623 5175620 +
ttctgtctagaacaccatat

SEQ ID NO: 3246 - DNA, 20 bp, Artificial Sequence
  Synthetic oligonucleotide; TAG chr11 5175610 5175629 5175626 +
ctagaacaccatatcagttt

SEQ ID NO: 3247 - DNA, 20 bp, Artificial Sequence
  Synthetic oligonucleotide; AAG chr11 5175615 5175634 5175631 +
acaccatatcagttttagct

SEQ ID NO: 3248 - DNA, 20 bp, Artificial Sequence
  Synthetic oligonucleotide; TGG chr11 5175649 5175668 5175665 +
ctccctgctttaaaattgtt

SEQ ID NO: 3249 - DNA, 20 bp, Artificial Sequence
  Synthetic oligonucleotide; TGG chr11 5175666 5175685 5175682 +
gtttggtttctgcccttttt

SEQ ID NO: 3250 - DNA, 20 bp, Artificial Sequence
  Synthetic oligonucleotide; AAG chr11 5175804 5175823 5175820 +
ttccctttcccttcctgctg

SEQ ID NO: 3251 - DNA, 20 bp, Artificial Sequence
  Synthetic oligonucleotide; AGG chr11 5175805 5175824 5175821 +
tccctttcccttcctgctga

SEQ ID NO: 3252 - DNA, 20 bp, Artificial Sequence
  Synthetic oligonucleotide; TGG chr11 5175813 5175832 5175829 +
ccttcctgctgaaggattac

SEQ ID NO: 3253 - DNA, 20 bp, Artificial Sequence
  Synthetic oligonucleotide; AAG chr11 5175818 5175837 5175834 +
ctgctgaaggattactggtt

SEQ ID NO: 3254 - DNA, 20 bp, Artificial Sequence
  Synthetic oligonucleotide; AGG chr11 5175819 5175838 5175835 +
tgctgaaggattactggtta

SEQ ID NO: 3255 - DNA, 20 bp, Artificial Sequence
  Synthetic oligonucleotide; GAG chr11 5175821 5175840 5175837 +
ctgaaggattactggttaag

SEQ ID NO: 3256 - DNA, 20 bp, Artificial Sequence
  Synthetic oligonucleotide; CAG chr11 5175825 5175844 5175841 +
aggattactggttaaggaga

SEQ ID NO: 3257 - DNA, 20 bp, Artificial Sequence
  Synthetic oligonucleotide; TAG chr11 5175828 5175847 5175844 +
attactggttaaggagacag

SEQ ID NO: 3258 - DNA, 20 bp, Artificial Sequence
  Synthetic oligonucleotide; CAG chr11 5175855 5175874 5175871 +
tgaaaacttcttctcatgtc

SEQ ID NO: 3259 - DNA, 20 bp, Artificial Sequence
  Synthetic oligonucleotide; AGG chr11 5175856 5175875 5175872 +
gaaaacttcttctcatgtcc

SEQ ID NO: 3260 - DNA, 20 bp, Artificial Sequence
  Synthetic oligonucleotide; GGG chr11 5175857 5175876 5175873 +
aaaacttcttctcatgtcca

SEQ ID NO: 3261 - DNA, 20 bp, Artificial Sequence
  Synthetic oligonucleotide; TGG chr11 5175863 5175882 5175879 +
tcttctcatgtccagggcaa

SEQ ID NO: 3262 - DNA, 20 bp, Artificial Sequence
  Synthetic oligonucleotide; CAG chr11 5175868 5175887 5175884 +
tcatgtccagggcaatggct

SEQ ID NO: 3263 - DNA, 20 bp, Artificial Sequence
  Synthetic oligonucleotide; CAG chr11 5175883 5175902 5175899 +
tggctcagtaatgttaaatt

SEQ ID NO: 3264 - DNA, 20 bp, Artificial Sequence
  Synthetic oligonucleotide; CAG chr11 5175886 5175905 5175902 +
ctcagtaatgttaaattcag

SEQ ID NO: 3265 - DNA, 20 bp, Artificial Sequence
  Synthetic oligonucleotide; TAG chr11 5175894 5175913 5175910 +
tgttaaattcagcagctgca

SEQ ID NO: 3266 - DNA, 20 bp, Artificial Sequence
  Synthetic oligonucleotide; CAG chr11 5175900 5175919 5175916 +
attcagcagctgcatagcaa

SEQ ID NO: 3267 - DNA, 20 bp, Artificial Sequence
  Synthetic oligonucleotide; CAG chr11 5175921 5175940 5175937 +
agccatttcctaaatccttt

SEQ ID NO: 3268 - DNA, 20 bp, Artificial Sequence
  Synthetic oligonucleotide; GAG chr11 5175929 5175948 5175945 +
cctaaatcctttcagaatct

SEQ ID NO: 3269 - DNA, 20 bp, Artificial Sequence
  Synthetic oligonucleotide; AAG chr11 5175943 5175962 5175959 +
gaatctgagtgctcaactga

SEQ ID NO: 3270 - DNA, 20 bp, Artificial Sequence
  Synthetic oligonucleotide; TAG chr11 5175952 5175971 5175968 +
tgctcaactgaaagtttatt

SEQ ID NO: 3271 - DNA, 20 bp, Artificial Sequence
  Synthetic oligonucleotide; GAG chr11 5175954 5175973 5175970 +
ctcaactgaaagtttattta

SEQ ID NO: 3272 - DNA, 20 bp, Artificial Sequence
  Synthetic oligonucleotide; TAG chr11 5176024 5176043 5176040 +
gacatgtatatgttactgtg

SEQ ID NO: 3273 - DNA, 20 bp, Artificial Sequence
  Synthetic oligonucleotide; AAG chr11 5176069 5176088 5176085 +
atatattcatatacctattt

SEQ ID NO: 3274 - DNA, 20 bp, Artificial Sequence
  Synthetic oligonucleotide; TGG chr11 5176092 5176111 5176108 +
atatcatgttgcatgcattt

SEQ ID NO: 3275 - DNA, 20 bp, Artificial Sequence
  Synthetic oligonucleotide; TGG chr11 5176104 5176123 5176120 +
atgcattttggatgtgaaat

SEQ ID NO: 3276 - DNA, 20 bp, Artificial Sequence
  Synthetic oligonucleotide; TAG chr11 5176115 5176134 5176131 +
atgtgaaattggcattttct

SEQ ID NO: 3277 - DNA, 20 bp, Artificial Sequence
  Synthetic oligonucleotide; AAG chr11 5176136 5176155 5176152 +
agctccccactgctaaaatc

SEQ ID NO: 3278 - DNA, 20 bp, Artificial Sequence
  Synthetic oligonucleotide; CAG chr11 5176161 5176180 5176177 +
tacaaaatcttcctaccttt

SEQ ID NO: 3279 - DNA, 20 bp, Artificial Sequence
  Synthetic oligonucleotide; TGG chr11 5176230 5176249 5176246 +
ccatcatattattactttta

SEQ ID NO: 3280 - DNA, 20 bp, Artificial Sequence
  Synthetic oligonucleotide; GAG chr11 5176232 5176251 5176248 +
atcatattattacttttatg

SEQ ID NO: 3281 - DNA, 20 bp, Artificial Sequence
  Synthetic oligonucleotide; GAG chr11 5176247 5176266 5176263 +
ttatggagaaatgcaacgct

SEQ ID NO: 3282 - DNA, 20 bp, Artificial Sequence
  Synthetic oligonucleotide; TAG chr11 5176264 5176283 5176280 +
gctgagtgtaaatttcacat

SEQ ID NO: 3283 - DNA, 20 bp, Artificial Sequence
  Synthetic oligonucleotide; TAG chr11 5176285 5176304 5176301 +
agaatgtccaaaacattgtg

SEQ ID NO: 3284 - DNA, 20 bp, Artificial Sequence
  Synthetic oligonucleotide; GAG chr11 5176287 5176306 5176303 +
aatgtccaaaacattgtgta

SEQ ID NO: 3285 - DNA, 20 bp, Artificial Sequence
  Synthetic oligonucleotide; TAG chr11 5176290 5176309 5176306 +
gtccaaaacattgtgtagag

SEQ ID NO: 3286 - DNA, 20 bp, Artificial Sequence
  Synthetic oligonucleotide; AAG chr11 5176309 5176328 5176325 +
gtagaaaaaaaaactatatg

SEQ ID NO: 3287 - DNA, 20 bp, Artificial Sequence
  Synthetic oligonucleotide; CAG chr11 5176317 5176336 5176333 +
aaaaactatatgaagtttaa

SEQ ID NO: 3288 - DNA, 20 bp, Artificial Sequence
  Synthetic oligonucleotide; GAG chr11 5176327 5176346 5176343 +
tgaagtttaacagatgtact

SEQ ID NO: 3289 - DNA, 20 bp, Artificial Sequence
  Synthetic oligonucleotide; AAG chr11 5176346 5176365 5176362 +
tgagaaatgcaaatattttg

SEQ ID NO: 3290 - DNA, 20 bp, Artificial Sequence
  Synthetic oligonucleotide; TAG chr11 5176360 5176379 5176376 +
attttgaagacaattcaaaa

SEQ ID NO: 3291 - DNA, 20 bp, Artificial Sequence
  Synthetic oligonucleotide; TAG chr11 5176375 5176394 5176391 +
caaaatagcacttaaatatt

SEQ ID NO: 3292 - DNA, 20 bp, Artificial Sequence
  Synthetic oligonucleotide; TAG chr11 5176380 5176399 5176396 +
tagcacttaaatatttagtg

SEQ ID NO: 3293 - DNA, 20 bp, Artificial Sequence
  Synthetic oligonucleotide; TAG chr11 5176386 5176405 5176402 +
ttaaatatttagtgtagtac

SEQ ID NO: 3294 - DNA, 20 bp, Artificial Sequence
  Synthetic oligonucleotide; CAG chr11 5176389 5176408 5176405 +
aatatttagtgtagtactag

SEQ ID NO: 3295 - DNA, 20 bp, Artificial Sequence
  Synthetic oligonucleotide; TAG chr11 5176404 5176423 5176420 +
actagcagaaacaaattaat

SEQ ID NO: 3296 - DNA, 20 bp, Artificial Sequence
  Synthetic oligonucleotide; TAG chr11 5176413 5176432 5176429 +
aacaaattaattagattttt

SEQ ID NO: 3297 - DNA, 20 bp, Artificial Sequence
  Synthetic oligonucleotide; TGG chr11 5176446 5176465 5176462 +
gtattctcccttcccaataa

SEQ ID NO: 3298 - DNA, 20 bp, Artificial Sequence
  Synthetic oligonucleotide; TAG chr11 5176457 5176476 5176473 +
tcccaataatggaaatactg

SEQ ID NO: 3299 - DNA, 20 bp, Artificial Sequence
  Synthetic oligonucleotide; AGG chr11 5176458 5176477 5176474 +
cccaataatggaaatactgt

SEQ ID NO: 3300 - DNA, 20 bp, Artificial Sequence
  Synthetic oligonucleotide; AAG chr11 5176461 5176480 5176477 +
aataatggaaatactgtagg

SEQ ID NO: 3301 - DNA, 20 bp, Artificial Sequence
  Synthetic oligonucleotide; TGG chr11 5176488 5176507 5176504 +
tttctaactttcttattctt

SEQ ID NO: 3302 - DNA, 20 bp, Artificial Sequence
  Synthetic oligonucleotide; AAG chr11 5176565 5176584 5176581 +
tgtgtgtgtacatatatatg

SEQ ID NO: 3303 - DNA, 20 bp, Artificial Sequence
  Synthetic oligonucleotide; AGG chr11 5176566 5176585 5176582 +
gtgtgtgtacatatatatga

SEQ ID NO: 3304 - DNA, 20 bp, Artificial Sequence
  Synthetic oligonucleotide; TAG chr11 5176587 5176606 5176603 +
ggtacatccacatataaatg

SEQ ID NO: 3305 - DNA, 20 bp, Artificial Sequence
  Synthetic oligonucleotide; AAG chr11 5176597 5176616 5176613 +
catataaatgtagataaatt

SEQ ID NO: 3306 - DNA, 20 bp, Artificial Sequence
  Synthetic oligonucleotide; AAG chr11 5176619 5176638 5176635 +
gtgtgtgtatatgtaaatct

SEQ ID NO: 3307 - DNA, 20 bp, Artificial Sequence
  Synthetic oligonucleotide; CAG chr11 5176655 5176674 5176671 +
ataaatttctataaaaatca

SEQ ID NO: 3308 - DNA, 20 bp, Artificial Sequence
  Synthetic oligonucleotide; AAG chr11 5176661 5176680 5176677 +
ttctataaaaatcacagaaa

SEQ ID NO: 3309 - DNA, 20 bp, Artificial Sequence
  Synthetic oligonucleotide; AAG chr11 5176666 5176685 5176682 +
taaaaatcacagaaaaagct

SEQ ID NO: 3310 - DNA, 20 bp, Artificial Sequence
  Synthetic oligonucleotide; AAG chr11 5176672 5176691 5176688 +
tcacagaaaaagctaagcat

SEQ ID NO: 3311 - DNA, 20 bp, Artificial Sequence
  Synthetic oligonucleotide; AAG chr11 5176677 5176696 5176693 +
gaaaaagctaagcataagcc

SEQ ID NO: 3312 - DNA, 20 bp, Artificial Sequence
  Synthetic oligonucleotide; GAG chr11 5176683 5176702 5176699 +
gctaagcataagccaagcat

SEQ ID NO: 3313 - DNA, 20 bp, Artificial Sequence
  Synthetic oligonucleotide; TAG chr11 5176686 5176705 5176702 +
aagcataagccaagcatgag

SEQ ID NO: 3314 - DNA, 20 bp, Artificial Sequence
  Synthetic oligonucleotide; AAG chr11 5176694 5176713 5176710 +
gccaagcatgagtagatttc

SEQ ID NO: 3315 - DNA, 20 bp, Artificial Sequence
  Synthetic oligonucleotide; AAG chr11 5176702 5176721 5176718 +
tgagtagatttcaagtgttt

SEQ ID NO: 3316 - DNA, 20 bp, Artificial Sequence
  Synthetic oligonucleotide; TAG chr11 5176706 5176725 5176722 +
tagatttcaagtgtttaaga

SEQ ID NO: 3317 - DNA, 20 bp, Artificial Sequence
  Synthetic oligonucleotide; CAG chr11 5176714 5176733 5176730 +
aagtgtttaagatagtacct

SEQ ID NO: 3318 - DNA, 20 bp, Artificial Sequence
  Synthetic oligonucleotide; AAG chr11 5176725 5176744 5176741 +
atagtacctcagatttctca

SEQ ID NO: 3319 - DNA, 20 bp, Artificial Sequence
  Synthetic oligonucleotide; TAG chr11 5176747 5176766 5176763 +
gttttttttttgtctttctt

SEQ ID NO: 3320 - DNA, 20 bp, Artificial Sequence
  Synthetic oligonucleotide; AGG chr11 5176748 5176767 5176764 +
ttttttttttgtctttcttt

SEQ ID NO: 3321 - DNA, 20 bp, Artificial Sequence
  Synthetic oligonucleotide; AAG chr11 5176758 5176777 5176774 +
gtctttctttaggtgtaaat

SEQ ID NO: 3322 - DNA, 20 bp, Artificial Sequence
  Synthetic oligonucleotide; AGG chr11 5176759 5176778 5176775 +
tctttctttaggtgtaaata

SEQ ID NO: 3323 - DNA, 20 bp, Artificial Sequence
  Synthetic oligonucleotide; TGG chr11 5176782 5176801 5176798 +
tcattttttaaacattctca

SEQ ID NO: 3324 - DNA, 20 bp, Artificial Sequence
  Synthetic oligonucleotide; TAG chr11 5176793 5176812 5176809 +
acattctcatggcattgttc

SEQ ID NO: 3325 - DNA, 20 bp, Artificial Sequence
  Synthetic oligonucleotide; AGG chr11 5176794 5176813 5176810 +
cattctcatggcattgttct

SEQ ID NO: 3326 - DNA, 20 bp, Artificial Sequence
  Synthetic oligonucleotide; AAG chr11 5176802 5176821 5176818 +
tggcattgttctaggctttt

SEQ ID NO: 3327 - DNA, 20 bp, Artificial Sequence
  Synthetic oligonucleotide; AAG chr11 5176805 5176824 5176821 +
cattgttctaggcttttaag

SEQ ID NO: 3328 - DNA, 20 bp, Artificial Sequence
  Synthetic oligonucleotide; AGG chr11 5176806 5176825 5176822 +
attgttctaggcttttaaga

SEQ ID NO: 3329 - DNA, 20 bp, Artificial Sequence
  Synthetic oligonucleotide; GAG chr11 5176808 5176827 5176824 +
tgttctaggcttttaagaag

SEQ ID NO: 3330 - DNA, 20 bp, Artificial Sequence
  Synthetic oligonucleotide; GAG chr11 5176810 5176829 5176826 +
ttctaggcttttaagaagga

SEQ ID NO: 3331 - DNA, 20 bp, Artificial Sequence
  Synthetic oligonucleotide; AAG chr11 5176837 5176856 5176853 +
taaaaatttgtattgatgtg

SEQ ID NO: 3332 - DNA, 20 bp, Artificial Sequence
  Synthetic oligonucleotide; AGG chr11 5176838 5176857 5176854 +
aaaaatttgtattgatgtga

SEQ ID NO: 3333 - DNA, 20 bp, Artificial Sequence
  Synthetic oligonucleotide; GGG chr11 5176839 5176858 5176855 +
aaaatttgtattgatgtgaa

SEQ ID NO: 3334 - DNA, 20 bp, Artificial Sequence
  Synthetic oligonucleotide; AAG chr11 5176845 5176864 5176861 +
tgtattgatgtgaagggatt

SEQ ID NO: 3335 - DNA, 20 bp, Artificial Sequence
  Synthetic oligonucleotide; AGG chr11 5176846 5176865 5176862 +
gtattgatgtgaagggatta

SEQ ID NO: 3336 - DNA, 20 bp, Artificial Sequence
  Synthetic oligonucleotide; TAG chr11 5176851 5176870 5176867 +
gatgtgaagggattaaggta

SEQ ID NO: 3337 - DNA, 20 bp, Artificial Sequence
  Synthetic oligonucleotide; TAG chr11 5176858 5176877 5176874 +
agggattaaggtatagtctg

SEQ ID NO: 3338 - DNA, 20 bp, Artificial Sequence
  Synthetic oligonucleotide; TAG chr11 5176870 5176889 5176886 +
atagtctgtagataatatca

SEQ ID NO: 3339 - DNA, 20 bp, Artificial Sequence
  Synthetic oligonucleotide; TGG chr11 5176887 5176906 5176903 +
tcatagataattacttttgc

SEQ ID NO: 3340 - DNA, 20 bp, Artificial Sequence
  Synthetic oligonucleotide; GGG chr11 5176888 5176907 5176904 +
catagataattacttttgct

SEQ ID NO: 3341 - DNA, 20 bp, Artificial Sequence
  Synthetic oligonucleotide; AAG chr11 5176910 5176929 5176926 +
gattacattcttttttattt

SEQ ID NO: 3342 - DNA, 20 bp, Artificial Sequence
  Synthetic oligonucleotide; TGG chr11 5176918 5176937 5176934 +
tcttttttatttaagtttct

SEQ ID NO: 3343 - DNA, 20 bp, Artificial Sequence
  Synthetic oligonucleotide; TAG chr11 5176944 5176963 5176960 +
atattctccttaatcttctc

SEQ ID NO: 3344 - DNA, 20 bp, Artificial Sequence
  Synthetic oligonucleotide; CAG chr11 5176987 5177006 5177003 +
ttaaaaatttatttatcacc

SEQ ID NO: 3345 - DNA, 20 bp, Artificial Sequence
  Synthetic oligonucleotide; AGG chr11 5176988 5177007 5177004 +
taaaaatttatttatcaccc

SEQ ID NO: 3346 - DNA, 20 bp, Artificial Sequence
  Synthetic oligonucleotide; TAG chr11 5176993 5177012 5177009 +
atttatttatcacccaggta

SEQ ID NO: 3347 - DNA, 20 bp, Artificial Sequence
  Synthetic oligonucleotide; CAG chr11 5177020 5177039 5177036 +
tttcaatcattttacttctt

SEQ ID NO: 3348 - DNA, 20 bp, Artificial Sequence
  Synthetic oligonucleotide; TGG chr11 5177062 5177081 5177078 +
atgatgctccattgatgact

SEQ ID NO: 3349 - DNA, 20 bp, Artificial Sequence
  Synthetic oligonucleotide; GGG chr11 5177063 5177082 5177079 +
tgatgctccattgatgactt

SEQ ID NO: 3350 - DNA, 20 bp, Artificial Sequence
  Synthetic oligonucleotide; TAG chr11 5177082 5177101 5177098 +
tgggtctaaaatctccacta

SEQ ID NO: 3351 - DNA, 20 bp, Artificial Sequence
  Synthetic oligonucleotide; AGG chr11 5177083 5177102 5177099 +
gggtctaaaatctccactat

SEQ ID NO: 3352 - DNA, 20 bp, Artificial Sequence
  Synthetic oligonucleotide; GGG chr11 5177084 5177103 5177100 +
ggtctaaaatctccactata

SEQ ID NO: 3353 - DNA, 20 bp, Artificial Sequence
  Synthetic oligonucleotide; GGG chr11 5177085 5177104 5177101 +
gtctaaaatctccactatag

SEQ ID NO: 3354 - DNA, 20 bp, Artificial Sequence
  Synthetic oligonucleotide; GGG chr11 5177086 5177105 5177102 +
tctaaaatctccactatagg

SEQ ID NO: 3355 - DNA, 20 bp, Artificial Sequence
  Synthetic oligonucleotide; CAG chr11 5177099 5177118 5177115 +
ctatagggggaaatgtgtat

SEQ ID NO: 3356 - DNA, 20 bp, Artificial Sequence
  Synthetic oligonucleotide; CAG chr11 5177115 5177134 5177131 +
gtatcagattttacatcatc

SEQ ID NO: 3357 - DNA, 20 bp, Artificial Sequence
  Synthetic oligonucleotide; AGG chr11 5177116 5177135 5177132 +
tatcagattttacatcatcc

SEQ ID NO: 3358 - DNA, 20 bp, Artificial Sequence
  Synthetic oligonucleotide; TGG chr11 5177145 5177164 5177161 +
catatttgttaatttaatat

SEQ ID NO: 3359 - DNA, 20 bp, Artificial Sequence
  Synthetic oligonucleotide; AAG chr11 5177216 5177235 5177232 +
attatgtgtctattccatac

SEQ ID NO: 3360 - DNA, 20 bp, Artificial Sequence
  Synthetic oligonucleotide; GAG chr11 5177218 5177237 5177234 +
tatgtgtctattccatacaa

SEQ ID NO: 3361 - DNA, 20 bp, Artificial Sequence
  Synthetic oligonucleotide; GAG chr11 5177228 5177247 5177244 +
ttccatacaagagactttgt

SEQ ID NO: 3362 - DNA, 20 bp, Artificial Sequence
  Synthetic oligonucleotide; CAG chr11 5177235 5177254 5177251 +
caagagactttgtgagatgt

SEQ ID NO: 3363 - DNA, 20 bp, Artificial Sequence
  Synthetic oligonucleotide; GAG chr11 5177239 5177258 5177255 +
agactttgtgagatgtcagt

SEQ ID NO: 3364 - DNA, 20 bp, Artificial Sequence
  Synthetic oligonucleotide; TAG chr11 5177243 5177262 5177259 +
tttgtgagatgtcagtgagt

SEQ ID NO: 3365 - DNA, 20 bp, Artificial Sequence
  Synthetic oligonucleotide; TAG chr11 5177255 5177274 5177271 +
cagtgagttagaaaatattc

SEQ ID NO: 3366 - DNA, 20 bp, Artificial Sequence
  Synthetic oligonucleotide; AGG chr11 5177256 5177275 5177272 +
agtgagttagaaaatattct

SEQ ID NO: 3367 - DNA, 20 bp, Artificial Sequence
  Synthetic oligonucleotide; GGG chr11 5177257 5177276 5177273 +
gtgagttagaaaatattcta

SEQ ID NO: 3368 - DNA, 20 bp, Artificial Sequence
  Synthetic oligonucleotide; AAG chr11 5177275 5177294 5177291 +
tagggataacattttaactt

SEQ ID NO: 3369 - DNA, 20 bp, Artificial Sequence
  Synthetic oligonucleotide; CAG chr11 5177281 5177300 5177297 +
taacattttaacttaagtaa

SEQ ID NO: 3370 - DNA, 20 bp, Artificial Sequence
  Synthetic oligonucleotide; AGG chr11 5177282 5177301 5177298 +
aacattttaacttaagtaac

SEQ ID NO: 3371 - DNA, 20 bp, Artificial Sequence
  Synthetic oligonucleotide; TGG chr11 5177305 5177324 5177321 +
tgttgacaaaaataatatta

SEQ ID NO: 3372 - DNA, 20 bp, Artificial Sequence
  Synthetic oligonucleotide; TGG chr11 5177319 5177338 5177335 +
atattatggcttcatgttat

SEQ ID NO: 3373 - DNA, 20 bp, Artificial Sequence
  Synthetic oligonucleotide; AAG chr11 5177325 5177344 5177341 +
tggcttcatgttattggttc

SEQ ID NO: 3374 - DNA, 20 bp, Artificial Sequence
  Synthetic oligonucleotide; CAG chr11 5177334 5177353 5177350 +
gttattggttcaagtctctg

SEQ ID NO: 3375 - DNA, 20 bp, Artificial Sequence
  Synthetic oligonucleotide; GAG chr11 5177336 5177355 5177352 +
tattggttcaagtctctgca

SEQ ID NO: 3376 - DNA, 20 bp, Artificial Sequence
  Synthetic oligonucleotide; CAG chr11 5177341 5177360 5177357 +
gttcaagtctctgcagagta

SEQ ID NO: 3377 - DNA, 20 bp, Artificial Sequence
  Synthetic oligonucleotide; CGG chr11 5177344 5177363 5177360 +
caagtctctgcagagtacag

SEQ ID NO: 3378 - DNA, 20 bp, Artificial Sequence
  Synthetic oligonucleotide; GGG chr11 5177345 5177364 5177361 +
aagtctctgcagagtacagc

SEQ ID NO: 3379 - DNA, 20 bp, Artificial Sequence
  Synthetic oligonucleotide; GAG chr11 5177347 5177366 5177363 +
gtctctgcagagtacagcgg

SEQ ID NO: 3380 - DNA, 20 bp, Artificial Sequence
  Synthetic oligonucleotide; CAG chr11 5177362 5177381 5177378 +
agcgggagtgttgtacattt

SEQ ID NO: 3381 - DNA, 20 bp, Artificial Sequence
  Synthetic oligonucleotide; CAG chr11 5177365 5177384 5177381 +
gggagtgttgtacatttcag

SEQ ID NO: 3382 - DNA, 20 bp, Artificial Sequence
  Synthetic oligonucleotide; CAG chr11 5177373 5177392 5177389 +
tgtacatttcagcagaattt

SEQ ID NO: 3383 - DNA, 20 bp, Artificial Sequence
  Synthetic oligonucleotide; AAG chr11 5177388 5177407 5177404 +
aatttcagactgactataaa

SEQ ID NO: 3384 - DNA, 20 bp, Artificial Sequence
  Synthetic oligonucleotide; CAG chr11 5177393 5177412 5177409 +
cagactgactataaaaagcc

SEQ ID NO: 3385 - DNA, 20 bp, Artificial Sequence
  Synthetic oligonucleotide; TAG chr11 5177420 5177439 5177436 +
tgactcaaaaccccacttcc

SEQ ID NO: 3386 - DNA, 20 bp, Artificial Sequence
  Synthetic oligonucleotide; TAG chr11 5177430 5177449 5177446 +
ccccacttcctagctctacg

SEQ ID NO: 3387 - DNA, 20 bp, Artificial Sequence
  Synthetic oligonucleotide; AGG chr11 5177431 5177450 5177447 +
cccacttcctagctctacgt

SEQ ID NO: 3388 - DNA, 20 bp, Artificial Sequence
  Synthetic oligonucleotide; AAG chr11 5177436 5177455 5177452 +
ttcctagctctacgtaggaa

SEQ ID NO: 3389 - DNA, 20 bp, Artificial Sequence
  Synthetic oligonucleotide; TGG chr11 5177445 5177464 5177461 +
ctacgtaggaaaagtcaatc

SEQ ID NO: 3390 - DNA, 20 bp, Artificial Sequence
  Synthetic oligonucleotide; AAG chr11 5177499 5177518 5177515 +
gattatctttatatattttt

SEQ ID NO: 3391 - DNA, 20 bp, Artificial Sequence
  Synthetic oligonucleotide; TAG chr11 5177518 5177537 5177534 +
taagttaaaattcatgaaaa

SEQ ID NO: 3392 - DNA, 20 bp, Artificial Sequence
  Synthetic oligonucleotide; TGG chr11 5177535 5177554 5177551 +
aaatagtatttctgaaaaaa

SEQ ID NO: 3393 - DNA, 20 bp, Artificial Sequence
  Synthetic oligonucleotide; GAG chr11 5177537 5177556 5177553 +
atagtatttctgaaaaaatg

SEQ ID NO: 3394 - DNA, 20 bp, Artificial Sequence
  Synthetic oligonucleotide; AAG chr11 5177550 5177569 5177566 +
aaaaatggagaatttcatta

SEQ ID NO: 3395 - DNA, 20 bp, Artificial Sequence
  Synthetic oligonucleotide; GAG chr11 5177582 5177601 5177598 +
tttcaaaacctttgatcttt

SEQ ID NO: 3396 - DNA, 20 bp, Artificial Sequence
  Synthetic oligonucleotide; TAG chr11 5177590 5177609 5177606 +
cctttgatctttgagtgcct

SEQ ID NO: 3397 - DNA, 20 bp, Artificial Sequence
  Synthetic oligonucleotide; TGG chr11 5177603 5177622 5177619 +
agtgccttagcaaaattccg

SEQ ID NO: 3398 - DNA, 20 bp, Artificial Sequence
  Synthetic oligonucleotide; TAG chr11 5177615 5177634 5177631 +
aaattccgtggacactttga

SEQ ID NO: 3399 - DNA, 20 bp, Artificial Sequence
  Synthetic oligonucleotide; AAG chr11 5177631 5177650 5177647 +
ttgatagacaccatcatttt

SEQ ID NO: 3400 - DNA, 20 bp, Artificial Sequence
  Synthetic oligonucleotide; GAG chr11 5177641 5177660 5177657 +
ccatcattttaagtgtgttt

SEQ ID NO: 3401 - DNA, 20 bp, Artificial Sequence
  Synthetic oligonucleotide; AGG chr11 5177642 5177661 5177658 +
catcattttaagtgtgtttg

SEQ ID NO: 3402 - DNA, 20 bp, Artificial Sequence
  Synthetic oligonucleotide; TGG chr11 5177652 5177671 5177668 +
agtgtgtttgaggatttcta

SEQ ID NO: 3403 - DNA, 20 bp, Artificial Sequence
  Synthetic oligonucleotide; CAG chr11 5177680 5177699 5177696 +
atttattctattccctaaaa

SEQ ID NO: 3404 - DNA, 20 bp, Artificial Sequence
  Synthetic oligonucleotide; CAG chr11 5177698 5177717 5177714 +
aacagactttttaatcttaa

SEQ ID NO: 3405 - DNA, 20 bp, Artificial Sequence
  Synthetic oligonucleotide; TAG chr11 5177711 5177730 5177727 +
atcttaacagcatacactga

SEQ ID NO: 3406 - DNA, 20 bp, Artificial Sequence
  Synthetic oligonucleotide; AGG chr11 5177712 5177731 5177728 +
tcttaacagcatacactgat

SEQ ID NO: 3407 - DNA, 20 bp, Artificial Sequence
  Synthetic oligonucleotide; GAG chr11 5177714 5177733 5177730 +
ttaacagcatacactgatag

SEQ ID NO: 3408 - DNA, 20 bp, Artificial Sequence
  Synthetic oligonucleotide; GAG chr11 5177716 5177735 5177732 +
aacagcatacactgatagga

SEQ ID NO: 3409 - DNA, 20 bp, Artificial Sequence
  Synthetic oligonucleotide; AAG chr11 5177721 5177740 5177737 +
catacactgataggagagaa

SEQ ID NO: 3410 - DNA, 20 bp, Artificial Sequence
  Synthetic oligonucleotide; TGG chr11 5177750 5177769 5177766 +
cactcgatctttaatttgtt

SEQ ID NO: 3411 - DNA, 20 bp, Artificial Sequence
  Synthetic oligonucleotide; TGG chr11 5177771 5177790 5177787 +
ggtcttcaccccataaatga

SEQ ID NO: 3412 - DNA, 20 bp, Artificial Sequence
  Synthetic oligonucleotide; GGG chr11 5177772 5177791 5177788 +
gtcttcaccccataaatgat

SEQ ID NO: 3413 - DNA, 20 bp, Artificial Sequence
  Synthetic oligonucleotide; GGG chr11 5177773 5177792 5177789 +
tcttcaccccataaatgatg

SEQ ID NO: 3414 - DNA, 20 bp, Artificial Sequence
  Synthetic oligonucleotide; TAG chr11 5177778 5177797 5177794 +
accccataaatgatggggtt

SEQ ID NO: 3415 - DNA, 20 bp, Artificial Sequence
  Synthetic oligonucleotide; TAG chr11 5177783 5177802 5177799 +
ataaatgatggggtttagca

SEQ ID NO: 3416 - DNA, 20 bp, Artificial Sequence
  Synthetic oligonucleotide; AGG chr11 5177784 5177803 5177800 +
taaatgatggggtttagcat

SEQ ID NO: 3417 - DNA, 20 bp, Artificial Sequence
  Synthetic oligonucleotide; GGG chr11 5177785 5177804 5177801 +
aaatgatggggtttagcata

SEQ ID NO: 3418 - DNA, 20 bp, Artificial Sequence
  Synthetic oligonucleotide; GGG chr11 5177786 5177805 5177802 +
aatgatggggtttagcatag

SEQ ID NO: 3419 - DNA, 20 bp, Artificial Sequence
  Synthetic oligonucleotide; GGG chr11 5177787 5177806 5177803 +
atgatggggtttagcatagg

SEQ ID NO: 3420 - DNA, 20 bp, Artificial Sequence
  Synthetic oligonucleotide; TAG chr11 5177800 5177819 5177816 +
gcatagggggcactaacaca

SEQ ID NO: 3421 - DNA, 20 bp, Artificial Sequence
  Synthetic oligonucleotide; GAG chr11 5177802 5177821 5177818 +
atagggggcactaacacata

SEQ ID NO: 3422 - DNA, 20 bp, Artificial Sequence
  Synthetic oligonucleotide; TAG chr11 5177814 5177833 5177830 +
aacacatagagactgcccac

SEQ ID NO: 3423 - DNA, 20 bp, Artificial Sequence
  Synthetic oligonucleotide; AGG chr11 5177815 5177834 5177831 +
acacatagagactgcccact

SEQ ID NO: 3424 - DNA, 20 bp, Artificial Sequence
  Synthetic oligonucleotide; TGG chr11 5177827 5177846 5177843 +
tgcccactaggatgtgaatg

SEQ ID NO: 3425 - DNA, 20 bp, Artificial Sequence
  Synthetic oligonucleotide; GAG chr11 5177831 5177850 5177847 +
cactaggatgtgaatgtggt

SEQ ID NO: 3426 - DNA, 20 bp, Artificial Sequence
  Synthetic oligonucleotide; AGG chr11 5177832 5177851 5177848 +
actaggatgtgaatgtggtg

SEQ ID NO: 3427 - DNA, 20 bp, Artificial Sequence
  Synthetic oligonucleotide; GGG chr11 5177833 5177852 5177849 +
ctaggatgtgaatgtggtga

SEQ ID NO: 3428 - DNA, 20 bp, Artificial Sequence
  Synthetic oligonucleotide; TGG chr11 5177837 5177856 5177853 +
gatgtgaatgtggtgaggga

SEQ ID NO: 3429 - DNA, 20 bp, Artificial Sequence
  Synthetic oligonucleotide; AAG chr11 5177851 5177870 5177867 +
gagggatggttttacctcca

SEQ ID NO: 3430 - DNA, 20 bp, Artificial Sequence
  Synthetic oligonucleotide; TGG chr11 5177857 5177876 5177873 +
tggttttacctccaaagcga

SEQ ID NO: 3431 - DNA, 20 bp, Artificial Sequence
  Synthetic oligonucleotide; GGG chr11 5177858 5177877 5177874 +
ggttttacctccaaagcgat

SEQ ID NO: 3432 - DNA, 20 bp, Artificial Sequence
  Synthetic oligonucleotide; AAG chr11 5177862 5177881 5177878 +
ttacctccaaagcgatgggc

SEQ ID NO: 3433 - DNA, 20 bp, Artificial Sequence
  Synthetic oligonucleotide; AAG chr11 5177872 5177891 5177888 +
agcgatgggcaagaaatgaa

SEQ ID NO: 3434 - DNA, 20 bp, Artificial Sequence
  Synthetic oligonucleotide; TGG chr11 5177880 5177899 5177896 +
gcaagaaatgaaaagaatgc

SEQ ID NO: 3435 - DNA, 20 bp, Artificial Sequence
  Synthetic oligonucleotide; GGG chr11 5177881 5177900 5177897 +
caagaaatgaaaagaatgct

SEQ ID NO: 3436 - DNA, 20 bp, Artificial Sequence
  Synthetic oligonucleotide; GGG chr11 5177882 5177901 5177898 +
aagaaatgaaaagaatgctg

SEQ ID NO: 3437 - DNA, 20 bp, Artificial Sequence
  Synthetic oligonucleotide; TAG chr11 5177887 5177906 5177903 +
atgaaaagaatgctggggta

SEQ ID NO: 3438 - DNA, 20 bp, Artificial Sequence
  Synthetic oligonucleotide; CAG chr11 5177905 5177924 5177921 +
tatagaacataaatatgaca

SEQ ID NO: 3439 - DNA, 20 bp, Artificial Sequence
  Synthetic oligonucleotide; GAG chr11 5177912 5177931 5177928 +
cataaatatgacacagatat

SEQ ID NO: 3440 - DNA, 20 bp, Artificial Sequence
  Synthetic oligonucleotide; GAG chr11 5177914 5177933 5177930 +
taaatatgacacagatatga

SEQ ID NO: 3441 - DNA, 20 bp, Artificial Sequence
  Synthetic oligonucleotide; AAG chr11 5177928 5177947 5177944 +
atatgagagccgcacgtact

SEQ ID NO: 3442 - DNA, 20 bp, Artificial Sequence
  Synthetic oligonucleotide; AGG chr11 5177929 5177948 5177945 +
tatgagagccgcacgtacta

SEQ ID NO: 3443 - DNA, 20 bp, Artificial Sequence
  Synthetic oligonucleotide; GGG chr11 5177930 5177949 5177946 +
atgagagccgcacgtactaa

SEQ ID NO: 3444 - DNA, 20 bp, Artificial Sequence
  Synthetic oligonucleotide; TGG chr11 5177942 5177961 5177958 +
cgtactaagggccttgaacc

SEQ ID NO: 3445 - DNA, 20 bp, Artificial Sequence
  Synthetic oligonucleotide; CAG chr11 5177945 5177964 5177961 +
actaagggccttgaacctgg

SEQ ID NO: 3446 - DNA, 20 bp, Artificial Sequence
  Synthetic oligonucleotide; CAG chr11 5177950 5177969 5177966 +
gggccttgaacctggcagcc

SEQ ID NO: 3447 - DNA, 20 bp, Artificial Sequence
  Synthetic oligonucleotide; AGG chr11 5177951 5177970 5177967 +
ggccttgaacctggcagccc

SEQ ID NO: 3448 - DNA, 20 bp, Artificial Sequence
  Synthetic oligonucleotide; AAG chr11 5177954 5177973 5177970 +
cttgaacctggcagcccagg

SEQ ID NO: 3449 - DNA, 20 bp, Artificial Sequence
  Synthetic oligonucleotide; GAG chr11 5177971 5177990 5177987 +
aggaagatatctgaaacact

SEQ ID NO: 3450 - DNA, 20 bp, Artificial Sequence
  Synthetic oligonucleotide; AAG chr11 5177976 5177995 5177992 +
gatatctgaaacactgagtg

SEQ ID NO: 3451 - DNA, 20 bp, Artificial Sequence
  Synthetic oligonucleotide; AGG chr11 5177977 5177996 5177993 +
atatctgaaacactgagtga

SEQ ID NO: 3452 - DNA, 20 bp, Artificial Sequence
  Synthetic oligonucleotide; TAG chr11 5177989 5178008 5178005 +
ctgagtgaaggatcattgtg

SEQ ID NO: 3453 - DNA, 20 bp, Artificial Sequence
  Synthetic oligonucleotide; AGG chr11 5177990 5178009 5178006 +
tgagtgaaggatcattgtgt

SEQ ID NO: 3454 - DNA, 20 bp, Artificial Sequence
  Synthetic oligonucleotide; AAG chr11 5178003 5178022 5178019 +
attgtgtaggatataatgat

SEQ ID NO: 3455 - DNA, 20 bp, Artificial Sequence
  Synthetic oligonucleotide; CAG chr11 5178015 5178034 5178031 +
ataatgataagcactatatc

SEQ ID NO: 3456 - DNA, 20 bp, Artificial Sequence
  Synthetic oligonucleotide; TAG chr11 5178023 5178042 5178039 +
aagcactatatccagtcctg

SEQ ID NO: 3457 - DNA, 20 bp, Artificial Sequence
  Synthetic oligonucleotide; GAG chr11 5178025 5178044 5178041 +
gcactatatccagtcctgta

SEQ ID NO: 3458 - DNA, 20 bp, Artificial Sequence
  Synthetic oligonucleotide; GAG chr11 5178027 5178046 5178043 +
actatatccagtcctgtaga

SEQ ID NO: 3459 - DNA, 20 bp, Artificial Sequence
  Synthetic oligonucleotide; TAG chr11 5178030 5178049 5178046 +
atatccagtcctgtagagag

SEQ ID NO: 3460 - DNA, 20 bp, Artificial Sequence
  Synthetic oligonucleotide; AGG chr11 5178031 5178050 5178047 +
tatccagtcctgtagagagt

SEQ ID NO: 3461 - DNA, 20 bp, Artificial Sequence
  Synthetic oligonucleotide; GGG chr11 5178032 5178051 5178048 +
atccagtcctgtagagagta

SEQ ID NO: 3462 - DNA, 20 bp, Artificial Sequence
  Synthetic oligonucleotide; CAG chr11 5178038 5178057 5178054 +
tcctgtagagagtagggcca

SEQ ID NO: 3463 - DNA, 20 bp, Artificial Sequence
  Synthetic oligonucleotide; GAG chr11 5178042 5178061 5178058 +
gtagagagtagggccacagt

SEQ ID NO: 3464 - DNA, 20 bp, Artificial Sequence
  Synthetic oligonucleotide; AGG chr11 5178043 5178062 5178059 +
tagagagtagggccacagtg

SEQ ID NO: 3465 - DNA, 20 bp, Artificial Sequence
  Synthetic oligonucleotide; AAG chr11 5178077 5178096 5178093 +
attgacattgatattgccac

SEQ ID NO: 3466 - DNA, 20 bp, Artificial Sequence
  Synthetic oligonucleotide; TGG chr11 5178086 5178105 5178102 +
gatattgccacaagccaatc

SEQ ID NO: 3467 - DNA, 20 bp, Artificial Sequence
  Synthetic oligonucleotide; CAG chr11 5178100 5178119 5178116 +
ccaatctggcaatgtgctca

SEQ ID NO: 3468 - DNA, 20 bp, Artificial Sequence
  Synthetic oligonucleotide; TAG chr11 5178103 5178122 5178119 +
atctggcaatgtgctcacag

SEQ ID NO: 3469 - DNA, 20 bp, Artificial Sequence
  Synthetic oligonucleotide; AGG chr11 5178104 5178123 5178120 +
tctggcaatgtgctcacagt

SEQ ID NO: 3470 - DNA, 20 bp, Artificial Sequence
  Synthetic oligonucleotide; GAG chr11 5178110 5178129 5178126 +
aatgtgctcacagtaggaat

SEQ ID NO: 3471 - DNA, 20 bp, Artificial Sequence
  Synthetic oligonucleotide; AGG chr11 5178111 5178130 5178127 +
atgtgctcacagtaggaatg

SEQ ID NO: 3472 - DNA, 20 bp, Artificial Sequence
  Synthetic oligonucleotide; AAG chr11 5178138 5178157 5178154 +
atgtttctcccacaatatgt

SEQ ID NO: 3473 - DNA, 20 bp, Artificial Sequence
  Synthetic oligonucleotide; CGG chr11 5178142 5178161 5178158 +
ttctcccacaatatgtaagt

SEQ ID NO: 3474 - DNA, 20 bp, Artificial Sequence
  Synthetic oligonucleotide; CAG chr11 5178150 5178169 5178166 +
caatatgtaagtcggtatac

SEQ ID NO: 3475 - DNA, 20 bp, Artificial Sequence
  Synthetic oligonucleotide; AGG chr11 5178151 5178170 5178167 +
aatatgtaagtcggtatacc

SEQ ID NO: 3476 - DNA, 20 bp, Artificial Sequence
  Synthetic oligonucleotide; AAG chr11 5178154 5178173 5178170 +
atgtaagtcggtataccagg

SEQ ID NO: 3477 - DNA, 20 bp, Artificial Sequence
  Synthetic oligonucleotide; CGG chr11 5178162 5178181 5178178 +
cggtataccaggaagatgaa

SEQ ID NO: 3478 - DNA, 20 bp, Artificial Sequence
  Synthetic oligonucleotide; CAG chr11 5178166 5178185 5178182 +
ataccaggaagatgaacgga

SEQ ID NO: 3479 - DNA, 20 bp, Artificial Sequence
  Synthetic oligonucleotide; CAG chr11 5178169 5178188 5178185 +
ccaggaagatgaacggacag

SEQ ID NO: 3480 - DNA, 20 bp, Artificial Sequence
  Synthetic oligonucleotide; AAG chr11 5178178 5178197 5178194 +
tgaacggacagcagatgaaa

SEQ ID NO: 3481 - DNA, 20 bp, Artificial Sequence
  Synthetic oligonucleotide; CAG chr11 5178191 5178210 5178207 +
gatgaaaaagctcctgacca

SEQ ID NO: 3482 - DNA, 20 bp, Artificial Sequence
  Synthetic oligonucleotide; CGG chr11 5178215 5178234 5178231 +
tgctatgccaatcttcctga

SEQ ID NO: 3483 - DNA, 20 bp, Artificial Sequence
  Synthetic oligonucleotide; GAG chr11 5178223 5178242 5178239 +
caatcttcctgacggctgat

SEQ ID NO: 3484 - DNA, 20 bp, Artificial Sequence
  Synthetic oligonucleotide; AGG chr11 5178224 5178243 5178240 +
aatcttcctgacggctgatg

SEQ ID NO: 3485 - DNA, 20 bp, Artificial Sequence
  Synthetic oligonucleotide; TGG chr11 5178233 5178252 5178249 +
gacggctgatgaggttaaaa

SEQ ID NO: 3486 - DNA, 20 bp, Artificial Sequence
  Synthetic oligonucleotide; CAG chr11 5178243 5178262 5178259 +
gaggttaaaatggtgtatct

SEQ ID NO: 3487 - DNA, 20 bp, Artificial Sequence
  Synthetic oligonucleotide; TGG chr11 5178246 5178265 5178262 +
gttaaaatggtgtatctcag

SEQ ID NO: 3488 - DNA, 20 bp, Artificial Sequence
  Synthetic oligonucleotide; GGG chr11 5178247 5178266 5178263 +
ttaaaatggtgtatctcagt

SEQ ID NO: 3489 - DNA, 20 bp, Artificial Sequence
  Synthetic oligonucleotide; CAG chr11 5178253 5178272 5178269 +
tggtgtatctcagtgggtaa

SEQ ID NO: 3490 - DNA, 20 bp, Artificial Sequence
  Synthetic oligonucleotide; TGG chr11 5178257 5178276 5178273 +
gtatctcagtgggtaacaga

SEQ ID NO: 3491 - DNA, 20 bp, Artificial Sequence
  Synthetic oligonucleotide; TAG chr11 5178265 5178284 5178281 +
gtgggtaacagatggccaca

SEQ ID NO: 3492 - DNA, 20 bp, Artificial Sequence
  Synthetic oligonucleotide; CGG chr11 5178268 5178287 5178284 +
ggtaacagatggccacatag

SEQ ID NO: 3493 - DNA, 20 bp, Artificial Sequence
  Synthetic oligonucleotide; CAG chr11 5178285 5178304 5178301 +
tagcggtcaaatgccattgc

SEQ ID NO: 3494 - DNA, 20 bp, Artificial Sequence
  Synthetic oligonucleotide; AGG chr11 5178286 5178305 5178302 +
agcggtcaaatgccattgcc

SEQ ID NO: 3495 - DNA, 20 bp, Artificial Sequence
  Synthetic oligonucleotide; GAG chr11 5178288 5178307 5178304 +
cggtcaaatgccattgccag

SEQ ID NO: 3496 - DNA, 20 bp, Artificial Sequence
  Synthetic oligonucleotide; TAG chr11 5178293 5178312 5178309 +
aaatgccattgccaggagaa

SEQ ID NO: 3497 - DNA, 20 bp, Artificial Sequence
  Synthetic oligonucleotide; CAG chr11 5178296 5178315 5178312 +
tgccattgccaggagaatag

SEQ ID NO: 3498 - DNA, 20 bp, Artificial Sequence
  Synthetic oligonucleotide; AAG chr11 5178310 5178329 5178326 +
gaatagcagattctgccaca

SEQ ID NO: 3499 - DNA, 20 bp, Artificial Sequence
  Synthetic oligonucleotide; AAG chr11 5178325 5178344 5178341 +
ccacaaagatgaaatgtatg

SEQ ID NO: 3500 - DNA, 20 bp, Artificial Sequence
  Synthetic oligonucleotide; GAG chr11 5178335 5178354 5178351 +
gaaatgtatgaagaacatct

SEQ ID NO: 3501 - DNA, 20 bp, Artificial Sequence
  Synthetic oligonucleotide; AAG chr11 5178352 5178371 5178368 +
tctgagacacacaactacca

SEQ ID NO: 3502 - DNA, 20 bp, Artificial Sequence
  Synthetic oligonucleotide; AGG chr11 5178353 5178372 5178369 +
ctgagacacacaactaccaa

SEQ ID NO: 3503 - DNA, 20 bp, Artificial Sequence
  Synthetic oligonucleotide; TGG chr11 5178365 5178384 5178381 +
actaccaaaggatatgtcca

SEQ ID NO: 3504 - DNA, 20 bp, Artificial Sequence
  Synthetic oligonucleotide; GAG chr11 5178367 5178386 5178383 +
taccaaaggatatgtccatg

SEQ ID NO: 3505 - DNA, 20 bp, Artificial Sequence
  Synthetic oligonucleotide; TGG chr11 5178370 5178389 5178386 +
caaaggatatgtccatggag

SEQ ID NO: 3506 - DNA, 20 bp, Artificial Sequence
  Synthetic oligonucleotide; CAG chr11 5178376 5178395 5178392 +
atatgtccatggagtggaac

SEQ ID NO: 3507 - DNA, 20 bp, Artificial Sequence
  Synthetic oligonucleotide; GAG chr11 5178378 5178397 5178394 +
atgtccatggagtggaacca

SEQ ID NO: 3508 - DNA, 20 bp, Artificial Sequence
  Synthetic oligonucleotide; AGG chr11 5178379 5178398 5178395 +
tgtccatggagtggaaccag

SEQ ID NO: 3509 - DNA, 20 bp, Artificial Sequence
  Synthetic oligonucleotide; TAG chr11 5178383 5178402 5178399 +
catggagtggaaccagagga

SEQ ID NO: 3510 - DNA, 20 bp, Artificial Sequence
  Synthetic oligonucleotide; CAG chr11 5178387 5178406 5178403 +
gagtggaaccagaggatagc

SEQ ID NO: 3511 - DNA, 20 bp, Artificial Sequence
  Synthetic oligonucleotide; TAG chr11 5178395 5178414 5178411 +
ccagaggatagccagcacct

SEQ ID NO: 3512 - DNA, 20 bp, Artificial Sequence
  Synthetic oligonucleotide; AGG chr11 5178396 5178415 5178412 +
cagaggatagccagcacctt

SEQ ID NO: 3513 - DNA, 20 bp, Artificial Sequence
  Synthetic oligonucleotide; GGG chr11 5178397 5178416 5178413 +
agaggatagccagcacctta

SEQ ID NO: 3514 - DNA, 20 bp, Artificial Sequence
  Synthetic oligonucleotide; GGG chr11 5178398 5178417 5178414 +
gaggatagccagcaccttag

SEQ ID NO: 3515 - DNA, 20 bp, Artificial Sequence
  Synthetic oligonucleotide; CAG chr11 5178404 5178423 5178420 +
agccagcaccttaggggctg

SEQ ID NO: 3516 - DNA, 20 bp, Artificial Sequence
  Synthetic oligonucleotide; CAG chr11 5178407 5178426 5178423 +
cagcaccttaggggctgcag

SEQ ID NO: 3517 - DNA, 20 bp, Artificial Sequence
  Synthetic oligonucleotide; TGG chr11 5178410 5178429 5178426 +
caccttaggggctgcagcag

SEQ ID NO: 3518 - DNA, 20 bp, Artificial Sequence
  Synthetic oligonucleotide; GAG chr11 5178414 5178433 5178430 +
ttaggggctgcagcagtggc

SEQ ID NO: 3519 - DNA, 20 bp, Artificial Sequence
  Synthetic oligonucleotide; CAG chr11 5178417 5178436 5178433 +
ggggctgcagcagtggcgag

SEQ ID NO: 3520 - DNA, 20 bp, Artificial Sequence
  Synthetic oligonucleotide; AGG chr11 5178418 5178437 5178434 +
gggctgcagcagtggcgagc

SEQ ID NO: 3521 - DNA, 20 bp, Artificial Sequence
  Synthetic oligonucleotide; AAG chr11 5178421 5178440 5178437 +
ctgcagcagtggcgagcagg

SEQ ID NO: 3522 - DNA, 20 bp, Artificial Sequence
  Synthetic oligonucleotide; CGG chr11 5178425 5178444 5178441 +
agcagtggcgagcaggaagt

SEQ ID NO: 3523 - DNA, 20 bp, Artificial Sequence
  Synthetic oligonucleotide; GAG chr11 5178430 5178449 5178446 +
tggcgagcaggaagtcggct

SEQ ID NO: 3524 - DNA, 20 bp, Artificial Sequence
  Synthetic oligonucleotide; AGG chr11 5178431 5178450 5178447 +
ggcgagcaggaagtcggctg

SEQ ID NO: 3525 - DNA, 20 bp, Artificial Sequence
  Synthetic oligonucleotide; CAG chr11 5178435 5178454 5178451 +
agcaggaagtcggctgaggc

SEQ ID NO: 3526 - DNA, 20 bp, Artificial Sequence
  Synthetic oligonucleotide; TGG chr11 5178440 5178459 5178456 +
gaagtcggctgaggccagca

SEQ ID NO: 3527 - DNA, 20 bp, Artificial Sequence
  Synthetic oligonucleotide; TAG chr11 5178444 5178463 5178460 +
tcggctgaggccagcatgga

SEQ ID NO: 3528 - DNA, 20 bp, Artificial Sequence
  Synthetic oligonucleotide; AGG chr11 5178445 5178464 5178461 +
cggctgaggccagcatggat

SEQ ID NO: 3529 - DNA, 20 bp, Artificial Sequence
  Synthetic oligonucleotide; AAG chr11 5178448 5178467 5178464 +
ctgaggccagcatggatagg

SEQ ID NO: 3530 - DNA, 20 bp, Artificial Sequence
  Synthetic oligonucleotide; GAG chr11 5178450 5178469 5178466 +
gaggccagcatggataggaa

SEQ ID NO: 3531 - DNA, 20 bp, Artificial Sequence
  Synthetic oligonucleotide; TGG chr11 5178458 5178477 5178474 +
catggataggaagagataca

SEQ ID NO: 3532 - DNA, 20 bp, Artificial Sequence
  Synthetic oligonucleotide; GGG chr11 5178459 5178478 5178475 +
atggataggaagagatacat

SEQ ID NO: 3533 - DNA, 20 bp, Artificial Sequence
  Synthetic oligonucleotide; TGG chr11 5178466 5178485 5178482 +
ggaagagatacatgggctca

SEQ ID NO: 3534 - DNA, 20 bp, Artificial Sequence
  Synthetic oligonucleotide; GAG chr11 5178468 5178487 5178484 +
aagagatacatgggctcatg

SEQ ID NO: 3535 - DNA, 20 bp, Artificial Sequence
  Synthetic oligonucleotide; CAG chr11 5178479 5178498 5178495 +
gggctcatggagactgcgct

SEQ ID NO: 3536 - DNA, 20 bp, Artificial Sequence
  Synthetic oligonucleotide; CAG chr11 5178489 5178508 5178505 +
agactgcgctcagtcatgat

SEQ ID NO: 3537 - DNA, 20 bp, Artificial Sequence
  Synthetic oligonucleotide; AGG chr11 5178490 5178509 5178506 +
gactgcgctcagtcatgatc

SEQ ID NO: 3538 - DNA, 20 bp, Artificial Sequence
  Synthetic oligonucleotide; AAG chr11 5178493 5178512 5178509 +
tgcgctcagtcatgatcagg

SEQ ID NO: 3539 - DNA, 20 bp, Artificial Sequence
  Synthetic oligonucleotide; AAG chr11 5178499 5178518 5178515 +
cagtcatgatcaggaagatc

SEQ ID NO: 3540 - DNA, 20 bp, Artificial Sequence
  Synthetic oligonucleotide; AAG chr11 5178502 5178521 5178518 +
tcatgatcaggaagatcaag

SEQ ID NO: 3541 - DNA, 20 bp, Artificial Sequence
  Synthetic oligonucleotide; CAG chr11 5178518 5178537 5178534 +
caagaagatattgcctgcaa

SEQ ID NO: 3542 - DNA, 20 bp, Artificial Sequence
  Synthetic oligonucleotide; AAG chr11 5178536 5178555 5178552 +
aacagccacaatgtacataa

SEQ ID NO: 3543 - DNA, 20 bp, Artificial Sequence
  Synthetic oligonucleotide; AAG chr11 5178542 5178561 5178558 +
cacaatgtacataaaagaaa

SEQ ID NO: 3544 - DNA, 20 bp, Artificial Sequence
  Synthetic oligonucleotide; AGG chr11 5178543 5178562 5178559 +
acaatgtacataaaagaaaa

SEQ ID NO: 3545 - DNA, 20 bp, Artificial Sequence
  Synthetic oligonucleotide; GGG chr11 5178544 5178563 5178560 +
caatgtacataaaagaaaaa

SEQ ID NO: 3546 - DNA, 20 bp, Artificial Sequence
  Synthetic oligonucleotide; TGG chr11 5178548 5178567 5178564 +
gtacataaaagaaaaaggga

SEQ ID NO: 3547 - DNA, 20 bp, Artificial Sequence
  Synthetic oligonucleotide; GAG chr11 5178550 5178569 5178566 +
acataaaagaaaaagggatg

SEQ ID NO: 3548 - DNA, 20 bp, Artificial Sequence
  Synthetic oligonucleotide; CAG chr11 5178556 5178575 5178572 +
aagaaaaagggatggagatc

SEQ ID NO: 3549 - DNA, 20 bp, Artificial Sequence
  Synthetic oligonucleotide; AGG chr11 5178557 5178576 5178573 +
agaaaaagggatggagatcc

SEQ ID NO: 3550 - DNA, 20 bp, Artificial Sequence
  Synthetic oligonucleotide; AAG chr11 5178565 5178584 5178581 +
ggatggagatccaggtatgc

SEQ ID NO: 3551 - DNA, 20 bp, Artificial Sequence
  Synthetic oligonucleotide; CAG chr11 5178573 5178592 5178589 +
atccaggtatgcaagccttc

SEQ ID NO: 3552 - DNA, 20 bp, Artificial Sequence
  Synthetic oligonucleotide; TGG chr11 5178579 5178598 5178595 +
gtatgcaagccttccagccc

SEQ ID NO: 3553 - DNA, 20 bp, Artificial Sequence
  Synthetic oligonucleotide; GGG chr11 5178580 5178599 5178596 +
tatgcaagccttccagccct

SEQ ID NO: 3554 - DNA, 20 bp, Artificial Sequence
  Synthetic oligonucleotide; CAG chr11 5178591 5178610 5178607 +
tccagccctgggattcccat

SEQ ID NO: 3555 - DNA, 20 bp, Artificial Sequence
  Synthetic oligonucleotide; AGG chr11 5178592 5178611 5178608 +
ccagccctgggattcccatc

SEQ ID NO: 3556 - DNA, 20 bp, Artificial Sequence
  Synthetic oligonucleotide; TGG chr11 5178610 5178629 5178626 +
tcaggacataccacacatcc

SEQ ID NO: 3557 - DNA, 20 bp, Artificial Sequence
  Synthetic oligonucleotide; GGG chr11 5178611 5178630 5178627 +
caggacataccacacatcct

SEQ ID NO: 3558 - DNA, 20 bp, Artificial Sequence
  Synthetic oligonucleotide; TAG chr11 5178617 5178636 5178633 +
ataccacacatcctgggaat

SEQ ID NO: 3559 - DNA, 20 bp, Artificial Sequence
  Synthetic oligonucleotide; AAG chr11 5178631 5178650 5178647 +
gggaattagtgtgattgcga

SEQ ID NO: 3560 - DNA, 20 bp, Artificial Sequence
  Synthetic oligonucleotide; AAG chr11 5178635 5178654 5178651 +
attagtgtgattgcgaaaga

SEQ ID NO: 3561 - DNA, 20 bp, Artificial Sequence
  Synthetic oligonucleotide; AGG chr11 5178636 5178655 5178652 +
ttagtgtgattgcgaaagaa

SEQ ID NO: 3562 - DNA, 20 bp, Artificial Sequence
  Synthetic oligonucleotide; GAG chr11 5178638 5178657 5178654 +
agtgtgattgcgaaagaaag

SEQ ID NO: 3563 - DNA, 20 bp, Artificial Sequence
  Synthetic oligonucleotide; CAG chr11 5178650 5178669 5178666 +
aaagaaaggagccgtatgta

SEQ ID NO: 3564 - DNA, 20 bp, Artificial Sequence
  Synthetic oligonucleotide; CAG chr11 5178660 5178679 5178676 +
gccgtatgtacagtttattc

SEQ ID NO: 3565 - DNA, 20 bp, Artificial Sequence
  Synthetic oligonucleotide; AGG chr11 5178661 5178680 5178677 +
ccgtatgtacagtttattcc

SEQ ID NO: 3566 - DNA, 20 bp, Artificial Sequence
  Synthetic oligonucleotide; TAG chr11 5178666 5178685 5178682 +
tgtacagtttattccaggcc

SEQ ID NO: 3567 - DNA, 20 bp, Artificial Sequence
  Synthetic oligonucleotide; TAG chr11 5178675 5178694 5178691 +
tattccaggcctagtgccat

SEQ ID NO: 3568 - DNA, 20 bp, Artificial Sequence
  Synthetic oligonucleotide; AAG chr11 5178681 5178700 5178697 +
aggcctagtgccattagtga

SEQ ID NO: 3569 - DNA, 20 bp, Artificial Sequence
  Synthetic oligonucleotide; AAG chr11 5178690 5178709 5178706 +
gccattagtgaaagactaca

SEQ ID NO: 3570 - DNA, 20 bp, Artificial Sequence
  Synthetic oligonucleotide; GAG chr11 5178695 5178714 5178711 +
tagtgaaagactacaaagtt

SEQ ID NO: 3571 - DNA, 20 bp, Artificial Sequence
  Synthetic oligonucleotide; AGG chr11 5178696 5178715 5178712 +
agtgaaagactacaaagttg

SEQ ID NO: 3572 - DNA, 20 bp, Artificial Sequence
  Synthetic oligonucleotide; TAG chr11 5178702 5178721 5178718 +
agactacaaagttgaggatt

SEQ ID NO: 3573 - DNA, 20 bp, Artificial Sequence
  Synthetic oligonucleotide; TAG chr11 5178716 5178735 5178732 +
aggatttagaaacactacct

SEQ ID NO: 3574 - DNA, 20 bp, Artificial Sequence
  Synthetic oligonucleotide; AGG chr11 5178717 5178736 5178733 +
ggatttagaaacactacctt

SEQ ID NO: 3575 - DNA, 20 bp, Artificial Sequence
  Synthetic oligonucleotide; GAG chr11 5178726 5178745 5178742 +
aacactaccttaggctgaat

SEQ ID NO: 3576 - DNA, 20 bp, Artificial Sequence
  Synthetic oligonucleotide; AGG chr11 5178727 5178746 5178743 +
acactaccttaggctgaatg

SEQ ID NO: 3577 - DNA, 20 bp, Artificial Sequence
  Synthetic oligonucleotide; CAG chr11 5178736 5178755 5178752 +
taggctgaatgaggtctcat

SEQ ID NO: 3578 - DNA, 20 bp, Artificial Sequence
  Synthetic oligonucleotide; TGG chr11 5178768 5178787 5178784 +
ctttccaatgttttcttctc

SEQ ID NO: 3579 - DNA, 20 bp, Artificial Sequence
  Synthetic oligonucleotide; GGG chr11 5178769 5178788 5178785 +
tttccaatgttttcttctct

SEQ ID NO: 3580 - DNA, 20 bp, Artificial Sequence
  Synthetic oligonucleotide; AAG chr11 5178773 5178792 5178789 +
caatgttttcttctctggga

SEQ ID NO: 3581 - DNA, 20 bp, Artificial Sequence
  Synthetic oligonucleotide; AGG chr11 5178774 5178793 5178790 +
aatgttttcttctctgggaa

SEQ ID NO: 3582 - DNA, 20 bp, Artificial Sequence
  Synthetic oligonucleotide; GAG chr11 5178776 5178795 5178792 +
tgttttcttctctgggaaag

SEQ ID NO: 3583 - DNA, 20 bp, Artificial Sequence
  Synthetic oligonucleotide; GAG chr11 5178778 5178797 5178794 +
ttttcttctctgggaaagga

SEQ ID NO: 3584 - DNA, 20 bp, Artificial Sequence
  Synthetic oligonucleotide; TGG chr11 5178786 5178805 5178802 +
tctgggaaaggagagtaaaa

SEQ ID NO: 3585 - DNA, 20 bp, Artificial Sequence
  Synthetic oligonucleotide; GGG chr11 5178787 5178806 5178803 +
ctgggaaaggagagtaaaat

SEQ ID NO: 3586 - DNA, 20 bp, Artificial Sequence
  Synthetic oligonucleotide; TAG chr11 5178794 5178813 5178810 +
aggagagtaaaatgggttaa

SEQ ID NO: 3587 - DNA, 20 bp, Artificial Sequence
  Synthetic oligonucleotide; AAG chr11 5178808 5178827 5178824 +
ggttaatagaccgaatatat

SEQ ID NO: 3588 - DNA, 20 bp, Artificial Sequence
  Synthetic oligonucleotide; TAG chr11 5178848 5178867 5178864 +
ttttttgtaccttaaaaaat

SEQ ID NO: 3589 - DNA, 20 bp, Artificial Sequence
  Synthetic oligonucleotide; TAG chr11 5178851 5178870 5178867 +
tttgtaccttaaaaaattag

SEQ ID NO: 3590 - DNA, 20 bp, Artificial Sequence
  Synthetic oligonucleotide; AAG chr11 5178935 5178954 5178951 +
cttcacaataacctattgaa

SEQ ID NO: 3591 - DNA, 20 bp, Artificial Sequence
  Synthetic oligonucleotide; CAG chr11 5178976 5178995 5178992 +
tataaatactattatttcta

SEQ ID NO: 3592 - DNA, 20 bp, Artificial Sequence
  Synthetic oligonucleotide; CAG chr11 5178995 5179014 5179011 +
acagatgtaaaaaaaaccca

SEQ ID NO: 3593 - DNA, 20 bp, Artificial Sequence
  Synthetic oligonucleotide; CAG chr11 5179003 5179022 5179019 +
aaaaaaaacccacagacttt

SEQ ID NO: 3594 - DNA, 20 bp, Artificial Sequence
  Synthetic oligonucleotide; TAG chr11 5179016 5179035 5179032 +
agactttcagcctcttaccc

SEQ ID NO: 3595 - DNA, 20 bp, Artificial Sequence
  Synthetic oligonucleotide; AGG chr11 5179017 5179036 5179033 +
gactttcagcctcttaccct

SEQ ID NO: 3596 - DNA, 20 bp, Artificial Sequence
  Synthetic oligonucleotide; TGG chr11 5179026 5179045 5179042 +
cctcttaccctaggccctac

SEQ ID NO: 3597 - DNA, 20 bp, Artificial Sequence
  Synthetic oligonucleotide; AAG chr11 5179034 5179053 5179050 +
cctaggccctactggattta

SEQ ID NO: 3598 - DNA, 20 bp, Artificial Sequence
  Synthetic oligonucleotide; AAG chr11 5179038 5179057 5179054 +
ggccctactggatttaaagt

SEQ ID NO: 3599 - DNA, 20 bp, Artificial Sequence
  Synthetic oligonucleotide; AGG chr11 5179039 5179058 5179055 +
gccctactggatttaaagta

SEQ ID NO: 3600 - DNA, 20 bp, Artificial Sequence
  Synthetic oligonucleotide; CAG chr11 5179042 5179061 5179058 +
ctactggatttaaagtaagg

SEQ ID NO: 3601 - DNA, 20 bp, Artificial Sequence
  Synthetic oligonucleotide; AGG chr11 5179043 5179062 5179059 +
tactggatttaaagtaaggc

SEQ ID NO: 3602 - DNA, 20 bp, Artificial Sequence
  Synthetic oligonucleotide; AAG chr11 5179056 5179075 5179072 +
gtaaggcaggataaatctga

SEQ ID NO: 3603 - DNA, 20 bp, Artificial Sequence
  Synthetic oligonucleotide; AAG chr11 5179093 5179112 5179109 +
accatccaatgctgcctatc

SEQ ID NO: 3604 - DNA, 20 bp, Artificial Sequence
  Synthetic oligonucleotide; AGG chr11 5179094 5179113 5179110 +
ccatccaatgctgcctatca

SEQ ID NO: 3605 - DNA, 20 bp, Artificial Sequence
  Synthetic oligonucleotide; TAG chr11 5179103 5179122 5179119 +
gctgcctatcaaggtaaaac

SEQ ID NO: 3606 - DNA, 20 bp, Artificial Sequence
  Synthetic oligonucleotide; CAG chr11 5179116 5179135 5179132 +
gtaaaactagatataaaacg

SEQ ID NO: 3607 - DNA, 20 bp, Artificial Sequence
  Synthetic oligonucleotide; AAG chr11 5179147 5179166 5179163 +
tttttactgatcatatccct

SEQ ID NO: 3608 - DNA, 20 bp, Artificial Sequence
  Synthetic oligonucleotide; AGG chr11 5179148 5179167 5179164 +
ttttactgatcatatcccta

SEQ ID NO: 3609 - DNA, 20 bp, Artificial Sequence
  Synthetic oligonucleotide; TAG chr11 5179155 5179174 5179171 +
gatcatatccctaaggaaaa

SEQ ID NO: 3610 - DNA, 20 bp, Artificial Sequence
  Synthetic oligonucleotide; GAG chr11 5179157 5179176 5179173 +
tcatatccctaaggaaaata

SEQ ID NO: 3611 - DNA, 20 bp, Artificial Sequence
  Synthetic oligonucleotide; GAG chr11 5179159 5179178 5179175 +
atatccctaaggaaaataga

SEQ ID NO: 3612 - DNA, 20 bp, Artificial Sequence
  Synthetic oligonucleotide; TAG chr11 5179172 5179191 5179188 +
aaatagagagttatgaaatt

SEQ ID NO: 3613 - DNA, 20 bp, Artificial Sequence
  Synthetic oligonucleotide; CAG chr11 5179187 5179206 5179203 +
aaatttagttgtgctgctta

SEQ ID NO: 3614 - DNA, 20 bp, Artificial Sequence
  Synthetic oligonucleotide; TGG chr11 5179193 5179212 5179209 +
agttgtgctgcttacagaaa

SEQ ID NO: 3615 - DNA, 20 bp, Artificial Sequence
  Synthetic oligonucleotide; GGG chr11 5179194 5179213 5179210 +
gttgtgctgcttacagaaat

SEQ ID NO: 3616 - DNA, 20 bp, Artificial Sequence
  Synthetic oligonucleotide; GAG chr11 5179196 5179215 5179212 +
tgtgctgcttacagaaatgg

SEQ ID NO: 3617 - DNA, 20 bp, Artificial Sequence
  Synthetic oligonucleotide; AGG chr11 5179197 5179216 5179213 +
gtgctgcttacagaaatggg

SEQ ID NO: 3618 - DNA, 20 bp, Artificial Sequence
  Synthetic oligonucleotide; GGG chr11 5179198 5179217 5179214 +
tgctgcttacagaaatggga

SEQ ID NO: 3619 - DNA, 20 bp, Artificial Sequence
  Synthetic oligonucleotide; AAG chr11 5179205 5179224 5179221 +
tacagaaatgggagggaatt

SEQ ID NO: 3620 - DNA, 20 bp, Artificial Sequence
  Synthetic oligonucleotide; TAG chr11 5179218 5179237 5179234 +
gggaattaagtctgacaaaa

SEQ ID NO: 3621 - DNA, 20 bp, Artificial Sequence
  Synthetic oligonucleotide; AAG chr11 5179226 5179245 5179242 +
agtctgacaaaatagatttc

SEQ ID NO: 3622 - DNA, 20 bp, Artificial Sequence
  Synthetic oligonucleotide; TAG chr11 5179234 5179253 5179250 +
aaaatagatttcaagcaata

SEQ ID NO: 3623 - DNA, 20 bp, Artificial Sequence
  Synthetic oligonucleotide; TGG chr11 5179262 5179281 5179278 +
atgccttcttccacattgat

SEQ ID NO: 3624 - DNA, 20 bp, Artificial Sequence
  Synthetic oligonucleotide; AAG chr11 5179280 5179299 5179296 +
attggccttaacttattgtt

SEQ ID NO: 3625 - DNA, 20 bp, Artificial Sequence
  Synthetic oligonucleotide; TAG chr11 5179291 5179310 5179307 +
cttattgttaagccatatgc

SEQ ID NO: 3626 - DNA, 20 bp, Artificial Sequence
  Synthetic oligonucleotide; AAG chr11 5179300 5179319 5179316 +
aagccatatgctagccattg

SEQ ID NO: 3627 - DNA, 20 bp, Artificial Sequence
  Synthetic oligonucleotide; CAG chr11 5179308 5179327 5179324 +
tgctagccattgaagacata

SEQ ID NO: 3628 - DNA, 20 bp, Artificial Sequence
  Synthetic oligonucleotide; TAG chr11 5179353 5179372 5179369 +
taatctatttctcaaaaata

SEQ ID NO: 3629 - DNA, 20 bp, Artificial Sequence
  Synthetic oligonucleotide; AGG chr11 5179354 5179373 5179370 +
aatctatttctcaaaaatat

SEQ ID NO: 3630 - DNA, 20 bp, Artificial Sequence
  Synthetic oligonucleotide; TAG chr11 5179375 5179394 5179391 +
ggataaaacattataaactt

SEQ ID NO: 3631 - DNA, 20 bp, Artificial Sequence
  Synthetic oligonucleotide; TGG chr11 5179388 5179407 5179404 +
taaactttagatatttgcaa

SEQ ID NO: 3632 - DNA, 20 bp, Artificial Sequence
  Synthetic oligonucleotide; CAG chr11 5179391 5179410 5179407 +
actttagatatttgcaatgg

SEQ ID NO: 3633 - DNA, 20 bp, Artificial Sequence
  Synthetic oligonucleotide; CGG chr11 5179395 5179414 5179411 +
tagatatttgcaatggcaga

SEQ ID NO: 3634 - DNA, 20 bp, Artificial Sequence
  Synthetic oligonucleotide; GAG chr11 5179397 5179416 5179413 +
gatatttgcaatggcagacg

SEQ ID NO: 3635 - DNA, 20 bp, Artificial Sequence
  Synthetic oligonucleotide; TGG chr11 5179401 5179420 5179417 +
tttgcaatggcagacggagc

SEQ ID NO: 3636 - DNA, 20 bp, Artificial Sequence
  Synthetic oligonucleotide; GGG chr11 5179402 5179421 5179418 +
ttgcaatggcagacggagct

SEQ ID NO: 3637 - DNA, 20 bp, Artificial Sequence
  Synthetic oligonucleotide; CAG chr11 5179422 5179441 5179438 +
gggtttttaaatctatatgc

SEQ ID NO: 3638 - DNA, 20 bp, Artificial Sequence
  Synthetic oligonucleotide; TGG chr11 5179427 5179446 5179443 +
tttaaatctatatgccagcc

SEQ ID NO: 3639 - DNA, 20 bp, Artificial Sequence
  Synthetic oligonucleotide; CGG chr11 5179432 5179451 5179448 +
atctatatgccagcctggca

SEQ ID NO: 3640 - DNA, 20 bp, Artificial Sequence
  Synthetic oligonucleotide; TGG chr11 5179435 5179454 5179451 +
tatatgccagcctggcacgg

SEQ ID NO: 3641 - DNA, 20 bp, Artificial Sequence
  Synthetic oligonucleotide; CAG chr11 5179454 5179473 5179470 +
gtggctcacacctgtaatcc

SEQ ID NO: 3642 - DNA, 20 bp, Artificial Sequence
  Synthetic oligonucleotide; GAG chr11 5179463 5179482 5179479 +
acctgtaatcccagcacttt

SEQ ID NO: 3643 - DNA, 20 bp, Artificial Sequence
  Synthetic oligonucleotide; GAG chr11 5179465 5179484 5179481 +
ctgtaatcccagcactttga

SEQ ID NO: 3644 - DNA, 20 bp, Artificial Sequence
  Synthetic oligonucleotide; AGG chr11 5179466 5179485 5179482 +
tgtaatcccagcactttgag

SEQ ID NO: 3645 - DNA, 20 bp, Artificial Sequence
  Synthetic oligonucleotide; GAG chr11 5179471 5179490 5179487 +
tcccagcactttgagaggct

SEQ ID NO: 3646 - DNA, 20 bp, Artificial Sequence
  Synthetic oligonucleotide; AGG chr11 5179472 5179491 5179488 +
cccagcactttgagaggctg

SEQ ID NO: 3647 - DNA, 20 bp, Artificial Sequence
  Synthetic oligonucleotide; CGG chr11 5179475 5179494 5179491 +
agcactttgagaggctgagg

SEQ ID NO: 3648 - DNA, 20 bp, Artificial Sequence
  Synthetic oligonucleotide; GGG chr11 5179476 5179495 5179492 +
gcactttgagaggctgaggc

SEQ ID NO: 3649 - DNA, 20 bp, Artificial Sequence
  Synthetic oligonucleotide; TAG chr11 5179479 5179498 5179495 +
ctttgagaggctgaggcggg

SEQ ID NO: 3650 - DNA, 20 bp, Artificial Sequence
  Synthetic oligonucleotide; AAG chr11 5179487 5179506 5179503 +
ggctgaggcgggtagatcac

SEQ ID NO: 3651 - DNA, 20 bp, Artificial Sequence
  Synthetic oligonucleotide; AGG chr11 5179488 5179507 5179504 +
gctgaggcgggtagatcaca

SEQ ID NO: 3652 - DNA, 20 bp, Artificial Sequence
  Synthetic oligonucleotide; CAG chr11 5179492 5179511 5179508 +
aggcgggtagatcacaaggt

SEQ ID NO: 3653 - DNA, 20 bp, Artificial Sequence
  Synthetic oligonucleotide; AGG chr11 5179493 5179512 5179509 +
ggcgggtagatcacaaggtc

SEQ ID NO: 3654 - DNA, 20 bp, Artificial Sequence
  Synthetic oligonucleotide; GAG chr11 5179495 5179514 5179511 +
cgggtagatcacaaggtcag

SEQ ID NO: 3655 - DNA, 20 bp, Artificial Sequence
  Synthetic oligonucleotide; CAG chr11 5179501 5179520 5179517 +
gatcacaaggtcaggagttc

SEQ ID NO: 3656 - DNA, 20 bp, Artificial Sequence
  Synthetic oligonucleotide; CAG chr11 5179506 5179525 5179522 +
caaggtcaggagttccagac

SEQ ID NO: 3657 - DNA, 20 bp, Artificial Sequence
  Synthetic oligonucleotide; TAG chr11 5179555 5179574 5179571 +
tctactaaaaatacaaaaat

SEQ ID NO: 3658 - DNA, 20 bp, Artificial Sequence
  Synthetic oligonucleotide; TGG chr11 5179559 5179578 5179575 +
ctaaaaatacaaaaattagc

SEQ ID NO: 3659 - DNA, 20 bp, Artificial Sequence
  Synthetic oligonucleotide; GGG chr11 5179560 5179579 5179576 +
taaaaatacaaaaattagct

SEQ ID NO: 3660 - DNA, 20 bp, Artificial Sequence
  Synthetic oligonucleotide; TAG chr11 5179565 5179584 5179581 +
atacaaaaattagctgggca

SEQ ID NO: 3661 - DNA, 20 bp, Artificial Sequence
  Synthetic oligonucleotide; TGG chr11 5179568 5179587 5179584 +
caaaaattagctgggcatag

SEQ ID NO: 3662 - DNA, 20 bp, Artificial Sequence
  Synthetic oligonucleotide; CAG chr11 5179587 5179606 5179603 +
gtggtgtgcacctttaatcc

SEQ ID NO: 3663 - DNA, 20 bp, Artificial Sequence
  Synthetic oligonucleotide; AAG chr11 5179596 5179615 5179612 +
acctttaatcccagctactc

SEQ ID NO: 3664 - DNA, 20 bp, Artificial Sequence
  Synthetic oligonucleotide; GAG chr11 5179598 5179617 5179614 +
ctttaatcccagctactcaa

SEQ ID NO: 3665 - DNA, 20 bp, Artificial Sequence
  Synthetic oligonucleotide; AGG chr11 5179599 5179618 5179615 +
tttaatcccagctactcaag

SEQ ID NO: 3666 - DNA, 20 bp, Artificial Sequence
  Synthetic oligonucleotide; GAG chr11 5179604 5179623 5179620 +
tcccagctactcaagaggct

SEQ ID NO: 3667 - DNA, 20 bp, Artificial Sequence
  Synthetic oligonucleotide; AGG chr11 5179605 5179624 5179621 +
cccagctactcaagaggctg

SEQ ID NO: 3668 - DNA, 20 bp, Artificial Sequence
  Synthetic oligonucleotide; CAG chr11 5179608 5179627 5179624 +
agctactcaagaggctgagg

SEQ ID NO: 3669 - DNA, 20 bp, Artificial Sequence
  Synthetic oligonucleotide; AGG chr11 5179609 5179628 5179625 +
gctactcaagaggctgaggc

SEQ ID NO: 3670 - DNA, 20 bp, Artificial Sequence
  Synthetic oligonucleotide; GAG chr11 5179611 5179630 5179627 +
tactcaagaggctgaggcag

SEQ ID NO: 3671 - DNA, 20 bp, Artificial Sequence
  Synthetic oligonucleotide; TGG chr11 5179627 5179646 5179643 +
gcaggagaatcgcttgaacc

SEQ ID NO: 3672 - DNA, 20 bp, Artificial Sequence
  Synthetic oligonucleotide; GGG chr11 5179628 5179647 5179644 +
caggagaatcgcttgaacct

SEQ ID NO: 3673 - DNA, 20 bp, Artificial Sequence
  Synthetic oligonucleotide; GAG chr11 5179630 5179649 5179646 +
ggagaatcgcttgaacctgg

SEQ ID NO: 3674 - DNA, 20 bp, Artificial Sequence
  Synthetic oligonucleotide; AGG chr11 5179631 5179650 5179647 +
gagaatcgcttgaacctggg

SEQ ID NO: 3675 - DNA, 20 bp, Artificial Sequence
  Synthetic oligonucleotide; CAG chr11 5179634 5179653 5179650 +
aatcgcttgaacctgggagg

SEQ ID NO: 3676 - DNA, 20 bp, Artificial Sequence
  Synthetic oligonucleotide; AAG chr11 5179637 5179656 5179653 +
cgcttgaacctgggaggcag

SEQ ID NO: 3677 - DNA, 20 bp, Artificial Sequence
  Synthetic oligonucleotide; CAG chr11 5179643 5179662 5179659 +
aacctgggaggcagaagttt

SEQ ID NO: 3678 - DNA, 20 bp, Artificial Sequence
  Synthetic oligonucleotide; GAG chr11 5179647 5179666 5179663 +
tgggaggcagaagtttcagt

SEQ ID NO: 3679 - DNA, 20 bp, Artificial Sequence
  Synthetic oligonucleotide; CAG chr11 5179650 5179669 5179666 +
gaggcagaagtttcagtgag

SEQ ID NO: 3680 - DNA, 20 bp, Artificial Sequence
  Synthetic oligonucleotide; GAG chr11 5179652 5179671 5179668 +
ggcagaagtttcagtgagca

SEQ ID NO: 3681 - DNA, 20 bp, Artificial Sequence
  Synthetic oligonucleotide; CAG chr11 5179672 5179691 5179688 +
gagatcgcgcaactgcactc

SEQ ID NO: 3682 - DNA, 20 bp, Artificial Sequence
  Synthetic oligonucleotide; TAG chr11 5179677 5179696 5179693 +
cgcgcaactgcactccagcc

SEQ ID NO: 3683 - DNA, 20 bp, Artificial Sequence
  Synthetic oligonucleotide; AGG chr11 5179678 5179697 5179694 +
gcgcaactgcactccagcct

SEQ ID NO: 3684 - DNA, 20 bp, Artificial Sequence
  Synthetic oligonucleotide; CAG chr11 5179684 5179703 5179700 +
ctgcactccagcctaggtga

SEQ ID NO: 3685 - DNA, 20 bp, Artificial Sequence
  Synthetic oligonucleotide; GAG chr11 5179686 5179705 5179702 +
gcactccagcctaggtgaca

SEQ ID NO: 3686 - DNA, 20 bp, Artificial Sequence
  Synthetic oligonucleotide; GAG chr11 5179690 5179709 5179706 +
tccagcctaggtgacagagc

SEQ ID NO: 3687 - DNA, 20 bp, Artificial Sequence
  Synthetic oligonucleotide; AAG chr11 5179711 5179730 5179727 +
agactccctctcaaaaaaaa

SEQ ID NO: 3688 - DNA, 20 bp, Artificial Sequence
  Synthetic oligonucleotide; TAG chr11 5179725 5179744 5179741 +
aaaaaaaagtatatgcctca

SEQ ID NO: 3689 - DNA, 20 bp, Artificial Sequence
  Synthetic oligonucleotide; AGG chr11 5179726 5179745 5179742 +
aaaaaaagtatatgcctcat

SEQ ID NO: 3690 - DNA, 20 bp, Artificial Sequence
  Synthetic oligonucleotide; TGG chr11 5179729 5179748 5179745 +
aaaagtatatgcctcatagg

SEQ ID NO: 3691 - DNA, 20 bp, Artificial Sequence
  Synthetic oligonucleotide; AAG chr11 5179734 5179753 5179750 +
tatatgcctcataggtggta

SEQ ID NO: 3692 - DNA, 20 bp, Artificial Sequence
  Synthetic oligonucleotide; CAG chr11 5179764 5179783 5179780 +
tattttgtttctttccactt

SEQ ID NO: 3693 - DNA, 20 bp, Artificial Sequence
  Synthetic oligonucleotide; GAG chr11 5179782 5179801 5179798 +
ttcagtcactgattgaaaat

SEQ ID NO: 3694 - DNA, 20 bp, Artificial Sequence
  Synthetic oligonucleotide; AAG chr11 5179827 5179846 5179843 +
atatatgtttattatacttt

SEQ ID NO: 3695 - DNA, 20 bp, Artificial Sequence
  Synthetic oligonucleotide; TAG chr11 5179833 5179852 5179849 +
gtttattatactttaagttc

SEQ ID NO: 3696 - DNA, 20 bp, Artificial Sequence
  Synthetic oligonucleotide; AGG chr11 5179834 5179853 5179850 +
tttattatactttaagttct

SEQ ID NO: 3697 - DNA, 20 bp, Artificial Sequence
  Synthetic oligonucleotide; GGG chr11 5179835 5179854 5179851 +
ttattatactttaagttcta

SEQ ID NO: 3698 - DNA, 20 bp, Artificial Sequence
  Synthetic oligonucleotide; CAG chr11 5179855 5179874 5179871 +
gggtacatgtgcacaacatg

SEQ ID NO: 3699 - DNA, 20 bp, Artificial Sequence
  Synthetic oligonucleotide; AGG chr11 5179856 5179875 5179872 +
ggtacatgtgcacaacatgc

SEQ ID NO: 3700 - DNA, 20 bp, Artificial Sequence
  Synthetic oligonucleotide; TGG chr11 5179888 5179907 5179904 +
tatgtatacatgtgccatgt

SEQ ID NO: 3701 - DNA, 20 bp, Artificial Sequence
  Synthetic oligonucleotide; TAG chr11 5179922 5179941 5179938 +
cattaactcgtcatttacat

SEQ ID NO: 3702 - DNA, 20 bp, Artificial Sequence
  Synthetic oligonucleotide; AGG chr11 5179923 5179942 5179939 +
attaactcgtcatttacatt

SEQ ID NO: 3703 - DNA, 20 bp, Artificial Sequence
  Synthetic oligonucleotide; CGG chr11 5179953 5179972 5179969 +
cctaatgctatccctccccc

SEQ ID NO: 3704 - DNA, 20 bp, Artificial Sequence
  Synthetic oligonucleotide; CAG chr11 5179970 5179989 5179986 +
ccccggcccccaccccacaa

SEQ ID NO: 3705 - DNA, 20 bp, Artificial Sequence
  Synthetic oligonucleotide; AGG chr11 5179971 5179990 5179987 +
cccggcccccaccccacaac

SEQ ID NO: 3706 - DNA, 20 bp, Artificial Sequence
  Synthetic oligonucleotide; CGG chr11 5179977 5179996 5179993 +
ccccaccccacaacaggccc

SEQ ID NO: 3707 - DNA, 20 bp, Artificial Sequence
  Synthetic oligonucleotide; GAG chr11 5180036 5180055 5180052 +
attgttcaactcccacctat

SEQ ID NO: 3708 - DNA, 20 bp, Artificial Sequence
  Synthetic oligonucleotide; GAG chr11 5180040 5180059 5180056 +
ttcaactcccacctatgagt

SEQ ID NO: 3709 - DNA, 20 bp, Artificial Sequence
  Synthetic oligonucleotide; TGG chr11 5180049 5180068 5180065 +
cacctatgagtgagaatatg

SEQ ID NO: 3710 - DNA, 20 bp, Artificial Sequence
  Synthetic oligonucleotide; TGG chr11 5180056 5180075 5180072 +
gagtgagaatatgtggtgtt

SEQ ID NO: 3711 - DNA, 20 bp, Artificial Sequence
  Synthetic oligonucleotide; CAG chr11 5180084 5180103 5180100 +
cgtccttgcgatactttgct

SEQ ID NO: 3712 - DNA, 20 bp, Artificial Sequence
  Synthetic oligonucleotide; TGG chr11 5180092 5180111 5180108 +
cgatactttgctcagaatga

SEQ ID NO: 3713 - DNA, 20 bp, Artificial Sequence
  Synthetic oligonucleotide; CAG chr11 5180099 5180118 5180115 +
ttgctcagaatgatggtttc

SEQ ID NO: 3714 - DNA, 20 bp, Artificial Sequence
  Synthetic oligonucleotide; AAG chr11 5180121 5180140 5180137 +
gtttcatccatgtccctaca

SEQ ID NO: 3715 - DNA, 20 bp, Artificial Sequence
  Synthetic oligonucleotide; AGG chr11 5180122 5180141 5180138 +
tttcatccatgtccctacaa

SEQ ID NO: 3716 - DNA, 20 bp, Artificial Sequence
  Synthetic oligonucleotide; TGG chr11 5180146 5180165 5180162 +
catgaactcatcatttttta

SEQ ID NO: 3717 - DNA, 20 bp, Artificial Sequence
  Synthetic oligonucleotide; TAG chr11 5180154 5180173 5180170 +
catcattttttatggctgca

SEQ ID NO: 3718 - DNA, 20 bp, Artificial Sequence
  Synthetic oligonucleotide; CAG chr11 5180193 5180212 5180209 +
tgtgccacattttcttaatc

SEQ ID NO: 3719 - DNA, 20 bp, Artificial Sequence
  Synthetic oligonucleotide; TGG chr11 5180207 5180226 5180223 +
ttaatccagtctatcattgt

SEQ ID NO: 3720 - DNA, 20 bp, Artificial Sequence
  Synthetic oligonucleotide; TGG chr11 5180215 5180234 5180231 +
gtctatcattgttggacatt

SEQ ID NO: 3721 - DNA, 20 bp, Artificial Sequence
  Synthetic oligonucleotide; GGG chr11 5180216 5180235 5180232 +
tctatcattgttggacattt

SEQ ID NO: 3722 - DNA, 20 bp, Artificial Sequence
  Synthetic oligonucleotide; TGG chr11 5180220 5180239 5180236 +
tcattgttggacatttgggt

SEQ ID NO: 3723 - DNA, 20 bp, Artificial Sequence
  Synthetic oligonucleotide; AAG chr11 5180227 5180246 5180243 +
tggacatttgggttggttcc

SEQ ID NO: 3724 - DNA, 20 bp, Artificial Sequence
  Synthetic oligonucleotide; TAG chr11 5180246 5180265 5180262 +
caagtctttgctattgtgaa

SEQ ID NO: 3725 - DNA, 20 bp, Artificial Sequence
  Synthetic oligonucleotide; TAG chr11 5180283 5180302 5180299 +
tacgtgtgcatgtgtcttta

SEQ ID NO: 3726 - DNA, 20 bp, Artificial Sequence
  Synthetic oligonucleotide; CAG chr11 5180286 5180305 5180302 +
gtgtgcatgtgtctttatag

SEQ ID NO: 3727 - DNA, 20 bp, Artificial Sequence
  Synthetic oligonucleotide; TGG chr11 5180306 5180325 5180322 +
cagcatgatttacattcctt

SEQ ID NO: 3728 - DNA, 20 bp, Artificial Sequence
  Synthetic oligonucleotide; GGG chr11 5180307 5180326 5180323 +
agcatgatttacattccttt

SEQ ID NO: 3729 - DNA, 20 bp, Artificial Sequence
  Synthetic oligonucleotide; CAG chr11 5180318 5180337 5180334 +
cattcctttgggtatatacc

SEQ ID NO: 3730 - DNA, 20 bp, Artificial Sequence
  Synthetic oligonucleotide; TAG chr11 5180324 5180343 5180340 +
tttgggtatatacccagtaa

SEQ ID NO: 3731 - DNA, 20 bp, Artificial Sequence
  Synthetic oligonucleotide; AGG chr11 5180325 5180344 5180341 +
ttgggtatatacccagtaat

SEQ ID NO: 3732 - DNA, 20 bp, Artificial Sequence
  Synthetic oligonucleotide; TGG chr11 5180329 5180348 5180345 +
gtatatacccagtaatagga

SEQ ID NO: 3733 - DNA, 20 bp, Artificial Sequence
  Synthetic oligonucleotide; TGG chr11 5180333 5180352 5180349 +
atacccagtaataggatggc

SEQ ID NO: 3734 - DNA, 20 bp, Artificial Sequence
  Synthetic oligonucleotide; GGG chr11 5180334 5180353 5180350 +
tacccagtaataggatggct

SEQ ID NO: 3735 - DNA, 20 bp, Artificial Sequence
  Synthetic oligonucleotide; TGG chr11 5180342 5180361 5180358 +
aataggatggctgggtcaaa

SEQ ID NO: 3736 - DNA, 20 bp, Artificial Sequence
  Synthetic oligonucleotide; TAG chr11 5180351 5180370 5180367 +
gctgggtcaaatggtatttc

SEQ ID NO: 3737 - DNA, 20 bp, Artificial Sequence
  Synthetic oligonucleotide; TAG chr11 5180357 5180376 5180373 +
tcaaatggtatttctagttc

SEQ ID NO: 3738 - DNA, 20 bp, Artificial Sequence
  Synthetic oligonucleotide; GAG chr11 5180366 5180385 5180382 +
atttctagttctagatccct

SEQ ID NO: 3739 - DNA, 20 bp, Artificial Sequence
  Synthetic oligonucleotide; AGG chr11 5180367 5180386 5180383 +
tttctagttctagatccctg

SEQ ID NO: 3740 - DNA, 20 bp, Artificial Sequence
  Synthetic oligonucleotide; TGG chr11 5180393 5180412 5180409 +
tgccacactgacttccacaa

SEQ ID NO: 3741 - DNA, 20 bp, Artificial Sequence
  Synthetic oligonucleotide; TAG chr11 5180402 5180421 5180418 +
gacttccacaatggttgaac

SEQ ID NO: 3742 - DNA, 20 bp, Artificial Sequence
  Synthetic oligonucleotide; TAG chr11 5180409 5180428 5180425 +
acaatggttgaactagttta

SEQ ID NO: 3743 - DNA, 20 bp, Artificial Sequence
  Synthetic oligonucleotide; CAG chr11 5180421 5180440 5180437 +
ctagtttatagtcccaccaa

SEQ ID NO: 3744 - DNA, 20 bp, Artificial Sequence
  Synthetic oligonucleotide; AAG chr11 5180429 5180448 5180445 +
tagtcccaccaacagtgtaa

SEQ ID NO: 3745 - DNA, 20 bp, Artificial Sequence
  Synthetic oligonucleotide; CAG chr11 5180457 5180476 5180473 +
ctatttctccacatcctctc

SEQ ID NO: 3746 - DNA, 20 bp, Artificial Sequence
  Synthetic oligonucleotide; TGG chr11 5180466 5180485 5180482 +
cacatcctctccagcacctg

SEQ ID NO: 3747 - DNA, 20 bp, Artificial Sequence
  Synthetic oligonucleotide; TGG chr11 5180501 5180520 5180517 +
ttaatgatcaccattctaac

SEQ ID NO: 3748 - DNA, 20 bp, Artificial Sequence
  Synthetic oligonucleotide; GAG chr11 5180507 5180526 5180523 +
atcaccattctaactggtgt

SEQ ID NO: 3749 - DNA, 20 bp, Artificial Sequence
  Synthetic oligonucleotide; TGG chr11 5180524 5180543 5180540 +
tgtgagatgatatctcattg

SEQ ID NO: 3750 - DNA, 20 bp, Artificial Sequence
  Synthetic oligonucleotide; TGG chr11 5180548 5180567 5180564 +
tttgatttgcatttctctga

SEQ ID NO: 3751 - DNA, 20 bp, Artificial Sequence
  Synthetic oligonucleotide; CAG chr11 5180552 5180571 5180568 +
atttgcatttctctgatggc

SEQ ID NO: 3752 - DNA, 20 bp, Artificial Sequence
  Synthetic oligonucleotide; GAG chr11 5180562 5180581 5180578 +
ctctgatggccagtgatgat

SEQ ID NO: 3753 - DNA, 20 bp, Artificial Sequence
  Synthetic oligonucleotide; TGG chr11 5180584 5180603 5180600 +
gcattttttcatgtgttttt

SEQ ID NO: 3754 - DNA, 20 bp, Artificial Sequence
  Synthetic oligonucleotide; GAG chr11 5180607 5180626 5180623 +
ctgcataaatgtcttctttt

SEQ ID NO: 3755 - DNA, 20 bp, Artificial Sequence
  Synthetic oligonucleotide; AAG chr11 5180610 5180629 5180626 +
cataaatgtcttcttttgag

SEQ ID NO: 3756 - DNA, 20 bp, Artificial Sequence
  Synthetic oligonucleotide; CAG chr11 5180646 5180665 5180662 +
ccttcacccccttgttgatg

SEQ ID NO: 3757 - DNA, 20 bp, Artificial Sequence
  Synthetic oligonucleotide; GAG chr11 5180678 5180697 5180694 +
tttttcttgtaaatttgttt

SEQ ID NO: 3758 - DNA, 20 bp, Artificial Sequence
  Synthetic oligonucleotide; TAG chr11 5180688 5180707 5180704 +
aaatttgtttgagttcattg

SEQ ID NO: 3759 - DNA, 20 bp, Artificial Sequence
  Synthetic oligonucleotide; TGG chr11 5180695 5180714 5180711 +
tttgagttcattgtagattc

SEQ ID NO: 3760 - DNA, 20 bp, Artificial Sequence
  Synthetic oligonucleotide; TAG chr11 5180702 5180721 5180718 +
tcattgtagattctggatat

SEQ ID NO: 3761 - DNA, 20 bp, Artificial Sequence
  Synthetic oligonucleotide; CAG chr11 5180713 5180732 5180729 +
tctggatattagccctttgt

SEQ ID NO: 3762 - DNA, 20 bp, Artificial Sequence
  Synthetic oligonucleotide; GAG chr11 5180718 5180737 5180734 +
atattagccctttgtcagat

SEQ ID NO: 3763 - DNA, 20 bp, Artificial Sequence
  Synthetic oligonucleotide; TAG chr11 5180721 5180740 5180737 +
ttagccctttgtcagatgag

SEQ ID NO: 3764 - DNA, 20 bp, Artificial Sequence
  Synthetic oligonucleotide; TAG chr11 5180749 5180768 5180765 +
aaaaattttctcccattgtg

SEQ ID NO: 3765 - DNA, 20 bp, Artificial Sequence
  Synthetic oligonucleotide; AGG chr11 5180750 5180769 5180766 +
aaaattttctcccattgtgt

SEQ ID NO: 3766 - DNA, 20 bp, Artificial Sequence
  Synthetic oligonucleotide; TGG chr11 5180770 5180789 5180786 +
aggttgcctgttcactctga

SEQ ID NO: 3767 - DNA, 20 bp, Artificial Sequence
  Synthetic oligonucleotide; TAG chr11 5180773 5180792 5180789 +
ttgcctgttcactctgatgg

SEQ ID NO: 3768 - DNA, 20 bp, Artificial Sequence
  Synthetic oligonucleotide; CAG chr11 5180790 5180809 5180806 +
tggtagtttcttttgctgtg

SEQ ID NO: 3769 - DNA, 20 bp, Artificial Sequence
  Synthetic oligonucleotide; AAG chr11 5180793 5180812 5180809 +
tagtttcttttgctgtgcag

SEQ ID NO: 3770 - DNA, 20 bp, Artificial Sequence
  Synthetic oligonucleotide; TAG chr11 5180801 5180820 5180817 +
tttgctgtgcagaagctctt

SEQ ID NO: 3771 - DNA, 20 bp, Artificial Sequence
  Synthetic oligonucleotide; TAG chr11 5180810 5180829 5180826 +
cagaagctctttagtttaat

SEQ ID NO: 3772 - DNA, 20 bp, Artificial Sequence
  Synthetic oligonucleotide; TGG chr11 5180852 5180871 5180868 +
tcttttgttgccattgcttt

SEQ ID NO: 3773 - DNA, 20 bp, Artificial Sequence
  Synthetic oligonucleotide; TAG chr11 5180860 5180879 5180876 +
tgccattgcttttggtgttt

SEQ ID NO: 3774 - DNA, 20 bp, Artificial Sequence
  Synthetic oligonucleotide; AAG chr11 5180868 5180887 5180884 +
cttttggtgttttagacatg

SEQ ID NO: 3775 - DNA, 20 bp, Artificial Sequence
  Synthetic oligonucleotide; TGG chr11 5180896 5180915 5180912 +
gcccatgcctatgtcctgaa

SEQ ID NO: 3776 - DNA, 20 bp, Artificial Sequence
  Synthetic oligonucleotide; TAG chr11 5180906 5180925 5180922 +
atgtcctgaatggtattgct

SEQ ID NO: 3777 - DNA, 20 bp, Artificial Sequence
  Synthetic oligonucleotide; AGG chr11 5180907 5180926 5180923 +
tgtcctgaatggtattgctt

SEQ ID NO: 3778 - DNA, 20 bp, Artificial Sequence
  Synthetic oligonucleotide; AAG chr11 5180919 5180938 5180935 +
tattgcttaggttttcttct

SEQ ID NO: 3779 - DNA, 20 bp, Artificial Sequence
  Synthetic oligonucleotide; AGG chr11 5180920 5180939 5180936 +
attgcttaggttttcttcta

SEQ ID NO: 3780 - DNA, 20 bp, Artificial Sequence
  Synthetic oligonucleotide; TGG chr11 5180929 5180948 5180945 +
gttttcttctaaggttttta

SEQ ID NO: 3781 - DNA, 20 bp, Artificial Sequence
  Synthetic oligonucleotide; TAG chr11 5180935 5180954 5180951 +
ttctaaggtttttatggttt

SEQ ID NO: 3782 - DNA, 20 bp, Artificial Sequence
  Synthetic oligonucleotide; AGG chr11 5180936 5180955 5180952 +
tctaaggtttttatggtttt

SEQ ID NO: 3783 - DNA, 20 bp, Artificial Sequence
  Synthetic oligonucleotide; AAG chr11 5180949 5180968 5180965 +
tggttttaggtctaacatgt

SEQ ID NO: 3784 - DNA, 20 bp, Artificial Sequence
  Synthetic oligonucleotide; AAG chr11 5180983 5181002 5180999 +
tcttgaaataatttttgtat

SEQ ID NO: 3785 - DNA, 20 bp, Artificial Sequence
  Synthetic oligonucleotide; AGG chr11 5180984 5181003 5181000 +
cttgaaataatttttgtata

SEQ ID NO: 3786 - DNA, 20 bp, Artificial Sequence
  Synthetic oligonucleotide; AAG chr11 5180990 5181009 5181006 +
ataatttttgtataaggtgt

SEQ ID NO: 3787 - DNA, 20 bp, Artificial Sequence
  Synthetic oligonucleotide; AGG chr11 5180991 5181010 5181007 +
taatttttgtataaggtgta

SEQ ID NO: 3788 - DNA, 20 bp, Artificial Sequence
  Synthetic oligonucleotide; AAG chr11 5180994 5181013 5181010 +
tttttgtataaggtgtaagg

SEQ ID NO: 3789 - DNA, 20 bp, Artificial Sequence
  Synthetic oligonucleotide; AGG chr11 5180995 5181014 5181011 +
ttttgtataaggtgtaagga

SEQ ID NO: 3790 - DNA, 20 bp, Artificial Sequence
  Synthetic oligonucleotide; GGG chr11 5180996 5181015 5181012 +
tttgtataaggtgtaaggaa

SEQ ID NO: 3791 - DNA, 20 bp, Artificial Sequence
  Synthetic oligonucleotide; CAG chr11 5181002 5181021 5181018 +
taaggtgtaaggaagggatc

SEQ ID NO: 3792 - DNA, 20 bp, Artificial Sequence
  Synthetic oligonucleotide; CAG chr11 5181008 5181027 5181024 +
gtaaggaagggatccagttt

SEQ ID NO: 3793 - DNA, 20 bp, Artificial Sequence
  Synthetic oligonucleotide; TGG chr11 5181022 5181041 5181038 +
cagtttcagctttctacata

SEQ ID NO: 3794 - DNA, 20 bp, Artificial Sequence
  Synthetic oligonucleotide; TAG chr11 5181026 5181045 5181042 +
ttcagctttctacatatggc

SEQ ID NO: 3795 - DNA, 20 bp, Artificial Sequence
  Synthetic oligonucleotide; CAG chr11 5181030 5181049 5181046 +
gctttctacatatggctagc

SEQ ID NO: 3796 - DNA, 20 bp, Artificial Sequence
  Synthetic oligonucleotide; CAG chr11 5181039 5181058 5181055 +
atatggctagccagttttcc

SEQ ID NO: 3797 - DNA, 20 bp, Artificial Sequence
  Synthetic oligonucleotide; TAG chr11 5181056 5181075 5181072 +
tcccagcatcatttattaaa

SEQ ID NO: 3798 - DNA, 20 bp, Artificial Sequence
  Synthetic oligonucleotide; AGG chr11 5181057 5181076 5181073 +
cccagcatcatttattaaat

SEQ ID NO: 3799 - DNA, 20 bp, Artificial Sequence
  Synthetic oligonucleotide; GGG chr11 5181058 5181077 5181074 +
ccagcatcatttattaaata

SEQ ID NO: 3800 - DNA, 20 bp, Artificial Sequence
  Synthetic oligonucleotide; CAG chr11 5181088 5181107 5181104 +
tccccattgcttgtttttgt

SEQ ID NO: 3801 - DNA, 20 bp, Artificial Sequence
  Synthetic oligonucleotide; AGG chr11 5181089 5181108 5181105 +
ccccattgcttgtttttgtc

SEQ ID NO: 3802 - DNA, 20 bp, Artificial Sequence
  Synthetic oligonucleotide; AAG chr11 5181099 5181118 5181115 +
tgtttttgtcaggtttgtca

SEQ ID NO: 3803 - DNA, 20 bp, Artificial Sequence
  Synthetic oligonucleotide; CAG chr11 5181104 5181123 5181120 +
ttgtcaggtttgtcaaagat

SEQ ID NO: 3804 - DNA, 20 bp, Artificial Sequence
  Synthetic oligonucleotide; TAG chr11 5181108 5181127 5181124 +
caggtttgtcaaagatcaga

SEQ ID NO: 3805 - DNA, 20 bp, Artificial Sequence
  Synthetic oligonucleotide; TGG chr11 5181114 5181133 5181130 +
tgtcaaagatcagatagttg

SEQ ID NO: 3806 - DNA, 20 bp, Artificial Sequence
  Synthetic oligonucleotide; TGG chr11 5181122 5181141 5181138 +
atcagatagttgtggatgtg

SEQ ID NO: 3807 - DNA, 20 bp, Artificial Sequence
  Synthetic oligonucleotide; GAG chr11 5181135 5181154 5181151 +
ggatgtgtggtattatttct

SEQ ID NO: 3808 - DNA, 20 bp, Artificial Sequence
  Synthetic oligonucleotide; GAG chr11 5181137 5181156 5181153 +
atgtgtggtattatttctga

SEQ ID NO: 3809 - DNA, 20 bp, Artificial Sequence
  Synthetic oligonucleotide; TGG chr11 5181156 5181175 5181172 +
agagctctgttctgctccat

SEQ ID NO: 3810 - DNA, 20 bp, Artificial Sequence
  Synthetic oligonucleotide; TGG chr11 5181174 5181193 5181190 +
attggtctacatctctgttt

SEQ ID NO: 3811 - DNA, 20 bp, Artificial Sequence
  Synthetic oligonucleotide; CAG chr11 5181180 5181199 5181196 +
ctacatctctgttttggtac

SEQ ID NO: 3812 - DNA, 20 bp, Artificial Sequence
  Synthetic oligonucleotide; TGG chr11 5181196 5181215 5181212 +
gtaccagtaccatgttgttt

SEQ ID NO: 3813 - DNA, 20 bp, Artificial Sequence
  Synthetic oligonucleotide; TAG chr11 5181212 5181231 5181228 +
gttttggttactgtaccttg

SEQ ID NO: 3814 - DNA, 20 bp, Artificial Sequence
  Synthetic oligonucleotide; TAG chr11 5181217 5181236 5181233 +
ggttactgtaccttgtagta

SEQ ID NO: 3815 - DNA, 20 bp, Artificial Sequence
  Synthetic oligonucleotide; AAG chr11 5181224 5181243 5181240 +
gtaccttgtagtatagtttg

SEQ ID NO: 3816 - DNA, 20 bp, Artificial Sequence
  Synthetic oligonucleotide; CAG chr11 5181228 5181247 5181244 +
cttgtagtatagtttgaagt

SEQ ID NO: 3817 - DNA, 20 bp, Artificial Sequence
  Synthetic oligonucleotide; AGG chr11 5181229 5181248 5181245 +
ttgtagtatagtttgaagtc

SEQ ID NO: 3818 - DNA, 20 bp, Artificial Sequence
  Synthetic oligonucleotide; TAG chr11 5181232 5181251 5181248 +
tagtatagtttgaagtcagg

SEQ ID NO: 3819 - DNA, 20 bp, Artificial Sequence
  Synthetic oligonucleotide; TAG chr11 5181246 5181265 5181262 +
gtcaggtagcatgatgcctc

SEQ ID NO: 3820 - DNA, 20 bp, Artificial Sequence
  Synthetic oligonucleotide; TGG chr11 5181260 5181279 5181276 +
tgcctctagctttgttcttt

SEQ ID NO: 3821 - DNA, 20 bp, Artificial Sequence
  Synthetic oligonucleotide; TAG chr11 5181265 5181284 5181281 +
ctagctttgttcttttggct

SEQ ID NO: 3822 - DNA, 20 bp, Artificial Sequence
  Synthetic oligonucleotide; AGG chr11 5181266 5181285 5181282 +
tagctttgttcttttggctt

SEQ ID NO: 3823 - DNA, 20 bp, Artificial Sequence
  Synthetic oligonucleotide; CGG chr11 5181284 5181303 5181300 +
ttaggattgacttgtcaatg

SEQ ID NO: 3824 - DNA, 20 bp, Artificial Sequence
  Synthetic oligonucleotide; GGG chr11 5181285 5181304 5181301 +
taggattgacttgtcaatgc

SEQ ID NO: 3825 - DNA, 20 bp, Artificial Sequence
  Synthetic oligonucleotide; TGG chr11 5181296 5181315 5181312 +
tgtcaatgcgggctcttttt

SEQ ID NO: 3826 - DNA, 20 bp, Artificial Sequence
  Synthetic oligonucleotide; AAG chr11 5181315 5181334 5181331 +
ttggttccatatgaacttta

SEQ ID NO: 3827 - DNA, 20 bp, Artificial Sequence
  Synthetic oligonucleotide; TAG chr11 5181318 5181337 5181334 +
gttccatatgaactttaaag

SEQ ID NO: 3828 - DNA, 20 bp, Artificial Sequence
  Synthetic oligonucleotide; AAG chr11 5181338 5181357 5181354 +
tagttttttccaattctgtg

SEQ ID NO: 3829 - DNA, 20 bp, Artificial Sequence
  Synthetic oligonucleotide; AAG chr11 5181342 5181361 5181358 +
tttttccaattctgtgaaga

SEQ ID NO: 3830 - DNA, 20 bp, Artificial Sequence
  Synthetic oligonucleotide; TGG chr11 5181349 5181368 5181365 +
aattctgtgaagaaagtcat

SEQ ID NO: 3831 - DNA, 20 bp, Artificial Sequence
  Synthetic oligonucleotide; TAG chr11 5181352 5181371 5181368 +
tctgtgaagaaagtcattgg

SEQ ID NO: 3832 - DNA, 20 bp, Artificial Sequence
  Synthetic oligonucleotide; TGG chr11 5181360 5181379 5181376 +
gaaagtcattggtagcttga

SEQ ID NO: 3833 - DNA, 20 bp, Artificial Sequence
  Synthetic oligonucleotide; GGG chr11 5181361 5181380 5181377 +
aaagtcattggtagcttgat

SEQ ID NO: 3834 - DNA, 20 bp, Artificial Sequence
  Synthetic oligonucleotide; GGG chr11 5181362 5181381 5181378 +
aagtcattggtagcttgatg

SEQ ID NO: 3835 - DNA, 20 bp, Artificial Sequence
  Synthetic oligonucleotide; TGG chr11 5181366 5181385 5181382 +
cattggtagcttgatgggga

SEQ ID NO: 3836 - DNA, 20 bp, Artificial Sequence
  Synthetic oligonucleotide; TGG chr11 5181390 5181409 5181406 +
attgaatctataaattacct

SEQ ID NO: 3837 - DNA, 20 bp, Artificial Sequence
  Synthetic oligonucleotide; GGG chr11 5181391 5181410 5181407 +
ttgaatctataaattacctt

SEQ ID NO: 3838 - DNA, 20 bp, Artificial Sequence
  Synthetic oligonucleotide; CAG chr11 5181394 5181413 5181410 +
aatctataaattaccttggg

SEQ ID NO: 3839 - DNA, 20 bp, Artificial Sequence
  Synthetic oligonucleotide; AAG chr11 5181398 5181417 5181414 +
tataaattaccttgggcagt

SEQ ID NO: 3840 - DNA, 20 bp, Artificial Sequence
  Synthetic oligonucleotide; AGG chr11 5181399 5181418 5181415 +
ataaattaccttgggcagta

SEQ ID NO: 3841 - DNA, 20 bp, Artificial Sequence
  Synthetic oligonucleotide; GAG chr11 5181434 5181453 5181450 +
tattgattcttcctatccat

SEQ ID NO: 3842 - DNA, 20 bp, Artificial Sequence
  Synthetic oligonucleotide; TGG chr11 5181439 5181458 5181455 +
attcttcctatccatgagca

SEQ ID NO: 3843 - DNA, 20 bp, Artificial Sequence
  Synthetic oligonucleotide; GAG chr11 5181481 5181500 5181497 +
gtatcctcttttatttcgtt

SEQ ID NO: 3844 - DNA, 20 bp, Artificial Sequence
  Synthetic oligonucleotide; CAG chr11 5181484 5181503 5181500 +
tcctcttttatttcgttgag

SEQ ID NO: 3845 - DNA, 20 bp, Artificial Sequence
  Synthetic oligonucleotide; AAG chr11 5181506 5181525 5181522 +
gtgttttgttgttctccttg

SEQ ID NO: 3846 - DNA, 20 bp, Artificial Sequence
  Synthetic oligonucleotide; GAG chr11 5181508 5181527 5181524 +
gttttgttgttctccttgaa

SEQ ID NO: 3847 - DNA, 20 bp, Artificial Sequence
  Synthetic oligonucleotide; AGG chr11 5181509 5181528 5181525 +
ttttgttgttctccttgaag

SEQ ID NO: 3848 - DNA, 20 bp, Artificial Sequence
  Synthetic oligonucleotide; AAG chr11 5181529 5181548 5181545 +
aggtccttcacatcccttgt

SEQ ID NO: 3849 - DNA, 20 bp, Artificial Sequence
  Synthetic oligonucleotide; TGG chr11 5181533 5181552 5181549 +
ccttcacatcccttgtaagt

SEQ ID NO: 3850 - DNA, 20 bp, Artificial Sequence
  Synthetic oligonucleotide; TAG chr11 5181541 5181560 5181557 +
tcccttgtaagttggattcc

SEQ ID NO: 3851 - DNA, 20 bp, Artificial Sequence
  Synthetic oligonucleotide; AGG chr11 5181542 5181561 5181558 +
cccttgtaagttggattcct

SEQ ID NO: 3852 - DNA, 20 bp, Artificial Sequence
  Synthetic oligonucleotide; GAG chr11 5181560 5181579 5181576 +
ctaggtattttattctcttt

SEQ ID NO: 3853 - DNA, 20 bp, Artificial Sequence
  Synthetic oligonucleotide; AGG chr11 5181561 5181580 5181577 +
taggtattttattctctttg

SEQ ID NO: 3854 - DNA, 20 bp, Artificial Sequence
  Synthetic oligonucleotide; TGG chr11 5181574 5181593 5181590 +
ctctttgaggcaattgtgaa

SEQ ID NO: 3855 - DNA, 20 bp, Artificial Sequence
  Synthetic oligonucleotide; GGG chr11 5181575 5181594 5181591 +
tctttgaggcaattgtgaat

SEQ ID NO: 3856 - DNA, 20 bp, Artificial Sequence
  Synthetic oligonucleotide; GAG chr11 5181577 5181596 5181593 +
tttgaggcaattgtgaatgg

SEQ ID NO: 3857 - DNA, 20 bp, Artificial Sequence
  Synthetic oligonucleotide; TGG chr11 5181593 5181612 5181609 +
atgggagttcactcatgatt

SEQ ID NO: 3858 - DNA, 20 bp, Artificial Sequence
  Synthetic oligonucleotide; TGG chr11 5181615 5181634 5181631 +
gctctctgtttgtctgttat

SEQ ID NO: 3859 - DNA, 20 bp, Artificial Sequence
  Synthetic oligonucleotide; TAG chr11 5181622 5181641 5181638 +
gtttgtctgttattggtgta

SEQ ID NO: 3860 - DNA, 20 bp, Artificial Sequence
  Synthetic oligonucleotide; AGG chr11 5181623 5181642 5181639 +
tttgtctgttattggtgtat

SEQ ID NO: 3861 - DNA, 20 bp, Artificial Sequence
  Synthetic oligonucleotide; GAG chr11 5181662 5181681 5181678 +
gcacattgattttgtatgct

SEQ ID NO: 3862 - DNA, 20 bp, Artificial Sequence
  Synthetic oligonucleotide; AAG chr11 5181674 5181693 5181690 +
tgtatgctgagacttttctg

SEQ ID NO: 3863 - DNA, 20 bp, Artificial Sequence
  Synthetic oligonucleotide; CAG chr11 5181685 5181704 5181701 +
acttttctgaagttgcttat

SEQ ID NO: 3864 - DNA, 20 bp, Artificial Sequence
  Synthetic oligonucleotide; AAG chr11 5181691 5181710 5181707 +
ctgaagttgcttatcagctt

SEQ ID NO: 3865 - DNA, 20 bp, Artificial Sequence
  Synthetic oligonucleotide; AGG chr11 5181692 5181711 5181708 +
tgaagttgcttatcagctta

SEQ ID NO: 3866 - DNA, 20 bp, Artificial Sequence
  Synthetic oligonucleotide; GAG chr11 5181694 5181713 5181710 +
aagttgcttatcagcttaag

SEQ ID NO: 3867 - DNA, 20 bp, Artificial Sequence
  Synthetic oligonucleotide; TGG chr11 5181701 5181720 5181717 +
ttatcagcttaaggagattt

SEQ ID NO: 3868 - DNA, 20 bp, Artificial Sequence
  Synthetic oligonucleotide; GGG chr11 5181702 5181721 5181718 +
tatcagcttaaggagatttt

SEQ ID NO: 3869 - DNA, 20 bp, Artificial Sequence
  Synthetic oligonucleotide; GAG chr11 5181707 5181726 5181723 +
gcttaaggagattttgggct

SEQ ID NO: 3870 - DNA, 20 bp, Artificial Sequence
  Synthetic oligonucleotide; TGG chr11 5181714 5181733 5181730 +
gagattttgggctgagacga

SEQ ID NO: 3871 - DNA, 20 bp, Artificial Sequence
  Synthetic oligonucleotide; GGG chr11 5181715 5181734 5181731 +
agattttgggctgagacgat

SEQ ID NO: 3872 - DNA, 20 bp, Artificial Sequence
  Synthetic oligonucleotide; GGG chr11 5181716 5181735 5181732 +
gattttgggctgagacgatg

SEQ ID NO: 3873 - DNA, 20 bp, Artificial Sequence
  Synthetic oligonucleotide; TAG chr11 5181724 5181743 5181740 +
gctgagacgatggggttttc

SEQ ID NO: 3874 - DNA, 20 bp, Artificial Sequence
  Synthetic oligonucleotide; CAG chr11 5181751 5181770 5181767 +
acaatcacgtcatctgcaaa

SEQ ID NO: 3875 - DNA, 20 bp, Artificial Sequence
  Synthetic oligonucleotide; AGG chr11 5181752 5181771 5181768 +
caatcacgtcatctgcaaac

SEQ ID NO: 3876 - DNA, 20 bp, Artificial Sequence
  Synthetic oligonucleotide; GGG chr11 5181753 5181772 5181769 +
aatcacgtcatctgcaaaca

SEQ ID NO: 3877 - DNA, 20 bp, Artificial Sequence
  Synthetic oligonucleotide; TGG chr11 5181819 5181838 5181835 +
tttctcttgcctgattgccc

SEQ ID NO: 3878 - DNA, 20 bp, Artificial Sequence
  Synthetic oligonucleotide; CAG chr11 5181823 5181842 5181839 +
tcttgcctgattgccctggc

SEQ ID NO: 3879 - DNA, 20 bp, Artificial Sequence
  Synthetic oligonucleotide; TAG chr11 5181847 5181866 5181863 +
acttccaacactatgttgaa

SEQ ID NO: 3880 - DNA, 20 bp, Artificial Sequence
  Synthetic oligonucleotide; AGG chr11 5181848 5181867 5181864 +
cttccaacactatgttgaat

SEQ ID NO: 3881 - DNA, 20 bp, Artificial Sequence
  Synthetic oligonucleotide; GAG chr11 5181850 5181869 5181866 +
tccaacactatgttgaatag

SEQ ID NO: 3882 - DNA, 20 bp, Artificial Sequence
  Synthetic oligonucleotide; TGG chr11 5181853 5181872 5181869 +
aacactatgttgaataggag

SEQ ID NO: 3883 - DNA, 20 bp, Artificial Sequence
  Synthetic oligonucleotide; GAG chr11 5181857 5181876 5181873 +
ctatgttgaataggagtggt

SEQ ID NO: 3884 - DNA, 20 bp, Artificial Sequence
  Synthetic oligonucleotide; GAG chr11 5181859 5181878 5181875 +
atgttgaataggagtggtga

SEQ ID NO: 3885 - DNA, 20 bp, Artificial Sequence
  Synthetic oligonucleotide; GAG chr11 5181861 5181880 5181877 +
gttgaataggagtggtgaga

SEQ ID NO: 3886 - DNA, 20 bp, Artificial Sequence
  Synthetic oligonucleotide; AGG chr11 5181862 5181881 5181878 +
ttgaataggagtggtgagag

SEQ ID NO: 3887 - DNA, 20 bp, Artificial Sequence
  Synthetic oligonucleotide; GGG chr11 5181863 5181882 5181879 +
tgaataggagtggtgagaga

SEQ ID NO: 3888 - DNA, 20 bp, Artificial Sequence
  Synthetic oligonucleotide; CAG chr11 5181882 5181901 5181898 +
agggcatccctgtcttgtgc

SEQ ID NO: 3889 - DNA, 20 bp, Artificial Sequence
  Synthetic oligonucleotide; AAG chr11 5181891 5181910 5181907 +
ctgtcttgtgccagttttca

SEQ ID NO: 3890 - DNA, 20 bp, Artificial Sequence
  Synthetic oligonucleotide; AGG chr11 5181892 5181911 5181908 +
tgtcttgtgccagttttcaa

SEQ ID NO: 3891 - DNA, 20 bp, Artificial Sequence
  Synthetic oligonucleotide; GGG chr11 5181893 5181912 5181909 +
gtcttgtgccagttttcaaa

SEQ ID NO: 3892 - DNA, 20 bp, Artificial Sequence
  Synthetic oligonucleotide; CAG chr11 5181904 5181923 5181920 +
gttttcaaagggaatgcttc

SEQ ID NO: 3893 - DNA, 20 bp, Artificial Sequence
  Synthetic oligonucleotide; CAG chr11 5181919 5181938 5181935 +
gcttccagtttttgtccatt

SEQ ID NO: 3894 - DNA, 20 bp, Artificial Sequence
  Synthetic oligonucleotide; TGG chr11 5181930 5181949 5181946 +
ttgtccattcagtatgatat

SEQ ID NO: 3895 - DNA, 20 bp, Artificial Sequence
  Synthetic oligonucleotide; TGG chr11 5181936 5181955 5181952 +
attcagtatgatattggctg

SEQ ID NO: 3896 - DNA, 20 bp, Artificial Sequence
  Synthetic oligonucleotide; GGG chr11 5181937 5181956 5181953 +
ttcagtatgatattggctgt

SEQ ID NO: 3897 - DNA, 20 bp, Artificial Sequence
  Synthetic oligonucleotide; TAG chr11 5181947 5181966 5181963 +
tattggctgtgggtttgtca

SEQ ID NO: 3898 - DNA, 20 bp, Artificial Sequence
  Synthetic oligonucleotide; TAG chr11 5181951 5181970 5181967 +
ggctgtgggtttgtcataga

SEQ ID NO: 3899 - DNA, 20 bp, Artificial Sequence
  Synthetic oligonucleotide; GAG chr11 5181967 5181986 5181983 +
tagatagctcttattatttt

SEQ ID NO: 3900 - DNA, 20 bp, Artificial Sequence
  Synthetic oligonucleotide; GAG chr11 5181997 5182016 5182013 +
ccatcgatacctaatttatt

SEQ ID NO: 3901 - DNA, 20 bp, Artificial Sequence
  Synthetic oligonucleotide; GAG chr11 5181999 5182018 5182015 +
atcgatacctaatttattga

SEQ ID NO: 3902 - DNA, 20 bp, Artificial Sequence
  Synthetic oligonucleotide; TAG chr11 5182006 5182025 5182022 +
cctaatttattgagagtttt

SEQ ID NO: 3903 - DNA, 20 bp, Artificial Sequence
  Synthetic oligonucleotide; AAG chr11 5182013 5182032 5182029 +
tattgagagtttttagtatg

SEQ ID NO: 3904 - DNA, 20 bp, Artificial Sequence
  Synthetic oligonucleotide; AAG chr11 5182034 5182053 5182050 +
agcattgttgaattttgtca

SEQ ID NO: 3905 - DNA, 20 bp, Artificial Sequence
  Synthetic oligonucleotide; AGG chr11 5182035 5182054 5182051 +
gcattgttgaattttgtcaa

SEQ ID NO: 3906 - DNA, 20 bp, Artificial Sequence
  Synthetic oligonucleotide; GAG chr11 5182055 5182074 5182071 +
aggccttttctgcatctatt

SEQ ID NO: 3907 - DNA, 20 bp, Artificial Sequence
  Synthetic oligonucleotide; TGG chr11 5182067 5182086 5182083 +
catctattgagataatcatg

SEQ ID NO: 3908 - DNA, 20 bp, Artificial Sequence
  Synthetic oligonucleotide; TGG chr11 5182080 5182099 5182096 +
aatcatgtggtttgtgtctt

SEQ ID NO: 3909 - DNA, 20 bp, Artificial Sequence
  Synthetic oligonucleotide; TGG chr11 5182097 5182116 5182113 +
ctttggttctgtttatatgc

SEQ ID NO: 3910 - DNA, 20 bp, Artificial Sequence
  Synthetic oligonucleotide; CAG chr11 5182130 5182149 5182146 +
ttgatttgcatatgttgaac

SEQ ID NO: 3911 - DNA, 20 bp, Artificial Sequence
  Synthetic oligonucleotide; CAG chr11 5182143 5182162 5182159 +
gttgaaccagccctgcatcc

SEQ ID NO: 3912 - DNA, 20 bp, Artificial Sequence
  Synthetic oligonucleotide; AGG chr11 5182144 5182163 5182160 +
ttgaaccagccctgcatccc

SEQ ID NO: 3913 - DNA, 20 bp, Artificial Sequence
  Synthetic oligonucleotide; GGG chr11 5182145 5182164 5182161 +
tgaaccagccctgcatccca

SEQ ID NO: 3914 - DNA, 20 bp, Artificial Sequence
  Synthetic oligonucleotide; AAG chr11 5182151 5182170 5182167 +
agccctgcatcccagggatg

SEQ ID NO: 3915 - DNA, 20 bp, Artificial Sequence
  Synthetic oligonucleotide; TGG chr11 5182166 5182185 5182182 +
ggatgaagcccacttgatca

SEQ ID NO: 3916 - DNA, 20 bp, Artificial Sequence
  Synthetic oligonucleotide; TGG chr11 5182169 5182188 5182185 +
tgaagcccacttgatcatgg

SEQ ID NO: 3917 - DNA, 20 bp, Artificial Sequence
  Synthetic oligonucleotide; AAG chr11 5182174 5182193 5182190 +
cccacttgatcatggtggat

SEQ ID NO: 3918 - DNA, 20 bp, Artificial Sequence
  Synthetic oligonucleotide; TGG chr11 5182193 5182212 5182209 +
taagctttttgatgtgctcc

SEQ ID NO: 3919 - DNA, 20 bp, Artificial Sequence
  Synthetic oligonucleotide; TGG chr11 5182199 5182218 5182215 +
ttttgatgtgctcctggatt

SEQ ID NO: 3920 - DNA, 20 bp, Artificial Sequence
  Synthetic oligonucleotide; CAG chr11 5182207 5182226 5182223 +
tgctcctggatttggtttgc

SEQ ID NO: 3921 - DNA, 20 bp, Artificial Sequence
  Synthetic oligonucleotide; GAG chr11 5182219 5182238 5182235 +
tggtttgccagtattttact

SEQ ID NO: 3922 - DNA, 20 bp, Artificial Sequence
  Synthetic oligonucleotide; AGG chr11 5182220 5182239 5182236 +
ggtttgccagtattttactg

SEQ ID NO: 3923 - DNA, 20 bp, Artificial Sequence
  Synthetic oligonucleotide; CAG chr11 5182243 5182262 5182259 +
atttttgcatcgatgttcat

SEQ ID NO: 3924 - DNA, 20 bp, Artificial Sequence
  Synthetic oligonucleotide; AGG chr11 5182244 5182263 5182260 +
tttttgcatcgatgttcatc

SEQ ID NO: 3925 - DNA, 20 bp, Artificial Sequence
  Synthetic oligonucleotide; GGG chr11 5182245 5182264 5182261 +
ttttgcatcgatgttcatca

SEQ ID NO: 3926 - DNA, 20 bp, Artificial Sequence
  Synthetic oligonucleotide; TGG chr11 5182252 5182271 5182268 +
tcgatgttcatcagggatat

SEQ ID NO: 3927 - DNA, 20 bp, Artificial Sequence
  Synthetic oligonucleotide; TAG chr11 5182287 5182306 5182303 +
tttttttgttgtgtgtctgc

SEQ ID NO: 3928 - DNA, 20 bp, Artificial Sequence
  Synthetic oligonucleotide; AGG chr11 5182288 5182307 5182304 +
ttttttgttgtgtgtctgct

SEQ ID NO: 3929 - DNA, 20 bp, Artificial Sequence
  Synthetic oligonucleotide; TGG chr11 5182294 5182313 5182310 +
gttgtgtgtctgctaggctt

SEQ ID NO: 3930 - DNA, 20 bp, Artificial Sequence
  Synthetic oligonucleotide; AAG chr11 5182301 5182320 5182317 +
gtctgctaggctttggtatc

SEQ ID NO: 3931 - DNA, 20 bp, Artificial Sequence
  Synthetic oligonucleotide; TGG chr11 5182311 5182330 5182327 +
ctttggtatcaagatgatgc

SEQ ID NO: 3932 - DNA, 20 bp, Artificial Sequence
  Synthetic oligonucleotide; GAG chr11 5182325 5182344 5182341 +
tgatgctggcctcataaaat

SEQ ID NO: 3933 - DNA, 20 bp, Artificial Sequence
  Synthetic oligonucleotide; TAG chr11 5182329 5182348 5182345 +
gctggcctcataaaatgagt

SEQ ID NO: 3934 - DNA, 20 bp, Artificial Sequence
  Synthetic oligonucleotide; AGG chr11 5182330 5182349 5182346 +
ctggcctcataaaatgagtt

SEQ ID NO: 3935 - DNA, 20 bp, Artificial Sequence
  Synthetic oligonucleotide; GGG chr11 5182331 5182350 5182347 +
tggcctcataaaatgagtta

SEQ ID NO: 3936 - DNA, 20 bp, Artificial Sequence
  Synthetic oligonucleotide; GAG chr11 5182333 5182352 5182349 +
gcctcataaaatgagttagg

SEQ ID NO: 3937 - DNA, 20 bp, Artificial Sequence
  Synthetic oligonucleotide; AGG chr11 5182334 5182353 5182350 +
cctcataaaatgagttaggg

SEQ ID NO: 3938 - DNA, 20 bp, Artificial Sequence
  Synthetic oligonucleotide; TGG chr11 5182358 5182377 5182374 +
ttccctctttttctattgat

SEQ ID NO: 3939 - DNA, 20 bp, Artificial Sequence
  Synthetic oligonucleotide; TAG chr11 5182363 5182382 5182379 +
tctttttctattgattggaa

SEQ ID NO: 3940 - DNA, 20 bp, Artificial Sequence
  Synthetic oligonucleotide; CAG chr11 5182369 5182388 5182385 +
tctattgattggaatagttt

SEQ ID NO: 3941 - DNA, 20 bp, Artificial Sequence
  Synthetic oligonucleotide; AAG chr11 5182372 5182391 5182388 +
attgattggaatagtttcag

SEQ ID NO: 3942 - DNA, 20 bp, Artificial Sequence
  Synthetic oligonucleotide; AGG chr11 5182373 5182392 5182389 +
ttgattggaatagtttcaga

SEQ ID NO: 3943 - DNA, 20 bp, Artificial Sequence
  Synthetic oligonucleotide; TGG chr11 5182378 5182397 5182394 +
tggaatagtttcagaaggaa

SEQ ID NO: 3944 - DNA, 20 bp, Artificial Sequence
  Synthetic oligonucleotide; CAG chr11 5182384 5182403 5182400 +
agtttcagaaggaatggtac

SEQ ID NO: 3945 - DNA, 20 bp, Artificial Sequence
  Synthetic oligonucleotide; TGG chr11 5182403 5182422 5182419 +
ccagctcctccttgtacctc

SEQ ID NO: 3946 - DNA, 20 bp, Artificial Sequence
  Synthetic oligonucleotide; TAG chr11 5182406 5182425 5182422 +
gctcctccttgtacctctgg

SEQ ID NO: 3947 - DNA, 20 bp, Artificial Sequence
  Synthetic oligonucleotide; CGG chr11 5182413 5182432 5182429 +
cttgtacctctggtagaatt

SEQ ID NO: 3948 - DNA, 20 bp, Artificial Sequence
  Synthetic oligonucleotide; TGG chr11 5182429 5182448 5182445 +
aattcggctgtgaatccatc

SEQ ID NO: 3949 - DNA, 20 bp, Artificial Sequence
  Synthetic oligonucleotide; TGG chr11 5182435 5182454 5182451 +
gctgtgaatccatctggtcc

SEQ ID NO: 3950 - DNA, 20 bp, Artificial Sequence
  Synthetic oligonucleotide; TGG chr11 5182446 5182465 5182462 +
atctggtcctggactttttt

SEQ ID NO: 3951 - DNA, 20 bp, Artificial Sequence
  Synthetic oligonucleotide; TGG chr11 5182450 5182469 5182466 +
ggtcctggactttttttggt

SEQ ID NO: 3952 - DNA, 20 bp, Artificial Sequence
  Synthetic oligonucleotide; AAG chr11 5182454 5182473 5182470 +
ctggactttttttggttggt

SEQ ID NO: 3953 - DNA, 20 bp, Artificial Sequence
  Synthetic oligonucleotide; AAG chr11 5182463 5182482 5182479 +
ttttggttggtaagcttcat

SEQ ID NO: 3954 - DNA, 20 bp, Artificial Sequence
  Synthetic oligonucleotide; AAG chr11 5182468 5182487 5182484 +
gttggtaagcttcataagtg

SEQ ID NO: 3955 - DNA, 20 bp, Artificial Sequence
  Synthetic oligonucleotide; AGG chr11 5182469 5182488 5182485 +
ttggtaagcttcataagtga

SEQ ID NO: 3956 - DNA, 20 bp, Artificial Sequence
  Synthetic oligonucleotide; GAG chr11 5182471 5182490 5182487 +
ggtaagcttcataagtgaag

SEQ ID NO: 3957 - DNA, 20 bp, Artificial Sequence
  Synthetic oligonucleotide; CAG chr11 5182489 5182508 5182505 +
aggagaaataaaatacttta

SEQ ID NO: 3958 - DNA, 20 bp, Artificial Sequence
  Synthetic oligonucleotide; AAG chr11 5182494 5182513 5182510 +
aaataaaatactttacagac

SEQ ID NO: 3959 - DNA, 20 bp, Artificial Sequence
  Synthetic oligonucleotide; CAG chr11 5182519 5182538 5182535 +
attgctgattttgtcaccac

SEQ ID NO: 3960 - DNA, 20 bp, Artificial Sequence
  Synthetic oligonucleotide; AGG chr11 5182520 5182539 5182536 +
ttgctgattttgtcaccacc

SEQ ID NO: 3961 - DNA, 20 bp, Artificial Sequence
  Synthetic oligonucleotide; AAG chr11 5182533 5182552 5182549 +
caccaccaggcctgccctaa

SEQ ID NO: 3962 - DNA, 20 bp, Artificial Sequence
  Synthetic oligonucleotide; GAG chr11 5182535 5182554 5182551 +
ccaccaggcctgccctaaaa

SEQ ID NO: 3963 - DNA, 20 bp, Artificial Sequence
  Synthetic oligonucleotide; AAG chr11 5182544 5182563 5182560 +
ctgccctaaaagagctcctg

SEQ ID NO: 3964 - DNA, 20 bp, Artificial Sequence
  Synthetic oligonucleotide; AGG chr11 5182545 5182564 5182561 +
tgccctaaaagagctcctga

SEQ ID NO: 3965 - DNA, 20 bp, Artificial Sequence
  Synthetic oligonucleotide; AAG chr11 5182548 5182567 5182564 +
cctaaaagagctcctgaagg

SEQ ID NO: 3966 - DNA, 20 bp, Artificial Sequence
  Synthetic oligonucleotide; CAG chr11 5182551 5182570 5182567 +
aaaagagctcctgaaggaag

SEQ ID NO: 3967 - DNA, 20 bp, Artificial Sequence
  Synthetic oligonucleotide; TGG chr11 5182560 5182579 5182576 +
cctgaaggaagcagtaaaca

SEQ ID NO: 3968 - DNA, 20 bp, Artificial Sequence
  Synthetic oligonucleotide; AAG chr11 5182564 5182583 5182580 +
aaggaagcagtaaacatgga

SEQ ID NO: 3969 - DNA, 20 bp, Artificial Sequence
  Synthetic oligonucleotide; CAG chr11 5182574 5182593 5182590 +
taaacatggaaagaaacaac

SEQ ID NO: 3970 - DNA, 20 bp, Artificial Sequence
  Synthetic oligonucleotide; CAG chr11 5182580 5182599 5182596 +
tggaaagaaacaaccagtac

SEQ ID NO: 3971 - DNA, 20 bp, Artificial Sequence
  Synthetic oligonucleotide; AAG chr11 5182609 5182628 5182625 +
caaaaacatgccaaattgta

SEQ ID NO: 3972 - DNA, 20 bp, Artificial Sequence
  Synthetic oligonucleotide; AAG chr11 5182618 5182637 5182634 +
gccaaattgtaaagaccatc

SEQ ID NO: 3973 - DNA, 20 bp, Artificial Sequence
  Synthetic oligonucleotide; AGG chr11 5182619 5182638 5182635 +
ccaaattgtaaagaccatca

SEQ ID NO: 3974 - DNA, 20 bp, Artificial Sequence
  Synthetic oligonucleotide; TAG chr11 5182623 5182642 5182639 +
attgtaaagaccatcaaggc

SEQ ID NO: 3975 - DNA, 20 bp, Artificial Sequence
  Synthetic oligonucleotide; AGG chr11 5182624 5182643 5182640 +
ttgtaaagaccatcaaggct

SEQ ID NO: 3976 - DNA, 20 bp, Artificial Sequence
  Synthetic oligonucleotide; GGG chr11 5182625 5182644 5182641 +
tgtaaagaccatcaaggcta

SEQ ID NO: 3977 - DNA, 20 bp, Artificial Sequence
  Synthetic oligonucleotide; GAG chr11 5182627 5182646 5182643 +
taaagaccatcaaggctagg

SEQ ID NO: 3978 - DNA, 20 bp, Artificial Sequence
  Synthetic oligonucleotide; TAG chr11 5182643 5182662 5182659 +
tagggagaaactgcatcaac

SEQ ID NO: 3979 - DNA, 20 bp, Artificial Sequence
  Synthetic oligonucleotide; AAG chr11 5182647 5182666 5182663 +
gagaaactgcatcaactagc

SEQ ID NO: 3980 - DNA, 20 bp, Artificial Sequence
  Synthetic oligonucleotide; CAG chr11 5182659 5182678 5182675 +
caactagcaagcaaaataac

SEQ ID NO: 3981 - DNA, 20 bp, Artificial Sequence
  Synthetic oligonucleotide; CAG chr11 5182677 5182696 5182693 +
accagctaacatcataatga

SEQ ID NO: 3982 - DNA, 20 bp, Artificial Sequence
  Synthetic oligonucleotide; AGG chr11 5182678 5182697 5182694 +
ccagctaacatcataatgac

SEQ ID NO: 3983 - DNA, 20 bp, Artificial Sequence
  Synthetic oligonucleotide; GAG chr11 5182721 5182740 5182737 +
tattaaccttaaatgtaaat

SEQ ID NO: 3984 - DNA, 20 bp, Artificial Sequence
  Synthetic oligonucleotide; AAG chr11 5182741 5182760 5182757 +
gagctaaatgctccaattaa

SEQ ID NO: 3985 - DNA, 20 bp, Artificial Sequence
  Synthetic oligonucleotide; CAG chr11 5182747 5182766 5182763 +
aatgctccaattaaaagaca

SEQ ID NO: 3986 - DNA, 20 bp, Artificial Sequence
  Synthetic oligonucleotide; TGG chr11 5182752 5182771 5182768 +
tccaattaaaagacacagac

SEQ ID NO: 3987 - DNA, 20 bp, Artificial Sequence
  Synthetic oligonucleotide; TGG chr11 5182760 5182779 5182776 +
aaagacacagactggcaaat

SEQ ID NO: 3988 - DNA, 20 bp, Artificial Sequence
  Synthetic oligonucleotide; AAG chr11 5182766 5182785 5182782 +
acagactggcaaattggata

SEQ ID NO: 3989 - DNA, 20 bp, Artificial Sequence
  Synthetic oligonucleotide; GAG chr11 5182768 5182787 5182784 +
agactggcaaattggataaa

SEQ ID NO: 3990 - DNA, 20 bp, Artificial Sequence
  Synthetic oligonucleotide; AAG chr11 5182773 5182792 5182789 +
ggcaaattggataaagagtc

SEQ ID NO: 3991 - DNA, 20 bp, Artificial Sequence
  Synthetic oligonucleotide; CAG chr11 5182782 5182801 5182798 +
gataaagagtcaagacctat

SEQ ID NO: 3992 - DNA, 20 bp, Artificial Sequence
  Synthetic oligonucleotide; CAG chr11 5182796 5182815 5182812 +
acctatcagtgtgctgtatt

SEQ ID NO: 3993 - DNA, 20 bp, Artificial Sequence
  Synthetic oligonucleotide; AGG chr11 5182797 5182816 5182813 +
cctatcagtgtgctgtattc

SEQ ID NO: 3994 - DNA, 20 bp, Artificial Sequence
  Synthetic oligonucleotide; TGG chr11 5182814 5182833 5182830 +
ttcaggaaaccaatctcatg

SEQ ID NO: 3995 - DNA, 20 bp, Artificial Sequence
  Synthetic oligonucleotide; GAG chr11 5182816 5182835 5182832 +
caggaaaccaatctcatgtg

SEQ ID NO: 3996 - DNA, 20 bp, Artificial Sequence
  Synthetic oligonucleotide; GAG chr11 5182818 5182837 5182834 +
ggaaaccaatctcatgtgga

SEQ ID NO: 3997 - DNA, 20 bp, Artificial Sequence
  Synthetic oligonucleotide; TAG chr11 5182828 5182847 5182844 +
ctcatgtggagagacacaca

SEQ ID NO: 3998 - DNA, 20 bp, Artificial Sequence
  Synthetic oligonucleotide; AGG chr11 5182829 5182848 5182845 +
tcatgtggagagacacacat

SEQ ID NO: 3999 - DNA, 20 bp, Artificial Sequence
  Synthetic oligonucleotide; AAG chr11 5182841 5182860 5182857 +
acacacataggctcaaaata

SEQ ID NO: 4000 - DNA, 20 bp, Artificial Sequence
  Synthetic oligonucleotide; AGG chr11 5182842 5182861 5182858 +
cacacataggctcaaaataa

SEQ ID NO: 4001 - DNA, 20 bp, Artificial Sequence
  Synthetic oligonucleotide; GGG chr11 5182843 5182862 5182859 +
acacataggctcaaaataaa

SEQ ID NO: 4002 - DNA, 20 bp, Artificial Sequence
  Synthetic oligonucleotide; TGG chr11 5182847 5182866 5182863 +
ataggctcaaaataaaggga

SEQ ID NO: 4003 - DNA, 20 bp, Artificial Sequence
  Synthetic oligonucleotide; GAG chr11 5182849 5182868 5182865 +
aggctcaaaataaagggatg

SEQ ID NO: 4004 - DNA, 20 bp, Artificial Sequence
  Synthetic oligonucleotide; AGG chr11 5182850 5182869 5182866 +
ggctcaaaataaagggatgg

SEQ ID NO: 4005 - DNA, 20 bp, Artificial Sequence
  Synthetic oligonucleotide; AAG chr11 5182853 5182872 5182869 +
tcaaaataaagggatggagg

SEQ ID NO: 4006 - DNA, 20 bp, Artificial Sequence
  Synthetic oligonucleotide; AAG chr11 5182863 5182882 5182879 +
gggatggaggaagatctacc

SEQ ID NO: 4007 - DNA, 20 bp, Artificial Sequence
  Synthetic oligonucleotide; TGG chr11 5182870 5182889 5182886 +
aggaagatctaccaagcaaa

SEQ ID NO: 4008 - DNA, 20 bp, Artificial Sequence
  Synthetic oligonucleotide; AAG chr11 5182884 5182903 5182900 +
agcaaatggaaaacaaaaaa

SEQ ID NO: 4009 - DNA, 20 bp, Artificial Sequence
  Synthetic oligonucleotide; AGG chr11 5182885 5182904 5182901 +
gcaaatggaaaacaaaaaaa

SEQ ID NO: 4010 - DNA, 20 bp, Artificial Sequence
  Synthetic oligonucleotide; CAG chr11 5182888 5182907 5182904 +
aatggaaaacaaaaaaaagg

SEQ ID NO: 4011 - DNA, 20 bp, Artificial Sequence
  Synthetic oligonucleotide; AGG chr11 5182889 5182908 5182905 +
atggaaaacaaaaaaaaggc

SEQ ID NO: 4012 - DNA, 20 bp, Artificial Sequence
  Synthetic oligonucleotide; GGG chr11 5182890 5182909 5182906 +
tggaaaacaaaaaaaaggca

SEQ ID NO: 4013 - DNA, 20 bp, Artificial Sequence
  Synthetic oligonucleotide; TAG chr11 5182903 5182922 5182919 +
aaaggcagggtttgcaatct

SEQ ID NO: 4014 - DNA, 20 bp, Artificial Sequence
  Synthetic oligonucleotide; CAG chr11 5182918 5182937 5182934 +
aatcttagtctctgataaaa

SEQ ID NO: 4015 - DNA, 20 bp, Artificial Sequence
  Synthetic oligonucleotide; AAG chr11 5182935 5182954 5182951 +
aaacagactttaaaccaaca

SEQ ID NO: 4016 - DNA, 20 bp, Artificial Sequence
  Synthetic oligonucleotide; AAG chr11 5182943 5182962 5182959 +
tttaaaccaacaaagatcaa

SEQ ID NO: 4017 - DNA, 20 bp, Artificial Sequence
  Synthetic oligonucleotide; GAG chr11 5182945 5182964 5182961 +
taaaccaacaaagatcaaaa

SEQ ID NO: 4018 - DNA, 20 bp, Artificial Sequence
  Synthetic oligonucleotide; AAG chr11 5182951 5182970 5182967 +
aacaaagatcaaaagagaca

SEQ ID NO: 4019 - DNA, 20 bp, Artificial Sequence
  Synthetic oligonucleotide; AAG chr11 5182954 5182973 5182970 +
aaagatcaaaagagacaaag

SEQ ID NO: 4020 - DNA, 20 bp, Artificial Sequence
  Synthetic oligonucleotide; AGG chr11 5182955 5182974 5182971 +
aagatcaaaagagacaaaga

SEQ ID NO: 4021 - DNA, 20 bp, Artificial Sequence
  Synthetic oligonucleotide; TGG chr11 5182969 5182988 5182985 +
caaagaaggccattacatac

SEQ ID NO: 4022 - DNA, 20 bp, Artificial Sequence
  Synthetic oligonucleotide; AAG chr11 5182974 5182993 5182990 +
aaggccattacatactggta

SEQ ID NO: 4023 - DNA, 20 bp, Artificial Sequence
  Synthetic oligonucleotide; AGG chr11 5182975 5182994 5182991 +
aggccattacatactggtaa

SEQ ID NO: 4024 - DNA, 20 bp, Artificial Sequence
  Synthetic oligonucleotide; GGG chr11 5182976 5182995 5182992 +
ggccattacatactggtaaa

SEQ ID NO: 4025 - DNA, 20 bp, Artificial Sequence
  Synthetic oligonucleotide; AAG chr11 5182990 5183009 5183006 +
ggtaaagggatcaattcaac

SEQ ID NO: 4026 - DNA, 20 bp, Artificial Sequence
  Synthetic oligonucleotide; AAG chr11 5182993 5183012 5183009 +
aaagggatcaattcaacaag

SEQ ID NO: 4027 - DNA, 20 bp, Artificial Sequence
  Synthetic oligonucleotide; GAG chr11 5182995 5183014 5183011 +
agggatcaattcaacaagaa

SEQ ID NO: 4028 - DNA, 20 bp, Artificial Sequence
  Synthetic oligonucleotide; CAG chr11 5183029 5183048 5183045 +
aaatatatatgcacccaata

SEQ ID NO: 4029 - DNA, 20 bp, Artificial Sequence
  Synthetic oligonucleotide; CAG chr11 5183032 5183051 5183048 +
tatatatgcacccaatacag

SEQ ID NO: 4030 - DNA, 20 bp, Artificial Sequence
  Synthetic oligonucleotide; CAG chr11 5183039 5183058 5183055 +
gcacccaatacagcagcacc

SEQ ID NO: 4031 - DNA, 20 bp, Artificial Sequence
  Synthetic oligonucleotide; AAG chr11 5183049 5183068 5183065 +
cagcagcacccagattcata

SEQ ID NO: 4032 - DNA, 20 bp, Artificial Sequence
  Synthetic oligonucleotide; AAG chr11 5183053 5183072 5183069 +
agcacccagattcataaagc

SEQ ID NO: 4033 - DNA, 20 bp, Artificial Sequence
  Synthetic oligonucleotide; TAG chr11 5183060 5183079 5183076 +
agattcataaagcaagtcct

SEQ ID NO: 4034 - DNA, 20 bp, Artificial Sequence
  Synthetic oligonucleotide; GAG chr11 5183062 5183081 5183078 +
attcataaagcaagtcctta

SEQ ID NO: 4035 - DNA, 20 bp, Artificial Sequence
  Synthetic oligonucleotide; AAG chr11 5183072 5183091 5183088 +
caagtccttagagacctaca

SEQ ID NO: 4036 - DNA, 20 bp, Artificial Sequence
  Synthetic oligonucleotide; GAG chr11 5183074 5183093 5183090 +
agtccttagagacctacaaa

SEQ ID NO: 4037 - DNA, 20 bp, Artificial Sequence
  Synthetic oligonucleotide; TAG chr11 5183080 5183099 5183096 +
tagagacctacaaagagact

SEQ ID NO: 4038 - DNA, 20 bp, Artificial Sequence
  Synthetic oligonucleotide; TGG chr11 5183101 5183120 5183117 +
agactcccacacaataataa

SEQ ID NO: 4039 - DNA, 20 bp, Artificial Sequence
  Synthetic oligonucleotide; GGG chr11 5183102 5183121 5183118 +
gactcccacacaataataat

SEQ ID NO: 4040 - DNA, 20 bp, Artificial Sequence
  Synthetic oligonucleotide; GAG chr11 5183104 5183123 5183120 +
ctcccacacaataataatgg

SEQ ID NO: 4041 - DNA, 20 bp, Artificial Sequence
  Synthetic oligonucleotide; TAG chr11 5183131 5183150 5183147 +
taacaccccactgtcaacat

SEQ ID NO: 4042 - DNA, 20 bp, Artificial Sequence
  Synthetic oligonucleotide; CAG chr11 5183135 5183154 5183151 +
accccactgtcaacattaga

SEQ ID NO: 4043 - DNA, 20 bp, Artificial Sequence
  Synthetic oligonucleotide; GAG chr11 5183144 5183163 5183160 +
tcaacattagacagatcaac

SEQ ID NO: 4044 - DNA, 20 bp, Artificial Sequence
  Synthetic oligonucleotide; CAG chr11 5183148 5183167 5183164 +
cattagacagatcaacgaga

SEQ ID NO: 4045 - DNA, 20 bp, Artificial Sequence
  Synthetic oligonucleotide; AAG chr11 5183152 5183171 5183168 +
agacagatcaacgagacaga

SEQ ID NO: 4046 - DNA, 20 bp, Artificial Sequence
  Synthetic oligonucleotide; AAG chr11 5183160 5183179 5183176 +
caacgagacagaaagttaac

SEQ ID NO: 4047 - DNA, 20 bp, Artificial Sequence
  Synthetic oligonucleotide; AGG chr11 5183161 5183180 5183177 +
aacgagacagaaagttaaca

SEQ ID NO: 4048 - DNA, 20 bp, Artificial Sequence
  Synthetic oligonucleotide; CAG chr11 5183169 5183188 5183185 +
agaaagttaacaaggatatc

SEQ ID NO: 4049 - DNA, 20 bp, Artificial Sequence
  Synthetic oligonucleotide; AGG chr11 5183170 5183189 5183186 +
gaaagttaacaaggatatcc

SEQ ID NO: 4050 - DNA, 20 bp, Artificial Sequence
  Synthetic oligonucleotide; CAG chr11 5183182 5183201 5183198 +
ggatatccaggaattgaatt

SEQ ID NO: 4051 - DNA, 20 bp, Artificial Sequence
  Synthetic oligonucleotide; AAG chr11 5183194 5183213 5183210 +
attgaattcagctctgcacc

SEQ ID NO: 4052 - DNA, 20 bp, Artificial Sequence
  Synthetic oligonucleotide; CAG chr11 5183197 5183216 5183213 +
gaattcagctctgcaccaag

SEQ ID NO: 4053 - DNA, 20 bp, Artificial Sequence
  Synthetic oligonucleotide; TAG chr11 5183206 5183225 5183222 +
tctgcaccaagcagacctaa

SEQ ID NO: 4054 - DNA, 20 bp, Artificial Sequence
  Synthetic oligonucleotide; CAG chr11 5183216 5183235 5183232 +
gcagacctaatagacatcta

SEQ ID NO: 4055 - DNA, 20 bp, Artificial Sequence
  Synthetic oligonucleotide; TAG chr11 5183239 5183258 5183255 +
aactctccatcccaaatcaa

SEQ ID NO: 4056 - DNA, 20 bp, Artificial Sequence
  Synthetic oligonucleotide; CAG chr11 5183257 5183276 5183273 +
aatagaatatacattcttct

SEQ ID NO: 4057 - DNA, 20 bp, Artificial Sequence
  Synthetic oligonucleotide; CAG chr11 5183279 5183298 5183295 +
gcaccacaccacacctattc

SEQ ID NO: 4058 - DNA, 20 bp, Artificial Sequence
  Synthetic oligonucleotide; TAG chr11 5183291 5183310 5183307 +
acctattccagttgaccaca

SEQ ID NO: 4059 - DNA, 20 bp, Artificial Sequence
  Synthetic oligonucleotide; TGG chr11 5183295 5183314 5183311 +
attccagttgaccacatagt

SEQ ID NO: 4060 - DNA, 20 bp, Artificial Sequence
  Synthetic oligonucleotide; AAG chr11 5183298 5183317 5183314 +
ccagttgaccacatagttgg

SEQ ID NO: 4061 - DNA, 20 bp, Artificial Sequence
  Synthetic oligonucleotide; AAG chr11 5183303 5183322 5183319 +
tgaccacatagttggaagtg

SEQ ID NO: 4062 - DNA, 20 bp, Artificial Sequence
  Synthetic oligonucleotide; CAG chr11 5183313 5183332 5183329 +
gttggaagtgaagcactcct

SEQ ID NO: 4063 - DNA, 20 bp, Artificial Sequence
  Synthetic oligonucleotide; AAG chr11 5183325 5183344 5183341 +
gcactcctcagcaaacgtaa

SEQ ID NO: 4064 - DNA, 20 bp, Artificial Sequence
  Synthetic oligonucleotide; CAG chr11 5183330 5183349 5183346 +
cctcagcaaacgtaaaagaa

SEQ ID NO: 4065 - DNA, 20 bp, Artificial Sequence
  Synthetic oligonucleotide; CAG chr11 5183354 5183373 5183370 +
aacaataacaaactgtctct

SEQ ID NO: 4066 - DNA, 20 bp, Artificial Sequence
  Synthetic oligonucleotide; CAG chr11 5183361 5183380 5183377 +
acaaactgtctctcagacca

SEQ ID NO: 4067 - DNA, 20 bp, Artificial Sequence
  Synthetic oligonucleotide; TAG chr11 5183375 5183394 5183391 +
agaccacagtgcaatcaaac

SEQ ID NO: 4068 - DNA, 20 bp, Artificial Sequence
  Synthetic oligonucleotide; CAG chr11 5183382 5183401 5183398 +
agtgcaatcaaactagaact

SEQ ID NO: 4069 - DNA, 20 bp, Artificial Sequence
  Synthetic oligonucleotide; AGG chr11 5183383 5183402 5183399 +
gtgcaatcaaactagaactc

SEQ ID NO: 4070 - DNA, 20 bp, Artificial Sequence
  Synthetic oligonucleotide; AAG chr11 5183389 5183408 5183405 +
tcaaactagaactcaggatt

SEQ ID NO: 4071 - DNA, 20 bp, Artificial Sequence
  Synthetic oligonucleotide; TGG chr11 5183419 5183438 5183435 +
ctcaaaaccactcaactaca

SEQ ID NO: 4072 - DNA, 20 bp, Artificial Sequence
  Synthetic oligonucleotide; CAG chr11 5183430 5183449 5183446 +
tcaactacatggaaactgaa

SEQ ID NO: 4073 - DNA, 20 bp, Artificial Sequence
  Synthetic oligonucleotide; TGG chr11 5183452 5183471 5183468 +
gcctgctcctgaatgactac

SEQ ID NO: 4074 - DNA, 20 bp, Artificial Sequence
  Synthetic oligonucleotide; GGG chr11 5183453 5183472 5183469 +
cctgctcctgaatgactact

SEQ ID NO: 4075 - DNA, 20 bp, Artificial Sequence
  Synthetic oligonucleotide; AAG chr11 5183470 5183489 5183486 +
actgggtacataacaaaatg

SEQ ID NO: 4076 - DNA, 20 bp, Artificial Sequence
  Synthetic oligonucleotide; AGG chr11 5183471 5183490 5183487 +
ctgggtacataacaaaatga

SEQ ID NO: 4077 - DNA, 20 bp, Artificial Sequence
  Synthetic oligonucleotide; CAG chr11 5183474 5183493 5183490 +
ggtacataacaaaatgaagg

SEQ ID NO: 4078 - DNA, 20 bp, Artificial Sequence
  Synthetic oligonucleotide; AAG chr11 5183482 5183501 5183498 +
acaaaatgaaggcagaaata

SEQ ID NO: 4079 - DNA, 20 bp, Artificial Sequence
  Synthetic oligonucleotide; GAG chr11 5183503 5183522 5183519 +
agatgttctttgaaaccaac

SEQ ID NO: 4080 - DNA, 20 bp, Artificial Sequence
  Synthetic oligonucleotide; AAG chr11 5183510 5183529 5183526 +
ctttgaaaccaacgagaata

SEQ ID NO: 4081 - DNA, 20 bp, Artificial Sequence
  Synthetic oligonucleotide; CAG chr11 5183524 5183543 5183540 +
agaataaagatacaacaaaa

SEQ ID NO: 4082 - DNA, 20 bp, Artificial Sequence
  Synthetic oligonucleotide; TGG chr11 5183533 5183552 5183549 +
atacaacaaaacagaatctc

SEQ ID NO: 4083 - DNA, 20 bp, Artificial Sequence
  Synthetic oligonucleotide; GGG chr11 5183534 5183553 5183550 +
tacaacaaaacagaatctct

SEQ ID NO: 4084 - DNA, 20 bp, Artificial Sequence
  Synthetic oligonucleotide; AAG chr11 5183546 5183565 5183562 +
gaatctctgggacacattta

SEQ ID NO: 4085 - DNA, 20 bp, Artificial Sequence
  Synthetic oligonucleotide; CAG chr11 5183549 5183568 5183565 +
tctctgggacacatttaaag

SEQ ID NO: 4086 - DNA, 20 bp, Artificial Sequence
  Synthetic oligonucleotide; TAG chr11 5183556 5183575 5183572 +
gacacatttaaagcagtgtg

SEQ ID NO: 4087 - DNA, 20 bp, Artificial Sequence
  Synthetic oligonucleotide; GAG chr11 5183558 5183577 5183574 +
cacatttaaagcagtgtgta

SEQ ID NO: 4088 - DNA, 20 bp, Artificial Sequence
  Synthetic oligonucleotide; AGG chr11 5183559 5183578 5183575 +
acatttaaagcagtgtgtag

SEQ ID NO: 4089 - DNA, 20 bp, Artificial Sequence
  Synthetic oligonucleotide; GGG chr11 5183560 5183579 5183576 +
catttaaagcagtgtgtaga

SEQ ID NO: 4090 - DNA, 20 bp, Artificial Sequence
  Synthetic oligonucleotide; TAG chr11 5183570 5183589 5183586 +
agtgtgtagagggaaattta

SEQ ID NO: 4091 - DNA, 20 bp, Artificial Sequence
  Synthetic oligonucleotide; AAG chr11 5183589 5183608 5183605 +
atagcactaaatgcccacaa

SEQ ID NO: 4092 - DNA, 20 bp, Artificial Sequence
  Synthetic oligonucleotide; AAG chr11 5183593 5183612 5183609 +
cactaaatgcccacaaaaga

SEQ ID NO: 4093 - DNA, 20 bp, Artificial Sequence
  Synthetic oligonucleotide; CAG chr11 5183596 5183615 5183612 +
taaatgcccacaaaagaaag

SEQ ID NO: 4094 - DNA, 20 bp, Artificial Sequence
  Synthetic oligonucleotide; AGG chr11 5183597 5183616 5183613 +
aaatgcccacaaaagaaagc

SEQ ID NO: 4095 - DNA, 20 bp, Artificial Sequence
  Synthetic oligonucleotide; AAG chr11 5183601 5183620 5183617 +
gcccacaaaagaaagcagga

SEQ ID NO: 4096 - DNA, 20 bp, Artificial Sequence
  Synthetic oligonucleotide; AAG chr11 5183636 5183655 5183652 +
caccctaacatcacaattaa

SEQ ID NO: 4097 - DNA, 20 bp, Artificial Sequence
  Synthetic oligonucleotide; TAG chr11 5183642 5183661 5183658 +
aacatcacaattaaaagaac

SEQ ID NO: 4098 - DNA, 20 bp, Artificial Sequence
  Synthetic oligonucleotide; GAG chr11 5183644 5183663 5183660 +
catcacaattaaaagaacta

SEQ ID NO: 4099 - DNA, 20 bp, Artificial Sequence
  Synthetic oligonucleotide; AAG chr11 5183647 5183666 5183663 +
cacaattaaaagaactagag

SEQ ID NO: 4100 - DNA, 20 bp, Artificial Sequence
  Synthetic oligonucleotide; AAG chr11 5183651 5183670 5183667 +
attaaaagaactagagaagc

SEQ ID NO: 4101 - DNA, 20 bp, Artificial Sequence
  Synthetic oligonucleotide; GAG chr11 5183653 5183672 5183669 +
taaaagaactagagaagcaa

SEQ ID NO: 4102 - DNA, 20 bp, Artificial Sequence
  Synthetic oligonucleotide; AAG chr11 5183669 5183688 5183685 +
gcaagagcaaacactttcaa

SEQ ID NO: 4103 - DNA, 20 bp, Artificial Sequence
  Synthetic oligonucleotide; TAG chr11 5183673 5183692 5183689 +
gagcaaacactttcaaaagc

SEQ ID NO: 4104 - DNA, 20 bp, Artificial Sequence
  Synthetic oligonucleotide; CGG chr11 5183676 5183695 5183692 +
caaacactttcaaaagctag

SEQ ID NO: 4105 - DNA, 20 bp, Artificial Sequence
  Synthetic oligonucleotide; AAG chr11 5183679 5183698 5183695 +
acactttcaaaagctagcgg

SEQ ID NO: 4106 - DNA, 20 bp, Artificial Sequence
  Synthetic oligonucleotide; AGG chr11 5183680 5183699 5183696 +
cactttcaaaagctagcgga

SEQ ID NO: 4107 - DNA, 20 bp, Artificial Sequence
  Synthetic oligonucleotide; AAG chr11 5183684 5183703 5183700 +
ttcaaaagctagcggaaggc

SEQ ID NO: 4108 - DNA, 20 bp, Artificial Sequence
  Synthetic oligonucleotide; AAG chr11 5183691 5183710 5183707 +
gctagcggaaggcaagaaat

SEQ ID NO: 4109 - DNA, 20 bp, Artificial Sequence
  Synthetic oligonucleotide; AAG chr11 5183695 5183714 5183711 +
gcggaaggcaagaaataagt

SEQ ID NO: 4110 - DNA, 20 bp, Artificial Sequence
  Synthetic oligonucleotide; CAG chr11 5183700 5183719 5183716 +
aggcaagaaataagtaagat

SEQ ID NO: 4111 - DNA, 20 bp, Artificial Sequence
  Synthetic oligonucleotide; GAG chr11 5183702 5183721 5183718 +
gcaagaaataagtaagatca

SEQ ID NO: 4112 - DNA, 20 bp, Artificial Sequence
  Synthetic oligonucleotide; CAG chr11 5183705 5183724 5183721 +
agaaataagtaagatcagag

SEQ ID NO: 4113 - DNA, 20 bp, Artificial Sequence
  Synthetic oligonucleotide; AAG chr11 5183708 5183727 5183724 +
aataagtaagatcagagcag

SEQ ID NO: 4114 - DNA, 20 bp, Artificial Sequence
  Synthetic oligonucleotide; AAG chr11 5183713 5183732 5183729 +
gtaagatcagagcagaagtg

SEQ ID NO: 4115 - DNA, 20 bp, Artificial Sequence
  Synthetic oligonucleotide; AGG chr11 5183714 5183733 5183730 +
taagatcagagcagaagtga

SEQ ID NO: 4116 - DNA, 20 bp, Artificial Sequence
  Synthetic oligonucleotide; GAG chr11 5183716 5183735 5183732 +
agatcagagcagaagtgaag

SEQ ID NO: 4117 - DNA, 20 bp, Artificial Sequence
  Synthetic oligonucleotide; GAG chr11 5183722 5183741 5183738 +
gagcagaagtgaaggagatt

SEQ ID NO: 4118 - DNA, 20 bp, Artificial Sequence
  Synthetic oligonucleotide; CAG chr11 5183757 5183776 5183773 +
cttaaaaaaatcaatgaatc

SEQ ID NO: 4119 - DNA, 20 bp, Artificial Sequence
  Synthetic oligonucleotide; AGG chr11 5183758 5183777 5183774 +
ttaaaaaaatcaatgaatcc

SEQ ID NO: 4120 - DNA, 20 bp, Artificial Sequence
  Synthetic oligonucleotide; GAG chr11 5183760 5183779 5183776 +
aaaaaaatcaatgaatccag

SEQ ID NO: 4121 - DNA, 20 bp, Artificial Sequence
  Synthetic oligonucleotide; TGG chr11 5183764 5183783 5183780 +
aaatcaatgaatccaggagc

SEQ ID NO: 4122 - DNA, 20 bp, Artificial Sequence
  Synthetic oligonucleotide; AAG chr11 5183776 5183795 5183792 +
ccaggagctggttttttgaa

SEQ ID NO: 4123 - DNA, 20 bp, Artificial Sequence
  Synthetic oligonucleotide; TAG chr11 5183793 5183812 5183809 +
gaaaagatcaacaaaattga

SEQ ID NO: 4124 - DNA, 20 bp, Artificial Sequence
  Synthetic oligonucleotide; TAG chr11 5183801 5183820 5183817 +
caacaaaattgatagactgc

SEQ ID NO: 4125 - DNA, 20 bp, Artificial Sequence
  Synthetic oligonucleotide; AAG chr11 5183805 5183824 5183821 +
aaaattgatagactgctagc

SEQ ID NO: 4126 - DNA, 20 bp, Artificial Sequence
  Synthetic oligonucleotide; AAG chr11 5183815 5183834 5183831 +
gactgctagcaagactaata

SEQ ID NO: 4127 - DNA, 20 bp, Artificial Sequence
  Synthetic oligonucleotide; AAG chr11 5183818 5183837 5183834 +
tgctagcaagactaataaag

SEQ ID NO: 4128 - DNA, 20 bp, Artificial Sequence
  Synthetic oligonucleotide; AAG chr11 5183823 5183842 5183839 +
gcaagactaataaagaagaa

SEQ ID NO: 4129 - DNA, 20 bp, Artificial Sequence
  Synthetic oligonucleotide; GAG chr11 5183825 5183844 5183841 +
aagactaataaagaagaaaa

SEQ ID NO: 4130 - DNA, 20 bp, Artificial Sequence
  Synthetic oligonucleotide; GAG chr11 5183827 5183846 5183843 +
gactaataaagaagaaaaga

SEQ ID NO: 4131 - DNA, 20 bp, Artificial Sequence
  Synthetic oligonucleotide; AAG chr11 5183830 5183849 5183846 +
taataaagaagaaaagagag

SEQ ID NO: 4132 - DNA, 20 bp, Artificial Sequence
  Synthetic oligonucleotide; TAG chr11 5183840 5183859 5183856 +
gaaaagagagaagactcaaa

SEQ ID NO: 4133 - DNA, 20 bp, Artificial Sequence
  Synthetic oligonucleotide; AAG chr11 5183850 5183869 5183866 +
aagactcaaatagatgcaat

SEQ ID NO: 4134 - DNA, 20 bp, Artificial Sequence
  Synthetic oligonucleotide; AAG chr11 5183861 5183880 5183877 +
agatgcaataagaaatgata

SEQ ID NO: 4135 - DNA, 20 bp, Artificial Sequence
  Synthetic oligonucleotide; AGG chr11 5183862 5183881 5183878 +
gatgcaataagaaatgataa

SEQ ID NO: 4136 - DNA, 20 bp, Artificial Sequence
  Synthetic oligonucleotide; GGG chr11 5183863 5183882 5183879 +
atgcaataagaaatgataaa

SEQ ID NO: 4137 - DNA, 20 bp, Artificial Sequence
  Synthetic oligonucleotide; GGG chr11 5183864 5183883 5183880 +
tgcaataagaaatgataaag

SEQ ID NO: 4138 - DNA, 20 bp, Artificial Sequence
  Synthetic oligonucleotide; CAG chr11 5183885 5183904 5183901 +
ggatatcaccaccaatccca

SEQ ID NO: 4139 - DNA, 20 bp, Artificial Sequence
  Synthetic oligonucleotide; CAG chr11 5183904 5183923 5183920 +
acagacatacaaactaccat

SEQ ID NO: 4140 - DNA, 20 bp, Artificial Sequence
  Synthetic oligonucleotide; GAG chr11 5183906 5183925 5183922 +
agacatacaaactaccatca

SEQ ID NO: 4141 - DNA, 20 bp, Artificial Sequence
  Synthetic oligonucleotide; TAG chr11 5183939 5183958 5183955 +
acacctctacgcaaataaac

SEQ ID NO: 4142 - DNA, 20 bp, Artificial Sequence
  Synthetic oligonucleotide; TAG chr11 5183948 5183967 5183964 +
cgcaaataaactagaaaatc

SEQ ID NO: 4143 - DNA, 20 bp, Artificial Sequence
  Synthetic oligonucleotide; TAG chr11 5183951 5183970 5183967 +
aaataaactagaaaatctag

SEQ ID NO: 4144 - DNA, 20 bp, Artificial Sequence
  Synthetic oligonucleotide; TGG chr11 5183957 5183976 5183973 +
actagaaaatctagtagaaa

SEQ ID NO: 4145 - DNA, 20 bp, Artificial Sequence
  Synthetic oligonucleotide; AAG chr11 5183988 5184007 5184004 +
ctcgacacatacaccctccc

SEQ ID NO: 4146 - DNA, 20 bp, Artificial Sequence
  Synthetic oligonucleotide; CAG chr11 5183998 5184017 5184014 +
acaccctcccaagactaaac

SEQ ID NO: 4147 - DNA, 20 bp, Artificial Sequence
  Synthetic oligonucleotide; AGG chr11 5183999 5184018 5184015 +
caccctcccaagactaaacc

SEQ ID NO: 4148 - DNA, 20 bp, Artificial Sequence
  Synthetic oligonucleotide; GGG chr11 5184000 5184019 5184016 +
accctcccaagactaaacca

SEQ ID NO: 4149 - DNA, 20 bp, Artificial Sequence
  Synthetic oligonucleotide; GAG chr11 5184002 5184021 5184018 +
cctcccaagactaaaccagg

SEQ ID NO: 4150 - DNA, 20 bp, Artificial Sequence
  Synthetic oligonucleotide; TAG chr11 5184021 5184040 5184037 +
ggagaaattgaatctcttaa

SEQ ID NO: 4151 - DNA, 20 bp, Artificial Sequence
  Synthetic oligonucleotide; TAG chr11 5184032 5184051 5184048 +
atctcttaatagacaaataa

SEQ ID NO: 4152 - DNA, 20 bp, Artificial Sequence
  Synthetic oligonucleotide; AGG chr11 5184033 5184052 5184049 +
tctcttaatagacaaataat

SEQ ID NO: 4153 - DNA, 20 bp, Artificial Sequence
  Synthetic oligonucleotide; GAG chr11 5184046 5184065 5184062 +
aaataataggctctgaaatt

SEQ ID NO: 4154 - DNA, 20 bp, Artificial Sequence
  Synthetic oligonucleotide; TAG chr11 5184060 5184079 5184076 +
gaaattgagacaataattaa

SEQ ID NO: 4155 - DNA, 20 bp, Artificial Sequence
  Synthetic oligonucleotide; AAG chr11 5184081 5184100 5184097 +
agtttacacattgtatatct

SEQ ID NO: 4156 - DNA, 20 bp, Artificial Sequence
  Synthetic oligonucleotide; CAG chr11 5184092 5184111 5184108 +
tgtatatctaagtaccacca

SEQ ID NO: 4157 - DNA, 20 bp, Artificial Sequence
  Synthetic oligonucleotide; CAG chr11 5184095 5184114 5184111 +
atatctaagtaccaccacag

SEQ ID NO: 4158 - DNA, 20 bp, Artificial Sequence
  Synthetic oligonucleotide; AAG chr11 5184099 5184118 5184115 +
ctaagtaccaccacagcagc

SEQ ID NO: 4159 - DNA, 20 bp, Artificial Sequence
  Synthetic oligonucleotide; CAG chr11 5184128 5184147 5184144 +
aatgttttcacattataaaa

SEQ ID NO: 4160 - DNA, 20 bp, Artificial Sequence
  Synthetic oligonucleotide; AGG chr11 5184129 5184148 5184145 +
atgttttcacattataaaac

SEQ ID NO: 4161 - DNA, 20 bp, Artificial Sequence
  Synthetic oligonucleotide; GAG chr11 5184131 5184150 5184147 +
gttttcacattataaaacag

SEQ ID NO: 4162 - DNA, 20 bp, Artificial Sequence
  Synthetic oligonucleotide; TAG chr11 5184174 5184193 5184190 +
tacttgttattactaattac

SEQ ID NO: 4163 - DNA, 20 bp, Artificial Sequence
  Synthetic oligonucleotide; TGG chr11 5184189 5184208 5184205 +
attactagttctaaaaaatg

SEQ ID NO: 4164 - DNA, 20 bp, Artificial Sequence
  Synthetic oligonucleotide; TAG chr11 5184193 5184212 5184209 +
ctagttctaaaaaatgtgga

SEQ ID NO: 4165 - DNA, 20 bp, Artificial Sequence
  Synthetic oligonucleotide; AAG chr11 5184196 5184215 5184212 +
gttctaaaaaatgtggatag

SEQ ID NO: 4166 - DNA, 20 bp, Artificial Sequence
  Synthetic oligonucleotide; AAG chr11 5184200 5184219 5184216 +
taaaaaatgtggatagaagc

SEQ ID NO: 4167 - DNA, 20 bp, Artificial Sequence
  Synthetic oligonucleotide; GAG chr11 5184212 5184231 5184228 +
atagaagcaagtttaatatt

SEQ ID NO: 4168 - DNA, 20 bp, Artificial Sequence
  Synthetic oligonucleotide; TGG chr11 5184215 5184234 5184231 +
gaagcaagtttaatattgag

SEQ ID NO: 4169 - DNA, 20 bp, Artificial Sequence
  Synthetic oligonucleotide; AAG chr11 5184223 5184242 5184239 +
tttaatattgagtggaaaat

SEQ ID NO: 4170 - DNA, 20 bp, Artificial Sequence
  Synthetic oligonucleotide; TAG chr11 5184228 5184247 5184244 +
tattgagtggaaaataagat

SEQ ID NO: 4171 - DNA, 20 bp, Artificial Sequence
  Synthetic oligonucleotide; AGG chr11 5184229 5184248 5184245 +
attgagtggaaaataagatt

SEQ ID NO: 4172 - DNA, 20 bp, Artificial Sequence
  Synthetic oligonucleotide; GAG chr11 5184231 5184250 5184247 +
tgagtggaaaataagattag

SEQ ID NO: 4173 - DNA, 20 bp, Artificial Sequence
  Synthetic oligonucleotide; CAG chr11 5184243 5184262 5184259 +
aagattaggagatgcaacac

SEQ ID NO: 4174 - DNA, 20 bp, Artificial Sequence
  Synthetic oligonucleotide; AGG chr11 5184244 5184263 5184260 +
agattaggagatgcaacacc

SEQ ID NO: 4175 - DNA, 20 bp, Artificial Sequence
  Synthetic oligonucleotide; GGG chr11 5184245 5184264 5184261 +
gattaggagatgcaacacca

SEQ ID NO: 4176 - DNA, 20 bp, Artificial Sequence
  Synthetic oligonucleotide; TAG chr11 5184248 5184267 5184264 +
taggagatgcaacaccaggg

SEQ ID NO: 4177 - DNA, 20 bp, Artificial Sequence
  Synthetic oligonucleotide; AGG chr11 5184249 5184268 5184265 +
aggagatgcaacaccagggt

SEQ ID NO: 4178 - DNA, 20 bp, Artificial Sequence
  Synthetic oligonucleotide; CAG chr11 5184261 5184280 5184277 +
accagggtaggtgacatata

SEQ ID NO: 4179 - DNA, 20 bp, Artificial Sequence
  Synthetic oligonucleotide; GAG chr11 5184263 5184282 5184279 +
cagggtaggtgacatataca

SEQ ID NO: 4180 - DNA, 20 bp, Artificial Sequence
  Synthetic oligonucleotide; TAG chr11 5184267 5184286 5184283 +
gtaggtgacatatacagaga

SEQ ID NO: 4181 - DNA, 20 bp, Artificial Sequence
  Synthetic oligonucleotide; TAG chr11 5184272 5184291 5184288 +
tgacatatacagagatagat

SEQ ID NO: 4182 - DNA, 20 bp, Artificial Sequence
  Synthetic oligonucleotide; TAG chr11 5184276 5184295 5184292 +
atatacagagatagattaga

SEQ ID NO: 4183 - DNA, 20 bp, Artificial Sequence
  Synthetic oligonucleotide; AGG chr11 5184277 5184296 5184293 +
tatacagagatagattagat

SEQ ID NO: 4184 - DNA, 20 bp, Artificial Sequence
  Synthetic oligonucleotide; TAG chr11 5184280 5184299 5184296 +
acagagatagattagatagg

SEQ ID NO: 4185 - DNA, 20 bp, Artificial Sequence
  Synthetic oligonucleotide; TAG chr11 5184284 5184303 5184300 +
agatagattagataggtaga

SEQ ID NO: 4186 - DNA, 20 bp, Artificial Sequence
  Synthetic oligonucleotide; TAG chr11 5184288 5184307 5184304 +
agattagataggtagatagc

SEQ ID NO: 4187 - DNA, 20 bp, Artificial Sequence
  Synthetic oligonucleotide; TAG chr11 5184292 5184311 5184308 +
tagataggtagatagctagc

SEQ ID NO: 4188 - DNA, 20 bp, Artificial Sequence
  Synthetic oligonucleotide; TAG chr11 5184296 5184315 5184312 +
taggtagatagctagctagc

SEQ ID NO: 4189 - DNA, 20 bp, Artificial Sequence
  Synthetic oligonucleotide; TAG chr11 5184300 5184319 5184316 +
tagatagctagctagctagc

SEQ ID NO: 4190 - DNA, 20 bp, Artificial Sequence
  Synthetic oligonucleotide; TAG chr11 5184304 5184323 5184320 +
tagctagctagctagctagc

SEQ ID NO: 4191 - DNA, 20 bp, Artificial Sequence
  Synthetic oligonucleotide; TAG chr11 5184308 5184327 5184324 +
tagctagctagctagctagc

SEQ ID NO: 4192 - DNA, 20 bp, Artificial Sequence
  Synthetic oligonucleotide; TAG chr11 5184312 5184331 5184328 +
tagctagctagctagctagc

SEQ ID NO: 4193 - DNA, 20 bp, Artificial Sequence
  Synthetic oligonucleotide; AAG chr11 5184316 5184335 5184332 +
tagctagctagctagctaga

SEQ ID NO: 4194 - DNA, 20 bp, Artificial Sequence
  Synthetic oligonucleotide; TAG chr11 5184320 5184339 5184336 +
tagctagctagctagaaaga

SEQ ID NO: 4195 - DNA, 20 bp, Artificial Sequence
  Synthetic oligonucleotide; TAG chr11 5184324 5184343 5184340 +
tagctagctagaaagataga

SEQ ID NO: 4196 - DNA, 20 bp, Artificial Sequence
  Synthetic oligonucleotide; TAG chr11 5184328 5184347 5184344 +
tagctagaaagatagataga

SEQ ID NO: 4197 - DNA, 20 bp, Artificial Sequence
  Synthetic oligonucleotide; TAG chr11 5184332 5184351 5184348 +
tagaaagatagatagataga

SEQ ID NO: 4198 - DNA, 20 bp, Artificial Sequence
  Synthetic oligonucleotide; TAG chr11 5184336 5184355 5184352 +
aagatagatagatagataga

SEQ ID NO: 4199 - DNA, 20 bp, Artificial Sequence
  Synthetic oligonucleotide; TAG chr11 5184340 5184359 5184356 +
tagatagatagatagataga

SEQ ID NO: 4200 - DNA, 20 bp, Artificial Sequence
  Synthetic oligonucleotide; TAG chr11 5184344 5184363 5184360 +
tagatagatagatagataga

SEQ ID NO: 4201 - DNA, 20 bp, Artificial Sequence
  Synthetic oligonucleotide; TAG chr11 5184348 5184367 5184364 +
tagatagatagatagataga

SEQ ID NO: 4202 - DNA, 20 bp, Artificial Sequence
  Synthetic oligonucleotide; TAG chr11 5184352 5184371 5184368 +
tagatagatagatagataga

SEQ ID NO: 4203 - DNA, 20 bp, Artificial Sequence
  Synthetic oligonucleotide; TAG chr11 5184356 5184375 5184372 +
tagatagatagatagataga

SEQ ID NO: 4204 - DNA, 20 bp, Artificial Sequence
  Synthetic oligonucleotide; TAG chr11 5184360 5184379 5184376 +
tagatagatagatagataga

SEQ ID NO: 4205 - DNA, 20 bp, Artificial Sequence
  Synthetic oligonucleotide; TAG chr11 5184364 5184383 5184380 +
tagatagatagatagataga

SEQ ID NO: 4206 - DNA, 20 bp, Artificial Sequence
  Synthetic oligonucleotide; TGG chr11 5184372 5184391 5184388 +
tagatagatagatagatgca

SEQ ID NO: 4207 - DNA, 20 bp, Artificial Sequence
  Synthetic oligonucleotide; GGG chr11 5184373 5184392 5184389 +
agatagatagatagatgcat

SEQ ID NO: 4208 - DNA, 20 bp, Artificial Sequence
  Synthetic oligonucleotide; TAG chr11 5184384 5184403 5184400 +
tagatgcatgggtataaaca

SEQ ID NO: 4209 - DNA, 20 bp, Artificial Sequence
  Synthetic oligonucleotide; CAG chr11 5184405 5184424 5184421 +
agataataatatgtgaatga

SEQ ID NO: 4210 - DNA, 20 bp, Artificial Sequence
  Synthetic oligonucleotide; AGG chr11 5184406 5184425 5184422 +
gataataatatgtgaatgac

SEQ ID NO: 4211 - DNA, 20 bp, Artificial Sequence
  Synthetic oligonucleotide; TGG chr11 5184409 5184428 5184425 +
aataatatgtgaatgacagg

SEQ ID NO: 4212 - DNA, 20 bp, Artificial Sequence
  Synthetic oligonucleotide; AAG chr11 5184426 5184445 5184442 +
aggtggcttctatactctct

SEQ ID NO: 4213 - DNA, 20 bp, Artificial Sequence
  Synthetic oligonucleotide; AAG chr11 5184440 5184459 5184456 +
ctctctaagttccctttctc

SEQ ID NO: 4214 - DNA, 20 bp, Artificial Sequence
  Synthetic oligonucleotide; AAG chr11 5184446 5184465 5184462 +
aagttccctttctcaagtaa

SEQ ID NO: 4215 - DNA, 20 bp, Artificial Sequence
  Synthetic oligonucleotide; TGG chr11 5184450 5184469 5184466 +
tccctttctcaagtaaaagc

SEQ ID NO: 4216 - DNA, 20 bp, Artificial Sequence
  Synthetic oligonucleotide; AAG chr11 5184456 5184475 5184472 +
tctcaagtaaaagctggcta

SEQ ID NO: 4217 - DNA, 20 bp, Artificial Sequence
  Synthetic oligonucleotide; GAG chr11 5184471 5184490 5184487 +
ggctaaagttcttgtttttt

SEQ ID NO: 4218 - DNA, 20 bp, Artificial Sequence
  Synthetic oligonucleotide; AGG chr11 5184472 5184491 5184488 +
gctaaagttcttgttttttg

SEQ ID NO: 4219 - DNA, 20 bp, Artificial Sequence
  Synthetic oligonucleotide; TGG chr11 5184475 5184494 5184491 +
aaagttcttgttttttgagg

SEQ ID NO: 4220 - DNA, 20 bp, Artificial Sequence
  Synthetic oligonucleotide; CAG chr11 5184480 5184499 5184496 +
tcttgttttttgaggtggca

SEQ ID NO: 4221 - DNA, 20 bp, Artificial Sequence
  Synthetic oligonucleotide; AGG chr11 5184481 5184500 5184497 +
cttgttttttgaggtggcac

SEQ ID NO: 4222 - DNA, 20 bp, Artificial Sequence
  Synthetic oligonucleotide; GGG chr11 5184482 5184501 5184498 +
ttgttttttgaggtggcaca

SEQ ID NO: 4223 - DNA, 20 bp, Artificial Sequence
  Synthetic oligonucleotide; GGG chr11 5184483 5184502 5184499 +
tgttttttgaggtggcacag

SEQ ID NO: 4224 - DNA, 20 bp, Artificial Sequence
  Synthetic oligonucleotide; AAG chr11 5184489 5184508 5184505 +
ttgaggtggcacaggggctt

SEQ ID NO: 4225 - DNA, 20 bp, Artificial Sequence
  Synthetic oligonucleotide; CAG chr11 5184525 5184544 5184541 +
cccatctcttgattccatta

SEQ ID NO: 4226 - DNA, 20 bp, Artificial Sequence
  Synthetic oligonucleotide; TAG chr11 5184549 5184568 5184565 +
tcaatatactgatcattgta

SEQ ID NO: 4227 - DNA, 20 bp, Artificial Sequence
  Synthetic oligonucleotide; TAG chr11 5184554 5184573 5184570 +
atactgatcattgtatagca

SEQ ID NO: 4228 - DNA, 20 bp, Artificial Sequence
  Synthetic oligonucleotide; AAG chr11 5184584 5184603 5184600 +
cctttacttttgtttttgct

SEQ ID NO: 4229 - DNA, 20 bp, Artificial Sequence
  Synthetic oligonucleotide; TGG chr11 5184599 5184618 5184615 +
ttgctaagtgctaaatattc

SEQ ID NO: 4230 - DNA, 20 bp, Artificial Sequence
  Synthetic oligonucleotide; TGG chr11 5184619 5184638 5184635 +
tggtctcaaattttatatga

SEQ ID NO: 4231 - DNA, 20 bp, Artificial Sequence
  Synthetic oligonucleotide; TGG chr11 5184629 5184648 5184645 +
ttttatatgatggaaatgtt

SEQ ID NO: 4232 - DNA, 20 bp, Artificial Sequence
  Synthetic oligonucleotide; GGG chr11 5184630 5184649 5184646 +
tttatatgatggaaatgttt

SEQ ID NO: 4233 - DNA, 20 bp, Artificial Sequence
  Synthetic oligonucleotide; GAG chr11 5184644 5184663 5184660 +
atgtttgggtcccatttttt

SEQ ID NO: 4234 - DNA, 20 bp, Artificial Sequence
  Synthetic oligonucleotide; CAG chr11 5184650 5184669 5184666 +
gggtcccattttttgagtta

SEQ ID NO: 4235 - DNA, 20 bp, Artificial Sequence
  Synthetic oligonucleotide; TAG chr11 5184655 5184674 5184671 +
ccattttttgagttacagtt

SEQ ID NO: 4236 - DNA, 20 bp, Artificial Sequence
  Synthetic oligonucleotide; CAG chr11 5184675 5184694 5184691 +
tagaatttaaaatacccaca

SEQ ID NO: 4237 - DNA, 20 bp, Artificial Sequence
  Synthetic oligonucleotide; GAG chr11 5184680 5184699 5184696 +
tttaaaatacccacacagct

SEQ ID NO: 4238 - DNA, 20 bp, Artificial Sequence
  Synthetic oligonucleotide; AAG chr11 5184700 5184719 5184716 +
gagcaatttacccttgcttt

SEQ ID NO: 4239 - DNA, 20 bp, Artificial Sequence
  Synthetic oligonucleotide; TGG chr11 5184704 5184723 5184720 +
aatttacccttgctttaagt

SEQ ID NO: 4240 - DNA, 20 bp, Artificial Sequence
  Synthetic oligonucleotide; GAG chr11 5184710 5184729 5184726 +
cccttgctttaagttggaat

SEQ ID NO: 4241 - DNA, 20 bp, Artificial Sequence
  Synthetic oligonucleotide; AGG chr11 5184711 5184730 5184727 +
ccttgctttaagttggaatg

SEQ ID NO: 4242 - DNA, 20 bp, Artificial Sequence
  Synthetic oligonucleotide; AAG chr11 5184729 5184748 5184745 +
tgaggttctttaaaaatatt

SEQ ID NO: 4243 - DNA, 20 bp, Artificial Sequence
  Synthetic oligonucleotide; AAG chr11 5184742 5184761 5184758 +
aaatattaagataaaatttg

SEQ ID NO: 4244 - DNA, 20 bp, Artificial Sequence
  Synthetic oligonucleotide; TGG chr11 5184758 5184777 5184774 +
tttgaagttatttaactctg

SEQ ID NO: 4245 - DNA, 20 bp, Artificial Sequence
  Synthetic oligonucleotide; TAG chr11 5184818 5184837 5184834 +
taatatatatctcacattgt

SEQ ID NO: 4246 - DNA, 20 bp, Artificial Sequence
  Synthetic oligonucleotide; AAG chr11 5184829 5184848 5184845 +
tcacattgttagaatatttt

SEQ ID NO: 4247 - DNA, 20 bp, Artificial Sequence
  Synthetic oligonucleotide; CAG chr11 5184848 5184867 5184864 +
taagtaaactgttgatgttt

SEQ ID NO: 4248 - DNA, 20 bp, Artificial Sequence
  Synthetic oligonucleotide; GAG chr11 5184850 5184869 5184866 +
agtaaactgttgatgtttca

SEQ ID NO: 4249 - DNA, 20 bp, Artificial Sequence
  Synthetic oligonucleotide; AAG chr11 5184854 5184873 5184870 +
aactgttgatgtttcagaga

SEQ ID NO: 4250 - DNA, 20 bp, Artificial Sequence
  Synthetic oligonucleotide; AGG chr11 5184855 5184874 5184871 +
actgttgatgtttcagagaa

SEQ ID NO: 4251 - DNA, 20 bp, Artificial Sequence
  Synthetic oligonucleotide; AAG chr11 5184859 5184878 5184875 +
ttgatgtttcagagaaagga

SEQ ID NO: 4252 - DNA, 20 bp, Artificial Sequence
  Synthetic oligonucleotide; AAG chr11 5184872 5184891 5184888 +
gaaaggaaagaataattttg

SEQ ID NO: 4253 - DNA, 20 bp, Artificial Sequence
  Synthetic oligonucleotide; CAG chr11 5184886 5184905 5184902 +
attttgaagcattcctgaca

SEQ ID NO: 4254 - DNA, 20 bp, Artificial Sequence
  Synthetic oligonucleotide; TAG chr11 5184892 5184911 5184908 +
aagcattcctgacacagttc

SEQ ID NO: 4255 - DNA, 20 bp, Artificial Sequence
  Synthetic oligonucleotide; AGG chr11 5184893 5184912 5184909 +
agcattcctgacacagttct

SEQ ID NO: 4256 - DNA, 20 bp, Artificial Sequence
  Synthetic oligonucleotide; CAG chr11 5184897 5184916 5184913 +
ttcctgacacagttctaggc

SEQ ID NO: 4257 - DNA, 20 bp, Artificial Sequence
  Synthetic oligonucleotide; GAG chr11 5184899 5184918 5184915 +
cctgacacagttctaggcca

SEQ ID NO: 4258 - DNA, 20 bp, Artificial Sequence
  Synthetic oligonucleotide; GAG chr11 5184912 5184931 5184928 +
taggccagagccatgcatgt

SEQ ID NO: 4259 - DNA, 20 bp, Artificial Sequence
  Synthetic oligonucleotide; AAG chr11 5184917 5184936 5184933 +
cagagccatgcatgtgagtg

SEQ ID NO: 4260 - DNA, 20 bp, Artificial Sequence
  Synthetic oligonucleotide; TAG chr11 5184922 5184941 5184938 +
ccatgcatgtgagtgaagcg

SEQ ID NO: 4261 - DNA, 20 bp, Artificial Sequence
  Synthetic oligonucleotide; TAG chr11 5184928 5184947 5184944 +
atgtgagtgaagcgtagtta

SEQ ID NO: 4262 - DNA, 20 bp, Artificial Sequence
  Synthetic oligonucleotide; AAG chr11 5184931 5184950 5184947 +
tgagtgaagcgtagttatag

SEQ ID NO: 4263 - DNA, 20 bp, Artificial Sequence
  Synthetic oligonucleotide; GAG chr11 5184935 5184954 5184951 +
tgaagcgtagttatagaagt

SEQ ID NO: 4264 - DNA, 20 bp, Artificial Sequence
  Synthetic oligonucleotide; AGG chr11 5184936 5184955 5184952 +
gaagcgtagttatagaagtg

SEQ ID NO: 4265 - DNA, 20 bp, Artificial Sequence
  Synthetic oligonucleotide; GGG chr11 5184937 5184956 5184953 +
aagcgtagttatagaagtga

SEQ ID NO: 4266 - DNA, 20 bp, Artificial Sequence
  Synthetic oligonucleotide; CAG chr11 5184943 5184962 5184959 +
agttatagaagtgagggtta

SEQ ID NO: 4267 - DNA, 20 bp, Artificial Sequence
  Synthetic oligonucleotide; TGG chr11 5184950 5184969 5184966 +
gaagtgagggttacagtgac

SEQ ID NO: 4268 - DNA, 20 bp, Artificial Sequence
  Synthetic oligonucleotide; GGG chr11 5184951 5184970 5184967 +
aagtgagggttacagtgact

SEQ ID NO: 4269 - DNA, 20 bp, Artificial Sequence
  Synthetic oligonucleotide; GGG chr11 5184952 5184971 5184968 +
agtgagggttacagtgactg

SEQ ID NO: 4270 - DNA, 20 bp, Artificial Sequence
  Synthetic oligonucleotide; CAG chr11 5184961 5184980 5184977 +
tacagtgactggggcttcat

SEQ ID NO: 4271 - DNA, 20 bp, Artificial Sequence
  Synthetic oligonucleotide; AGG chr11 5184962 5184981 5184978 +
acagtgactggggcttcatc

SEQ ID NO: 4272 - DNA, 20 bp, Artificial Sequence
  Synthetic oligonucleotide; TAG chr11 5184969 5184988 5184985 +
ctggggcttcatcaggacat

SEQ ID NO: 4273 - DNA, 20 bp, Artificial Sequence
  Synthetic oligonucleotide; AGG chr11 5184970 5184989 5184986 +
tggggcttcatcaggacatt

SEQ ID NO: 4274 - DNA, 20 bp, Artificial Sequence
  Synthetic oligonucleotide; GGG chr11 5184971 5184990 5184987 +
ggggcttcatcaggacatta

SEQ ID NO: 4275 - DNA, 20 bp, Artificial Sequence
  Synthetic oligonucleotide; TGG chr11 5184975 5184994 5184991 +
cttcatcaggacattaggga

SEQ ID NO: 4276 - DNA, 20 bp, Artificial Sequence
  Synthetic oligonucleotide; GGG chr11 5184976 5184995 5184992 +
ttcatcaggacattagggat

SEQ ID NO: 4277 - DNA, 20 bp, Artificial Sequence
  Synthetic oligonucleotide; GAG chr11 5184978 5184997 5184994 +
catcaggacattagggatgg

SEQ ID NO: 4278 - DNA, 20 bp, Artificial Sequence
  Synthetic oligonucleotide; GAG chr11 5184980 5184999 5184996 +
tcaggacattagggatggga

SEQ ID NO: 4279 - DNA, 20 bp, Artificial Sequence
  Synthetic oligonucleotide; AAG chr11 5184983 5185002 5184999 +
ggacattagggatgggagag

SEQ ID NO: 4280 - DNA, 20 bp, Artificial Sequence
  Synthetic oligonucleotide; AAG chr11 5184991 5185010 5185007 +
gggatgggagagaagaatct

SEQ ID NO: 4281 - DNA, 20 bp, Artificial Sequence
  Synthetic oligonucleotide; CAG chr11 5185007 5185026 5185023 +
atctaagtgaaaaaaaaata

SEQ ID NO: 4282 - DNA, 20 bp, Artificial Sequence
  Synthetic oligonucleotide; AGG chr11 5185008 5185027 5185024 +
tctaagtgaaaaaaaaatac

SEQ ID NO: 4283 - DNA, 20 bp, Artificial Sequence
  Synthetic oligonucleotide; AAG chr11 5185015 5185034 5185031 +
gaaaaaaaaatacaggaatg

SEQ ID NO: 4284 - DNA, 20 bp, Artificial Sequence
  Synthetic oligonucleotide; AAG chr11 5185020 5185039 5185036 +
aaaaatacaggaatgaagat

SEQ ID NO: 4285 - DNA, 20 bp, Artificial Sequence
  Synthetic oligonucleotide; AGG chr11 5185021 5185040 5185037 +
aaaatacaggaatgaagata

SEQ ID NO: 4286 - DNA, 20 bp, Artificial Sequence
  Synthetic oligonucleotide; GGG chr11 5185022 5185041 5185038 +
aaatacaggaatgaagataa

SEQ ID NO: 4287 - DNA, 20 bp, Artificial Sequence
  Synthetic oligonucleotide; GGG chr11 5185023 5185042 5185039 +
aatacaggaatgaagataag

SEQ ID NO: 4288 - DNA, 20 bp, Artificial Sequence
  Synthetic oligonucleotide; GGG chr11 5185024 5185043 5185040 +
atacaggaatgaagataagg

SEQ ID NO: 4289 - DNA, 20 bp, Artificial Sequence
  Synthetic oligonucleotide; AAG chr11 5185028 5185047 5185044 +
aggaatgaagataaggggga

SEQ ID NO: 4290 - DNA, 20 bp, Artificial Sequence
  Synthetic oligonucleotide; CAG chr11 5185035 5185054 5185051 +
aagataagggggaaagaaaa

SEQ ID NO: 4291 - DNA, 20 bp, Artificial Sequence
  Synthetic oligonucleotide; TGG chr11 5185044 5185063 5185060 +
gggaaagaaaacagattttc

SEQ ID NO: 4292 - DNA, 20 bp, Artificial Sequence
  Synthetic oligonucleotide; TGG chr11 5185062 5185081 5185078 +
tctggcctttaaattttttc

SEQ ID NO: 4293 - DNA, 20 bp, Artificial Sequence
  Synthetic oligonucleotide; TGG chr11 5185084 5185103 5185100 +
gtgatcttttgtgataccta

SEQ ID NO: 4294 - DNA, 20 bp, Artificial Sequence
  Synthetic oligonucleotide; TAG chr11 5185152 5185171 5185168 +
atatgtgatgacccaaatta

SEQ ID NO: 4295 - DNA, 20 bp, Artificial Sequence
  Synthetic oligonucleotide; AGG chr11 5185153 5185172 5185169 +
tatgtgatgacccaaattat

SEQ ID NO: 4296 - DNA, 20 bp, Artificial Sequence
  Synthetic oligonucleotide; TGG chr11 5185158 5185177 5185174 +
gatgacccaaattataggcc

SEQ ID NO: 4297 - DNA, 20 bp, Artificial Sequence
  Synthetic oligonucleotide; GGG chr11 5185159 5185178 5185175 +
atgacccaaattataggcct

SEQ ID NO: 4298 - DNA, 20 bp, Artificial Sequence
  Synthetic oligonucleotide; TAG chr11 5185169 5185188 5185185 +
ttataggcctgggttccttg

SEQ ID NO: 4299 - DNA, 20 bp, Artificial Sequence
  Synthetic oligonucleotide; TAG chr11 5185180 5185199 5185196 +
ggttccttgtagcattattc

SEQ ID NO: 4300 - DNA, 20 bp, Artificial Sequence
  Synthetic oligonucleotide; AGG chr11 5185181 5185200 5185197 +
gttccttgtagcattattct

SEQ ID NO: 4301 - DNA, 20 bp, Artificial Sequence
  Synthetic oligonucleotide; CAG chr11 5185194 5185213 5185210 +
ttattctaggatatttctga

SEQ ID NO: 4302 - DNA, 20 bp, Artificial Sequence
  Synthetic oligonucleotide; CGG chr11 5185227 5185246 5185243 +
ctgaatcatgaatgtatcca

SEQ ID NO: 4303 - DNA, 20 bp, Artificial Sequence
  Synthetic oligonucleotide; GAG chr11 5185229 5185248 5185245 +
gaatcatgaatgtatccacg

SEQ ID NO: 4304 - DNA, 20 bp, Artificial Sequence
  Synthetic oligonucleotide; AAG chr11 5185234 5185253 5185250 +
atgaatgtatccacggagca

SEQ ID NO: 4305 - DNA, 20 bp, Artificial Sequence
  Synthetic oligonucleotide; TAG chr11 5185238 5185257 5185254 +
atgtatccacggagcaaaga

SEQ ID NO: 4306 - DNA, 20 bp, Artificial Sequence
  Synthetic oligonucleotide; TGG chr11 5185243 5185262 5185259 +
tccacggagcaaagatagtg

SEQ ID NO: 4307 - DNA, 20 bp, Artificial Sequence
  Synthetic oligonucleotide; TAG chr11 5185251 5185270 5185267 +
gcaaagatagtgtggtgtaa

SEQ ID NO: 4308 - DNA, 20 bp, Artificial Sequence
  Synthetic oligonucleotide; CAG chr11 5185257 5185276 5185273 +
atagtgtggtgtaatagaaa

SEQ ID NO: 4309 - DNA, 20 bp, Artificial Sequence
  Synthetic oligonucleotide; TAG chr11 5185262 5185281 5185278 +
gtggtgtaatagaaacagta

SEQ ID NO: 4310 - DNA, 20 bp, Artificial Sequence
  Synthetic oligonucleotide; AAG chr11 5185269 5185288 5185285 +
aatagaaacagtatagctct

SEQ ID NO: 4311 - DNA, 20 bp, Artificial Sequence
  Synthetic oligonucleotide; AGG chr11 5185270 5185289 5185286 +
atagaaacagtatagctcta

SEQ ID NO: 4312 - DNA, 20 bp, Artificial Sequence
  Synthetic oligonucleotide; TAG chr11 5185280 5185299 5185296 +
tatagctctaaggacatata

SEQ ID NO: 4313 - DNA, 20 bp, Artificial Sequence
  Synthetic oligonucleotide; TGG chr11 5185297 5185316 5185313 +
atatagttgtatttaaatac

SEQ ID NO: 4314 - DNA, 20 bp, Artificial Sequence
  Synthetic oligonucleotide; TGG chr11 5185327 5185346 5185343 +
ttattctgactctatgaccc

SEQ ID NO: 4315 - DNA, 20 bp, Artificial Sequence
  Synthetic oligonucleotide; TAG chr11 5185352 5185371 5185368 +
acgtcatttaatttaaactt

SEQ ID NO: 4316 - DNA, 20 bp, Artificial Sequence
  Synthetic oligonucleotide; AAG chr11 5185383 5185402 5185399 +
cttgtaaaatacctaacaat

SEQ ID NO: 4317 - DNA, 20 bp, Artificial Sequence
  Synthetic oligonucleotide; GAG chr11 5185402 5185421 5185418 +
taagcataaatttaaaatgt

SEQ ID NO: 4318 - DNA, 20 bp, Artificial Sequence
  Synthetic oligonucleotide; AAG chr11 5185414 5185433 5185430 +
taaaatgtgagtcttttctg

SEQ ID NO: 4319 - DNA, 20 bp, Artificial Sequence
  Synthetic oligonucleotide; CAG chr11 5185418 5185437 5185434 +
atgtgagtcttttctgaagt

SEQ ID NO: 4320 - DNA, 20 bp, Artificial Sequence
  Synthetic oligonucleotide; TAG chr11 5185426 5185445 5185442 +
cttttctgaagtcagtgtct

SEQ ID NO: 4321 - DNA, 20 bp, Artificial Sequence
  Synthetic oligonucleotide; AGG chr11 5185427 5185446 5185443 +
ttttctgaagtcagtgtctt

SEQ ID NO: 4322 - DNA, 20 bp, Artificial Sequence
  Synthetic oligonucleotide; AAG chr11 5185430 5185449 5185446 +
tctgaagtcagtgtcttagg

SEQ ID NO: 4323 - DNA, 20 bp, Artificial Sequence
  Synthetic oligonucleotide; AGG chr11 5185431 5185450 5185447 +
ctgaagtcagtgtcttagga

SEQ ID NO: 4324 - DNA, 20 bp, Artificial Sequence
  Synthetic oligonucleotide; TAG chr11 5185434 5185453 5185450 +
aagtcagtgtcttaggaagg

SEQ ID NO: 4325 - DNA, 20 bp, Artificial Sequence
  Synthetic oligonucleotide; AAG chr11 5185443 5185462 5185459 +
tcttaggaaggtagctacat

SEQ ID NO: 4326 - DNA, 20 bp, Artificial Sequence
  Synthetic oligonucleotide; TAG chr11 5185470 5185489 5185486 +
ttatatctctatcccaacaa

SEQ ID NO: 4327 - DNA, 20 bp, Artificial Sequence
  Synthetic oligonucleotide; CAG chr11 5185480 5185499 5185496 +
atcccaacaatagatgacat

SEQ ID NO: 4328 - DNA, 20 bp, Artificial Sequence
  Synthetic oligonucleotide; AGG chr11 5185481 5185500 5185497 +
tcccaacaatagatgacatc

SEQ ID NO: 4329 - DNA, 20 bp, Artificial Sequence
  Synthetic oligonucleotide; TAG chr11 5185499 5185518 5185515 +
tcaggacactaacaaaattg

SEQ ID NO: 4330 - DNA, 20 bp, Artificial Sequence
  Synthetic oligonucleotide; AAG chr11 5185507 5185526 5185523 +
ctaacaaaattgtagcaatt

SEQ ID NO: 4331 - DNA, 20 bp, Artificial Sequence
  Synthetic oligonucleotide; TGG chr11 5185528 5185547 5185544 +
agaccaaaattattgtcaac

SEQ ID NO: 4332 - DNA, 20 bp, Artificial Sequence
  Synthetic oligonucleotide; AAG chr11 5185534 5185553 5185550 +
aaattattgtcaactggaat

SEQ ID NO: 4333 - DNA, 20 bp, Artificial Sequence
  Synthetic oligonucleotide; CAG chr11 5185546 5185565 5185562 +
actggaataagtttaacttt

SEQ ID NO: 4334 - DNA, 20 bp, Artificial Sequence
  Synthetic oligonucleotide; AGG chr11 5185547 5185566 5185563 +
ctggaataagtttaactttc

SEQ ID NO: 4335 - DNA, 20 bp, Artificial Sequence
  Synthetic oligonucleotide; CAG chr11 5185554 5185573 5185570 +
aagtttaactttcaggactt

SEQ ID NO: 4336 - DNA, 20 bp, Artificial Sequence
  Synthetic oligonucleotide; AGG chr11 5185555 5185574 5185571 +
agtttaactttcaggacttc

SEQ ID NO: 4337 - DNA, 20 bp, Artificial Sequence
  Synthetic oligonucleotide; GAG chr11 5185576 5185595 5185592 +
ggcttattatccatcaaact

SEQ ID NO: 4338 - DNA, 20 bp, Artificial Sequence
  Synthetic oligonucleotide; TAG chr11 5185591 5185610 5185607 +
aaactgagattgaattgatt

SEQ ID NO: 4339 - DNA, 20 bp, Artificial Sequence
  Synthetic oligonucleotide; GAG chr11 5185593 5185612 5185609 +
actgagattgaattgattta

SEQ ID NO: 4340 - DNA, 20 bp, Artificial Sequence
  Synthetic oligonucleotide; TAG chr11 5185609 5185628 5185625 +
tttagagtatccataaatac

SEQ ID NO: 4341 - DNA, 20 bp, Artificial Sequence
  Synthetic oligonucleotide; AGG chr11 5185610 5185629 5185626 +
ttagagtatccataaatact

SEQ ID NO: 4342 - DNA, 20 bp, Artificial Sequence
  Synthetic oligonucleotide; TGG chr11 5185644 5185663 5185660 +
ttttaataaatttcttatac

SEQ ID NO: 4343 - DNA, 20 bp, Artificial Sequence
  Synthetic oligonucleotide; GGG chr11 5185645 5185664 5185661 +
tttaataaatttcttatact

SEQ ID NO: 4344 - DNA, 20 bp, Artificial Sequence
  Synthetic oligonucleotide; TGG chr11 5185652 5185671 5185668 +
aatttcttatactgggcaca

SEQ ID NO: 4345 - DNA, 20 bp, Artificial Sequence
  Synthetic oligonucleotide; TGG chr11 5185662 5185681 5185678 +
actgggcacatggtatcaat

SEQ ID NO: 4346 - DNA, 20 bp, Artificial Sequence
  Synthetic oligonucleotide; AAG chr11 5185699 5185718 5185715 +
tatctgtcatttacttttat

SEQ ID NO: 4347 - DNA, 20 bp, Artificial Sequence
  Synthetic oligonucleotide; AGG chr11 5185700 5185719 5185716 +
atctgtcatttacttttata

SEQ ID NO: 4348 - DNA, 20 bp, Artificial Sequence
  Synthetic oligonucleotide; TAG chr11 5185709 5185728 5185725 +
ttacttttataaggtgcaaa

SEQ ID NO: 4349 - DNA, 20 bp, Artificial Sequence
  Synthetic oligonucleotide; CAG chr11 5185714 5185733 5185730 +
tttataaggtgcaaatagtt

SEQ ID NO: 4350 - DNA, 20 bp, Artificial Sequence
  Synthetic oligonucleotide; TGG chr11 5185719 5185738 5185735 +
aaggtgcaaatagttcagca

SEQ ID NO: 4351 - DNA, 20 bp, Artificial Sequence
  Synthetic oligonucleotide; CAG chr11 5185725 5185744 5185741 +
caaatagttcagcatggtga

SEQ ID NO: 4352 - DNA, 20 bp, Artificial Sequence
  Synthetic oligonucleotide; TGG chr11 5185745 5185764 5185761 +
cagacacatgaattttgaaa

SEQ ID NO: 4353 - DNA, 20 bp, Artificial Sequence
  Synthetic oligonucleotide; GAG chr11 5185747 5185766 5185763 +
gacacatgaattttgaaatg

SEQ ID NO: 4354 - DNA, 20 bp, Artificial Sequence
  Synthetic oligonucleotide; CAG chr11 5185770 5185789 5185786 +
ttttatttttgccccatcac

SEQ ID NO: 4355 - DNA, 20 bp, Artificial Sequence
  Synthetic oligonucleotide; TAG chr11 5185791 5185810 5185807 +
agtataatatctttgttaca

SEQ ID NO: 4356 - DNA, 20 bp, Artificial Sequence
  Synthetic oligonucleotide; AGG chr11 5185792 5185811 5185808 +
gtataatatctttgttacat

SEQ ID NO: 4357 - DNA, 20 bp, Artificial Sequence
  Synthetic oligonucleotide; GGG chr11 5185793 5185812 5185809 +
tataatatctttgttacata

SEQ ID NO: 4358 - DNA, 20 bp, Artificial Sequence
  Synthetic oligonucleotide; AAG chr11 5185796 5185815 5185812 +
aatatctttgttacataggg

SEQ ID NO: 4359 - DNA, 20 bp, Artificial Sequence
  Synthetic oligonucleotide; GAG chr11 5185798 5185817 5185814 +
tatctttgttacatagggaa

SEQ ID NO: 4360 - DNA, 20 bp, Artificial Sequence
  Synthetic oligonucleotide; GAG chr11 5185800 5185819 5185816 +
tctttgttacatagggaaga

SEQ ID NO: 4361 - DNA, 20 bp, Artificial Sequence
  Synthetic oligonucleotide; TGG chr11 5185813 5185832 5185829 +
gggaagagagttaaaaattt

SEQ ID NO: 4362 - DNA, 20 bp, Artificial Sequence
  Synthetic oligonucleotide; GAG chr11 5185815 5185834 5185831 +
gaagagagttaaaaattttg

SEQ ID NO: 4363 - DNA, 20 bp, Artificial Sequence
  Synthetic oligonucleotide; CAG chr11 5185821 5185840 5185837 +
agttaaaaattttggagtgc

SEQ ID NO: 4364 - DNA, 20 bp, Artificial Sequence
  Synthetic oligonucleotide; TAG chr11 5185840 5185859 5185856 +
ccagcttcttaatctgtgcc

SEQ ID NO: 4365 - DNA, 20 bp, Artificial Sequence
  Synthetic oligonucleotide; GAG chr11 5185856 5185875 5185872 +
tgcctagactattacctgat

SEQ ID NO: 4366 - DNA, 20 bp, Artificial Sequence
  Synthetic oligonucleotide; TAG chr11 5185862 5185881 5185878 +
gactattacctgatgagtaa

SEQ ID NO: 4367 - DNA, 20 bp, Artificial Sequence
  Synthetic oligonucleotide; CAG chr11 5185876 5185895 5185892 +
gagtaatagtcaataaacta

SEQ ID NO: 4368 - DNA, 20 bp, Artificial Sequence
  Synthetic oligonucleotide; GAG chr11 5185928 5185947 5185944 +
tactaaaattttttattact

SEQ ID NO: 4369 - DNA, 20 bp, Artificial Sequence
  Synthetic oligonucleotide; TAG chr11 5185946 5185965 5185962 +
ctgagccttgttttaactac

SEQ ID NO: 4370 - DNA, 20 bp, Artificial Sequence
  Synthetic oligonucleotide; AAG chr11 5185996 5186015 5186012 +
acattcaaatctgcatatca

SEQ ID NO: 4371 - DNA, 20 bp, Artificial Sequence
  Synthetic oligonucleotide; GAG chr11 5186004 5186023 5186020 +
atctgcatatcaaagaaaat

SEQ ID NO: 4372 - DNA, 20 bp, Artificial Sequence
  Synthetic oligonucleotide; AAG chr11 5186026 5186045 5186042 +
gcattatttaaacatattct

SEQ ID NO: 4373 - DNA, 20 bp, Artificial Sequence
  Synthetic oligonucleotide; GAG chr11 5186028 5186047 5186044 +
attatttaaacatattctaa

SEQ ID NO: 4374 - DNA, 20 bp, Artificial Sequence
  Synthetic oligonucleotide; AAG chr11 5186071 5186090 5186087 +
gaaaatgacttacttaatac

SEQ ID NO: 4375 - DNA, 20 bp, Artificial Sequence
  Synthetic oligonucleotide; CAG chr11 5186107 5186126 5186123 +
ctacaattgcaaatcaactc

SEQ ID NO: 4376 - DNA, 20 bp, Artificial Sequence
  Synthetic oligonucleotide; AAG chr11 5186113 5186132 5186129 +
ttgcaaatcaactccagcta

SEQ ID NO: 4377 - DNA, 20 bp, Artificial Sequence
  Synthetic oligonucleotide; AAG chr11 5186118 5186137 5186134 +
aatcaactccagctaaagcc

SEQ ID NO: 4378 - DNA, 20 bp, Artificial Sequence
  Synthetic oligonucleotide; TAG chr11 5186123 5186142 5186139 +
actccagctaaagccaagtc

SEQ ID NO: 4379 - DNA, 20 bp, Artificial Sequence
  Synthetic oligonucleotide; TGG chr11 5186133 5186152 5186149 +
aagccaagtctagtattcca

SEQ ID NO: 4380 - DNA, 20 bp, Artificial Sequence
  Synthetic oligonucleotide; GGG chr11 5186134 5186153 5186150 +
agccaagtctagtattccat

SEQ ID NO: 4381 - DNA, 20 bp, Artificial Sequence
  Synthetic oligonucleotide; AAG chr11 5186146 5186165 5186162 +
tattccatgggtcaaaaatc

SEQ ID NO: 4382 - DNA, 20 bp, Artificial Sequence
  Synthetic oligonucleotide; AGG chr11 5186147 5186166 5186163 +
attccatgggtcaaaaatca

SEQ ID NO: 4383 - DNA, 20 bp, Artificial Sequence
  Synthetic oligonucleotide; TAG chr11 5186157 5186176 5186173 +
tcaaaaatcaaggaaaatgt

SEQ ID NO: 4384 - DNA, 20 bp, Artificial Sequence
  Synthetic oligonucleotide; AAG chr11 5186166 5186185 5186182 +
aaggaaaatgttagatgatt

SEQ ID NO: 4385 - DNA, 20 bp, Artificial Sequence
  Synthetic oligonucleotide; CGG chr11 5186173 5186192 5186189 +
atgttagatgattaagttat

SEQ ID NO: 4386 - DNA, 20 bp, Artificial Sequence
  Synthetic oligonucleotide; AAG chr11 5186176 5186195 5186192 +
ttagatgattaagttatcgg

SEQ ID NO: 4387 - DNA, 20 bp, Artificial Sequence
  Synthetic oligonucleotide; GAG chr11 5186182 5186201 5186198 +
gattaagttatcggaagaat

SEQ ID NO: 4388 - DNA, 20 bp, Artificial Sequence
  Synthetic oligonucleotide; CAG chr11 5186194 5186213 5186210 +
ggaagaatgagctgcttctg

SEQ ID NO: 4389 - DNA, 20 bp, Artificial Sequence
  Synthetic oligonucleotide; TGG chr11 5186217 5186236 5186233 +
tttcttgccttttttttttc

SEQ ID NO: 4390 - DNA, 20 bp, Artificial Sequence
  Synthetic oligonucleotide; AAG chr11 5186233 5186252 5186249 +
tttctggtgttattttctac

SEQ ID NO: 4391 - DNA, 20 bp, Artificial Sequence
  Synthetic oligonucleotide; GAG chr11 5186244 5186263 5186260 +
attttctacaagttttcatt

SEQ ID NO: 4392 - DNA, 20 bp, Artificial Sequence
  Synthetic oligonucleotide; CAG chr11 5186254 5186273 5186270 +
agttttcattgagcataact

SEQ ID NO: 4393 - DNA, 20 bp, Artificial Sequence
  Synthetic oligonucleotide; TAG chr11 5186276 5186295 5186292 +
gtttacttacttgcattttc

SEQ ID NO: 4394 - DNA, 20 bp, Artificial Sequence
  Synthetic oligonucleotide; AAG chr11 5186286 5186305 5186302 +
ttgcattttctagaatcctg

SEQ ID NO: 4395 - DNA, 20 bp, Artificial Sequence
  Synthetic oligonucleotide; TAG chr11 5186294 5186313 5186310 +
tctagaatcctgaagatatt

SEQ ID NO: 4396 - DNA, 20 bp, Artificial Sequence
  Synthetic oligonucleotide; CAG chr11 5186297 5186316 5186313 +
agaatcctgaagatatttag

SEQ ID NO: 4397 - DNA, 20 bp, Artificial Sequence
  Synthetic oligonucleotide; AGG chr11 5186298 5186317 5186314 +
gaatcctgaagatatttagc

SEQ ID NO: 4398 - DNA, 20 bp, Artificial Sequence
  Synthetic oligonucleotide; GAG chr11 5186303 5186322 5186319 +
ctgaagatatttagcaggtt

SEQ ID NO: 4399 - DNA, 20 bp, Artificial Sequence
  Synthetic oligonucleotide; GAG chr11 5186305 5186324 5186321 +
gaagatatttagcaggttga

SEQ ID NO: 4400 - DNA, 20 bp, Artificial Sequence
  Synthetic oligonucleotide; AGG chr11 5186306 5186325 5186322 +
aagatatttagcaggttgag

SEQ ID NO: 4401 - DNA, 20 bp, Artificial Sequence
  Synthetic oligonucleotide; GAG chr11 5186308 5186327 5186324 +
gatatttagcaggttgagag

SEQ ID NO: 4402 - DNA, 20 bp, Artificial Sequence
  Synthetic oligonucleotide; AAG chr11 5186325 5186344 5186341 +
gaggagacaaaataaatgca

SEQ ID NO: 4403 - DNA, 20 bp, Artificial Sequence
  Synthetic oligonucleotide; GAG chr11 5186327 5186346 5186343 +
ggagacaaaataaatgcaaa

SEQ ID NO: 4404 - DNA, 20 bp, Artificial Sequence
  Synthetic oligonucleotide; TAG chr11 5186332 5186351 5186348 +
caaaataaatgcaaagagat

SEQ ID NO: 4405 - DNA, 20 bp, Artificial Sequence
  Synthetic oligonucleotide; AGG chr11 5186333 5186352 5186349 +
aaaataaatgcaaagagatt

SEQ ID NO: 4406 - DNA, 20 bp, Artificial Sequence
  Synthetic oligonucleotide; TGG chr11 5186341 5186360 5186357 +
tgcaaagagattaggaaatc

SEQ ID NO: 4407 - DNA, 20 bp, Artificial Sequence
  Synthetic oligonucleotide; AAG chr11 5186364 5186383 5186380 +
aactatttatacttctttta

SEQ ID NO: 4408 - DNA, 20 bp, Artificial Sequence
  Synthetic oligonucleotide; TGG chr11 5186374 5186393 5186390 +
acttcttttaaagcatgtct

SEQ ID NO: 4409 - DNA, 20 bp, Artificial Sequence
  Synthetic oligonucleotide; GGG chr11 5186375 5186394 5186391 +
cttcttttaaagcatgtctt

SEQ ID NO: 4410 - DNA, 20 bp, Artificial Sequence
  Synthetic oligonucleotide; AAG chr11 5186381 5186400 5186397 +
ttaaagcatgtcttgggccc

SEQ ID NO: 4411 - DNA, 20 bp, Artificial Sequence
  Synthetic oligonucleotide; AGG chr11 5186382 5186401 5186398 +
taaagcatgtcttgggccca

SEQ ID NO: 4412 - DNA, 20 bp, Artificial Sequence
  Synthetic oligonucleotide; CAG chr11 5186389 5186408 5186405 +
tgtcttgggcccaaggtttt

SEQ ID NO: 4413 - DNA, 20 bp, Artificial Sequence
  Synthetic oligonucleotide; AAG chr11 5186395 5186414 5186411 +
gggcccaaggttttcagctt

SEQ ID NO: 4414 - DNA, 20 bp, Artificial Sequence
  Synthetic oligonucleotide; GAG chr11 5186397 5186416 5186413 +
gcccaaggttttcagcttaa

SEQ ID NO: 4415 - DNA, 20 bp, Artificial Sequence
  Synthetic oligonucleotide; AGG chr11 5186398 5186417 5186414 +
cccaaggttttcagcttaag

SEQ ID NO: 4416 - DNA, 20 bp, Artificial Sequence
  Synthetic oligonucleotide; TGG chr11 5186420 5186439 5186436 +
gacgaattttactcctccca

SEQ ID NO: 4417 - DNA, 20 bp, Artificial Sequence
  Synthetic oligonucleotide; AAG chr11 5186423 5186442 5186439 +
gaattttactcctcccatgg

SEQ ID NO: 4418 - DNA, 20 bp, Artificial Sequence
  Synthetic oligonucleotide; AGG chr11 5186424 5186443 5186440 +
aattttactcctcccatgga

SEQ ID NO: 4419 - DNA, 20 bp, Artificial Sequence
  Synthetic oligonucleotide; GAG chr11 5186426 5186445 5186442 +
ttttactcctcccatggaag

SEQ ID NO: 4420 - DNA, 20 bp, Artificial Sequence
  Synthetic oligonucleotide; CAG chr11 5186435 5186454 5186451 +
tcccatggaaggagatgaca

SEQ ID NO: 4421 - DNA, 20 bp, Artificial Sequence
  Synthetic oligonucleotide; GAG chr11 5186437 5186456 5186453 +
ccatggaaggagatgacaca

SEQ ID NO: 4422 - DNA, 20 bp, Artificial Sequence
  Synthetic oligonucleotide; TGG chr11 5186447 5186466 5186463 +
agatgacacagagctgcttc

SEQ ID NO: 4423 - DNA, 20 bp, Artificial Sequence
  Synthetic oligonucleotide; TAG chr11 5186454 5186473 5186470 +
acagagctgcttctggtaca

SEQ ID NO: 4424 - DNA, 20 bp, Artificial Sequence
  Synthetic oligonucleotide; CAG chr11 5186461 5186480 5186477 +
tgcttctggtacatagtcca

SEQ ID NO: 4425 - DNA, 20 bp, Artificial Sequence
  Synthetic oligonucleotide; AGG chr11 5186462 5186481 5186478 +
gcttctggtacatagtccac

SEQ ID NO: 4426 - DNA, 20 bp, Artificial Sequence
  Synthetic oligonucleotide; GGG chr11 5186463 5186482 5186479 +
cttctggtacatagtccaca

SEQ ID NO: 4427 - DNA, 20 bp, Artificial Sequence
  Synthetic oligonucleotide; GAG chr11 5186465 5186484 5186481 +
tctggtacatagtccacagg

SEQ ID NO: 4428 - DNA, 20 bp, Artificial Sequence
  Synthetic oligonucleotide; CAG chr11 5186515 5186534 5186531 +
atttgtgcattttttttctt

SEQ ID NO: 4429 - DNA, 20 bp, Artificial Sequence
  Synthetic oligonucleotide; AAG chr11 5186537 5186556 5186553 +
gccaccactctctgacacct

SEQ ID NO: 4430 - DNA, 20 bp, Artificial Sequence
  Synthetic oligonucleotide; CAG chr11 5186562 5186581 5186578 +
aatacatacatctacatgtc

SEQ ID NO: 4431 - DNA, 20 bp, Artificial Sequence
  Synthetic oligonucleotide; AGG chr11 5186563 5186582 5186579 +
atacatacatctacatgtcc

SEQ ID NO: 4432 - DNA, 20 bp, Artificial Sequence
  Synthetic oligonucleotide; GAG chr11 5186597 5186616 5186613 +
tgtcatatattgtttccaat

SEQ ID NO: 4433 - DNA, 20 bp, Artificial Sequence
  Synthetic oligonucleotide; TGG chr11 5186604 5186623 5186620 +
tattgtttccaatgagccat

SEQ ID NO: 4434 - DNA, 20 bp, Artificial Sequence
  Synthetic oligonucleotide; TAG chr11 5186613 5186632 5186629 +
caatgagccattggcaaata

SEQ ID NO: 4435 - DNA, 20 bp, Artificial Sequence
  Synthetic oligonucleotide; AGG chr11 5186614 5186633 5186630 +
aatgagccattggcaaatat

SEQ ID NO: 4436 - DNA, 20 bp, Artificial Sequence
  Synthetic oligonucleotide; AAG chr11 5186622 5186641 5186638 +
attggcaaatataggttgca

SEQ ID NO: 4437 - DNA, 20 bp, Artificial Sequence
  Synthetic oligonucleotide; AGG chr11 5186623 5186642 5186639 +
ttggcaaatataggttgcaa

SEQ ID NO: 4438 - DNA, 20 bp, Artificial Sequence
  Synthetic oligonucleotide; GAG chr11 5186625 5186644 5186641 +
ggcaaatataggttgcaaag

SEQ ID NO: 4439 - DNA, 20 bp, Artificial Sequence
  Synthetic oligonucleotide; TGG chr11 5186633 5186652 5186649 +
taggttgcaaaggagacatg

SEQ ID NO: 4440 - DNA, 20 bp, Artificial Sequence
  Synthetic oligonucleotide; GGG chr11 5186634 5186653 5186650 +
aggttgcaaaggagacatgt

SEQ ID NO: 4441 - DNA, 20 bp, Artificial Sequence
  Synthetic oligonucleotide; GAG chr11 5186636 5186655 5186652 +
gttgcaaaggagacatgtgg

SEQ ID NO: 4442 - DNA, 20 bp, Artificial Sequence
  Synthetic oligonucleotide; AAG chr11 5186639 5186658 5186655 +
gcaaaggagacatgtgggag

SEQ ID NO: 4443 - DNA, 20 bp, Artificial Sequence
  Synthetic oligonucleotide; AGG chr11 5186640 5186659 5186656 +
caaaggagacatgtgggaga

SEQ ID NO: 4444 - DNA, 20 bp, Artificial Sequence
  Synthetic oligonucleotide; TAG chr11 5186656 5186675 5186672 +
gagaaggactttacacatct

SEQ ID NO: 4445 - DNA, 20 bp, Artificial Sequence
  Synthetic oligonucleotide; TGG chr11 5186660 5186679 5186676 +
aggactttacacatcttaga

SEQ ID NO: 4446 - DNA, 20 bp, Artificial Sequence
  Synthetic oligonucleotide; AAG chr11 5186670 5186689 5186686 +
acatcttagatggcacctaa

SEQ ID NO: 4447 - DNA, 20 bp, Artificial Sequence
  Synthetic oligonucleotide; AAG chr11 5186706 5186725 5186722 +
tttatttccctttaattttt

SEQ ID NO: 4448 - DNA, 20 bp, Artificial Sequence
  Synthetic oligonucleotide; AGG chr11 5186707 5186726 5186723 +
ttatttccctttaattttta

SEQ ID NO: 4449 - DNA, 20 bp, Artificial Sequence
  Synthetic oligonucleotide; TGG chr11 5186735 5186754 5186751 +
ttgctttccctgctttttct

SEQ ID NO: 4450 - DNA, 20 bp, Artificial Sequence
  Synthetic oligonucleotide; TGG chr11 5186743 5186762 5186759 +
cctgctttttcttggtcaca

SEQ ID NO: 4451 - DNA, 20 bp, Artificial Sequence
  Synthetic oligonucleotide; TGG chr11 5186750 5186769 5186766 +
tttcttggtcacatggtaaa

SEQ ID NO: 4452 - DNA, 20 bp, Artificial Sequence
  Synthetic oligonucleotide; GGG chr11 5186751 5186770 5186767 +
ttcttggtcacatggtaaat

SEQ ID NO: 4453 - DNA, 20 bp, Artificial Sequence
  Synthetic oligonucleotide; CAG chr11 5186755 5186774 5186771 +
tggtcacatggtaaatgggt

SEQ ID NO: 4454 - DNA, 20 bp, Artificial Sequence
  Synthetic oligonucleotide; AAG chr11 5186764 5186783 5186780 +
ggtaaatgggtcagaatctg

SEQ ID NO: 4455 - DNA, 20 bp, Artificial Sequence
  Synthetic oligonucleotide; AGG chr11 5186765 5186784 5186781 +
gtaaatgggtcagaatctga

SEQ ID NO: 4456 - DNA, 20 bp, Artificial Sequence
  Synthetic oligonucleotide; GGG chr11 5186766 5186785 5186782 +
taaatgggtcagaatctgaa

SEQ ID NO: 4457 - DNA, 20 bp, Artificial Sequence
  Synthetic oligonucleotide; AAG chr11 5186771 5186790 5186787 +
gggtcagaatctgaagggcc

SEQ ID NO: 4458 - DNA, 20 bp, Artificial Sequence
  Synthetic oligonucleotide; TAG chr11 5186783 5186802 5186799 +
gaagggccaagaaattatat

SEQ ID NO: 4459 - DNA, 20 bp, Artificial Sequence
  Synthetic oligonucleotide; TAG chr11 5186792 5186811 5186808 +
agaaattatattagctactg

SEQ ID NO: 4460 - DNA, 20 bp, Artificial Sequence
  Synthetic oligonucleotide; AAG chr11 5186811 5186830 5186827 +
gtagatatcccattctcttg

SEQ ID NO: 4461 - DNA, 20 bp, Artificial Sequence
  Synthetic oligonucleotide; AGG chr11 5186812 5186831 5186828 +
tagatatcccattctcttga

SEQ ID NO: 4462 - DNA, 20 bp, Artificial Sequence
  Synthetic oligonucleotide; GAG chr11 5186825 5186844 5186841 +
ctcttgaaggatactttaat

SEQ ID NO: 4463 - DNA, 20 bp, Artificial Sequence
  Synthetic oligonucleotide; AGG chr11 5186826 5186845 5186842 +
tcttgaaggatactttaatg

SEQ ID NO: 4464 - DNA, 20 bp, Artificial Sequence
  Synthetic oligonucleotide; CAG chr11 5186833 5186852 5186849 +
ggatactttaatgaggaata

SEQ ID NO: 4465 - DNA, 20 bp, Artificial Sequence
  Synthetic oligonucleotide; AAG chr11 5186839 5186858 5186855 +
tttaatgaggaatacagatg

SEQ ID NO: 4466 - DNA, 20 bp, Artificial Sequence
  Synthetic oligonucleotide; AAG chr11 5186847 5186866 5186863 +
ggaatacagatgaagataaa

SEQ ID NO: 4467 - DNA, 20 bp, Artificial Sequence
  Synthetic oligonucleotide; TAG chr11 5186851 5186870 5186867 +
tacagatgaagataaaaaga

SEQ ID NO: 4468 - DNA, 20 bp, Artificial Sequence
  Synthetic oligonucleotide; TGG chr11 5186875 5186894 5186891 +
aacaaataccatgatattca

SEQ ID NO: 4469 - DNA, 20 bp, Artificial Sequence
  Synthetic oligonucleotide; TGG chr11 5186888 5186907 5186904 +
atattcatggaattaaaaac

SEQ ID NO: 4470 - DNA, 20 bp, Artificial Sequence
  Synthetic oligonucleotide; AAG chr11 5186903 5186922 5186919 +
aaaactggcttcacactgat

SEQ ID NO: 4471 - DNA, 20 bp, Artificial Sequence
  Synthetic oligonucleotide; CAG chr11 5186907 5186926 5186923 +
ctggcttcacactgataagc

SEQ ID NO: 4472 - DNA, 20 bp, Artificial Sequence
  Synthetic oligonucleotide; TGG chr11 5186915 5186934 5186931 +
acactgataagccagattta

SEQ ID NO: 4473 - DNA, 20 bp, Artificial Sequence
  Synthetic oligonucleotide; GAG chr11 5186917 5186936 5186933 +
actgataagccagatttatg

SEQ ID NO: 4474 - DNA, 20 bp, Artificial Sequence
  Synthetic oligonucleotide; GAG chr11 5186919 5186938 5186935 +
tgataagccagatttatgga

SEQ ID NO: 4475 - DNA, 20 bp, Artificial Sequence
  Synthetic oligonucleotide; GAG chr11 5186921 5186940 5186937 +
ataagccagatttatggaga

SEQ ID NO: 4476 - DNA, 20 bp, Artificial Sequence
  Synthetic oligonucleotide; AAG chr11 5186942 5186961 5186958 +
agatgtttccttattctctc

SEQ ID NO: 4477 - DNA, 20 bp, Artificial Sequence
  Synthetic oligonucleotide; TGG chr11 5186945 5186964 5186961 +
tgtttccttattctctcaag

SEQ ID NO: 4478 - DNA, 20 bp, Artificial Sequence
  Synthetic oligonucleotide; GAG chr11 5186947 5186966 5186963 +
tttccttattctctcaagtg

SEQ ID NO: 4479 - DNA, 20 bp, Artificial Sequence
  Synthetic oligonucleotide; AAG chr11 5186985 5187004 5187001 +
tgattttctgatatttttca

SEQ ID NO: 4480 - DNA, 20 bp, Artificial Sequence
  Synthetic oligonucleotide; TAG chr11 5186994 5187013 5187010 +
gatatttttcaaagaatccc

SEQ ID NO: 4481 - DNA, 20 bp, Artificial Sequence
  Synthetic oligonucleotide; AAG chr11 5186997 5187016 5187013 +
atttttcaaagaatccctag

SEQ ID NO: 4482 - DNA, 20 bp, Artificial Sequence
  Synthetic oligonucleotide; TAG chr11 5187013 5187032 5187029 +
ctagaagcttttttcaccta

SEQ ID NO: 4483 - DNA, 20 bp, Artificial Sequence
  Synthetic oligonucleotide; TAG chr11 5187016 5187035 5187032 +
gaagcttttttcacctatag

SEQ ID NO: 4484 - DNA, 20 bp, Artificial Sequence
  Synthetic oligonucleotide; TAG chr11 5187026 5187045 5187042 +
tcacctatagtagtaaaact

SEQ ID NO: 4485 - DNA, 20 bp, Artificial Sequence
  Synthetic oligonucleotide; TAG chr11 5187039 5187058 5187055 +
taaaacttagtaaaaaaaaa

SEQ ID NO: 4486 - DNA, 20 bp, Artificial Sequence
  Synthetic oligonucleotide; CAG chr11 5187074 5187093 5187090 +
ataaatatgatgtttgacat

SEQ ID NO: 4487 - DNA, 20 bp, Artificial Sequence
  Synthetic oligonucleotide; TGG chr11 5187088 5187107 5187104 +
tgacatcagctgaccctgac

SEQ ID NO: 4488 - DNA, 20 bp, Artificial Sequence
  Synthetic oligonucleotide; TGG chr11 5187102 5187121 5187118 +
cctgactggatgatcttgat

SEQ ID NO: 4489 - DNA, 20 bp, Artificial Sequence
  Synthetic oligonucleotide; TAG chr11 5187109 5187128 5187125 +
ggatgatcttgattggatgc

SEQ ID NO: 4490 - DNA, 20 bp, Artificial Sequence
  Synthetic oligonucleotide; AGG chr11 5187110 5187129 5187126 +
gatgatcttgattggatgct

SEQ ID NO: 4491 - DNA, 20 bp, Artificial Sequence
  Synthetic oligonucleotide; AAG chr11 5187114 5187133 5187130 +
atcttgattggatgctaggc

SEQ ID NO: 4492 - DNA, 20 bp, Artificial Sequence
  Synthetic oligonucleotide; CAG chr11 5187121 5187140 5187137 +
ttggatgctaggcaagtgcc

SEQ ID NO: 4493 - DNA, 20 bp, Artificial Sequence
  Synthetic oligonucleotide; AGG chr11 5187122 5187141 5187138 +
tggatgctaggcaagtgccc

SEQ ID NO: 4494 - DNA, 20 bp, Artificial Sequence
  Synthetic oligonucleotide; CAG chr11 5187134 5187153 5187150 +
aagtgcccaggtcctccaat

SEQ ID NO: 4495 - DNA, 20 bp, Artificial Sequence
  Synthetic oligonucleotide; TAG chr11 5187142 5187161 5187158 +
aggtcctccaatcagtcatc

SEQ ID NO: 4496 - DNA, 20 bp, Artificial Sequence
  Synthetic oligonucleotide; AGG chr11 5187143 5187162 5187159 +
ggtcctccaatcagtcatct

SEQ ID NO: 4497 - DNA, 20 bp, Artificial Sequence
  Synthetic oligonucleotide; TAG chr11 5187151 5187170 5187167 +
aatcagtcatctaggcatct

SEQ ID NO: 4498 - DNA, 20 bp, Artificial Sequence
  Synthetic oligonucleotide; TGG chr11 5187161 5187180 5187177 +
ctaggcatcttagttctcac

SEQ ID NO: 4499 - DNA, 20 bp, Artificial Sequence
  Synthetic oligonucleotide; AAG chr11 5187166 5187185 5187182 +
catcttagttctcactggct

SEQ ID NO: 4500 - DNA, 20 bp, Artificial Sequence
  Synthetic oligonucleotide; GAG chr11 5187168 5187187 5187184 +
tcttagttctcactggctaa

SEQ ID NO: 4501 - DNA, 20 bp, Artificial Sequence
  Synthetic oligonucleotide; GAG chr11 5187170 5187189 5187186 +
ttagttctcactggctaaga

SEQ ID NO: 4502 - DNA, 20 bp, Artificial Sequence
  Synthetic oligonucleotide; AGG chr11 5187171 5187190 5187187 +
tagttctcactggctaagag

SEQ ID NO: 4503 - DNA, 20 bp, Artificial Sequence
  Synthetic oligonucleotide; AAG chr11 5187190 5187209 5187206 +
gaggtcatattttattacgt

SEQ ID NO: 4504 - DNA, 20 bp, Artificial Sequence
  Synthetic oligonucleotide; GAG chr11 5187196 5187215 5187212 +
atattttattacgtaagtgt

SEQ ID NO: 4505 - DNA, 20 bp, Artificial Sequence
  Synthetic oligonucleotide; TGG chr11 5187206 5187225 5187222 +
acgtaagtgtgagtgctata

SEQ ID NO: 4506 - DNA, 20 bp, Artificial Sequence
  Synthetic oligonucleotide; TGG chr11 5187209 5187228 5187225 +
taagtgtgagtgctatatgg

SEQ ID NO: 4507 - DNA, 20 bp, Artificial Sequence
  Synthetic oligonucleotide; GGG chr11 5187210 5187229 5187226 +
aagtgtgagtgctatatggt

SEQ ID NO: 4508 - DNA, 20 bp, Artificial Sequence
  Synthetic oligonucleotide; GAG chr11 5187212 5187231 5187228 +
gtgtgagtgctatatggtgg

SEQ ID NO: 4509 - DNA, 20 bp, Artificial Sequence
  Synthetic oligonucleotide; AAG chr11 5187219 5187238 5187235 +
tgctatatggtgggagatat

SEQ ID NO: 4510 - DNA, 20 bp, Artificial Sequence
  Synthetic oligonucleotide; AAG chr11 5187240 5187259 5187256 +
agaattatcacatgcatttc

SEQ ID NO: 4511 - DNA, 20 bp, Artificial Sequence
  Synthetic oligonucleotide; AAG chr11 5187256 5187275 5187272 +
tttcaagtgctttccattca

SEQ ID NO: 4512 - DNA, 20 bp, Artificial Sequence
  Synthetic oligonucleotide; AGG chr11 5187257 5187276 5187273 +
ttcaagtgctttccattcaa

SEQ ID NO: 4513 - DNA, 20 bp, Artificial Sequence
  Synthetic oligonucleotide; TAG chr11 5187271 5187290 5187287 +
attcaaaggtcttgaaacca

SEQ ID NO: 4514 - DNA, 20 bp, Artificial Sequence
  Synthetic oligonucleotide; GAG chr11 5187275 5187294 5187291 +
aaaggtcttgaaaccatagt

SEQ ID NO: 4515 - DNA, 20 bp, Artificial Sequence
  Synthetic oligonucleotide; AGG chr11 5187276 5187295 5187292 +
aaggtcttgaaaccatagtg

SEQ ID NO: 4516 - DNA, 20 bp, Artificial Sequence
  Synthetic oligonucleotide; GGG chr11 5187277 5187296 5187293 +
aggtcttgaaaccatagtga

SEQ ID NO: 4517 - DNA, 20 bp, Artificial Sequence
  Synthetic oligonucleotide; TGG chr11 5187285 5187304 5187301 +
aaaccatagtgagggtaaat

SEQ ID NO: 4518 - DNA, 20 bp, Artificial Sequence
  Synthetic oligonucleotide; TGG chr11 5187289 5187308 5187305 +
catagtgagggtaaattgga

SEQ ID NO: 4519 - DNA, 20 bp, Artificial Sequence
  Synthetic oligonucleotide; TAG chr11 5187308 5187327 5187324 +
atggcttcaccttgcttttt

SEQ ID NO: 4520 - DNA, 20 bp, Artificial Sequence
  Synthetic oligonucleotide; AAG chr11 5187317 5187336 5187333 +
ccttgcttttttagacatta

SEQ ID NO: 4521 - DNA, 20 bp, Artificial Sequence
  Synthetic oligonucleotide; AAG chr11 5187321 5187340 5187337 +
gcttttttagacattaaaga

SEQ ID NO: 4522 - DNA, 20 bp, Artificial Sequence
  Synthetic oligonucleotide; AGG chr11 5187322 5187341 5187338 +
cttttttagacattaaagaa

SEQ ID NO: 4523 - DNA, 20 bp, Artificial Sequence
  Synthetic oligonucleotide; CAG chr11 5187326 5187345 5187342 +
tttagacattaaagaaagga

SEQ ID NO: 4524 - DNA, 20 bp, Artificial Sequence
  Synthetic oligonucleotide; TGG chr11 5187351 5187370 5187367 +
cttatcttcccacctatcct

SEQ ID NO: 4525 - DNA, 20 bp, Artificial Sequence
  Synthetic oligonucleotide; AAG chr11 5187356 5187375 5187372 +
cttcccacctatccttggaa

SEQ ID NO: 4526 - DNA, 20 bp, Artificial Sequence
  Synthetic oligonucleotide; AAG chr11 5187365 5187384 5187381 +
tatccttggaaaagaaatta

SEQ ID NO: 4527 - DNA, 20 bp, Artificial Sequence
  Synthetic oligonucleotide; AGG chr11 5187366 5187385 5187382 +
atccttggaaaagaaattaa

SEQ ID NO: 4528 - DNA, 20 bp, Artificial Sequence
  Synthetic oligonucleotide; AAG chr11 5187374 5187393 5187390 +
aaaagaaattaaaggaatca

SEQ ID NO: 4529 - DNA, 20 bp, Artificial Sequence
  Synthetic oligonucleotide; AGG chr11 5187375 5187394 5187391 +
aaagaaattaaaggaatcaa

SEQ ID NO: 4530 - DNA, 20 bp, Artificial Sequence
  Synthetic oligonucleotide; TAG chr11 5187384 5187403 5187400 +
aaaggaatcaaaggatatta

SEQ ID NO: 4531 - DNA, 20 bp, Artificial Sequence
  Synthetic oligonucleotide; AAG chr11 5187390 5187409 5187406 +
atcaaaggatattatagaaa

SEQ ID NO: 4532 - DNA, 20 bp, Artificial Sequence
  Synthetic oligonucleotide; GAG chr11 5187392 5187411 5187408 +
caaaggatattatagaaaaa

SEQ ID NO: 4533 - DNA, 20 bp, Artificial Sequence
  Synthetic oligonucleotide; TGG chr11 5187396 5187415 5187412 +
ggatattatagaaaaagaga

SEQ ID NO: 4534 - DNA, 20 bp, Artificial Sequence
  Synthetic oligonucleotide; GAG chr11 5187398 5187417 5187414 +
atattatagaaaaagagatg

SEQ ID NO: 4535 - DNA, 20 bp, Artificial Sequence
  Synthetic oligonucleotide; AAG chr11 5187402 5187421 5187418 +
tatagaaaaagagatggaga

SEQ ID NO: 4536 - DNA, 20 bp, Artificial Sequence
  Synthetic oligonucleotide; AGG chr11 5187403 5187422 5187419 +
atagaaaaagagatggagaa

SEQ ID NO: 4537 - DNA, 20 bp, Artificial Sequence
  Synthetic oligonucleotide; AAG chr11 5187408 5187427 5187424 +
aaaagagatggagaaaggac

SEQ ID NO: 4538 - DNA, 20 bp, Artificial Sequence
  Synthetic oligonucleotide; AGG chr11 5187409 5187428 5187425 +
aaagagatggagaaaggaca

SEQ ID NO: 4539 - DNA, 20 bp, Artificial Sequence
  Synthetic oligonucleotide; GAG chr11 5187411 5187430 5187427 +
agagatggagaaaggacaag

SEQ ID NO: 4540 - DNA, 20 bp, Artificial Sequence
  Synthetic oligonucleotide; TAG chr11 5187418 5187437 5187434 +
gagaaaggacaaggagaatt

SEQ ID NO: 4541 - DNA, 20 bp, Artificial Sequence
  Synthetic oligonucleotide; AGG chr11 5187419 5187438 5187435 +
agaaaggacaaggagaattt

SEQ ID NO: 4542 - DNA, 20 bp, Artificial Sequence
  Synthetic oligonucleotide; GGG chr11 5187420 5187439 5187436 +
gaaaggacaaggagaattta

SEQ ID NO: 4543 - DNA, 20 bp, Artificial Sequence
  Synthetic oligonucleotide; GGG chr11 5187421 5187440 5187437 +
aaaggacaaggagaatttag

SEQ ID NO: 4544 - DNA, 20 bp, Artificial Sequence
  Synthetic oligonucleotide; CAG chr11 5187428 5187447 5187444 +
aaggagaatttaggggacaa

SEQ ID NO: 4545 - DNA, 20 bp, Artificial Sequence
  Synthetic oligonucleotide; TAG chr11 5187459 5187478 5187475 +
gtctgcatctgactacctga

SEQ ID NO: 4546 - DNA, 20 bp, Artificial Sequence
  Synthetic oligonucleotide; CAG chr11 5187465 5187484 5187481 +
atctgactacctgatagtga

SEQ ID NO: 4547 - DNA, 20 bp, Artificial Sequence
  Synthetic oligonucleotide; AGG chr11 5187466 5187485 5187482 +
tctgactacctgatagtgac

SEQ ID NO: 4548 - DNA, 20 bp, Artificial Sequence
  Synthetic oligonucleotide; AAG chr11 5187469 5187488 5187485 +
gactacctgatagtgacagg

SEQ ID NO: 4549 - DNA, 20 bp, Artificial Sequence
  Synthetic oligonucleotide; AAG chr11 5187476 5187495 5187492 +
tgatagtgacaggaagaaca

SEQ ID NO: 4550 - DNA, 20 bp, Artificial Sequence
  Synthetic oligonucleotide; TAG chr11 5187481 5187500 5187497 +
gtgacaggaagaacaaagaa

SEQ ID NO: 4551 - DNA, 20 bp, Artificial Sequence
  Synthetic oligonucleotide; AAG chr11 5187489 5187508 5187505 +
aagaacaaagaatagaatcc

SEQ ID NO: 4552 - DNA, 20 bp, Artificial Sequence
  Synthetic oligonucleotide; GAG chr11 5187491 5187510 5187507 +
gaacaaagaatagaatccaa

SEQ ID NO: 4553 - DNA, 20 bp, Artificial Sequence
  Synthetic oligonucleotide; AGG chr11 5187492 5187511 5187508 +
aacaaagaatagaatccaag

SEQ ID NO: 4554 - DNA, 20 bp, Artificial Sequence
  Synthetic oligonucleotide; TGG chr11 5187533 5187552 5187549 +
tattataatgtttttaaatc

SEQ ID NO: 4555 - DNA, 20 bp, Artificial Sequence
  Synthetic oligonucleotide; GGG chr11 5187534 5187553 5187550 +
attataatgtttttaaatct

SEQ ID NO: 4556 - DNA, 20 bp, Artificial Sequence
  Synthetic oligonucleotide; GGG chr11 5187535 5187554 5187551 +
ttataatgtttttaaatctg

SEQ ID NO: 4557 - DNA, 20 bp, Artificial Sequence
  Synthetic oligonucleotide; AAG chr11 5187551 5187570 5187567 +
tctggggactctaaaacttg

SEQ ID NO: 4558 - DNA, 20 bp, Artificial Sequence
  Synthetic oligonucleotide; GAG chr11 5187565 5187584 5187581 +
aacttgaagaattttttttt

SEQ ID NO: 4559 - DNA, 20 bp, Artificial Sequence
  Synthetic oligonucleotide; CAG chr11 5187578 5187597 5187594 +
tttttttgagcaaatgtttt

SEQ ID NO: 4560 - DNA, 20 bp, Artificial Sequence
  Synthetic oligonucleotide; AAG chr11 5187612 5187631 5187628 +
ttctgataaatataatatgc

SEQ ID NO: 4561 - DNA, 20 bp, Artificial Sequence
  Synthetic oligonucleotide; GAG chr11 5187614 5187633 5187630 +
ctgataaatataatatgcaa

SEQ ID NO: 4562 - DNA, 20 bp, Artificial Sequence
  Synthetic oligonucleotide; AGG chr11 5187615 5187634 5187631 +
tgataaatataatatgcaag

SEQ ID NO: 4563 - DNA, 20 bp, Artificial Sequence
  Synthetic oligonucleotide; GGG chr11 5187616 5187635 5187632 +
gataaatataatatgcaaga

SEQ ID NO: 4564 - DNA, 20 bp, Artificial Sequence
  Synthetic oligonucleotide; CAG chr11 5187619 5187638 5187635 +
aaatataatatgcaagaggg

SEQ ID NO: 4565 - DNA, 20 bp, Artificial Sequence
  Synthetic oligonucleotide; CGG chr11 5187634 5187653 5187650 +
gagggcagtgatccaaacta

SEQ ID NO: 4566 - DNA, 20 bp, Artificial Sequence
  Synthetic oligonucleotide; AAG chr11 5187649 5187668 5187665 +
aactacggctgctgtgatac

SEQ ID NO: 4567 - DNA, 20 bp, Artificial Sequence
  Synthetic oligonucleotide; CAG chr11 5187681 5187700 5187697 +
actactttaaaacacacctt

SEQ ID NO: 4568 - DNA, 20 bp, Artificial Sequence
  Synthetic oligonucleotide; CAG chr11 5187696 5187715 5187712 +
accttcagcaatattctatg

SEQ ID NO: 4569 - DNA, 20 bp, Artificial Sequence
  Synthetic oligonucleotide; TAG chr11 5187708 5187727 5187724 +
attctatgcagatgaaataa

SEQ ID NO: 4570 - DNA, 20 bp, Artificial Sequence
  Synthetic oligonucleotide; TAG chr11 5187738 5187757 5187754 +
tatgtttaatttaatatgtt

SEQ ID NO: 4571 - DNA, 20 bp, Artificial Sequence
  Synthetic oligonucleotide; TAG chr11 5187749 5187768 5187765 +
taatatgtttagttttctta

SEQ ID NO: 4572 - DNA, 20 bp, Artificial Sequence
  Synthetic oligonucleotide; AAG chr11 5187752 5187771 5187768 +
tatgtttagttttcttatag

SEQ ID NO: 4573 - DNA, 20 bp, Artificial Sequence
  Synthetic oligonucleotide; CAG chr11 5187759 5187778 5187775 +
agttttcttatagaagtcta

SEQ ID NO: 4574 - DNA, 20 bp, Artificial Sequence
  Synthetic oligonucleotide; GAG chr11 5187767 5187786 5187783 +
tatagaagtctacagtcttt

SEQ ID NO: 4575 - DNA, 20 bp, Artificial Sequence
  Synthetic oligonucleotide; TAG chr11 5187780 5187799 5187796 +
agtctttgagccacatgctt

SEQ ID NO: 4576 - DNA, 20 bp, Artificial Sequence
  Synthetic oligonucleotide; AAG chr11 5187832 5187851 5187848 +
tatataatattattgacatc

SEQ ID NO: 4577 - DNA, 20 bp, Artificial Sequence
  Synthetic oligonucleotide; TGG chr11 5187847 5187866 5187863 +
acatcaagtaacaatatcat

SEQ ID NO: 4578 - DNA, 20 bp, Artificial Sequence
  Synthetic oligonucleotide; CGG chr11 5187855 5187874 5187871 +
taacaatatcattggaatct

SEQ ID NO: 4579 - DNA, 20 bp, Artificial Sequence
  Synthetic oligonucleotide; TAG chr11 5187902 5187921 5187918 +
atatgattatctaatatacc

SEQ ID NO: 4580 - DNA, 20 bp, Artificial Sequence
  Synthetic oligonucleotide; CAG chr11 5187914 5187933 5187930 +
aatatacctagatatttttg

SEQ ID NO: 4581 - DNA, 20 bp, Artificial Sequence
  Synthetic oligonucleotide; AGG chr11 5187915 5187934 5187931 +
atatacctagatatttttgc

SEQ ID NO: 4582 - DNA, 20 bp, Artificial Sequence
  Synthetic oligonucleotide; GGG chr11 5187916 5187935 5187932 +
tatacctagatatttttgca

SEQ ID NO: 4583 - DNA, 20 bp, Artificial Sequence
  Synthetic oligonucleotide; AAG chr11 5187926 5187945 5187942 +
tatttttgcagggaacatgt

SEQ ID NO: 4584 - DNA, 20 bp, Artificial Sequence
  Synthetic oligonucleotide; TAG chr11 5187936 5187955 5187952 +
gggaacatgtaagtattatg

SEQ ID NO: 4585 - DNA, 20 bp, Artificial Sequence
  Synthetic oligonucleotide; AAG chr11 5187947 5187966 5187963 +
agtattatgtagaataaata

SEQ ID NO: 4586 - DNA, 20 bp, Artificial Sequence
  Synthetic oligonucleotide; AAG chr11 5187969 5187988 5187985 +
gattataaaaattctcacat

SEQ ID NO: 4587 - DNA, 20 bp, Artificial Sequence
  Synthetic oligonucleotide; CAG chr11 5187979 5187998 5187995 +
attctcacataagttcatgt

SEQ ID NO: 4588 - DNA, 20 bp, Artificial Sequence
  Synthetic oligonucleotide; TAG chr11 5187997 5188016 5188013 +
gtcagaaattgccatcactt

SEQ ID NO: 4589 - DNA, 20 bp, Artificial Sequence
  Synthetic oligonucleotide; GAG chr11 5187999 5188018 5188015 +
cagaaattgccatcacttta

SEQ ID NO: 4590 - DNA, 20 bp, Artificial Sequence
  Synthetic oligonucleotide; CAG chr11 5188002 5188021 5188018 +
aaattgccatcactttagag

SEQ ID NO: 4591 - DNA, 20 bp, Artificial Sequence
  Synthetic oligonucleotide; AAG chr11 5188018 5188037 5188034 +
agagcagattgtgctgttaa

SEQ ID NO: 4592 - DNA, 20 bp, Artificial Sequence
  Synthetic oligonucleotide; CAG chr11 5188024 5188043 5188040 +
gattgtgctgttaaaagact

SEQ ID NO: 4593 - DNA, 20 bp, Artificial Sequence
  Synthetic oligonucleotide; TGG chr11 5188041 5188060 5188057 +
actcagtttttaaatttcta

SEQ ID NO: 4594 - DNA, 20 bp, Artificial Sequence
  Synthetic oligonucleotide; AAG chr11 5188049 5188068 5188065 +
tttaaatttctatggatttc

SEQ ID NO: 4595 - DNA, 20 bp, Artificial Sequence
  Synthetic oligonucleotide; AGG chr11 5188050 5188069 5188066 +
ttaaatttctatggatttca

SEQ ID NO: 4596 - DNA, 20 bp, Artificial Sequence
  Synthetic oligonucleotide; TGG chr11 5188056 5188075 5188072 +
ttctatggatttcaaggaaa

SEQ ID NO: 4597 - DNA, 20 bp, Artificial Sequence
  Synthetic oligonucleotide; TGG chr11 5188070 5188089 5188086 +
aggaaatggataaatgattg

SEQ ID NO: 4598 - DNA, 20 bp, Artificial Sequence
  Synthetic oligonucleotide; TAG chr11 5188088 5188107 5188104 +
tgtggccctgttaaccaaaa

SEQ ID NO: 4599 - DNA, 20 bp, Artificial Sequence
  Synthetic oligonucleotide; CAG chr11 5188091 5188110 5188107 +
ggccctgttaaccaaaatag

SEQ ID NO: 4600 - DNA, 20 bp, Artificial Sequence
  Synthetic oligonucleotide; TGG chr11 5188100 5188119 5188116 +
aaccaaaatagcagtaaaaa

SEQ ID NO: 4601 - DNA, 20 bp, Artificial Sequence
  Synthetic oligonucleotide; TGG chr11 5188106 5188125 5188122 +
aatagcagtaaaaatggctt

SEQ ID NO: 4602 - DNA, 20 bp, Artificial Sequence
  Synthetic oligonucleotide; TAG chr11 5188118 5188137 5188134 +
aatggctttggctactgatt

SEQ ID NO: 4603 - DNA, 20 bp, Artificial Sequence
  Synthetic oligonucleotide; AAG chr11 5188133 5188152 5188149 +
tgatttagtatctgtaaatt

SEQ ID NO: 4604 - DNA, 20 bp, Artificial Sequence
  Synthetic oligonucleotide; AGG chr11 5188134 5188153 5188150 +
gatttagtatctgtaaatta

SEQ ID NO: 4605 - DNA, 20 bp, Artificial Sequence
  Synthetic oligonucleotide; TGG chr11 5188141 5188160 5188157 +
tatctgtaaattaaggatgt

SEQ ID NO: 4606 - DNA, 20 bp, Artificial Sequence
  Synthetic oligonucleotide; GAG chr11 5188151 5188170 5188167 +
ttaaggatgttggattgctt

SEQ ID NO: 4607 - DNA, 20 bp, Artificial Sequence
  Synthetic oligonucleotide; TAG chr11 5188158 5188177 5188174 +
tgttggattgcttgagattt

SEQ ID NO: 4608 - DNA, 20 bp, Artificial Sequence
  Synthetic oligonucleotide; AAG chr11 5188183 5188202 5188199 +
ctaactctgcttcaatatgt

SEQ ID NO: 4609 - DNA, 20 bp, Artificial Sequence
  Synthetic oligonucleotide; GAG chr11 5188198 5188217 5188214 +
tatgtaagatacttctaatt

SEQ ID NO: 4610 - DNA, 20 bp, Artificial Sequence
  Synthetic oligonucleotide; TAG chr11 5188203 5188222 5188219 +
aagatacttctaattgagtc

SEQ ID NO: 4611 - DNA, 20 bp, Artificial Sequence
  Synthetic oligonucleotide; TAG chr11 5188218 5188237 5188234 +
gagtctagataattgttcta

SEQ ID NO: 4612 - DNA, 20 bp, Artificial Sequence
  Synthetic oligonucleotide; AGG chr11 5188219 5188238 5188235 +
agtctagataattgttctat

SEQ ID NO: 4613 - DNA, 20 bp, Artificial Sequence
  Synthetic oligonucleotide; TAG chr11 5188227 5188246 5188243 +
taattgttctataggtaaat

SEQ ID NO: 4614 - DNA, 20 bp, Artificial Sequence
  Synthetic oligonucleotide; TGG chr11 5188235 5188254 5188251 +
ctataggtaaattagtgtcc

SEQ ID NO: 4615 - DNA, 20 bp, Artificial Sequence
  Synthetic oligonucleotide; TAG chr11 5188242 5188261 5188258 +
taaattagtgtcctggatgc

SEQ ID NO: 4616 - DNA, 20 bp, Artificial Sequence
  Synthetic oligonucleotide; CAG chr11 5188250 5188269 5188266 +
tgtcctggatgctagtgctt

SEQ ID NO: 4617 - DNA, 20 bp, Artificial Sequence
  Synthetic oligonucleotide; AAG chr11 5188266 5188285 5188282 +
gcttcagccaaaaaatgaaa

SEQ ID NO: 4618 - DNA, 20 bp, Artificial Sequence
  Synthetic oligonucleotide; AAG chr11 5188283 5188302 5188299 +
aaaaagatacaattaaatga

SEQ ID NO: 4619 - DNA, 20 bp, Artificial Sequence
  Synthetic oligonucleotide; TGG chr11 5188300 5188319 5188316 +
tgaaagcctttatcttacta

SEQ ID NO: 4620 - DNA, 20 bp, Artificial Sequence
  Synthetic oligonucleotide; GGG chr11 5188301 5188320 5188317 +
gaaagcctttatcttactat

SEQ ID NO: 4621 - DNA, 20 bp, Artificial Sequence
  Synthetic oligonucleotide; GAG chr11 5188308 5188327 5188324 +
tttatcttactatgggactt

SEQ ID NO: 4622 - DNA, 20 bp, Artificial Sequence
  Synthetic oligonucleotide; TGG chr11 5188311 5188330 5188327 +
atcttactatgggacttgag

SEQ ID NO: 4623 - DNA, 20 bp, Artificial Sequence
  Synthetic oligonucleotide; GAG chr11 5188313 5188332 5188329 +
cttactatgggacttgagtg

SEQ ID NO: 4624 - DNA, 20 bp, Artificial Sequence
  Synthetic oligonucleotide; AGG chr11 5188314 5188333 5188330 +
ttactatgggacttgagtgg

SEQ ID NO: 4625 - DNA, 20 bp, Artificial Sequence
  Synthetic oligonucleotide; AAG chr11 5188323 5188342 5188339 +
gacttgagtggaggaaatcc

SEQ ID NO: 4626 - DNA, 20 bp, Artificial Sequence
  Synthetic oligonucleotide; AAG chr11 5188328 5188347 5188344 +
gagtggaggaaatccaagaa

SEQ ID NO: 4627 - DNA, 20 bp, Artificial Sequence
  Synthetic oligonucleotide; CAG chr11 5188336 5188355 5188352 +
gaaatccaagaaaagaattc

SEQ ID NO: 4628 - DNA, 20 bp, Artificial Sequence
  Synthetic oligonucleotide; AAG chr11 5188357 5188376 5188373 +
agatgatcctttcttcgaac

SEQ ID NO: 4629 - DNA, 20 bp, Artificial Sequence
  Synthetic oligonucleotide; TGG chr11 5188365 5188384 5188381 +
ctttcttcgaacaagtaatt

SEQ ID NO: 4630 - DNA, 20 bp, Artificial Sequence
  Synthetic oligonucleotide; TGG chr11 5188374 5188393 5188390 +
aacaagtaatttggcataat

SEQ ID NO: 4631 - DNA, 20 bp, Artificial Sequence
  Synthetic oligonucleotide; TGG chr11 5188382 5188401 5188398 +
atttggcataattggacacc

SEQ ID NO: 4632 - DNA, 20 bp, Artificial Sequence
  Synthetic oligonucleotide; AAG chr11 5188400 5188419 5188416 +
cctggtttcttctcatttgt

SEQ ID NO: 4633 - DNA, 20 bp, Artificial Sequence
  Synthetic oligonucleotide; TAG chr11 5188404 5188423 5188420 +
gtttcttctcatttgtaagt

SEQ ID NO: 4634 - DNA, 20 bp, Artificial Sequence
  Synthetic oligonucleotide; AAG chr11 5188409 5188428 5188425 +
ttctcatttgtaagttagta

SEQ ID NO: 4635 - DNA, 20 bp, Artificial Sequence
  Synthetic oligonucleotide; TGG chr11 5188413 5188432 5188429 +
catttgtaagttagtaaagc

SEQ ID NO: 4636 - DNA, 20 bp, Artificial Sequence
  Synthetic oligonucleotide; GGG chr11 5188414 5188433 5188430 +
atttgtaagttagtaaagct

SEQ ID NO: 4637 - DNA, 20 bp, Artificial Sequence
  Synthetic oligonucleotide; GAG chr11 5188416 5188435 5188432 +
ttgtaagttagtaaagctgg

SEQ ID NO: 4638 - DNA, 20 bp, Artificial Sequence
  Synthetic oligonucleotide; TGG chr11 5188420 5188439 5188436 +
aagttagtaaagctgggagt

SEQ ID NO: 4639 - DNA, 20 bp, Artificial Sequence
  Synthetic oligonucleotide; TAG chr11 5188426 5188445 5188442 +
gtaaagctgggagttggtgc

SEQ ID NO: 4640 - DNA, 20 bp, Artificial Sequence
  Synthetic oligonucleotide; AAG chr11 5188431 5188450 5188447 +
gctgggagttggtgctagta

SEQ ID NO: 4641 - DNA, 20 bp, Artificial Sequence
  Synthetic oligonucleotide; TGG chr11 5188435 5188454 5188451 +
ggagttggtgctagtaaagc

SEQ ID NO: 4642 - DNA, 20 bp, Artificial Sequence
  Synthetic oligonucleotide; GGG chr11 5188436 5188455 5188452 +
gagttggtgctagtaaagct

SEQ ID NO: 4643 - DNA, 20 bp, Artificial Sequence
  Synthetic oligonucleotide; GAG chr11 5188438 5188457 5188454 +
gttggtgctagtaaagctgg

SEQ ID NO: 4644 - DNA, 20 bp, Artificial Sequence
  Synthetic oligonucleotide; TGG chr11 5188442 5188461 5188458 +
gtgctagtaaagctgggagt

SEQ ID NO: 4645 - DNA, 20 bp, Artificial Sequence
  Synthetic oligonucleotide; CAG chr11 5188448 5188467 5188464 +
gtaaagctgggagttggtgc

SEQ ID NO: 4646 - DNA, 20 bp, Artificial Sequence
  Synthetic oligonucleotide; AAG chr11 5188453 5188472 5188469 +
gctgggagttggtgccagaa

SEQ ID NO: 4647 - DNA, 20 bp, Artificial Sequence
  Synthetic oligonucleotide; GAG chr11 5188455 5188474 5188471 +
tgggagttggtgccagaaaa

SEQ ID NO: 4648 - DNA, 20 bp, Artificial Sequence
  Synthetic oligonucleotide; CAG chr11 5188460 5188479 5188476 +
gttggtgccagaaaagagaa

SEQ ID NO: 4649 - DNA, 20 bp, Artificial Sequence
  Synthetic oligonucleotide; TAG chr11 5188491 5188510 5188507 +
atttatttcttccttgtttg

SEQ ID NO: 4650 - DNA, 20 bp, Artificial Sequence
  Synthetic oligonucleotide; AGG chr11 5188492 5188511 5188508 +
tttatttcttccttgtttgt

SEQ ID NO: 4651 - DNA, 20 bp, Artificial Sequence
  Synthetic oligonucleotide; TAG chr11 5188498 5188517 5188514 +
tcttccttgtttgtaggctg

SEQ ID NO: 4652 - DNA, 20 bp, Artificial Sequence
  Synthetic oligonucleotide; GAG chr11 5188500 5188519 5188516 +
ttccttgtttgtaggctgta

SEQ ID NO: 4653 - DNA, 20 bp, Artificial Sequence
  Synthetic oligonucleotide; AAG chr11 5188504 5188523 5188520 +
ttgtttgtaggctgtagagc

SEQ ID NO: 4654 - DNA, 20 bp, Artificial Sequence
  Synthetic oligonucleotide; TGG chr11 5188520 5188539 5188536 +
gagcaagcttgtccaacctg

SEQ ID NO: 4655 - DNA, 20 bp, Artificial Sequence
  Synthetic oligonucleotide; TGG chr11 5188527 5188546 5188543 +
cttgtccaacctgtggcccg

SEQ ID NO: 4656 - DNA, 20 bp, Artificial Sequence
  Synthetic oligonucleotide; GGG chr11 5188528 5188547 5188544 +
ttgtccaacctgtggcccgt

SEQ ID NO: 4657 - DNA, 20 bp, Artificial Sequence
  Synthetic oligonucleotide; AAG chr11 5188544 5188563 5188560 +
ccgtgggctgcatgcatccc

SEQ ID NO: 4658 - DNA, 20 bp, Artificial Sequence
  Synthetic oligonucleotide; TGG chr11 5188548 5188567 5188564 +
gggctgcatgcatcccaaga

SEQ ID NO: 4659 - DNA, 20 bp, Artificial Sequence
  Synthetic oligonucleotide; GAG chr11 5188590 5188609 5188606 +
caactttcttaaaacattat

SEQ ID NO: 4660 - DNA, 20 bp, Artificial Sequence
  Synthetic oligonucleotide; TGG chr11 5188599 5188618 5188615 +
taaaacattatgagatttta

SEQ ID NO: 4661 - DNA, 20 bp, Artificial Sequence
  Synthetic oligonucleotide; GGG chr11 5188600 5188619 5188616 +
aaaacattatgagattttat

SEQ ID NO: 4662 - DNA, 20 bp, Artificial Sequence
  Synthetic oligonucleotide; TGG chr11 5188628 5188647 5188644 +
ttgtgatttttttttttttt

SEQ ID NO: 4663 - DNA, 20 bp, Artificial Sequence
  Synthetic oligonucleotide; GAG chr11 5188636 5188655 5188652 +
tttttttttttttggctcat

SEQ ID NO: 4664 - DNA, 20 bp, Artificial Sequence
  Synthetic oligonucleotide; TAG chr11 5188646 5188665 5188662 +
tttggctcatgagctgtcat

SEQ ID NO: 4665 - DNA, 20 bp, Artificial Sequence
  Synthetic oligonucleotide; TAG chr11 5188652 5188671 5188668 +
tcatgagctgtcattagtgt

SEQ ID NO: 4666 - DNA, 20 bp, Artificial Sequence
  Synthetic oligonucleotide; TGG chr11 5188668 5188687 5188684 +
gtgttagtatattttatgtg

SEQ ID NO: 4667 - DNA, 20 bp, Artificial Sequence
  Synthetic oligonucleotide; CAG chr11 5188673 5188692 5188689 +
agtatattttatgtgtggcc

SEQ ID NO: 4668 - DNA, 20 bp, Artificial Sequence
  Synthetic oligonucleotide; AGG chr11 5188674 5188693 5188690 +
gtatattttatgtgtggccc

SEQ ID NO: 4669 - DNA, 20 bp, Artificial Sequence
  Synthetic oligonucleotide; GGG chr11 5188675 5188694 5188691 +
tatattttatgtgtggccca

SEQ ID NO: 4670 - DNA, 20 bp, Artificial Sequence
  Synthetic oligonucleotide; AAG chr11 5188678 5188697 5188694 +
attttatgtgtggcccaggg

SEQ ID NO: 4671 - DNA, 20 bp, Artificial Sequence
  Synthetic oligonucleotide; AAG chr11 5188685 5188704 5188701 +
gtgtggcccagggaagccaa

SEQ ID NO: 4672 - DNA, 20 bp, Artificial Sequence
  Synthetic oligonucleotide; TGG chr11 5188690 5188709 5188706 +
gcccagggaagccaaaagat

SEQ ID NO: 4673 - DNA, 20 bp, Artificial Sequence
  Synthetic oligonucleotide; TAG chr11 5188705 5188724 5188721 +
aagattggacatccctgctg

SEQ ID NO: 4674 - DNA, 20 bp, Artificial Sequence
  Synthetic oligonucleotide; GAG chr11 5188707 5188726 5188723 +
gattggacatccctgctgta

SEQ ID NO: 4675 - DNA, 20 bp, Artificial Sequence
  Synthetic oligonucleotide; CAG chr11 5188715 5188734 5188731 +
atccctgctgtagagtttct

SEQ ID NO: 4676 - DNA, 20 bp, Artificial Sequence
  Synthetic oligonucleotide; TGG chr11 5188718 5188737 5188734 +
cctgctgtagagtttctcag

SEQ ID NO: 4677 - DNA, 20 bp, Artificial Sequence
  Synthetic oligonucleotide; TGG chr11 5188722 5188741 5188738 +
ctgtagagtttctcagtggt

SEQ ID NO: 4678 - DNA, 20 bp, Artificial Sequence
  Synthetic oligonucleotide; CAG chr11 5188737 5188756 5188753 +
gtggttggaatcaatatttg

SEQ ID NO: 4679 - DNA, 20 bp, Artificial Sequence
  Synthetic oligonucleotide; GAG chr11 5188739 5188758 5188755 +
ggttggaatcaatatttgca

SEQ ID NO: 4680 - DNA, 20 bp, Artificial Sequence
  Synthetic oligonucleotide; TAG chr11 5188747 5188766 5188763 +
tcaatatttgcagagtcttg

SEQ ID NO: 4681 - DNA, 20 bp, Artificial Sequence
  Synthetic oligonucleotide; AAG chr11 5188758 5188777 5188774 +
agagtcttgtagctttttca

SEQ ID NO: 4682 - DNA, 20 bp, Artificial Sequence
  Synthetic oligonucleotide; AAG chr11 5188781 5188800 5188797 +
atttttcccctgccacattg

SEQ ID NO: 4683 - DNA, 20 bp, Artificial Sequence
  Synthetic oligonucleotide; TAG chr11 5188786 5188805 5188802 +
tcccctgccacattgaagaa

SEQ ID NO: 4684 - DNA, 20 bp, Artificial Sequence
  Synthetic oligonucleotide; GAG chr11 5188792 5188811 5188808 +
gccacattgaagaatagctt

SEQ ID NO: 4685 - DNA, 20 bp, Artificial Sequence
  Synthetic oligonucleotide; TAG chr11 5188798 5188817 5188814 +
ttgaagaatagcttgagcaa

SEQ ID NO: 4686 - DNA, 20 bp, Artificial Sequence
  Synthetic oligonucleotide; CAG chr11 5188814 5188833 5188830 +
gcaatagccactcttctttc

SEQ ID NO: 4687 - DNA, 20 bp, Artificial Sequence
  Synthetic oligonucleotide; AGG chr11 5188815 5188834 5188831 +
caatagccactcttctttcc

SEQ ID NO: 4688 - DNA, 20 bp, Artificial Sequence
  Synthetic oligonucleotide; TGG chr11 5188818 5188837 5188834 +
tagccactcttctttccagg

SEQ ID NO: 4689 - DNA, 20 bp, Artificial Sequence
  Synthetic oligonucleotide; GAG chr11 5188820 5188839 5188836 +
gccactcttctttccaggtg

SEQ ID NO: 4690 - DNA, 20 bp, Artificial Sequence
  Synthetic oligonucleotide; TAG chr11 5188837 5188856 5188853 +
gtggagtttgtgaattactt

SEQ ID NO: 4691 - DNA, 20 bp, Artificial Sequence
  Synthetic oligonucleotide; GAG chr11 5188839 5188858 5188855 +
ggagtttgtgaattacttta

SEQ ID NO: 4692 - DNA, 20 bp, Artificial Sequence
  Synthetic oligonucleotide; TGG chr11 5188854 5188873 5188870 +
ctttagagatgatctttatc

SEQ ID NO: 4693 - DNA, 20 bp, Artificial Sequence
  Synthetic oligonucleotide; GGG chr11 5188855 5188874 5188871 +
tttagagatgatctttatct

SEQ ID NO: 4694 - DNA, 20 bp, Artificial Sequence
  Synthetic oligonucleotide; AAG chr11 5188858 5188877 5188874 +
agagatgatctttatctggg

SEQ ID NO: 4695 - DNA, 20 bp, Artificial Sequence
  Synthetic oligonucleotide; TAG chr11 5188887 5188906 5188903 +
taatatattatctcttcgtt

SEQ ID NO: 4696 - DNA, 20 bp, Artificial Sequence
  Synthetic oligonucleotide; AAG chr11 5188897 5188916 5188913 +
tctcttcgtttagctaacgt

SEQ ID NO: 4697 - DNA, 20 bp, Artificial Sequence
  Synthetic oligonucleotide; AGG chr11 5188898 5188917 5188914 +
ctcttcgtttagctaacgta

SEQ ID NO: 4698 - DNA, 20 bp, Artificial Sequence
  Synthetic oligonucleotide; TAG chr11 5188905 5188924 5188921 +
tttagctaacgtaaggttat

SEQ ID NO: 4699 - DNA, 20 bp, Artificial Sequence
  Synthetic oligonucleotide; AAG chr11 5188920 5188939 5188936 +
gttattagatacttttcttt

SEQ ID NO: 4700 - DNA, 20 bp, Artificial Sequence
  Synthetic oligonucleotide; AGG chr11 5188921 5188940 5188937 +
ttattagatacttttcttta

SEQ ID NO: 4701 - DNA, 20 bp, Artificial Sequence
  Synthetic oligonucleotide; AAG chr11 5188924 5188943 5188940 +
ttagatacttttctttaagg

SEQ ID NO: 4702 - DNA, 20 bp, Artificial Sequence
  Synthetic oligonucleotide; AGG chr11 5188925 5188944 5188941 +
tagatacttttctttaagga

SEQ ID NO: 4703 - DNA, 20 bp, Artificial Sequence
  Synthetic oligonucleotide; CAG chr11 5188934 5188953 5188950 +
ttctttaaggaaggatacac

SEQ ID NO: 4704 - DNA, 20 bp, Artificial Sequence
  Synthetic oligonucleotide; AGG chr11 5188935 5188954 5188951 +
tctttaaggaaggatacacc

SEQ ID NO: 4705 - DNA, 20 bp, Artificial Sequence
  Synthetic oligonucleotide; AAG chr11 5188950 5188969 5188966 +
acaccaggacctgccttaat

SEQ ID NO: 4706 - DNA, 20 bp, Artificial Sequence
  Synthetic oligonucleotide; AGG chr11 5188951 5188970 5188967 +
caccaggacctgccttaata

SEQ ID NO: 4707 - DNA, 20 bp, Artificial Sequence
  Synthetic oligonucleotide; CAG chr11 5189003 5189022 5189019 +
atcataatatgtgtgtcgtg

SEQ ID NO: 4708 - DNA, 20 bp, Artificial Sequence
  Synthetic oligonucleotide; GAG chr11 5189005 5189024 5189021 +
cataatatgtgtgtcgtgca

SEQ ID NO: 4709 - DNA, 20 bp, Artificial Sequence
  Synthetic oligonucleotide; TAG chr11 5189019 5189038 5189035 +
cgtgcagagataaacttgta

SEQ ID NO: 4710 - DNA, 20 bp, Artificial Sequence
  Synthetic oligonucleotide; AAG chr11 5189022 5189041 5189038 +
gcagagataaacttgtatag

SEQ ID NO: 4711 - DNA, 20 bp, Artificial Sequence
  Synthetic oligonucleotide; AAG chr11 5189046 5189065 5189062 +
caatacgactgcttgtatta

SEQ ID NO: 4712 - DNA, 20 bp, Artificial Sequence
  Synthetic oligonucleotide; AAG chr11 5189054 5189073 5189070 +
ctgcttgtattaaagaaaca

SEQ ID NO: 4713 - DNA, 20 bp, Artificial Sequence
  Synthetic oligonucleotide; AAG chr11 5189126 5189145 5189142 +
gttgaattgtgtttaatcac

SEQ ID NO: 4714 - DNA, 20 bp, Artificial Sequence
  Synthetic oligonucleotide; GAG chr11 5189128 5189147 5189144 +
tgaattgtgtttaatcacaa

SEQ ID NO: 4715 - DNA, 20 bp, Artificial Sequence
  Synthetic oligonucleotide; TGG chr11 5189147 5189166 5189163 +
agagtaatgcatgcctgata

SEQ ID NO: 4716 - DNA, 20 bp, Artificial Sequence
  Synthetic oligonucleotide; TGG chr11 5189152 5189171 5189168 +
aatgcatgcctgatatggtt

SEQ ID NO: 4717 - DNA, 20 bp, Artificial Sequence
  Synthetic oligonucleotide; CAG chr11 5189183 5189202 5189199 +
ctccaccctaatctcatgtt

SEQ ID NO: 4718 - DNA, 20 bp, Artificial Sequence
  Synthetic oligonucleotide; CAG chr11 5189196 5189215 5189212 +
tcatgttcagctgtaatccc

SEQ ID NO: 4719 - DNA, 20 bp, Artificial Sequence
  Synthetic oligonucleotide; AAG chr11 5189204 5189223 5189220 +
agctgtaatccccagtgttg

SEQ ID NO: 4720 - DNA, 20 bp, Artificial Sequence
  Synthetic oligonucleotide; TGG chr11 5189208 5189227 5189224 +
gtaatccccagtgttgaaga

SEQ ID NO: 4721 - DNA, 20 bp, Artificial Sequence
  Synthetic oligonucleotide; GGG chr11 5189209 5189228 5189225 +
taatccccagtgttgaagat

SEQ ID NO: 4722 - DNA, 20 bp, Artificial Sequence
  Synthetic oligonucleotide; GGG chr11 5189210 5189229 5189226 +
aatccccagtgttgaagatg

SEQ ID NO: 4723 - DNA, 20 bp, Artificial Sequence
  Synthetic oligonucleotide; TGG chr11 5189215 5189234 5189231 +
ccagtgttgaagatggggcc

SEQ ID NO: 4724 - DNA, 20 bp, Artificial Sequence
  Synthetic oligonucleotide; TGG chr11 5189218 5189237 5189234 +
gtgttgaagatggggcctgg

SEQ ID NO: 4725 - DNA, 20 bp, Artificial Sequence
  Synthetic oligonucleotide; GGG chr11 5189219 5189238 5189235 +
tgttgaagatggggcctggt

SEQ ID NO: 4726 - DNA, 20 bp, Artificial Sequence
  Synthetic oligonucleotide; AAG chr11 5189222 5189241 5189238 +
tgaagatggggcctggtggg

SEQ ID NO: 4727 - DNA, 20 bp, Artificial Sequence
  Synthetic oligonucleotide; TGG chr11 5189229 5189248 5189245 +
ggggcctggtgggaagtgat

SEQ ID NO: 4728 - DNA, 20 bp, Artificial Sequence
  Synthetic oligonucleotide; TAG chr11 5189236 5189255 5189252 +
ggtgggaagtgattggatca

SEQ ID NO: 4729 - DNA, 20 bp, Artificial Sequence
  Synthetic oligonucleotide; AGG chr11 5189237 5189256 5189253 +
gtgggaagtgattggatcat

SEQ ID NO: 4730 - DNA, 20 bp, Artificial Sequence
  Synthetic oligonucleotide; GAG chr11 5189239 5189258 5189255 +
gggaagtgattggatcatag

SEQ ID NO: 4731 - DNA, 20 bp, Artificial Sequence
  Synthetic oligonucleotide; CAG chr11 5189242 5189261 5189258 +
aagtgattggatcataggag

SEQ ID NO: 4732 - DNA, 20 bp, Artificial Sequence
  Synthetic oligonucleotide; GAG chr11 5189244 5189263 5189260 +
gtgattggatcataggagca

SEQ ID NO: 4733 - DNA, 20 bp, Artificial Sequence
  Synthetic oligonucleotide; TAG chr11 5189257 5189276 5189273 +
aggagcagagttatcataaa

SEQ ID NO: 4734 - DNA, 20 bp, Artificial Sequence
  Synthetic oligonucleotide; CAG chr11 5189268 5189287 5189284 +
tatcataaatagcttaatat

SEQ ID NO: 4735 - DNA, 20 bp, Artificial Sequence
  Synthetic oligonucleotide; TGG chr11 5189278 5189297 5189294 +
agcttaatatcagtcccttt

SEQ ID NO: 4736 - DNA, 20 bp, Artificial Sequence
  Synthetic oligonucleotide; TAG chr11 5189287 5189306 5189303 +
tcagtcccttttggtacgta

SEQ ID NO: 4737 - DNA, 20 bp, Artificial Sequence
  Synthetic oligonucleotide; TGG chr11 5189290 5189309 5189306 +
gtcccttttggtacgtatag

SEQ ID NO: 4738 - DNA, 20 bp, Artificial Sequence
  Synthetic oligonucleotide; GGG chr11 5189291 5189310 5189307 +
tcccttttggtacgtatagt

SEQ ID NO: 4739 - DNA, 20 bp, Artificial Sequence
  Synthetic oligonucleotide; GAG chr11 5189295 5189314 5189311 +
ttttggtacgtatagtgggt

SEQ ID NO: 4740 - DNA, 20 bp, Artificial Sequence
  Synthetic oligonucleotide; GAG chr11 5189305 5189324 5189321 +
tatagtgggtgagttctcat

SEQ ID NO: 4741 - DNA, 20 bp, Artificial Sequence
  Synthetic oligonucleotide; TGG chr11 5189311 5189330 5189327 +
gggtgagttctcatgagata

SEQ ID NO: 4742 - DNA, 20 bp, Artificial Sequence
  Synthetic oligonucleotide; CAG chr11 5189348 5189367 5189364 +
cctgcctcttcttcctgctc

SEQ ID NO: 4743 - DNA, 20 bp, Artificial Sequence
  Synthetic oligonucleotide; AAG chr11 5189358 5189377 5189374 +
cttcctgctccagccatgtg

SEQ ID NO: 4744 - DNA, 20 bp, Artificial Sequence
  Synthetic oligonucleotide; AAG chr11 5189396 5189415 5189412 +
tttctctctgccatgattat

SEQ ID NO: 4745 - DNA, 20 bp, Artificial Sequence
  Synthetic oligonucleotide; TAG chr11 5189415 5189434 5189431 +
taagtttcctgaaacctccc

SEQ ID NO: 4746 - DNA, 20 bp, Artificial Sequence
  Synthetic oligonucleotide; AAG chr11 5189418 5189437 5189434 +
gtttcctgaaacctccctag

SEQ ID NO: 4747 - DNA, 20 bp, Artificial Sequence
  Synthetic oligonucleotide; GAG chr11 5189423 5189442 5189439 +
ctgaaacctccctagaagct

SEQ ID NO: 4748 - DNA, 20 bp, Artificial Sequence
  Synthetic oligonucleotide; CAG chr11 5189426 5189445 5189442 +
aaacctccctagaagctgag

SEQ ID NO: 4749 - DNA, 20 bp, Artificial Sequence
  Synthetic oligonucleotide; CAG chr11 5189449 5189468 5189465 +
acgttgccatgcttcctgta

SEQ ID NO: 4750 - DNA, 20 bp, Artificial Sequence
  Synthetic oligonucleotide; TAG chr11 5189456 5189475 5189472 +
catgcttcctgtacagcctt

SEQ ID NO: 4751 - DNA, 20 bp, Artificial Sequence
  Synthetic oligonucleotide; GAG chr11 5189465 5189484 5189481 +
tgtacagcctttagaactgt

SEQ ID NO: 4752 - DNA, 20 bp, Artificial Sequence
  Synthetic oligonucleotide; CAG chr11 5189499 5189518 5189515 +
tctgttcttcaccatttacc

SEQ ID NO: 4753 - DNA, 20 bp, Artificial Sequence
  Synthetic oligonucleotide; CAG chr11 5189505 5189524 5189521 +
cttcaccatttacccagtct

SEQ ID NO: 4754 - DNA, 20 bp, Artificial Sequence
  Synthetic oligonucleotide; AGG chr11 5189506 5189525 5189522 +
ttcaccatttacccagtctc

SEQ ID NO: 4755 - DNA, 20 bp, Artificial Sequence
  Synthetic oligonucleotide; TAG chr11 5189519 5189538 5189535 +
cagtctcaggtatttcctta

SEQ ID NO: 4756 - DNA, 20 bp, Artificial Sequence
  Synthetic oligonucleotide; AAG chr11 5189523 5189542 5189539 +
ctcaggtatttccttatagc

SEQ ID NO: 4757 - DNA, 20 bp, Artificial Sequence
  Synthetic oligonucleotide; GAG chr11 5189528 5189547 5189544 +
gtatttccttatagcaagat

SEQ ID NO: 4758 - DNA, 20 bp, Artificial Sequence
  Synthetic oligonucleotide; TGG chr11 5189533 5189552 5189549 +
tccttatagcaagatgagaa

SEQ ID NO: 4759 - DNA, 20 bp, Artificial Sequence
  Synthetic oligonucleotide; CAG chr11 5189538 5189557 5189554 +
atagcaagatgagaatggac

SEQ ID NO: 4760 - DNA, 20 bp, Artificial Sequence
  Synthetic oligonucleotide; CAG chr11 5189543 5189562 5189559 +
aagatgagaatggaccagta

SEQ ID NO: 4761 - DNA, 20 bp, Artificial Sequence
  Synthetic oligonucleotide; TGG chr11 5189551 5189570 5189567 +
aatggaccagtacagaaaat

SEQ ID NO: 4762 - DNA, 20 bp, Artificial Sequence
  Synthetic oligonucleotide; AAG chr11 5189560 5189579 5189576 +
gtacagaaaattggtaccaa

SEQ ID NO: 4763 - DNA, 20 bp, Artificial Sequence
  Synthetic oligonucleotide; TGG chr11 5189563 5189582 5189579 +
cagaaaattggtaccaaaag

SEQ ID NO: 4764 - DNA, 20 bp, Artificial Sequence
  Synthetic oligonucleotide; GGG chr11 5189564 5189583 5189580 +
agaaaattggtaccaaaagt

SEQ ID NO: 4765 - DNA, 20 bp, Artificial Sequence
  Synthetic oligonucleotide; GGG chr11 5189565 5189584 5189581 +
gaaaattggtaccaaaagtg

SEQ ID NO: 4766 - DNA, 20 bp, Artificial Sequence
  Synthetic oligonucleotide; AAG chr11 5189578 5189597 5189594 +
aaaagtggggtactgctata

SEQ ID NO: 4767 - DNA, 20 bp, Artificial Sequence
  Synthetic oligonucleotide; TGG chr11 5189594 5189613 5189610 +
tataaagatacatgaaaatg

SEQ ID NO: 4768 - DNA, 20 bp, Artificial Sequence
  Synthetic oligonucleotide; AAG chr11 5189597 5189616 5189613 +
aaagatacatgaaaatgtgg

SEQ ID NO: 4769 - DNA, 20 bp, Artificial Sequence
  Synthetic oligonucleotide; TGG chr11 5189606 5189625 5189622 +
tgaaaatgtggaagcaactt

SEQ ID NO: 4770 - DNA, 20 bp, Artificial Sequence
  Synthetic oligonucleotide; TGG chr11 5189612 5189631 5189628 +
tgtggaagcaactttggcat

SEQ ID NO: 4771 - DNA, 20 bp, Artificial Sequence
  Synthetic oligonucleotide; CAG chr11 5189619 5189638 5189635 +
gcaactttggcattggataa

SEQ ID NO: 4772 - DNA, 20 bp, Artificial Sequence
  Synthetic oligonucleotide; AGG chr11 5189620 5189639 5189636 +
caactttggcattggataac

SEQ ID NO: 4773 - DNA, 20 bp, Artificial Sequence
  Synthetic oligonucleotide; CAG chr11 5189623 5189642 5189639 +
ctttggcattggataacagg

SEQ ID NO: 4774 - DNA, 20 bp, Artificial Sequence
  Synthetic oligonucleotide; AAG chr11 5189626 5189645 5189642 +
tggcattggataacaggcag

SEQ ID NO: 4775 - DNA, 20 bp, Artificial Sequence
  Synthetic oligonucleotide; TGG chr11 5189630 5189649 5189646 +
attggataacaggcagaagt

SEQ ID NO: 4776 - DNA, 20 bp, Artificial Sequence
  Synthetic oligonucleotide; AAG chr11 5189633 5189652 5189649 +
ggataacaggcagaagttgg

SEQ ID NO: 4777 - DNA, 20 bp, Artificial Sequence
  Synthetic oligonucleotide; GAG chr11 5189635 5189654 5189651 +
ataacaggcagaagttggaa

SEQ ID NO: 4778 - DNA, 20 bp, Artificial Sequence
  Synthetic oligonucleotide; TGG chr11 5189640 5189659 5189656 +
aggcagaagttggaagagtg

SEQ ID NO: 4779 - DNA, 20 bp, Artificial Sequence
  Synthetic oligonucleotide; CGG chr11 5189644 5189663 5189660 +
agaagttggaagagtgtgga

SEQ ID NO: 4780 - DNA, 20 bp, Artificial Sequence
  Synthetic oligonucleotide; CAG chr11 5189649 5189668 5189665 +
ttggaagagtgtggacggct

SEQ ID NO: 4781 - DNA, 20 bp, Artificial Sequence
  Synthetic oligonucleotide; AAG chr11 5189652 5189671 5189668 +
gaagagtgtggacggctcag

SEQ ID NO: 4782 - DNA, 20 bp, Artificial Sequence
  Synthetic oligonucleotide; AAG chr11 5189655 5189674 5189671 +
gagtgtggacggctcagaag

SEQ ID NO: 4783 - DNA, 20 bp, Artificial Sequence
  Synthetic oligonucleotide; CAG chr11 5189659 5189678 5189675 +
gtggacggctcagaagaaga

SEQ ID NO: 4784 - DNA, 20 bp, Artificial Sequence
  Synthetic oligonucleotide; AGG chr11 5189660 5189679 5189676 +
tggacggctcagaagaagac

SEQ ID NO: 4785 - DNA, 20 bp, Artificial Sequence
  Synthetic oligonucleotide; GGG chr11 5189661 5189680 5189677 +
ggacggctcagaagaagaca

SEQ ID NO: 4786 - DNA, 20 bp, Artificial Sequence
  Synthetic oligonucleotide; GAG chr11 5189663 5189682 5189679 +
acggctcagaagaagacagg

SEQ ID NO: 4787 - DNA, 20 bp, Artificial Sequence
  Synthetic oligonucleotide; GAG chr11 5189668 5189687 5189684 +
tcagaagaagacagggagat

SEQ ID NO: 4788 - DNA, 20 bp, Artificial Sequence
  Synthetic oligonucleotide; AGG chr11 5189669 5189688 5189685 +
cagaagaagacagggagatg

SEQ ID NO: 4789 - DNA, 20 bp, Artificial Sequence
  Synthetic oligonucleotide; GGG chr11 5189670 5189689 5189686 +
agaagaagacagggagatga

SEQ ID NO: 4790 - DNA, 20 bp, Artificial Sequence
  Synthetic oligonucleotide; GAG chr11 5189672 5189691 5189688 +
aagaagacagggagatgagg

SEQ ID NO: 4791 - DNA, 20 bp, Artificial Sequence
  Synthetic oligonucleotide; TGG chr11 5189679 5189698 5189695 +
cagggagatgagggagaatt

SEQ ID NO: 4792 - DNA, 20 bp, Artificial Sequence
  Synthetic oligonucleotide; TAG chr11 5189689 5189708 5189705 +
agggagaatttggaactttc

SEQ ID NO: 4793 - DNA, 20 bp, Artificial Sequence
  Synthetic oligonucleotide; GAG chr11 5189691 5189710 5189707 +
ggagaatttggaactttcta

SEQ ID NO: 4794 - DNA, 20 bp, Artificial Sequence
  Synthetic oligonucleotide; TGG chr11 5189699 5189718 5189715 +
tggaactttctagagacttg

SEQ ID NO: 4795 - DNA, 20 bp, Artificial Sequence
  Synthetic oligonucleotide; TGG chr11 5189704 5189723 5189720 +
ctttctagagacttgtggaa

SEQ ID NO: 4796 - DNA, 20 bp, Artificial Sequence
  Synthetic oligonucleotide; TAG chr11 5189725 5189744 5189741 +
ggttgtgaccaaaattctga

SEQ ID NO: 4797 - DNA, 20 bp, Artificial Sequence
  Synthetic oligonucleotide; TGG chr11 5189733 5189752 5189749 +
ccaaaattctgatagtgata

SEQ ID NO: 4798 - DNA, 20 bp, Artificial Sequence
  Synthetic oligonucleotide; AAG chr11 5189742 5189761 5189758 +
tgatagtgatatggacaatg

SEQ ID NO: 4799 - DNA, 20 bp, Artificial Sequence
  Synthetic oligonucleotide; CAG chr11 5189747 5189766 5189763 +
gtgatatggacaatgaagtc

SEQ ID NO: 4800 - DNA, 20 bp, Artificial Sequence
  Synthetic oligonucleotide; AGG chr11 5189748 5189767 5189764 +
tgatatggacaatgaagtcc

SEQ ID NO: 4801 - DNA, 20 bp, Artificial Sequence
  Synthetic oligonucleotide; GAG chr11 5189753 5189772 5189769 +
tggacaatgaagtccaggct

SEQ ID NO: 4802 - DNA, 20 bp, Artificial Sequence
  Synthetic oligonucleotide; AGG chr11 5189754 5189773 5189770 +
ggacaatgaagtccaggctg

SEQ ID NO: 4803 - DNA, 20 bp, Artificial Sequence
  Synthetic oligonucleotide; TGG chr11 5189757 5189776 5189773 +
caatgaagtccaggctgagg

SEQ ID NO: 4804 - DNA, 20 bp, Artificial Sequence
  Synthetic oligonucleotide; CAG chr11 5189763 5189782 5189779 +
agtccaggctgaggtggtct

SEQ ID NO: 4805 - DNA, 20 bp, Artificial Sequence
  Synthetic oligonucleotide; TGG chr11 5189767 5189786 5189783 +
caggctgaggtggtctcaga

SEQ ID NO: 4806 - DNA, 20 bp, Artificial Sequence
  Synthetic oligonucleotide; TGG chr11 5189782 5189801 5189798 +
tcagatggaaatgaatttat

SEQ ID NO: 4807 - DNA, 20 bp, Artificial Sequence
  Synthetic oligonucleotide; TGG chr11 5189789 5189808 5189805 +
gaaatgaatttattggaaac

SEQ ID NO: 4808 - DNA, 20 bp, Artificial Sequence
  Synthetic oligonucleotide; GAG chr11 5189791 5189810 5189807 +
aatgaatttattggaaactg

SEQ ID NO: 4809 - DNA, 20 bp, Artificial Sequence
  Synthetic oligonucleotide; AAG chr11 5189796 5189815 5189812 +
atttattggaaactggagca

SEQ ID NO: 4810 - DNA, 20 bp, Artificial Sequence
  Synthetic oligonucleotide; AGG chr11 5189797 5189816 5189813 +
tttattggaaactggagcaa

SEQ ID NO: 4811 - DNA, 20 bp, Artificial Sequence
  Synthetic oligonucleotide; TAG chr11 5189817 5189836 5189833 +
aggtcacttttgttatacat

SEQ ID NO: 4812 - DNA, 20 bp, Artificial Sequence
  Synthetic oligonucleotide; AAG chr11 5189822 5189841 5189838 +
acttttgttatacattagca

SEQ ID NO: 4813 - DNA, 20 bp, Artificial Sequence
  Synthetic oligonucleotide; GAG chr11 5189824 5189843 5189840 +
ttttgttatacattagcaaa

SEQ ID NO: 4814 - DNA, 20 bp, Artificial Sequence
  Synthetic oligonucleotide; AGG chr11 5189825 5189844 5189841 +
tttgttatacattagcaaag

SEQ ID NO: 4815 - DNA, 20 bp, Artificial Sequence
  Synthetic oligonucleotide; TAG chr11 5189851 5189870 5189867 +
actgcactgtgcctctacct

SEQ ID NO: 4816 - DNA, 20 bp, Artificial Sequence
  Synthetic oligonucleotide; GAG chr11 5189853 5189872 5189869 +
tgcactgtgcctctacctta

SEQ ID NO: 4817 - DNA, 20 bp, Artificial Sequence
  Synthetic oligonucleotide; TGG chr11 5189862 5189881 5189878 +
cctctaccttagagaatctg

SEQ ID NO: 4818 - DNA, 20 bp, Artificial Sequence
  Synthetic oligonucleotide; AAG chr11 5189872 5189891 5189888 +
agagaatctgtggaaattcg

SEQ ID NO: 4819 - DNA, 20 bp, Artificial Sequence
  Synthetic oligonucleotide; AAG chr11 5189890 5189909 5189906 +
cgaagttgataatattattt

SEQ ID NO: 4820 - DNA, 20 bp, Artificial Sequence
  Synthetic oligonucleotide; CAG chr11 5189901 5189920 5189917 +
atattatttaagttatgtga

SEQ ID NO: 4821 - DNA, 20 bp, Artificial Sequence
  Synthetic oligonucleotide; AAG chr11 5189904 5189923 5189920 +
ttatttaagttatgtgacag

SEQ ID NO: 4822 - DNA, 20 bp, Artificial Sequence
  Synthetic oligonucleotide; AAG chr11 5189912 5189931 5189928 +
gttatgtgacagaagtttct

SEQ ID NO: 4823 - DNA, 20 bp, Artificial Sequence
  Synthetic oligonucleotide; CAG chr11 5189915 5189934 5189931 +
atgtgacagaagtttctaag

SEQ ID NO: 4824 - DNA, 20 bp, Artificial Sequence
  Synthetic oligonucleotide; AAG chr11 5189919 5189938 5189935 +
gacagaagtttctaagcagc

SEQ ID NO: 4825 - DNA, 20 bp, Artificial Sequence
  Synthetic oligonucleotide; AGG chr11 5189920 5189939 5189936 +
acagaagtttctaagcagca

SEQ ID NO: 4826 - DNA, 20 bp, Artificial Sequence
  Synthetic oligonucleotide; AAG chr11 5189928 5189947 5189944 +
ttctaagcagcaaggtgttc

SEQ ID NO: 4827 - DNA, 20 bp, Artificial Sequence
  Synthetic oligonucleotide; TGG chr11 5189939 5189958 5189955 +
aaggtgttcaagatgtgtcc

SEQ ID NO: 4828 - DNA, 20 bp, Artificial Sequence
  Synthetic oligonucleotide; GAG chr11 5189972 5189991 5189988 +
caacctatgctcatatgtgt

SEQ ID NO: 4829 - DNA, 20 bp, Artificial Sequence
  Synthetic oligonucleotide; AAG chr11 5189977 5189996 5189993 +
tatgctcatatgtgtgagca

SEQ ID NO: 4830 - DNA, 20 bp, Artificial Sequence
  Synthetic oligonucleotide; CAG chr11 5189994 5190013 5190010 +
gcaaagaaataacataaaat

SEQ ID NO: 4831 - DNA, 20 bp, Artificial Sequence
  Synthetic oligonucleotide; AAG chr11 5190010 5190029 5190026 +
aaatcagaacttatatttaa

SEQ ID NO: 4832 - DNA, 20 bp, Artificial Sequence
  Synthetic oligonucleotide; AGG chr11 5190011 5190030 5190027 +
aatcagaacttatatttaaa

SEQ ID NO: 4833 - DNA, 20 bp, Artificial Sequence
  Synthetic oligonucleotide; GGG chr11 5190012 5190031 5190028 +
atcagaacttatatttaaaa

SEQ ID NO: 4834 - DNA, 20 bp, Artificial Sequence
  Synthetic oligonucleotide; AAG chr11 5190015 5190034 5190031 +
agaacttatatttaaaaggg

SEQ ID NO: 4835 - DNA, 20 bp, Artificial Sequence
  Synthetic oligonucleotide; CAG chr11 5190018 5190037 5190034 +
acttatatttaaaagggaag

SEQ ID NO: 4836 - DNA, 20 bp, Artificial Sequence
  Synthetic oligonucleotide; GAG chr11 5190020 5190039 5190036 +
ttatatttaaaagggaagca

SEQ ID NO: 4837 - DNA, 20 bp, Artificial Sequence
  Synthetic oligonucleotide; AAG chr11 5190028 5190047 5190044 +
aaaagggaagcagagcataa

SEQ ID NO: 4838 - DNA, 20 bp, Artificial Sequence
  Synthetic oligonucleotide; TGG chr11 5190033 5190052 5190049 +
ggaagcagagcataaaagtt

SEQ ID NO: 4839 - DNA, 20 bp, Artificial Sequence
  Synthetic oligonucleotide; CGG chr11 5190049 5190068 5190065 +
agtttggaaaattatctgct

SEQ ID NO: 4840 - DNA, 20 bp, Artificial Sequence
  Synthetic oligonucleotide; TGG chr11 5190057 5190076 5190073 +
aaattatctgctcggccatg

SEQ ID NO: 4841 - DNA, 20 bp, Artificial Sequence
  Synthetic oligonucleotide; TAG chr11 5190060 5190079 5190076 +
ttatctgctcggccatgtgg

SEQ ID NO: 4842 - DNA, 20 bp, Artificial Sequence
  Synthetic oligonucleotide; CAG chr11 5190067 5190086 5190083 +
ctcggccatgtggtagaaaa

SEQ ID NO: 4843 - DNA, 20 bp, Artificial Sequence
  Synthetic oligonucleotide; AAG chr11 5190070 5190089 5190086 +
ggccatgtggtagaaaacag

SEQ ID NO: 4844 - DNA, 20 bp, Artificial Sequence
  Synthetic oligonucleotide; AAG chr11 5190083 5190102 5190099 +
aaaacagaagctcattttca

SEQ ID NO: 4845 - DNA, 20 bp, Artificial Sequence
  Synthetic oligonucleotide; AGG chr11 5190084 5190103 5190100 +
aaacagaagctcattttcaa

SEQ ID NO: 4846 - DNA, 20 bp, Artificial Sequence
  Synthetic oligonucleotide; GAG chr11 5190086 5190105 5190102 +
acagaagctcattttcaaag

SEQ ID NO: 4847 - DNA, 20 bp, Artificial Sequence
  Synthetic oligonucleotide; AAG chr11 5190095 5190114 5190111 +
cattttcaaaggagcaattc

SEQ ID NO: 4848 - DNA, 20 bp, Artificial Sequence
  Synthetic oligonucleotide; CAG chr11 5190098 5190117 5190114 +
tttcaaaggagcaattcaag

SEQ ID NO: 4849 - DNA, 20 bp, Artificial Sequence
  Synthetic oligonucleotide; AGG chr11 5190099 5190118 5190115 +
ttcaaaggagcaattcaagc

SEQ ID NO: 4850 - DNA, 20 bp, Artificial Sequence
  Synthetic oligonucleotide; TAG chr11 5190105 5190124 5190121 +
ggagcaattcaagcaggctg

SEQ ID NO: 4851 - DNA, 20 bp, Artificial Sequence
  Synthetic oligonucleotide; AAG chr11 5190123 5190142 5190139 +
tgtagaaatttgcataaatg

SEQ ID NO: 4852 - DNA, 20 bp, Artificial Sequence
  Synthetic oligonucleotide; GAG chr11 5190125 5190144 5190141 +
tagaaatttgcataaatgaa

SEQ ID NO: 4853 - DNA, 20 bp, Artificial Sequence
  Synthetic oligonucleotide; AGG chr11 5190126 5190145 5190142 +
agaaatttgcataaatgaag

SEQ ID NO: 4854 - DNA, 20 bp, Artificial Sequence
  Synthetic oligonucleotide; GAG chr11 5190128 5190147 5190144 +
aaatttgcataaatgaagag

SEQ ID NO: 4855 - DNA, 20 bp, Artificial Sequence
  Synthetic oligonucleotide; GAG chr11 5190133 5190152 5190149 +
tgcataaatgaagaggagcc

SEQ ID NO: 4856 - DNA, 20 bp, Artificial Sequence
  Synthetic oligonucleotide; TAG chr11 5190142 5190161 5190158 +
gaagaggagccgagttctaa

SEQ ID NO: 4857 - DNA, 20 bp, Artificial Sequence
  Synthetic oligonucleotide; AAG chr11 5190153 5190172 5190169 +
gagttctaatagccaaaata

SEQ ID NO: 4858 - DNA, 20 bp, Artificial Sequence
  Synthetic oligonucleotide; AGG chr11 5190154 5190173 5190170 +
agttctaatagccaaaataa

SEQ ID NO: 4859 - DNA, 20 bp, Artificial Sequence
  Synthetic oligonucleotide; GGG chr11 5190155 5190174 5190171 +
gttctaatagccaaaataaa

SEQ ID NO: 4860 - DNA, 20 bp, Artificial Sequence
  Synthetic oligonucleotide; GGG chr11 5190156 5190175 5190172 +
ttctaatagccaaaataaag

SEQ ID NO: 4861 - DNA, 20 bp, Artificial Sequence
  Synthetic oligonucleotide; GAG chr11 5190158 5190177 5190174 +
ctaatagccaaaataaaggg

SEQ ID NO: 4862 - DNA, 20 bp, Artificial Sequence
  Synthetic oligonucleotide; AAG chr11 5190170 5190189 5190186 +
ataaaggggagaatgcctca

SEQ ID NO: 4863 - DNA, 20 bp, Artificial Sequence
  Synthetic oligonucleotide; CAG chr11 5190179 5190198 5190195 +
agaatgcctcaaagacattt

SEQ ID NO: 4864 - DNA, 20 bp, Artificial Sequence
  Synthetic oligonucleotide; GAG chr11 5190181 5190200 5190197 +
aatgcctcaaagacatttca

SEQ ID NO: 4865 - DNA, 20 bp, Artificial Sequence
  Synthetic oligonucleotide; TAG chr11 5190191 5190210 5190207 +
agacatttcagagacccttg

SEQ ID NO: 4866 - DNA, 20 bp, Artificial Sequence
  Synthetic oligonucleotide; CAG chr11 5190194 5190213 5190210 +
catttcagagacccttgtag

SEQ ID NO: 4867 - DNA, 20 bp, Artificial Sequence
  Synthetic oligonucleotide; CAG chr11 5190209 5190228 5190225 +
tgtagcagcccctcacatca

SEQ ID NO: 4868 - DNA, 20 bp, Artificial Sequence
  Synthetic oligonucleotide; AGG chr11 5190210 5190229 5190226 +
gtagcagcccctcacatcac

SEQ ID NO: 4869 - DNA, 20 bp, Artificial Sequence
  Synthetic oligonucleotide; TGG chr11 5190215 5190234 5190231 +
agcccctcacatcacaggcc

SEQ ID NO: 4870 - DNA, 20 bp, Artificial Sequence
  Synthetic oligonucleotide; TGG chr11 5190218 5190237 5190234 +
ccctcacatcacaggcctgg

SEQ ID NO: 4871 - DNA, 20 bp, Artificial Sequence
  Synthetic oligonucleotide; TAG chr11 5190223 5190242 5190239 +
acatcacaggcctggtggcc

SEQ ID NO: 4872 - DNA, 20 bp, Artificial Sequence
  Synthetic oligonucleotide; AGG chr11 5190224 5190243 5190240 +
catcacaggcctggtggcct

SEQ ID NO: 4873 - DNA, 20 bp, Artificial Sequence
  Synthetic oligonucleotide; GAG chr11 5190226 5190245 5190242 +
tcacaggcctggtggcctag

SEQ ID NO: 4874 - DNA, 20 bp, Artificial Sequence
  Synthetic oligonucleotide; TGG chr11 5190244 5190263 5190260 +
aggagtactgaatgattttg

SEQ ID NO: 4875 - DNA, 20 bp, Artificial Sequence
  Synthetic oligonucleotide; GGG chr11 5190245 5190264 5190261 +
ggagtactgaatgattttgt

SEQ ID NO: 4876 - DNA, 20 bp, Artificial Sequence
  Synthetic oligonucleotide; GAG chr11 5190249 5190268 5190265 +
tactgaatgattttgtgggt

SEQ ID NO: 4877 - DNA, 20 bp, Artificial Sequence
  Synthetic oligonucleotide; CAG chr11 5190255 5190274 5190271 +
atgattttgtgggtgagatt

SEQ ID NO: 4878 - DNA, 20 bp, Artificial Sequence
  Synthetic oligonucleotide; AGG chr11 5190256 5190275 5190272 +
tgattttgtgggtgagattc

SEQ ID NO: 4879 - DNA, 20 bp, Artificial Sequence
  Synthetic oligonucleotide; GAG chr11 5190272 5190291 5190288 +
attcaggaccctgctgcctt

SEQ ID NO: 4880 - DNA, 20 bp, Artificial Sequence
  Synthetic oligonucleotide; CAG chr11 5190275 5190294 5190291 +
caggaccctgctgccttgag

SEQ ID NO: 4881 - DNA, 20 bp, Artificial Sequence
  Synthetic oligonucleotide; CAG chr11 5190281 5190300 5190297 +
cctgctgccttgagcagctt

SEQ ID NO: 4882 - DNA, 20 bp, Artificial Sequence
  Synthetic oligonucleotide; AGG chr11 5190282 5190301 5190298 +
ctgctgccttgagcagcttc

SEQ ID NO: 4883 - DNA, 20 bp, Artificial Sequence
  Synthetic oligonucleotide; TGG chr11 5190303 5190322 5190319 +
ggacactgttccttgcatcc

SEQ ID NO: 4884 - DNA, 20 bp, Artificial Sequence
  Synthetic oligonucleotide; CAG chr11 5190312 5190331 5190328 +
tccttgcatcctggctgctc

SEQ ID NO: 4885 - DNA, 20 bp, Artificial Sequence
  Synthetic oligonucleotide; CAG chr11 5190318 5190337 5190334 +
catcctggctgctccagcac

SEQ ID NO: 4886 - DNA, 20 bp, Artificial Sequence
  Synthetic oligonucleotide; TGG chr11 5190324 5190343 5190340 +
ggctgctccagcaccagctg

SEQ ID NO: 4887 - DNA, 20 bp, Artificial Sequence
  Synthetic oligonucleotide; AAG chr11 5190331 5190350 5190347 +
ccagcaccagctgtggctca

SEQ ID NO: 4888 - DNA, 20 bp, Artificial Sequence
  Synthetic oligonucleotide; AGG chr11 5190332 5190351 5190348 +
cagcaccagctgtggctcaa

SEQ ID NO: 4889 - DNA, 20 bp, Artificial Sequence
  Synthetic oligonucleotide; GGG chr11 5190333 5190352 5190349 +
agcaccagctgtggctcaaa

SEQ ID NO: 4890 - DNA, 20 bp, Artificial Sequence
  Synthetic oligonucleotide; GGG chr11 5190334 5190353 5190350 +
gcaccagctgtggctcaaag

SEQ ID NO: 4891 - DNA, 20 bp, Artificial Sequence
  Synthetic oligonucleotide; AAG chr11 5190340 5190359 5190356 +
gctgtggctcaaaggggccc

SEQ ID NO: 4892 - DNA, 20 bp, Artificial Sequence
  Synthetic oligonucleotide; CAG chr11 5190345 5190364 5190361 +
ggctcaaaggggcccaagaa

SEQ ID NO: 4893 - DNA, 20 bp, Artificial Sequence
  Synthetic oligonucleotide; AAG chr11 5190350 5190369 5190366 +
aaaggggcccaagaacagct

SEQ ID NO: 4894 - DNA, 20 bp, Artificial Sequence
  Synthetic oligonucleotide; AGG chr11 5190351 5190370 5190367 +
aaggggcccaagaacagcta

SEQ ID NO: 4895 - DNA, 20 bp, Artificial Sequence
  Synthetic oligonucleotide; CAG chr11 5190363 5190382 5190379 +
aacagctaaggccactgctt

SEQ ID NO: 4896 - DNA, 20 bp, Artificial Sequence
  Synthetic oligonucleotide; GAG chr11 5190365 5190384 5190381 +
cagctaaggccactgcttca

SEQ ID NO: 4897 - DNA, 20 bp, Artificial Sequence
  Synthetic oligonucleotide; AGG chr11 5190366 5190385 5190382 +
agctaaggccactgcttcag

SEQ ID NO: 4898 - DNA, 20 bp, Artificial Sequence
  Synthetic oligonucleotide; GGG chr11 5190367 5190386 5190383 +
gctaaggccactgcttcaga

SEQ ID NO: 4899 - DNA, 20 bp, Artificial Sequence
  Synthetic oligonucleotide; AAG chr11 5190373 5190392 5190389 +
gccactgcttcagagggtgc

SEQ ID NO: 4900 - DNA, 20 bp, Artificial Sequence
  Synthetic oligonucleotide; AAG chr11 5190380 5190399 5190396 +
cttcagagggtgcaagacat

SEQ ID NO: 4901 - DNA, 20 bp, Artificial Sequence
  Synthetic oligonucleotide; TGG chr11 5190386 5190405 5190402 +
agggtgcaagacataagcct

SEQ ID NO: 4902 - DNA, 20 bp, Artificial Sequence
  Synthetic oligonucleotide; GAG chr11 5190388 5190407 5190404 +
ggtgcaagacataagccttg

SEQ ID NO: 4903 - DNA, 20 bp, Artificial Sequence
  Synthetic oligonucleotide; AGG chr11 5190389 5190408 5190405 +
gtgcaagacataagccttgg

SEQ ID NO: 4904 - DNA, 20 bp, Artificial Sequence
  Synthetic oligonucleotide; TGG chr11 5190400 5190419 5190416 +
aagccttggaggcttccaca

SEQ ID NO: 4905 - DNA, 20 bp, Artificial Sequence
  Synthetic oligonucleotide; TGG chr11 5190412 5190431 5190428 +
cttccacatggtgataaatc

SEQ ID NO: 4906 - DNA, 20 bp, Artificial Sequence
  Synthetic oligonucleotide; GGG chr11 5190413 5190432 5190429 +
ttccacatggtgataaatct

SEQ ID NO: 4907 - DNA, 20 bp, Artificial Sequence
  Synthetic oligonucleotide; GAG chr11 5190415 5190434 5190431 +
ccacatggtgataaatctgg

SEQ ID NO: 4908 - DNA, 20 bp, Artificial Sequence
  Synthetic oligonucleotide; AAG chr11 5190424 5190443 5190440 +
gataaatctgggagtgtgca

SEQ ID NO: 4909 - DNA, 20 bp, Artificial Sequence
  Synthetic oligonucleotide; AGG chr11 5190425 5190444 5190441 +
ataaatctgggagtgtgcaa

SEQ ID NO: 4910 - DNA, 20 bp, Artificial Sequence
  Synthetic oligonucleotide; AAG chr11 5190433 5190452 5190449 +
gggagtgtgcaaaggtcaaa

SEQ ID NO: 4911 - DNA, 20 bp, Artificial Sequence
  Synthetic oligonucleotide; GAG chr11 5190438 5190457 5190454 +
tgtgcaaaggtcaaaaagtt

SEQ ID NO: 4912 - DNA, 20 bp, Artificial Sequence
  Synthetic oligonucleotide; AGG chr11 5190439 5190458 5190455 +
gtgcaaaggtcaaaaagttg

SEQ ID NO: 4913 - DNA, 20 bp, Artificial Sequence
  Synthetic oligonucleotide; AAG chr11 5190447 5190466 5190463 +
gtcaaaaagttgaggcttgt

SEQ ID NO: 4914 - DNA, 20 bp, Artificial Sequence
  Synthetic oligonucleotide; TAG chr11 5190458 5190477 5190474 +
gaggcttgtaagcctccacc

SEQ ID NO: 4915 - DNA, 20 bp, Artificial Sequence
  Synthetic oligonucleotide; CAG chr11 5190465 5190484 5190481 +
gtaagcctccacctagattt

SEQ ID NO: 4916 - DNA, 20 bp, Artificial Sequence
  Synthetic oligonucleotide; GAG chr11 5190467 5190486 5190483 +
aagcctccacctagatttca

SEQ ID NO: 4917 - DNA, 20 bp, Artificial Sequence
  Synthetic oligonucleotide; AGG chr11 5190468 5190487 5190484 +
agcctccacctagatttcag

SEQ ID NO: 4918 - DNA, 20 bp, Artificial Sequence
  Synthetic oligonucleotide; TAG chr11 5190476 5190495 5190492 +
cctagatttcagaggatgtg

SEQ ID NO: 4919 - DNA, 20 bp, Artificial Sequence
  Synthetic oligonucleotide; AAG chr11 5190481 5190500 5190497 +
atttcagaggatgtgtagaa

SEQ ID NO: 4920 - DNA, 20 bp, Artificial Sequence
  Synthetic oligonucleotide; GAG chr11 5190487 5190506 5190503 +
gaggatgtgtagaaaagcct

SEQ ID NO: 4921 - DNA, 20 bp, Artificial Sequence
  Synthetic oligonucleotide; CAG chr11 5190494 5190513 5190510 +
tgtagaaaagcctgagtgtt

SEQ ID NO: 4922 - DNA, 20 bp, Artificial Sequence
  Synthetic oligonucleotide; AGG chr11 5190495 5190514 5190511 +
gtagaaaagcctgagtgttc

SEQ ID NO: 4923 - DNA, 20 bp, Artificial Sequence
  Synthetic oligonucleotide; CAG chr11 5190498 5190517 5190514 +
gaaaagcctgagtgttcagg

SEQ ID NO: 4924 - DNA, 20 bp, Artificial Sequence
  Synthetic oligonucleotide; AAG chr11 5190501 5190520 5190517 +
aagcctgagtgttcaggcag

SEQ ID NO: 4925 - DNA, 20 bp, Artificial Sequence
  Synthetic oligonucleotide; CAG chr11 5190511 5190530 5190527 +
gttcaggcagaagcctcctg

SEQ ID NO: 4926 - DNA, 20 bp, Artificial Sequence
  Synthetic oligonucleotide; AGG chr11 5190512 5190531 5190528 +
ttcaggcagaagcctcctgc

SEQ ID NO: 4927 - DNA, 20 bp, Artificial Sequence
  Synthetic oligonucleotide; GGG chr11 5190513 5190532 5190529 +
tcaggcagaagcctcctgca

SEQ ID NO: 4928 - DNA, 20 bp, Artificial Sequence
  Synthetic oligonucleotide; GGG chr11 5190514 5190533 5190530 +
caggcagaagcctcctgcag

SEQ ID NO: 4929 - DNA, 20 bp, Artificial Sequence
  Synthetic oligonucleotide; CAG chr11 5190517 5190536 5190533 +
gcagaagcctcctgcagggg

SEQ ID NO: 4930 - DNA, 20 bp, Artificial Sequence
  Synthetic oligonucleotide; AAG chr11 5190530 5190549 5190546 +
gcaggggcagaaccctcatg

SEQ ID NO: 4931 - DNA, 20 bp, Artificial Sequence
  Synthetic oligonucleotide; TAG chr11 5190542 5190561 5190558 +
ccctcatgaagaacctctaa

SEQ ID NO: 4932 - DNA, 20 bp, Artificial Sequence
  Synthetic oligonucleotide; AGG chr11 5190543 5190562 5190559 +
cctcatgaagaacctctaat

SEQ ID NO: 4933 - DNA, 20 bp, Artificial Sequence
  Synthetic oligonucleotide; GGG chr11 5190544 5190563 5190560 +
ctcatgaagaacctctaata

SEQ ID NO: 4934 - DNA, 20 bp, Artificial Sequence
  Synthetic oligonucleotide; TGG chr11 5190552 5190571 5190568 +
gaacctctaatagggcaatg

SEQ ID NO: 4935 - DNA, 20 bp, Artificial Sequence
  Synthetic oligonucleotide; GAG chr11 5190554 5190573 5190570 +
acctctaatagggcaatgtg

SEQ ID NO: 4936 - DNA, 20 bp, Artificial Sequence
  Synthetic oligonucleotide; AGG chr11 5190555 5190574 5190571 +
cctctaatagggcaatgtgg

SEQ ID NO: 4937 - DNA, 20 bp, Artificial Sequence
  Synthetic oligonucleotide; GAG chr11 5190566 5190585 5190582 +
gcaatgtggaggaaaaatat

SEQ ID NO: 4938 - DNA, 20 bp, Artificial Sequence
  Synthetic oligonucleotide; AGG chr11 5190567 5190586 5190583 +
caatgtggaggaaaaatatg

SEQ ID NO: 4939 - DNA, 20 bp, Artificial Sequence
  Synthetic oligonucleotide; TGG chr11 5190571 5190590 5190587 +
gtggaggaaaaatatgaggt

SEQ ID NO: 4940 - DNA, 20 bp, Artificial Sequence
  Synthetic oligonucleotide; CAG chr11 5190584 5190603 5190600 +
atgaggttggaaccccctca

SEQ ID NO: 4941 - DNA, 20 bp, Artificial Sequence
  Synthetic oligonucleotide; GAG chr11 5190586 5190605 5190602 +
gaggttggaaccccctcaca

SEQ ID NO: 4942 - DNA, 20 bp, Artificial Sequence
  Synthetic oligonucleotide; TGG chr11 5190596 5190615 5190612 +
ccccctcacagagtctccac

SEQ ID NO: 4943 - DNA, 20 bp, Artificial Sequence
  Synthetic oligonucleotide; GGG chr11 5190597 5190616 5190613 +
cccctcacagagtctccact

SEQ ID NO: 4944 - DNA, 20 bp, Artificial Sequence
  Synthetic oligonucleotide; GGG chr11 5190598 5190617 5190614 +
ccctcacagagtctccactg

SEQ ID NO: 4945 - DNA, 20 bp, Artificial Sequence
  Synthetic oligonucleotide; TAG chr11 5190608 5190627 5190624 +
gtctccactggggcactgcc

SEQ ID NO: 4946 - DNA, 20 bp, Artificial Sequence
  Synthetic oligonucleotide; CAG chr11 5190611 5190630 5190627 +
tccactggggcactgcctag

SEQ ID NO: 4947 - DNA, 20 bp, Artificial Sequence
  Synthetic oligonucleotide; GAG chr11 5190613 5190632 5190629 +
cactggggcactgcctagca

SEQ ID NO: 4948 - DNA, 20 bp, Artificial Sequence
  Synthetic oligonucleotide; GAG chr11 5190620 5190639 5190636 +
gcactgcctagcagagctat

SEQ ID NO: 4949 - DNA, 20 bp, Artificial Sequence
  Synthetic oligonucleotide; AAG chr11 5190625 5190644 5190641 +
gcctagcagagctatgagaa

SEQ ID NO: 4950 - DNA, 20 bp, Artificial Sequence
  Synthetic oligonucleotide; AGG chr11 5190626 5190645 5190642 +
cctagcagagctatgagaaa

SEQ ID NO: 4951 - DNA, 20 bp, Artificial Sequence
  Synthetic oligonucleotide; GGG chr11 5190627 5190646 5190643 +
ctagcagagctatgagaaaa

SEQ ID NO: 4952 - DNA, 20 bp, Artificial Sequence
  Synthetic oligonucleotide; CAG chr11 5190641 5190660 5190657 +
agaaaagggccaccgtcctc

SEQ ID NO: 4953 - DNA, 20 bp, Artificial Sequence
  Synthetic oligonucleotide; CAG chr11 5190648 5190667 5190664 +
ggccaccgtcctccagaccc

SEQ ID NO: 4954 - DNA, 20 bp, Artificial Sequence
  Synthetic oligonucleotide; TGG chr11 5190653 5190672 5190669 +
ccgtcctccagaccccagaa

SEQ ID NO: 4955 - DNA, 20 bp, Artificial Sequence
  Synthetic oligonucleotide; TAG chr11 5190656 5190675 5190672 +
tcctccagaccccagaatgg

SEQ ID NO: 4956 - DNA, 20 bp, Artificial Sequence
  Synthetic oligonucleotide; CAG chr11 5190668 5190687 5190684 +
cagaatggtagatccactga

SEQ ID NO: 4957 - DNA, 20 bp, Artificial Sequence
  Synthetic oligonucleotide; TAG chr11 5190686 5190705 5190702 +
gacagtttgcaccgtgcacc

SEQ ID NO: 4958 - DNA, 20 bp, Artificial Sequence
  Synthetic oligonucleotide; AAG chr11 5190691 5190710 5190707 +
tttgcaccgtgcacctagaa

SEQ ID NO: 4959 - DNA, 20 bp, Artificial Sequence
  Synthetic oligonucleotide; AAG chr11 5190719 5190738 5190735 +
aacactcaatacaatctctt

SEQ ID NO: 4960 - DNA, 20 bp, Artificial Sequence
  Synthetic oligonucleotide; GAG chr11 5190721 5190740 5190737 +
cactcaatacaatctcttaa

SEQ ID NO: 4961 - DNA, 20 bp, Artificial Sequence
  Synthetic oligonucleotide; CAG chr11 5190724 5190743 5190740 +
tcaatacaatctcttaagag

SEQ ID NO: 4962 - DNA, 20 bp, Artificial Sequence
  Synthetic oligonucleotide; CAG chr11 5190727 5190746 5190743 +
atacaatctcttaagagcag

SEQ ID NO: 4963 - DNA, 20 bp, Artificial Sequence
  Synthetic oligonucleotide; CAG chr11 5190730 5190749 5190746 +
caatctcttaagagcagcag

SEQ ID NO: 4964 - DNA, 20 bp, Artificial Sequence
  Synthetic oligonucleotide; AGG chr11 5190731 5190750 5190747 +
aatctcttaagagcagcagc

SEQ ID NO: 4965 - DNA, 20 bp, Artificial Sequence
  Synthetic oligonucleotide; GGG chr11 5190732 5190751 5190748 +
atctcttaagagcagcagca

SEQ ID NO: 4966 - DNA, 20 bp, Artificial Sequence
  Synthetic oligonucleotide; GGG chr11 5190733 5190752 5190749 +
tctcttaagagcagcagcag

SEQ ID NO: 4967 - DNA, 20 bp, Artificial Sequence
  Synthetic oligonucleotide; AAG chr11 5190748 5190767 5190764 +
agcaggggctaaactgtgca

SEQ ID NO: 4968 - DNA, 20 bp, Artificial Sequence
  Synthetic oligonucleotide; TAG chr11 5190754 5190773 5190770 +
ggctaaactgtgcaaagcaa

SEQ ID NO: 4969 - DNA, 20 bp, Artificial Sequence
  Synthetic oligonucleotide; AGG chr11 5190755 5190774 5190771 +
gctaaactgtgcaaagcaat

SEQ ID NO: 4970 - DNA, 20 bp, Artificial Sequence
  Synthetic oligonucleotide; GGG chr11 5190756 5190775 5190772 +
ctaaactgtgcaaagcaata

SEQ ID NO: 4971 - DNA, 20 bp, Artificial Sequence
  Synthetic oligonucleotide; GGG chr11 5190757 5190776 5190773 +
taaactgtgcaaagcaatag

SEQ ID NO: 4972 - DNA, 20 bp, Artificial Sequence
  Synthetic oligonucleotide; TGG chr11 5190760 5190779 5190776 +
actgtgcaaagcaatagggg

SEQ ID NO: 4973 - DNA, 20 bp, Artificial Sequence
  Synthetic oligonucleotide; AAG chr11 5190771 5190790 5190787 +
caataggggtggaactgccc

SEQ ID NO: 4974 - DNA, 20 bp, Artificial Sequence
  Synthetic oligonucleotide; AGG chr11 5190772 5190791 5190788 +
aataggggtggaactgccca

SEQ ID NO: 4975 - DNA, 20 bp, Artificial Sequence
  Synthetic oligonucleotide; TGG chr11 5190778 5190797 5190794 +
ggtggaactgcccaaggcct

SEQ ID NO: 4976 - DNA, 20 bp, Artificial Sequence
  Synthetic oligonucleotide; GGG chr11 5190779 5190798 5190795 +
gtggaactgcccaaggcctt

SEQ ID NO: 4977 - DNA, 20 bp, Artificial Sequence
  Synthetic oligonucleotide; GAG chr11 5190781 5190800 5190797 +
ggaactgcccaaggccttgg

SEQ ID NO: 4978 - DNA, 20 bp, Artificial Sequence
  Synthetic oligonucleotide; CAG chr11 5190798 5190817 5190814 +
tgggagcccacctcttgcat

SEQ ID NO: 4979 - DNA, 20 bp, Artificial Sequence
  Synthetic oligonucleotide; GAG chr11 5190815 5190834 5190831 +
catcagtgtgtccctgatat

SEQ ID NO: 4980 - DNA, 20 bp, Artificial Sequence
  Synthetic oligonucleotide; TGG chr11 5190821 5190840 5190837 +
tgtgtccctgatatgagaca

SEQ ID NO: 4981 - DNA, 20 bp, Artificial Sequence
  Synthetic oligonucleotide; GGG chr11 5190822 5190841 5190838 +
gtgtccctgatatgagacat

SEQ ID NO: 4982 - DNA, 20 bp, Artificial Sequence
  Synthetic oligonucleotide; GGG chr11 5190823 5190842 5190839 +
tgtccctgatatgagacatg

SEQ ID NO: 4983 - DNA, 20 bp, Artificial Sequence
  Synthetic oligonucleotide; AAG chr11 5190829 5190848 5190845 +
tgatatgagacatggggtca

SEQ ID NO: 4984 - DNA, 20 bp, Artificial Sequence
  Synthetic oligonucleotide; AGG chr11 5190830 5190849 5190846 +
gatatgagacatggggtcaa

SEQ ID NO: 4985 - DNA, 20 bp, Artificial Sequence
  Synthetic oligonucleotide; GAG chr11 5190832 5190851 5190848 +
tatgagacatggggtcaaag

SEQ ID NO: 4986 - DNA, 20 bp, Artificial Sequence
  Synthetic oligonucleotide; TGG chr11 5190842 5190861 5190858 +
ggggtcaaaggagattattt

SEQ ID NO: 4987 - DNA, 20 bp, Artificial Sequence
  Synthetic oligonucleotide; GAG chr11 5190844 5190863 5190860 +
ggtcaaaggagattattttg

SEQ ID NO: 4988 - DNA, 20 bp, Artificial Sequence
  Synthetic oligonucleotide; AAG chr11 5190851 5190870 5190867 +
ggagattattttggagtgtt

SEQ ID NO: 4989 - DNA, 20 bp, Artificial Sequence
  Synthetic oligonucleotide; AGG chr11 5190852 5190871 5190868 +
gagattattttggagtgtta

SEQ ID NO: 4990 - DNA, 20 bp, Artificial Sequence
  Synthetic oligonucleotide; AAG chr11 5190884 5190903 5190900 +
gtccgttttaaactgctatg

SEQ ID NO: 4991 - DNA, 20 bp, Artificial Sequence
  Synthetic oligonucleotide; GAG chr11 5190895 5190914 5190911 +
actgctatgaagaaataccc

SEQ ID NO: 4992 - DNA, 20 bp, Artificial Sequence
  Synthetic oligonucleotide; TGG chr11 5190900 5190919 5190916 +
tatgaagaaatacccgagac

SEQ ID NO: 4993 - DNA, 20 bp, Artificial Sequence
  Synthetic oligonucleotide; GGG chr11 5190901 5190920 5190917 +
atgaagaaatacccgagact

SEQ ID NO: 4994 - DNA, 20 bp, Artificial Sequence
  Synthetic oligonucleotide; AAG chr11 5190913 5190932 5190929 +
ccgagactgggtaatttata

SEQ ID NO: 4995 - DNA, 20 bp, Artificial Sequence
  Synthetic oligonucleotide; AAG chr11 5190919 5190938 5190935 +
ctgggtaatttataaagaaa

SEQ ID NO: 4996 - DNA, 20 bp, Artificial Sequence
  Synthetic oligonucleotide; GAG chr11 5190921 5190940 5190937 +
gggtaatttataaagaaaaa

SEQ ID NO: 4997 - DNA, 20 bp, Artificial Sequence
  Synthetic oligonucleotide; TGG chr11 5190930 5190949 5190946 +
ataaagaaaaagagatttaa

SEQ ID NO: 4998 - DNA, 20 bp, Artificial Sequence
  Synthetic oligonucleotide; TAG chr11 5190938 5190957 5190954 +
aaagagatttaatggactca

SEQ ID NO: 4999 - DNA, 20 bp, Artificial Sequence
  Synthetic oligonucleotide; TGG chr11 5190952 5190971 5190968 +
gactcatagatccacattgc

SEQ ID NO: 5000 - DNA, 20 bp, Artificial Sequence
  Synthetic oligonucleotide; GGG chr11 5190953 5190972 5190969 +
actcatagatccacattgct

SEQ ID NO: 5001 - DNA, 20 bp, Artificial Sequence
  Synthetic oligonucleotide; GGG chr11 5190954 5190973 5190970 +
ctcatagatccacattgctg

SEQ ID NO: 5002 - DNA, 20 bp, Artificial Sequence
  Synthetic oligonucleotide; GAG chr11 5190956 5190975 5190972 +
catagatccacattgctggg

SEQ ID NO: 5003 - DNA, 20 bp, Artificial Sequence
  Synthetic oligonucleotide; AGG chr11 5190957 5190976 5190973 +
atagatccacattgctgggg

SEQ ID NO: 5004 - DNA, 20 bp, Artificial Sequence
  Synthetic oligonucleotide; TGG chr11 5190971 5190990 5190987 +
ctggggaggccttacaatca

SEQ ID NO: 5005 - DNA, 20 bp, Artificial Sequence
  Synthetic oligonucleotide; TGG chr11 5190974 5190993 5190990 +
gggaggccttacaatcatgg

SEQ ID NO: 5006 - DNA, 20 bp, Artificial Sequence
  Synthetic oligonucleotide; AAG chr11 5190977 5190996 5190993 +
aggccttacaatcatggtgg

SEQ ID NO: 5007 - DNA, 20 bp, Artificial Sequence
  Synthetic oligonucleotide; AGG chr11 5190978 5190997 5190994 +
ggccttacaatcatggtgga

SEQ ID NO: 5008 - DNA, 20 bp, Artificial Sequence
  Synthetic oligonucleotide; AAG chr11 5190983 5191002 5190999 +
tacaatcatggtggaaggtg

SEQ ID NO: 5009 - DNA, 20 bp, Artificial Sequence
  Synthetic oligonucleotide; AGG chr11 5190984 5191003 5191000 +
acaatcatggtggaaggtga

SEQ ID NO: 5010 - DNA, 20 bp, Artificial Sequence
  Synthetic oligonucleotide; GAG chr11 5190986 5191005 5191002 +
aatcatggtggaaggtgaag

SEQ ID NO: 5011 - DNA, 20 bp, Artificial Sequence
  Synthetic oligonucleotide; AGG chr11 5190987 5191006 5191003 +
atcatggtggaaggtgaagg

SEQ ID NO: 5012 - DNA, 20 bp, Artificial Sequence
  Synthetic oligonucleotide; GAG chr11 5190989 5191008 5191005 +
catggtggaaggtgaaggag

SEQ ID NO: 5013 - DNA, 20 bp, Artificial Sequence
  Synthetic oligonucleotide; AAG chr11 5190994 5191013 5191010 +
tggaaggtgaaggaggagca

SEQ ID NO: 5014 - DNA, 20 bp, Artificial Sequence
  Synthetic oligonucleotide; TGG chr11 5191009 5191028 5191025 +
gagcaaagtcacatctgaca

SEQ ID NO: 5015 - DNA, 20 bp, Artificial Sequence
  Synthetic oligonucleotide; TGG chr11 5191012 5191031 5191028 +
caaagtcacatctgacatgg

SEQ ID NO: 5016 - DNA, 20 bp, Artificial Sequence
  Synthetic oligonucleotide; CAG chr11 5191015 5191034 5191031 +
agtcacatctgacatggtgg

SEQ ID NO: 5017 - DNA, 20 bp, Artificial Sequence
  Synthetic oligonucleotide; AGG chr11 5191016 5191035 5191032 +
gtcacatctgacatggtggc

SEQ ID NO: 5018 - DNA, 20 bp, Artificial Sequence
  Synthetic oligonucleotide; AAG chr11 5191020 5191039 5191036 +
catctgacatggtggcaggc

SEQ ID NO: 5019 - DNA, 20 bp, Artificial Sequence
  Synthetic oligonucleotide; GAG chr11 5191022 5191041 5191038 +
tctgacatggtggcaggcaa

SEQ ID NO: 5020 - DNA, 20 bp, Artificial Sequence
  Synthetic oligonucleotide; GAG chr11 5191024 5191043 5191040 +
tgacatggtggcaggcaaga

SEQ ID NO: 5021 - DNA, 20 bp, Artificial Sequence
  Synthetic oligonucleotide; AAG chr11 5191034 5191053 5191050 +
gcaggcaagagagcatgtgc

SEQ ID NO: 5022 - DNA, 20 bp, Artificial Sequence
  Synthetic oligonucleotide; AGG chr11 5191035 5191054 5191051 +
caggcaagagagcatgtgca

SEQ ID NO: 5023 - DNA, 20 bp, Artificial Sequence
  Synthetic oligonucleotide; GGG chr11 5191036 5191055 5191052 +
aggcaagagagcatgtgcaa

SEQ ID NO: 5024 - DNA, 20 bp, Artificial Sequence
  Synthetic oligonucleotide; CAG chr11 5191060 5191079 5191076 +
aatgccctttataaaaccat

SEQ ID NO: 5025 - DNA, 20 bp, Artificial Sequence
  Synthetic oligonucleotide; GAG chr11 5191070 5191089 5191086 +
ataaaaccatcagatcttgt

SEQ ID NO: 5026 - DNA, 20 bp, Artificial Sequence
  Synthetic oligonucleotide; GAG chr11 5191089 5191108 5191105 +
tgagacttactcactatcat

SEQ ID NO: 5027 - DNA, 20 bp, Artificial Sequence
  Synthetic oligonucleotide; CAG chr11 5191094 5191113 5191110 +
cttactcactatcatgagaa

SEQ ID NO: 5028 - DNA, 20 bp, Artificial Sequence
  Synthetic oligonucleotide; CAG chr11 5191134 5191153 5191150 +
cccatgattcaattacatcc

SEQ ID NO: 5029 - DNA, 20 bp, Artificial Sequence
  Synthetic oligonucleotide; CAG chr11 5191153 5191172 5191169 +
ccagtgtgttccttccatga

SEQ ID NO: 5030 - DNA, 20 bp, Artificial Sequence
  Synthetic oligonucleotide; AGG chr11 5191154 5191173 5191170 +
cagtgtgttccttccatgac

SEQ ID NO: 5031 - DNA, 20 bp, Artificial Sequence
  Synthetic oligonucleotide; CAG chr11 5191157 5191176 5191173 +
tgtgttccttccatgacagg

SEQ ID NO: 5032 - DNA, 20 bp, Artificial Sequence
  Synthetic oligonucleotide; AGG chr11 5191158 5191177 5191174 +
gtgttccttccatgacaggc

SEQ ID NO: 5033 - DNA, 20 bp, Artificial Sequence
  Synthetic oligonucleotide; GGG chr11 5191159 5191178 5191175 +
tgttccttccatgacaggca

SEQ ID NO: 5034 - DNA, 20 bp, Artificial Sequence
  Synthetic oligonucleotide; TGG chr11 5191166 5191185 5191182 +
tccatgacaggcagggatta

SEQ ID NO: 5035 - DNA, 20 bp, Artificial Sequence
  Synthetic oligonucleotide; GGG chr11 5191167 5191186 5191183 +
ccatgacaggcagggattat

SEQ ID NO: 5036 - DNA, 20 bp, Artificial Sequence
  Synthetic oligonucleotide; AAG chr11 5191181 5191200 5191197 +
gattatgggacctactattc

SEQ ID NO: 5037 - DNA, 20 bp, Artificial Sequence
  Synthetic oligonucleotide; AAG chr11 5191184 5191203 5191200 +
tatgggacctactattcaag

SEQ ID NO: 5038 - DNA, 20 bp, Artificial Sequence
  Synthetic oligonucleotide; TGG chr11 5191192 5191211 5191208 +
ctactattcaagaagaaatt

SEQ ID NO: 5039 - DNA, 20 bp, Artificial Sequence
  Synthetic oligonucleotide; GGG chr11 5191193 5191212 5191209 +
tactattcaagaagaaattt

SEQ ID NO: 5040 - DNA, 20 bp, Artificial Sequence
  Synthetic oligonucleotide; TGG chr11 5191196 5191215 5191212 +
tattcaagaagaaatttggg

SEQ ID NO: 5041 - DNA, 20 bp, Artificial Sequence
  Synthetic oligonucleotide; GGG chr11 5191197 5191216 5191213 +
attcaagaagaaatttgggt

SEQ ID NO: 5042 - DNA, 20 bp, Artificial Sequence
  Synthetic oligonucleotide; AAG chr11 5191219 5191238 5191235 +
gaaaactgccaaaccatatc

SEQ ID NO: 5043 - DNA, 20 bp, Artificial Sequence
  Synthetic oligonucleotide; AGG chr11 5191220 5191239 5191236 +
aaaactgccaaaccatatca

SEQ ID NO: 5044 - DNA, 20 bp, Artificial Sequence
  Synthetic oligonucleotide; TGG chr11 5191240 5191259 5191256 +
aggtgtaatgactgccctgc

SEQ ID NO: 5045 - DNA, 20 bp, Artificial Sequence
  Synthetic oligonucleotide; GGG chr11 5191241 5191260 5191257 +
ggtgtaatgactgccctgct

SEQ ID NO: 5046 - DNA, 20 bp, Artificial Sequence
  Synthetic oligonucleotide; TGG chr11 5191257 5191276 5191273 +
tgctgggttttctactcgtg

SEQ ID NO: 5047 - DNA, 20 bp, Artificial Sequence
  Synthetic oligonucleotide; GGG chr11 5191258 5191277 5191274 +
gctgggttttctactcgtgt

SEQ ID NO: 5048 - DNA, 20 bp, Artificial Sequence
  Synthetic oligonucleotide; TAG chr11 5191266 5191285 5191282 +
ttctactcgtgtgggatctt

SEQ ID NO: 5049 - DNA, 20 bp, Artificial Sequence
  Synthetic oligonucleotide; TGG chr11 5191280 5191299 5191296 +
gatctttagcccctttcttt

SEQ ID NO: 5050 - DNA, 20 bp, Artificial Sequence
  Synthetic oligonucleotide; TGG chr11 5191298 5191317 5191314 +
tttggtgcatttctctcttt

SEQ ID NO: 5051 - DNA, 20 bp, Artificial Sequence
  Synthetic oligonucleotide; TGG chr11 5191303 5191322 5191319 +
tgcatttctctcttttggaa

SEQ ID NO: 5052 - DNA, 20 bp, Artificial Sequence
  Synthetic oligonucleotide; GGG chr11 5191304 5191323 5191320 +
gcatttctctcttttggaat

SEQ ID NO: 5053 - DNA, 20 bp, Artificial Sequence
  Synthetic oligonucleotide; CAG chr11 5191323 5191342 5191339 +
tgggaatttgtacccaatgc

SEQ ID NO: 5054 - DNA, 20 bp, Artificial Sequence
  Synthetic oligonucleotide; TGG chr11 5191342 5191361 5191358 +
ccagtacctccattatgtct

SEQ ID NO: 5055 - DNA, 20 bp, Artificial Sequence
  Synthetic oligonucleotide; AAG chr11 5191345 5191364 5191361 +
gtacctccattatgtcttgg

SEQ ID NO: 5056 - DNA, 20 bp, Artificial Sequence
  Synthetic oligonucleotide; CAG chr11 5191371 5191390 5191387 +
ctaacttgtttttgatttta

SEQ ID NO: 5057 - DNA, 20 bp, Artificial Sequence
  Synthetic oligonucleotide; AGG chr11 5191372 5191391 5191388 +
taacttgtttttgattttac

SEQ ID NO: 5058 - DNA, 20 bp, Artificial Sequence
  Synthetic oligonucleotide; TAG chr11 5191379 5191398 5191395 +
tttttgattttacaggctca

SEQ ID NO: 5059 - DNA, 20 bp, Artificial Sequence
  Synthetic oligonucleotide; AGG chr11 5191380 5191399 5191396 +
ttttgattttacaggctcat

SEQ ID NO: 5060 - DNA, 20 bp, Artificial Sequence
  Synthetic oligonucleotide; AAG chr11 5191386 5191405 5191402 +
ttttacaggctcataggttg

SEQ ID NO: 5061 - DNA, 20 bp, Artificial Sequence
  Synthetic oligonucleotide; AGG chr11 5191387 5191406 5191403 +
tttacaggctcataggttga

SEQ ID NO: 5062 - DNA, 20 bp, Artificial Sequence
  Synthetic oligonucleotide; GGG chr11 5191388 5191407 5191404 +
ttacaggctcataggttgaa

SEQ ID NO: 5063 - DNA, 20 bp, Artificial Sequence
  Synthetic oligonucleotide; TGG chr11 5191404 5191423 5191420 +
tgaagggacttgccttgtct

SEQ ID NO: 5064 - DNA, 20 bp, Artificial Sequence
  Synthetic oligonucleotide; AAG chr11 5191409 5191428 5191425 +
ggacttgccttgtcttggat

SEQ ID NO: 5065 - DNA, 20 bp, Artificial Sequence
  Synthetic oligonucleotide; TGG chr11 5191416 5191435 5191432 +
ccttgtcttggataagactt

SEQ ID NO: 5066 - DNA, 20 bp, Artificial Sequence
  Synthetic oligonucleotide; TGG chr11 5191423 5191442 5191439 +
ttggataagactttggactt

SEQ ID NO: 5067 - DNA, 20 bp, Artificial Sequence
  Synthetic oligonucleotide; GAG chr11 5191432 5191451 5191448 +
actttggactttggactttt

SEQ ID NO: 5068 - DNA, 20 bp, Artificial Sequence
  Synthetic oligonucleotide; TGG chr11 5191442 5191461 5191458 +
ttggacttttgagttaatgc

SEQ ID NO: 5069 - DNA, 20 bp, Artificial Sequence
  Synthetic oligonucleotide; GAG chr11 5191448 5191467 5191464 +
ttttgagttaatgctggaat

SEQ ID NO: 5070 - DNA, 20 bp, Artificial Sequence
  Synthetic oligonucleotide; AAG chr11 5191453 5191472 5191469 +
agttaatgctggaatgagtt

SEQ ID NO: 5071 - DNA, 20 bp, Artificial Sequence
  Synthetic oligonucleotide; TAG chr11 5191462 5191481 5191478 +
tggaatgagttaagactttg

SEQ ID NO: 5072 - DNA, 20 bp, Artificial Sequence
  Synthetic oligonucleotide; AGG chr11 5191463 5191482 5191479 +
ggaatgagttaagactttgt

SEQ ID NO: 5073 - DNA, 20 bp, Artificial Sequence
  Synthetic oligonucleotide; TGG chr11 5191471 5191490 5191487 +
ttaagactttgtaggactgt

SEQ ID NO: 5074 - DNA, 20 bp, Artificial Sequence
  Synthetic oligonucleotide; GGG chr11 5191472 5191491 5191488 +
taagactttgtaggactgtt

SEQ ID NO: 5075 - DNA, 20 bp, Artificial Sequence
  Synthetic oligonucleotide; AAG chr11 5191475 5191494 5191491 +
gactttgtaggactgttggg

SEQ ID NO: 5076 - DNA, 20 bp, Artificial Sequence
  Synthetic oligonucleotide; GAG chr11 5191500 5191519 5191516 +
atgattgtattttgtgatgt

SEQ ID NO: 5077 - DNA, 20 bp, Artificial Sequence
  Synthetic oligonucleotide; AAG chr11 5191503 5191522 5191519 +
attgtattttgtgatgtgag

SEQ ID NO: 5078 - DNA, 20 bp, Artificial Sequence
  Synthetic oligonucleotide; GAG chr11 5191511 5191530 5191527 +
ttgtgatgtgagaagaacat

SEQ ID NO: 5079 - DNA, 20 bp, Artificial Sequence
  Synthetic oligonucleotide; TGG chr11 5191517 5191536 5191533 +
tgtgagaagaacatgagatt

SEQ ID NO: 5080 - DNA, 20 bp, Artificial Sequence
  Synthetic oligonucleotide; AAG chr11 5191520 5191539 5191536 +
gagaagaacatgagatttgg

SEQ ID NO: 5081 - DNA, 20 bp, Artificial Sequence
  Synthetic oligonucleotide; AGG chr11 5191521 5191540 5191537 +
agaagaacatgagatttgga

SEQ ID NO: 5082 - DNA, 20 bp, Artificial Sequence
  Synthetic oligonucleotide; GGG chr11 5191522 5191541 5191538 +
gaagaacatgagatttggaa

SEQ ID NO: 5083 - DNA, 20 bp, Artificial Sequence
  Synthetic oligonucleotide; GGG chr11 5191523 5191542 5191539 +
aagaacatgagatttggaag

SEQ ID NO: 5084 - DNA, 20 bp, Artificial Sequence
  Synthetic oligonucleotide; CAG chr11 5191527 5191546 5191543 +
acatgagatttggaaggggc

SEQ ID NO: 5085 - DNA, 20 bp, Artificial Sequence
  Synthetic oligonucleotide; GAG chr11 5191529 5191548 5191545 +
atgagatttggaaggggcca

SEQ ID NO: 5086 - DNA, 20 bp, Artificial Sequence
  Synthetic oligonucleotide; AGG chr11 5191530 5191549 5191546 +
tgagatttggaaggggccag

SEQ ID NO: 5087 - DNA, 20 bp, Artificial Sequence
  Synthetic oligonucleotide; TGG chr11 5191533 5191552 5191549 +
gatttggaaggggccagagg

SEQ ID NO: 5088 - DNA, 20 bp, Artificial Sequence
  Synthetic oligonucleotide; AAG chr11 5191536 5191555 5191552 +
ttggaaggggccagaggtgg

SEQ ID NO: 5089 - DNA, 20 bp, Artificial Sequence
  Synthetic oligonucleotide; AGG chr11 5191537 5191556 5191553 +
tggaaggggccagaggtgga

SEQ ID NO: 5090 - DNA, 20 bp, Artificial Sequence
  Synthetic oligonucleotide; TGG chr11 5191543 5191562 5191559 +
gggccagaggtggaaggata

SEQ ID NO: 5091 - DNA, 20 bp, Artificial Sequence
  Synthetic oligonucleotide; TGG chr11 5191548 5191567 5191564 +
agaggtggaaggatatggtt

SEQ ID NO: 5092 - DNA, 20 bp, Artificial Sequence
  Synthetic oligonucleotide; CAG chr11 5191592 5191611 5191608 +
tcatgttaaattataatcac

SEQ ID NO: 5093 - DNA, 20 bp, Artificial Sequence
  Synthetic oligonucleotide; TGG chr11 5191598 5191617 5191614 +
taaattataatcaccagcgt

SEQ ID NO: 5094 - DNA, 20 bp, Artificial Sequence
  Synthetic oligonucleotide; GAG chr11 5191600 5191619 5191616 +
aattataatcaccagcgttg

SEQ ID NO: 5095 - DNA, 20 bp, Artificial Sequence
  Synthetic oligonucleotide; AGG chr11 5191601 5191620 5191617 +
attataatcaccagcgttgg

SEQ ID NO: 5096 - DNA, 20 bp, Artificial Sequence
  Synthetic oligonucleotide; TGG chr11 5191604 5191623 5191620 +
ataatcaccagcgttggagg

SEQ ID NO: 5097 - DNA, 20 bp, Artificial Sequence
  Synthetic oligonucleotide; GGG chr11 5191605 5191624 5191621 +
taatcaccagcgttggaggt

SEQ ID NO: 5098 - DNA, 20 bp, Artificial Sequence
  Synthetic oligonucleotide; GGG chr11 5191606 5191625 5191622 +
aatcaccagcgttggaggtg

SEQ ID NO: 5099 - DNA, 20 bp, Artificial Sequence
  Synthetic oligonucleotide; TGG chr11 5191614 5191633 5191630 +
gcgttggaggtggggccttg

SEQ ID NO: 5100 - DNA, 20 bp, Artificial Sequence
  Synthetic oligonucleotide; GGG chr11 5191615 5191634 5191631 +
cgttggaggtggggccttgt

SEQ ID NO: 5101 - DNA, 20 bp, Artificial Sequence
  Synthetic oligonucleotide; GAG chr11 5191617 5191636 5191633 +
ttggaggtggggccttgtgg

SEQ ID NO: 5102 - DNA, 20 bp, Artificial Sequence
  Synthetic oligonucleotide; AGG chr11 5191618 5191637 5191634 +
tggaggtggggccttgtggg

SEQ ID NO: 5103 - DNA, 20 bp, Artificial Sequence
  Synthetic oligonucleotide; TGG chr11 5191632 5191651 5191648 +
tgtgggaggtaattcaatca

SEQ ID NO: 5104 - DNA, 20 bp, Artificial Sequence
  Synthetic oligonucleotide; TGG chr11 5191635 5191654 5191651 +
gggaggtaattcaatcatgg

SEQ ID NO: 5105 - DNA, 20 bp, Artificial Sequence
  Synthetic oligonucleotide; CAG chr11 5191638 5191657 5191654 +
aggtaattcaatcatggtgg

SEQ ID NO: 5106 - DNA, 20 bp, Artificial Sequence
  Synthetic oligonucleotide; GAG chr11 5191640 5191659 5191656 +
gtaattcaatcatggtggca

SEQ ID NO: 5107 - DNA, 20 bp, Artificial Sequence
  Synthetic oligonucleotide; CAG chr11 5191650 5191669 5191666 +
catggtggcagagttctcat

SEQ ID NO: 5108 - DNA, 20 bp, Artificial Sequence
  Synthetic oligonucleotide; TAG chr11 5191658 5191677 5191674 +
cagagttctcatcagcgatt

SEQ ID NO: 5109 - DNA, 20 bp, Artificial Sequence
  Synthetic oligonucleotide; TGG chr11 5191673 5191692 5191689 +
cgatttagtaccatccccct

SEQ ID NO: 5110 - DNA, 20 bp, Artificial Sequence
  Synthetic oligonucleotide; TAG chr11 5191683 5191702 5191699 +
ccatcccccttggtactgta

SEQ ID NO: 5111 - DNA, 20 bp, Artificial Sequence
  Synthetic oligonucleotide; GAG chr11 5191687 5191706 5191703 +
cccccttggtactgtatagt

SEQ ID NO: 5112 - DNA, 20 bp, Artificial Sequence
  Synthetic oligonucleotide; AAG chr11 5191695 5191714 5191711 +
gtactgtatagtgagttctc

SEQ ID NO: 5113 - DNA, 20 bp, Artificial Sequence
  Synthetic oligonucleotide; GAG chr11 5191697 5191716 5191713 +
actgtatagtgagttctcaa

SEQ ID NO: 5114 - DNA, 20 bp, Artificial Sequence
  Synthetic oligonucleotide; AGG chr11 5191698 5191717 5191714 +
ctgtatagtgagttctcaag

SEQ ID NO: 5115 - DNA, 20 bp, Artificial Sequence
  Synthetic oligonucleotide; TGG chr11 5191702 5191721 5191718 +
atagtgagttctcaagaggc

SEQ ID NO: 5116 - DNA, 20 bp, Artificial Sequence
  Synthetic oligonucleotide; AAG chr11 5191713 5191732 5191729 +
tcaagaggctggttgtttga

SEQ ID NO: 5117 - DNA, 20 bp, Artificial Sequence
  Synthetic oligonucleotide; TAG chr11 5191720 5191739 5191736 +
gctggttgtttgaaagtgtg

SEQ ID NO: 5118 - DNA, 20 bp, Artificial Sequence
  Synthetic oligonucleotide; TGG chr11 5191750 5191769 5191766 +
taccctgcttctccctgtcc

SEQ ID NO: 5119 - DNA, 20 bp, Artificial Sequence
  Synthetic oligonucleotide; AAG chr11 5191760 5191779 5191776 +
ctccctgtcctggccatgtg

SEQ ID NO: 5120 - DNA, 20 bp, Artificial Sequence
  Synthetic oligonucleotide; AAG chr11 5191798 5191817 5191814 +
ttgtcttctgccatgattgt

SEQ ID NO: 5121 - DNA, 20 bp, Artificial Sequence
  Synthetic oligonucleotide; GAG chr11 5191807 5191826 5191823 +
gccatgattgtaagtttctt

SEQ ID NO: 5122 - DNA, 20 bp, Artificial Sequence
  Synthetic oligonucleotide; AGG chr11 5191808 5191827 5191824 +
ccatgattgtaagtttcttg

SEQ ID NO: 5123 - DNA, 20 bp, Artificial Sequence
  Synthetic oligonucleotide; TAG chr11 5191817 5191836 5191833 +
taagtttcttgaggtctccc

SEQ ID NO: 5124 - DNA, 20 bp, Artificial Sequence
  Synthetic oligonucleotide; AAG chr11 5191820 5191839 5191836 +
gtttcttgaggtctccctag

SEQ ID NO: 5125 - DNA, 20 bp, Artificial Sequence
  Synthetic oligonucleotide; GAG chr11 5191825 5191844 5191841 +
ttgaggtctccctagaagct

SEQ ID NO: 5126 - DNA, 20 bp, Artificial Sequence
  Synthetic oligonucleotide; CAG chr11 5191828 5191847 5191844 +
aggtctccctagaagctgag

SEQ ID NO: 5127 - DNA, 20 bp, Artificial Sequence
  Synthetic oligonucleotide; CAG chr11 5191851 5191870 5191867 +
atgctgccatgcttcttgta

SEQ ID NO: 5128 - DNA, 20 bp, Artificial Sequence
  Synthetic oligonucleotide; AAG chr11 5191858 5191877 5191874 +
catgcttcttgtacagcctg

SEQ ID NO: 5129 - DNA, 20 bp, Artificial Sequence
  Synthetic oligonucleotide; GAG chr11 5191867 5191886 5191883 +
tgtacagcctgaagaacttt

SEQ ID NO: 5130 - DNA, 20 bp, Artificial Sequence
  Synthetic oligonucleotide; CAG chr11 5191901 5191920 5191917 +
tctgttctttataaattacc

SEQ ID NO: 5131 - DNA, 20 bp, Artificial Sequence
  Synthetic oligonucleotide; CAG chr11 5191907 5191926 5191923 +
ctttataaattacccagtct

SEQ ID NO: 5132 - DNA, 20 bp, Artificial Sequence
  Synthetic oligonucleotide; AGG chr11 5191908 5191927 5191924 +
tttataaattacccagtctc

SEQ ID NO: 5133 - DNA, 20 bp, Artificial Sequence
  Synthetic oligonucleotide; CAG chr11 5191921 5191940 5191937 +
cagtctcaggtattttttta

SEQ ID NO: 5134 - DNA, 20 bp, Artificial Sequence
  Synthetic oligonucleotide; CAG chr11 5191924 5191943 5191940 +
tctcaggtatttttttacag

SEQ ID NO: 5135 - DNA, 20 bp, Artificial Sequence
  Synthetic oligonucleotide; AAG chr11 5192035 5192054 5192051 +
ctttgatactcaatgtgatc

SEQ ID NO: 5136 - DNA, 20 bp, Artificial Sequence
  Synthetic oligonucleotide; TGG chr11 5192041 5192060 5192057 +
tactcaatgtgatcaagatt

SEQ ID NO: 5137 - DNA, 20 bp, Artificial Sequence
  Synthetic oligonucleotide; GGG chr11 5192042 5192061 5192058 +
actcaatgtgatcaagattt

SEQ ID NO: 5138 - DNA, 20 bp, Artificial Sequence
  Synthetic oligonucleotide; GAG chr11 5192044 5192063 5192060 +
tcaatgtgatcaagatttgg

SEQ ID NO: 5139 - DNA, 20 bp, Artificial Sequence
  Synthetic oligonucleotide; AAG chr11 5192079 5192098 5192095 +
ctcctctttactcatgtcca

SEQ ID NO: 5140 - DNA, 20 bp, Artificial Sequence
  Synthetic oligonucleotide; AAG chr11 5192101 5192120 5192117 +
gtgacatgaaacctgtatct

SEQ ID NO: 5141 - DNA, 20 bp, Artificial Sequence
  Synthetic oligonucleotide; TGG chr11 5192117 5192136 5192133 +
atctaagtgtgttatctcca

SEQ ID NO: 5142 - DNA, 20 bp, Artificial Sequence
  Synthetic oligonucleotide; GGG chr11 5192118 5192137 5192134 +
tctaagtgtgttatctccat

SEQ ID NO: 5143 - DNA, 20 bp, Artificial Sequence
  Synthetic oligonucleotide; AAG chr11 5192121 5192140 5192137 +
aagtgtgttatctccatggg

SEQ ID NO: 5144 - DNA, 20 bp, Artificial Sequence
  Synthetic oligonucleotide; TAG chr11 5192210 5192229 5192226 +
atctatttcattctatgcaa

SEQ ID NO: 5145 - DNA, 20 bp, Artificial Sequence
  Synthetic oligonucleotide; AAG chr11 5192225 5192244 5192241 +
tgcaatagctgtctgaaact

SEQ ID NO: 5146 - DNA, 20 bp, Artificial Sequence
  Synthetic oligonucleotide; AAG chr11 5192231 5192250 5192247 +
agctgtctgaaactaagtca

SEQ ID NO: 5147 - DNA, 20 bp, Artificial Sequence
  Synthetic oligonucleotide; GAG chr11 5192288 5192307 5192304 +
ttgaatatctatatttgttt

SEQ ID NO: 5148 - DNA, 20 bp, Artificial Sequence
  Synthetic oligonucleotide; AGG chr11 5192289 5192308 5192305 +
tgaatatctatatttgtttg

SEQ ID NO: 5149 - DNA, 20 bp, Artificial Sequence
  Synthetic oligonucleotide; CAG chr11 5192301 5192320 5192317 +
tttgtttgaggaataataat

SEQ ID NO: 5150 - DNA, 20 bp, Artificial Sequence
  Synthetic oligonucleotide; CAG chr11 5192306 5192325 5192322 +
ttgaggaataataatcagaa

SEQ ID NO: 5151 - DNA, 20 bp, Artificial Sequence
  Synthetic oligonucleotide; AAG chr11 5192309 5192328 5192325 +
aggaataataatcagaacag

SEQ ID NO: 5152 - DNA, 20 bp, Artificial Sequence
  Synthetic oligonucleotide; AGG chr11 5192310 5192329 5192326 +
ggaataataatcagaacaga

SEQ ID NO: 5153 - DNA, 20 bp, Artificial Sequence
  Synthetic oligonucleotide; AAG chr11 5192319 5192338 5192335 +
atcagaacagaaggatatga

SEQ ID NO: 5154 - DNA, 20 bp, Artificial Sequence
  Synthetic oligonucleotide; TAG chr11 5192326 5192345 5192342 +
cagaaggatatgaaagacta

SEQ ID NO: 5155 - DNA, 20 bp, Artificial Sequence
  Synthetic oligonucleotide; AGG chr11 5192327 5192346 5192343 +
agaaggatatgaaagactat

SEQ ID NO: 5156 - DNA, 20 bp, Artificial Sequence
  Synthetic oligonucleotide; TGG chr11 5192332 5192351 5192348 +
gatatgaaagactataggaa

SEQ ID NO: 5157 - DNA, 20 bp, Artificial Sequence
  Synthetic oligonucleotide; AAG chr11 5192335 5192354 5192351 +
atgaaagactataggaatgg

SEQ ID NO: 5158 - DNA, 20 bp, Artificial Sequence
  Synthetic oligonucleotide; CAG chr11 5192346 5192365 5192362 +
taggaatggaagtttctcaa

SEQ ID NO: 5159 - DNA, 20 bp, Artificial Sequence
  Synthetic oligonucleotide; AAG chr11 5192350 5192369 5192366 +
aatggaagtttctcaacagc

SEQ ID NO: 5160 - DNA, 20 bp, Artificial Sequence
  Synthetic oligonucleotide; TAG chr11 5192359 5192378 5192375 +
ttctcaacagcaagataaaa

SEQ ID NO: 5161 - DNA, 20 bp, Artificial Sequence
  Synthetic oligonucleotide; AGG chr11 5192360 5192379 5192376 +
tctcaacagcaagataaaat

SEQ ID NO: 5162 - DNA, 20 bp, Artificial Sequence
  Synthetic oligonucleotide; TGG chr11 5192367 5192386 5192383 +
agcaagataaaataggttaa

SEQ ID NO: 5163 - DNA, 20 bp, Artificial Sequence
  Synthetic oligonucleotide; GAG chr11 5192369 5192388 5192385 +
caagataaaataggttaatg

SEQ ID NO: 5164 - DNA, 20 bp, Artificial Sequence
  Synthetic oligonucleotide; TAG chr11 5192379 5192398 5192395 +
taggttaatggagtaatatg

SEQ ID NO: 5165 - DNA, 20 bp, Artificial Sequence
  Synthetic oligonucleotide; GAG chr11 5192381 5192400 5192397 +
ggttaatggagtaatatgta

SEQ ID NO: 5166 - DNA, 20 bp, Artificial Sequence
  Synthetic oligonucleotide; AAG chr11 5192401 5192420 5192417 +
gagaatgatgactataatta

SEQ ID NO: 5167 - DNA, 20 bp, Artificial Sequence
  Synthetic oligonucleotide; AAG chr11 5192414 5192433 5192430 +
ataattaaagaaaatgaatt

SEQ ID NO: 5168 - DNA, 20 bp, Artificial Sequence
  Synthetic oligonucleotide; AAG chr11 5192430 5192449 5192446 +
aattaagcaatatacaatta

SEQ ID NO: 5169 - DNA, 20 bp, Artificial Sequence
  Synthetic oligonucleotide; CAG chr11 5192450 5192469 5192466 +
aagctctttatgtcttttca

SEQ ID NO: 5170 - DNA, 20 bp, Artificial Sequence
  Synthetic oligonucleotide; TAG chr11 5192458 5192477 5192474 +
tatgtcttttcacagcttga

SEQ ID NO: 5171 - DNA, 20 bp, Artificial Sequence
  Synthetic oligonucleotide; TGG chr11 5192497 5192516 5192513 +
ctgaataatattctatccta

SEQ ID NO: 5172 - DNA, 20 bp, Artificial Sequence
  Synthetic oligonucleotide; CAG chr11 5192508 5192527 5192524 +
tctatcctatggatgttcca

SEQ ID NO: 5173 - DNA, 20 bp, Artificial Sequence
  Synthetic oligonucleotide; TGG chr11 5192526 5192545 5192542 +
cacagtttatccattcatct

SEQ ID NO: 5174 - DNA, 20 bp, Artificial Sequence
  Synthetic oligonucleotide; TGG chr11 5192543 5192562 5192559 +
tcttggttactttcaacttt

SEQ ID NO: 5175 - DNA, 20 bp, Artificial Sequence
  Synthetic oligonucleotide; GAG chr11 5192553 5192572 5192569 +
tttcaacttttggcaattat

SEQ ID NO: 5176 - DNA, 20 bp, Artificial Sequence
  Synthetic oligonucleotide; AAG chr11 5192558 5192577 5192574 +
acttttggcaattatgagta

SEQ ID NO: 5177 - DNA, 20 bp, Artificial Sequence
  Synthetic oligonucleotide; TGG chr11 5192574 5192593 5192590 +
agtaaagttcctataaacct

SEQ ID NO: 5178 - DNA, 20 bp, Artificial Sequence
  Synthetic oligonucleotide; TAG chr11 5192578 5192597 5192594 +
aagttcctataaaccttggt

SEQ ID NO: 5179 - DNA, 20 bp, Artificial Sequence
  Synthetic oligonucleotide; TGG chr11 5192595 5192614 5192611 +
ggttagttcatgtctgtgtg

SEQ ID NO: 5180 - DNA, 20 bp, Artificial Sequence
  Synthetic oligonucleotide; TGG chr11 5192618 5192637 5192634 +
acataaatttttgactcatt

SEQ ID NO: 5181 - DNA, 20 bp, Artificial Sequence
  Synthetic oligonucleotide; GGG chr11 5192619 5192638 5192635 +
cataaatttttgactcattt

SEQ ID NO: 5182 - DNA, 20 bp, Artificial Sequence
  Synthetic oligonucleotide; TAG chr11 5192630 5192649 5192646 +
gactcatttgggtaaataca

SEQ ID NO: 5183 - DNA, 20 bp, Artificial Sequence
  Synthetic oligonucleotide; AGG chr11 5192631 5192650 5192647 +
actcatttgggtaaatacat

SEQ ID NO: 5184 - DNA, 20 bp, Artificial Sequence
  Synthetic oligonucleotide; GAG chr11 5192633 5192652 5192649 +
tcatttgggtaaatacatag

SEQ ID NO: 5185 - DNA, 20 bp, Artificial Sequence
  Synthetic oligonucleotide; TGG chr11 5192645 5192664 5192661 +
atacataggagtgtgattgt

SEQ ID NO: 5186 - DNA, 20 bp, Artificial Sequence
  Synthetic oligonucleotide; GGG chr11 5192646 5192665 5192662 +
tacataggagtgtgattgtt

SEQ ID NO: 5187 - DNA, 20 bp, Artificial Sequence
  Synthetic oligonucleotide; AAG chr11 5192658 5192677 5192674 +
tgattgttgggtcacatgaa

SEQ ID NO: 5188 - DNA, 20 bp, Artificial Sequence
  Synthetic oligonucleotide; TAG chr11 5192663 5192682 5192679 +
gttgggtcacatgaaaagac

SEQ ID NO: 5189 - DNA, 20 bp, Artificial Sequence
  Synthetic oligonucleotide; AAG chr11 5192672 5192691 5192688 +
catgaaaagactagttttgt

SEQ ID NO: 5190 - DNA, 20 bp, Artificial Sequence
  Synthetic oligonucleotide; TGG chr11 5192698 5192717 5192714 +
ctgtaaactgtcttccaatt

SEQ ID NO: 5191 - DNA, 20 bp, Artificial Sequence
  Synthetic oligonucleotide; AAG chr11 5192723 5192742 5192739 +
gcactatttctcatccctac

SEQ ID NO: 5192 - DNA, 20 bp, Artificial Sequence
  Synthetic oligonucleotide; AAG chr11 5192730 5192749 5192746 +
ttctcatccctacaagcaat

SEQ ID NO: 5193 - DNA, 20 bp, Artificial Sequence
  Synthetic oligonucleotide; GAG chr11 5192734 5192753 5192750 +
catccctacaagcaataagt

SEQ ID NO: 5194 - DNA, 20 bp, Artificial Sequence
  Synthetic oligonucleotide; GAG chr11 5192736 5192755 5192752 +
tccctacaagcaataagtga

SEQ ID NO: 5195 - DNA, 20 bp, Artificial Sequence
  Synthetic oligonucleotide; CAG chr11 5192762 5192781 5192778 +
ctgttgctccacttcgttgc

SEQ ID NO: 5196 - DNA, 20 bp, Artificial Sequence
  Synthetic oligonucleotide; TGG chr11 5192769 5192788 5192785 +
tccacttcgttgccagtgtt

SEQ ID NO: 5197 - DNA, 20 bp, Artificial Sequence
  Synthetic oligonucleotide; TGG chr11 5192772 5192791 5192788 +
acttcgttgccagtgtttgg

SEQ ID NO: 5198 - DNA, 20 bp, Artificial Sequence
  Synthetic oligonucleotide; CAG chr11 5192779 5192798 5192795 +
tgccagtgtttggtggatgt

SEQ ID NO: 5199 - DNA, 20 bp, Artificial Sequence
  Synthetic oligonucleotide; TGG chr11 5192787 5192806 5192803 +
tttggtggatgtcagtattt

SEQ ID NO: 5200 - DNA, 20 bp, Artificial Sequence
  Synthetic oligonucleotide; TGG chr11 5192794 5192813 5192810 +
gatgtcagtattttggaatt

SEQ ID NO: 5201 - DNA, 20 bp, Artificial Sequence
  Synthetic oligonucleotide; TAG chr11 5192813 5192832 5192829 +
ttggccttctaatatgtgtg

SEQ ID NO: 5202 - DNA, 20 bp, Artificial Sequence
  Synthetic oligonucleotide; TGG chr11 5192816 5192835 5192832 +
gccttctaatatgtgtgtag

SEQ ID NO: 5203 - DNA, 20 bp, Artificial Sequence
  Synthetic oligonucleotide; TGG chr11 5192820 5192839 5192836 +
tctaatatgtgtgtagtggt

SEQ ID NO: 5204 - DNA, 20 bp, Artificial Sequence
  Synthetic oligonucleotide; CAG chr11 5192843 5192862 5192859 +
tatcttcttgttttaatgtg

SEQ ID NO: 5205 - DNA, 20 bp, Artificial Sequence
  Synthetic oligonucleotide; GAG chr11 5192868 5192887 5192884 +
tcttaatgacatgtgttact

SEQ ID NO: 5206 - DNA, 20 bp, Artificial Sequence
  Synthetic oligonucleotide; TGG chr11 5192910 5192929 5192926 +
tgcaatctatatatcttctt

SEQ ID NO: 5207 - DNA, 20 bp, Artificial Sequence
  Synthetic oligonucleotide; AAG chr11 5192915 5192934 5192931 +
tctatatatcttctttggta

SEQ ID NO: 5208 - DNA, 20 bp, Artificial Sequence
  Synthetic oligonucleotide; CAG chr11 5192926 5192945 5192942 +
tctttggtaaagtgtctgtt

SEQ ID NO: 5209 - DNA, 20 bp, Artificial Sequence
  Synthetic oligonucleotide; TGG chr11 5192950 5192969 5192966 +
tcttttgcccactttgcaat

SEQ ID NO: 5210 - DNA, 20 bp, Artificial Sequence
  Synthetic oligonucleotide; TAG chr11 5192971 5192990 5192987 +
ggattgtttgttttttattg

SEQ ID NO: 5211 - DNA, 20 bp, Artificial Sequence
  Synthetic oligonucleotide; AAG chr11 5192982 5193001 5192998 +
tttttattgtagaattttaa

SEQ ID NO: 5212 - DNA, 20 bp, Artificial Sequence
  Synthetic oligonucleotide; AAG chr11 5193006 5193025 5193022 +
tctttgtataatatgtatac

SEQ ID NO: 5213 - DNA, 20 bp, Artificial Sequence
  Synthetic oligonucleotide; CAG chr11 5193017 5193036 5193033 +
tatgtatacaagtcctttat

SEQ ID NO: 5214 - DNA, 20 bp, Artificial Sequence
  Synthetic oligonucleotide; TGG chr11 5193048 5193067 5193064 +
ttttgcaaatatgttctctg

SEQ ID NO: 5215 - DNA, 20 bp, Artificial Sequence
  Synthetic oligonucleotide; TGG chr11 5193108 5193127 5193124 +
tattttattttattttgttc

SEQ ID NO: 5216 - DNA, 20 bp, Artificial Sequence
  Synthetic oligonucleotide; GGG chr11 5193109 5193128 5193125 +
attttattttattttgttct

SEQ ID NO: 5217 - DNA, 20 bp, Artificial Sequence
  Synthetic oligonucleotide; TGG chr11 5193119 5193138 5193135 +
attttgttctgggtattttg

SEQ ID NO: 5218 - DNA, 20 bp, Artificial Sequence
  Synthetic oligonucleotide; CAG chr11 5193156 5193175 5193172 +
aactgctgtgttcttttgtt

SEQ ID NO: 5219 - DNA, 20 bp, Artificial Sequence
  Synthetic oligonucleotide; TAG chr11 5193181 5193200 5193197 +
aattgtcttgtattgatctc

SEQ ID NO: 5220 - DNA, 20 bp, Artificial Sequence
  Synthetic oligonucleotide; AAG chr11 5193185 5193204 5193201 +
gtcttgtattgatctctagt

SEQ ID NO: 5221 - DNA, 20 bp, Artificial Sequence
  Synthetic oligonucleotide; CAG chr11 5193227 5193246 5193243 +
tttcactctctcctgaactc

SEQ ID NO: 5222 - DNA, 20 bp, Artificial Sequence
  Synthetic oligonucleotide; AAG chr11 5193232 5193251 5193248 +
ctctctcctgaactccagtt

SEQ ID NO: 5223 - DNA, 20 bp, Artificial Sequence
  Synthetic oligonucleotide; TGG chr11 5193239 5193258 5193255 +
ctgaactccagttaagattt

SEQ ID NO: 5224 - DNA, 20 bp, Artificial Sequence
  Synthetic oligonucleotide; GAG chr11 5193241 5193260 5193257 +
gaactccagttaagattttg

SEQ ID NO: 5225 - DNA, 20 bp, Artificial Sequence
  Synthetic oligonucleotide; TGG chr11 5193340 5193359 5193356 +
ctacttcctgtcccccttat

SEQ ID NO: 5226 - DNA, 20 bp, Artificial Sequence
  Synthetic oligonucleotide; AAG chr11 5193426 5193445 5193442 +
tactattctgttcaaatatc

SEQ ID NO: 5227 - DNA, 20 bp, Artificial Sequence
  Synthetic oligonucleotide; AGG chr11 5193427 5193446 5193443 +
actattctgttcaaatatca

SEQ ID NO: 5228 - DNA, 20 bp, Artificial Sequence
  Synthetic oligonucleotide; GAG chr11 5193439 5193458 5193455 +
aaatatcaaggatctaaaat

SEQ ID NO: 5229 - DNA, 20 bp, Artificial Sequence
  Synthetic oligonucleotide; TGG chr11 5193442 5193461 5193458 +
tatcaaggatctaaaatgag

SEQ ID NO: 5230 - DNA, 20 bp, Artificial Sequence
  Synthetic oligonucleotide; AAG chr11 5193455 5193474 5193471 +
aaatgagtggttatttaatt

SEQ ID NO: 5231 - DNA, 20 bp, Artificial Sequence
  Synthetic oligonucleotide; TAG chr11 5193486 5193505 5193502 +
ttatgcacctcttttattat

SEQ ID NO: 5232 - DNA, 20 bp, Artificial Sequence
  Synthetic oligonucleotide; AAG chr11 5193510 5193529 5193526 +
ttttattttctgccctgaat

SEQ ID NO: 5233 - DNA, 20 bp, Artificial Sequence
  Synthetic oligonucleotide; AAG chr11 5193526 5193545 5193542 +
gaataagctgtgctccaaat

SEQ ID NO: 5234 - DNA, 20 bp, Artificial Sequence
  Synthetic oligonucleotide; TAG chr11 5193551 5193570 5193567 +
ttctttattaaaattgattc

SEQ ID NO: 5235 - DNA, 20 bp, Artificial Sequence
  Synthetic oligonucleotide; AGG chr11 5193552 5193571 5193568 +
tctttattaaaattgattct

SEQ ID NO: 5236 - DNA, 20 bp, Artificial Sequence
  Synthetic oligonucleotide; TGG chr11 5193571 5193590 5193587 +
taggtatgtaatttttgtgt

SEQ ID NO: 5237 - DNA, 20 bp, Artificial Sequence
  Synthetic oligonucleotide; TGG chr11 5193574 5193593 5193590 +
gtatgtaatttttgtgttgg

SEQ ID NO: 5238 - DNA, 20 bp, Artificial Sequence
  Synthetic oligonucleotide; CGG chr11 5193620 5193639 5193636 +
tttgtccatccttctgtgtc

SEQ ID NO: 5239 - DNA, 20 bp, Artificial Sequence
  Synthetic oligonucleotide; TGG chr11 5193626 5193645 5193642 +
catccttctgtgtccggaat

SEQ ID NO: 5240 - DNA, 20 bp, Artificial Sequence
  Synthetic oligonucleotide; TGG chr11 5193629 5193648 5193645 +
ccttctgtgtccggaattgg

SEQ ID NO: 5241 - DNA, 20 bp, Artificial Sequence
  Synthetic oligonucleotide; GGG chr11 5193630 5193649 5193646 +
cttctgtgtccggaattggt

SEQ ID NO: 5242 - DNA, 20 bp, Artificial Sequence
  Synthetic oligonucleotide; TGG chr11 5193637 5193656 5193653 +
gtccggaattggtgggttct

SEQ ID NO: 5243 - DNA, 20 bp, Artificial Sequence
  Synthetic oligonucleotide; AAG chr11 5193653 5193672 5193669 +
ttcttggtctcgctgactta

SEQ ID NO: 5244 - DNA, 20 bp, Artificial Sequence
  Synthetic oligonucleotide; AAG chr11 5193660 5193679 5193676 +
tctcgctgacttaaagaatg

SEQ ID NO: 5245 - DNA, 20 bp, Artificial Sequence
  Synthetic oligonucleotide; TGG chr11 5193676 5193695 5193692 +
aatgaagccgcgaaccctcg

SEQ ID NO: 5246 - DNA, 20 bp, Artificial Sequence
  Synthetic oligonucleotide; GAG chr11 5193680 5193699 5193696 +
aagccgcgaaccctcgtggt

SEQ ID NO: 5247 - DNA, 20 bp, Artificial Sequence
  Synthetic oligonucleotide; AAG chr11 5193697 5193716 5193713 +
ggtgagtgttacaattctta

SEQ ID NO: 5248 - DNA, 20 bp, Artificial Sequence
  Synthetic oligonucleotide; TGG chr11 5193701 5193720 5193717 +
agtgttacaattcttaaaga

SEQ ID NO: 5249 - DNA, 20 bp, Artificial Sequence
  Synthetic oligonucleotide; AAG chr11 5193712 5193731 5193728 +
tcttaaagatggtgtgttca

SEQ ID NO: 5250 - DNA, 20 bp, Artificial Sequence
  Synthetic oligonucleotide; AGG chr11 5193713 5193732 5193729 +
cttaaagatggtgtgttcaa

SEQ ID NO: 5251 - DNA, 20 bp, Artificial Sequence
  Synthetic oligonucleotide; TGG chr11 5193717 5193736 5193733 +
aagatggtgtgttcaaagga

SEQ ID NO: 5252 - DNA, 20 bp, Artificial Sequence
  Synthetic oligonucleotide; AAG chr11 5193728 5193747 5193744 +
ttcaaaggatggtgtgtcca

SEQ ID NO: 5253 - DNA, 20 bp, Artificial Sequence
  Synthetic oligonucleotide; CAG chr11 5193741 5193760 5193757 +
gtgtccaaagtttgttactt

SEQ ID NO: 5254 - DNA, 20 bp, Artificial Sequence
  Synthetic oligonucleotide; CAG chr11 5193751 5193770 5193767 +
tttgttacttcagatgtgtc

SEQ ID NO: 5255 - DNA, 20 bp, Artificial Sequence
  Synthetic oligonucleotide; GAG chr11 5193753 5193772 5193769 +
tgttacttcagatgtgtcca

SEQ ID NO: 5256 - DNA, 20 bp, Artificial Sequence
  Synthetic oligonucleotide; TGG chr11 5193767 5193786 5193783 +
tgtccagagtttcttccttc

SEQ ID NO: 5257 - DNA, 20 bp, Artificial Sequence
  Synthetic oligonucleotide; CGG chr11 5193778 5193797 5193794 +
tcttccttctggtgtgttca

SEQ ID NO: 5258 - DNA, 20 bp, Artificial Sequence
  Synthetic oligonucleotide; TGG chr11 5193787 5193806 5193803 +
tggtgtgttcacggtcttgc

SEQ ID NO: 5259 - DNA, 20 bp, Artificial Sequence
  Synthetic oligonucleotide; CAG chr11 5193793 5193812 5193809 +
gttcacggtcttgctggctc

SEQ ID NO: 5260 - DNA, 20 bp, Artificial Sequence
  Synthetic oligonucleotide; AGG chr11 5193794 5193813 5193810 +
ttcacggtcttgctggctcc

SEQ ID NO: 5261 - DNA, 20 bp, Artificial Sequence
  Synthetic oligonucleotide; GAG chr11 5193796 5193815 5193812 +
cacggtcttgctggctccag

SEQ ID NO: 5262 - DNA, 20 bp, Artificial Sequence
  Synthetic oligonucleotide; AAG chr11 5193801 5193820 5193817 +
tcttgctggctccaggagtg

SEQ ID NO: 5263 - DNA, 20 bp, Artificial Sequence
  Synthetic oligonucleotide; CAG chr11 5193807 5193826 5193823 +
tggctccaggagtgaagctg

SEQ ID NO: 5264 - DNA, 20 bp, Artificial Sequence
  Synthetic oligonucleotide; CGG chr11 5193817 5193836 5193833 +
agtgaagctgcagaccccca

SEQ ID NO: 5265 - DNA, 20 bp, Artificial Sequence
  Synthetic oligonucleotide; GGG chr11 5193818 5193837 5193834 +
gtgaagctgcagacccccac

SEQ ID NO: 5266 - DNA, 20 bp, Artificial Sequence
  Synthetic oligonucleotide; GGG chr11 5193819 5193838 5193835 +
tgaagctgcagacccccacg

SEQ ID NO: 5267 - DNA, 20 bp, Artificial Sequence
  Synthetic oligonucleotide; GAG chr11 5193821 5193840 5193837 +
aagctgcagacccccacggg

SEQ ID NO: 5268 - DNA, 20 bp, Artificial Sequence
  Synthetic oligonucleotide; CAG chr11 5193829 5193848 5193845 +
gacccccacggggagtgtta

SEQ ID NO: 5269 - DNA, 20 bp, Artificial Sequence
  Synthetic oligonucleotide; AAG chr11 5193838 5193857 5193854 +
ggggagtgttacagctctta

SEQ ID NO: 5270 - DNA, 20 bp, Artificial Sequence
  Synthetic oligonucleotide; AGG chr11 5193839 5193858 5193855 +
gggagtgttacagctcttaa

SEQ ID NO: 5271 - DNA, 20 bp, Artificial Sequence
  Synthetic oligonucleotide; CGG chr11 5193842 5193861 5193858 +
agtgttacagctcttaaagg

SEQ ID NO: 5272 - DNA, 20 bp, Artificial Sequence
  Synthetic oligonucleotide; GAG chr11 5193844 5193863 5193860 +
tgttacagctcttaaaggcg

SEQ ID NO: 5273 - DNA, 20 bp, Artificial Sequence
  Synthetic oligonucleotide; TGG chr11 5193851 5193870 5193867 +
gctcttaaaggcggagcgta

SEQ ID NO: 5274 - DNA, 20 bp, Artificial Sequence
  Synthetic oligonucleotide; GAG chr11 5193853 5193872 5193869 +
tcttaaaggcggagcgtatg

SEQ ID NO: 5275 - DNA, 20 bp, Artificial Sequence
  Synthetic oligonucleotide; TGG chr11 5193875 5193894 5193891 +
gttgctcattcctcctgtct

SEQ ID NO: 5276 - DNA, 20 bp, Artificial Sequence
  Synthetic oligonucleotide; GGG chr11 5193876 5193895 5193892 +
ttgctcattcctcctgtctt

SEQ ID NO: 5277 - DNA, 20 bp, Artificial Sequence
  Synthetic oligonucleotide; TGG chr11 5193896 5193915 5193912 +
gggttgttcatcccccatgc

SEQ ID NO: 5278 - DNA, 20 bp, Artificial Sequence
  Synthetic oligonucleotide; GGG chr11 5193897 5193916 5193913 +
ggttgttcatcccccatgct

SEQ ID NO: 5279 - DNA, 20 bp, Artificial Sequence
  Synthetic oligonucleotide; TGG chr11 5193904 5193923 5193920 +
catcccccatgctgggttcg

SEQ ID NO: 5280 - DNA, 20 bp, Artificial Sequence
  Synthetic oligonucleotide; TGG chr11 5193913 5193932 5193929 +
tgctgggttcgtggtcttgc

SEQ ID NO: 5281 - DNA, 20 bp, Artificial Sequence
  Synthetic oligonucleotide; CAG chr11 5193919 5193938 5193935 +
gttcgtggtcttgctggctt

SEQ ID NO: 5282 - DNA, 20 bp, Artificial Sequence
  Synthetic oligonucleotide; AAG chr11 5193922 5193941 5193938 +
cgtggtcttgctggcttcag

SEQ ID NO: 5283 - DNA, 20 bp, Artificial Sequence
  Synthetic oligonucleotide; AAG chr11 5193927 5193946 5193943 +
tcttgctggcttcagaagtg

SEQ ID NO: 5284 - DNA, 20 bp, Artificial Sequence
  Synthetic oligonucleotide; CAG chr11 5193933 5193952 5193949 +
tggcttcagaagtgaagccg

SEQ ID NO: 5285 - DNA, 20 bp, Artificial Sequence
  Synthetic oligonucleotide; CAG chr11 5193943 5193962 5193959 +
agtgaagccgcagaccttcg

SEQ ID NO: 5286 - DNA, 20 bp, Artificial Sequence
  Synthetic oligonucleotide; GAG chr11 5193947 5193966 5193963 +
aagccgcagaccttcgcagt

SEQ ID NO: 5287 - DNA, 20 bp, Artificial Sequence
  Synthetic oligonucleotide; CAG chr11 5193955 5193974 5193971 +
gaccttcgcagtgagtgtta

SEQ ID NO: 5288 - DNA, 20 bp, Artificial Sequence
  Synthetic oligonucleotide; AAG chr11 5193964 5193983 5193980 +
agtgagtgttacagctcata

SEQ ID NO: 5289 - DNA, 20 bp, Artificial Sequence
  Synthetic oligonucleotide; AGG chr11 5193965 5193984 5193981 +
gtgagtgttacagctcataa

SEQ ID NO: 5290 - DNA, 20 bp, Artificial Sequence
  Synthetic oligonucleotide; CAG chr11 5193968 5193987 5193984 +
agtgttacagctcataaagg

SEQ ID NO: 5291 - DNA, 20 bp, Artificial Sequence
  Synthetic oligonucleotide; CGG chr11 5193973 5193992 5193989 +
tacagctcataaaggcagcg

SEQ ID NO: 5292 - DNA, 20 bp, Artificial Sequence
  Synthetic oligonucleotide; AAG chr11 5193981 5194000 5193997 +
ataaaggcagcgcggatcca

SEQ ID NO: 5293 - DNA, 20 bp, Artificial Sequence
  Synthetic oligonucleotide; GAG chr11 5193983 5194002 5193999 +
aaaggcagcgcggatccaaa

SEQ ID NO: 5294 - DNA, 20 bp, Artificial Sequence
  Synthetic oligonucleotide; GAG chr11 5193987 5194006 5194003 +
gcagcgcggatccaaagagt

SEQ ID NO: 5295 - DNA, 20 bp, Artificial Sequence
  Synthetic oligonucleotide; CAG chr11 5193990 5194009 5194006 +
gcgcggatccaaagagtgag

SEQ ID NO: 5296 - DNA, 20 bp, Artificial Sequence
  Synthetic oligonucleotide; CAG chr11 5193993 5194012 5194009 +
cggatccaaagagtgagcag

SEQ ID NO: 5297 - DNA, 20 bp, Artificial Sequence
  Synthetic oligonucleotide; AAG chr11 5193997 5194016 5194013 +
tccaaagagtgagcagcagt

SEQ ID NO: 5298 - DNA, 20 bp, Artificial Sequence
  Synthetic oligonucleotide; AAG chr11 5194010 5194029 5194026 +
cagcagtaagatttattgtg

SEQ ID NO: 5299 - DNA, 20 bp, Artificial Sequence
  Synthetic oligonucleotide; AAG chr11 5194018 5194037 5194034 +
agatttattgtgaagaataa

SEQ ID NO: 5300 - DNA, 20 bp, Artificial Sequence
  Synthetic oligonucleotide; AAG chr11 5194025 5194044 5194041 +
ttgtgaagaataaaagaaca

SEQ ID NO: 5301 - DNA, 20 bp, Artificial Sequence
  Synthetic oligonucleotide; CAG chr11 5194034 5194053 5194050 +
ataaaagaacaaagcttcca

SEQ ID NO: 5302 - DNA, 20 bp, Artificial Sequence
  Synthetic oligonucleotide; TGG chr11 5194039 5194058 5194055 +
agaacaaagcttccacagca

SEQ ID NO: 5303 - DNA, 20 bp, Artificial Sequence
  Synthetic oligonucleotide; TAG chr11 5194042 5194061 5194058 +
acaaagcttccacagcatgg

SEQ ID NO: 5304 - DNA, 20 bp, Artificial Sequence
  Synthetic oligonucleotide; AGG chr11 5194043 5194062 5194059 +
caaagcttccacagcatggt

SEQ ID NO: 5305 - DNA, 20 bp, Artificial Sequence
  Synthetic oligonucleotide; GGG chr11 5194044 5194063 5194060 +
aaagcttccacagcatggta

SEQ ID NO: 5306 - DNA, 20 bp, Artificial Sequence
  Synthetic oligonucleotide; AAG chr11 5194052 5194071 5194068 +
cacagcatggtagggaaccc

SEQ ID NO: 5307 - DNA, 20 bp, Artificial Sequence
  Synthetic oligonucleotide; CAG chr11 5194056 5194075 5194072 +
gcatggtagggaacccaagt

SEQ ID NO: 5308 - DNA, 20 bp, Artificial Sequence
  Synthetic oligonucleotide; CAG chr11 5194065 5194084 5194081 +
ggaacccaagtcagttgtca

SEQ ID NO: 5309 - DNA, 20 bp, Artificial Sequence
  Synthetic oligonucleotide; TGG chr11 5194069 5194088 5194085 +
cccaagtcagttgtcacagc

SEQ ID NO: 5310 - DNA, 20 bp, Artificial Sequence
  Synthetic oligonucleotide; CGG chr11 5194075 5194094 5194091 +
tcagttgtcacagctggctc

SEQ ID NO: 5311 - DNA, 20 bp, Artificial Sequence
  Synthetic oligonucleotide; CAG chr11 5194078 5194097 5194094 +
gttgtcacagctggctccgg

SEQ ID NO: 5312 - DNA, 20 bp, Artificial Sequence
  Synthetic oligonucleotide; TGG chr11 5194125 5194144 5194141 +
cccacccacatcctgctgat

SEQ ID NO: 5313 - DNA, 20 bp, Artificial Sequence
  Synthetic oligonucleotide; CAG chr11 5194137 5194156 5194153 +
ctgctgattggtccatttta

SEQ ID NO: 5314 - DNA, 20 bp, Artificial Sequence
  Synthetic oligonucleotide; GAG chr11 5194139 5194158 5194155 +
gctgattggtccattttaca

SEQ ID NO: 5315 - DNA, 20 bp, Artificial Sequence
  Synthetic oligonucleotide; GAG chr11 5194141 5194160 5194157 +
tgattggtccattttacaga

SEQ ID NO: 5316 - DNA, 20 bp, Artificial Sequence
  Synthetic oligonucleotide; TGG chr11 5194149 5194168 5194165 +
ccattttacagagagctgat

SEQ ID NO: 5317 - DNA, 20 bp, Artificial Sequence
  Synthetic oligonucleotide; CAG chr11 5194161 5194180 5194177 +
gagctgattggcccatttta

SEQ ID NO: 5318 - DNA, 20 bp, Artificial Sequence
  Synthetic oligonucleotide; GAG chr11 5194163 5194182 5194179 +
gctgattggcccattttaca

SEQ ID NO: 5319 - DNA, 20 bp, Artificial Sequence
  Synthetic oligonucleotide; GAG chr11 5194165 5194184 5194181 +
tgattggcccattttacaga

SEQ ID NO: 5320 - DNA, 20 bp, Artificial Sequence
  Synthetic oligonucleotide; TGG chr11 5194169 5194188 5194185 +
tggcccattttacagagagc

SEQ ID NO: 5321 - DNA, 20 bp, Artificial Sequence
  Synthetic oligonucleotide; TGG chr11 5194173 5194192 5194189 +
ccattttacagagagctggt

SEQ ID NO: 5322 - DNA, 20 bp, Artificial Sequence
  Synthetic oligonucleotide; TGG chr11 5194183 5194202 5194199 +
gagagctggttggtccgttt

SEQ ID NO: 5323 - DNA, 20 bp, Artificial Sequence
  Synthetic oligonucleotide; CAG chr11 5194186 5194205 5194202 +
agctggttggtccgttttgg

SEQ ID NO: 5324 - DNA, 20 bp, Artificial Sequence
  Synthetic oligonucleotide; GAG chr11 5194188 5194207 5194204 +
ctggttggtccgttttggca

SEQ ID NO: 5325 - DNA, 20 bp, Artificial Sequence
  Synthetic oligonucleotide; TGG chr11 5194198 5194217 5194214 +
cgttttggcagagtgctgat

SEQ ID NO: 5326 - DNA, 20 bp, Artificial Sequence
  Synthetic oligonucleotide; GAG chr11 5194217 5194236 5194233 +
ttggtgcatttacaaacctt

SEQ ID NO: 5327 - DNA, 20 bp, Artificial Sequence
  Synthetic oligonucleotide; TAG chr11 5194221 5194240 5194237 +
tgcatttacaaaccttgagc

SEQ ID NO: 5328 - DNA, 20 bp, Artificial Sequence
  Synthetic oligonucleotide; CAG chr11 5194227 5194246 5194243 +
tacaaaccttgagctagaca

SEQ ID NO: 5329 - DNA, 20 bp, Artificial Sequence
  Synthetic oligonucleotide; GAG chr11 5194229 5194248 5194245 +
caaaccttgagctagacaca

SEQ ID NO: 5330 - DNA, 20 bp, Artificial Sequence
  Synthetic oligonucleotide; TAG chr11 5194239 5194258 5194255 +
gctagacacagagtgctgat

SEQ ID NO: 5331 - DNA, 20 bp, Artificial Sequence
  Synthetic oligonucleotide; TAG chr11 5194258 5194277 5194274 +
ttagtgcatttacaatcctt

SEQ ID NO: 5332 - DNA, 20 bp, Artificial Sequence
  Synthetic oligonucleotide; TAG chr11 5194262 5194281 5194278 +
tgcatttacaatcctttagc

SEQ ID NO: 5333 - DNA, 20 bp, Artificial Sequence
  Synthetic oligonucleotide; AAG chr11 5194271 5194290 5194287 +
aatcctttagctagacacaa

SEQ ID NO: 5334 - DNA, 20 bp, Artificial Sequence
  Synthetic oligonucleotide; AAG chr11 5194280 5194299 5194296 +
gctagacacaaaagttctcc

SEQ ID NO: 5335 - DNA, 20 bp, Artificial Sequence
  Synthetic oligonucleotide; TAG chr11 5194290 5194309 5194306 +
aaagttctccaagtccccac

SEQ ID NO: 5336 - DNA, 20 bp, Artificial Sequence
  Synthetic oligonucleotide; TAG chr11 5194295 5194314 5194311 +
tctccaagtccccactagat

SEQ ID NO: 5337 - DNA, 20 bp, Artificial Sequence
  Synthetic oligonucleotide; TAG chr11 5194299 5194318 5194315 +
caagtccccactagattagc

SEQ ID NO: 5338 - DNA, 20 bp, Artificial Sequence
  Synthetic oligonucleotide; CAG chr11 5194305 5194324 5194321 +
cccactagattagctagaca

SEQ ID NO: 5339 - DNA, 20 bp, Artificial Sequence
  Synthetic oligonucleotide; GAG chr11 5194307 5194326 5194323 +
cactagattagctagacaca

SEQ ID NO: 5340 - DNA, 20 bp, Artificial Sequence
  Synthetic oligonucleotide; TGG chr11 5194317 5194336 5194333 +
gctagacacagagcactgat

SEQ ID NO: 5341 - DNA, 20 bp, Artificial Sequence
  Synthetic oligonucleotide; GAG chr11 5194336 5194355 5194352 +
ttggtgcatttacaaacctt

SEQ ID NO: 5342 - DNA, 20 bp, Artificial Sequence
  Synthetic oligonucleotide; TAG chr11 5194340 5194359 5194356 +
tgcatttacaaaccttgagt

SEQ ID NO: 5343 - DNA, 20 bp, Artificial Sequence
  Synthetic oligonucleotide; CAG chr11 5194346 5194365 5194362 +
tacaaaccttgagttagaca

SEQ ID NO: 5344 - DNA, 20 bp, Artificial Sequence
  Synthetic oligonucleotide; TGG chr11 5194358 5194377 5194374 +
gttagacacagattgctgat

SEQ ID NO: 5345 - DNA, 20 bp, Artificial Sequence
  Synthetic oligonucleotide; TAG chr11 5194377 5194396 5194393 +
ttggtgcatttacaaacctt

SEQ ID NO: 5346 - DNA, 20 bp, Artificial Sequence
  Synthetic oligonucleotide; TAG chr11 5194381 5194400 5194397 +
tgcatttacaaacctttagc

SEQ ID NO: 5347 - DNA, 20 bp, Artificial Sequence
  Synthetic oligonucleotide; AAG chr11 5194390 5194409 5194406 +
aaacctttagctagacatga

SEQ ID NO: 5348 - DNA, 20 bp, Artificial Sequence
  Synthetic oligonucleotide; CAG chr11 5194398 5194417 5194414 +
agctagacatgaaagttctc

SEQ ID NO: 5349 - DNA, 20 bp, Artificial Sequence
  Synthetic oligonucleotide; TGG chr11 5194413 5194432 5194429 +
ttctccagttccatatttca

SEQ ID NO: 5350 - DNA, 20 bp, Artificial Sequence
  Synthetic oligonucleotide; GAG chr11 5194417 5194436 5194433 +
ccagttccatatttcatggt

SEQ ID NO: 5351 - DNA, 20 bp, Artificial Sequence
  Synthetic oligonucleotide; AGG chr11 5194418 5194437 5194434 +
cagttccatatttcatggtg

SEQ ID NO: 5352 - DNA, 20 bp, Artificial Sequence
  Synthetic oligonucleotide; AAG chr11 5194425 5194444 5194441 +
atatttcatggtgaggaaca

SEQ ID NO: 5353 - DNA, 20 bp, Artificial Sequence
  Synthetic oligonucleotide; TAG chr11 5194432 5194451 5194448 +
atggtgaggaacaaagaata

SEQ ID NO: 5354 - DNA, 20 bp, Artificial Sequence
  Synthetic oligonucleotide; TGG chr11 5194435 5194454 5194451 +
gtgaggaacaaagaatatag

SEQ ID NO: 5355 - DNA, 20 bp, Artificial Sequence
  Synthetic oligonucleotide; GGG chr11 5194436 5194455 5194452 +
tgaggaacaaagaatatagt

SEQ ID NO: 5356 - DNA, 20 bp, Artificial Sequence
  Synthetic oligonucleotide; GGG chr11 5194437 5194456 5194453 +
gaggaacaaagaatatagtg

SEQ ID NO: 5357 - DNA, 20 bp, Artificial Sequence
  Synthetic oligonucleotide; TGG chr11 5194476 5194495 5194492 +
ttgttcctcaccatgaaata

SEQ ID NO: 5358 - DNA, 20 bp, Artificial Sequence
  Synthetic oligonucleotide; TGG chr11 5194482 5194501 5194498 +
ctcaccatgaaatatggaac

SEQ ID NO: 5359 - DNA, 20 bp, Artificial Sequence
  Synthetic oligonucleotide; GAG chr11 5194484 5194503 5194500 +
caccatgaaatatggaactg

SEQ ID NO: 5360 - DNA, 20 bp, Artificial Sequence
  Synthetic oligonucleotide; TAG chr11 5194499 5194518 5194515 +
aactggagaactttcatgtc

SEQ ID NO: 5361 - DNA, 20 bp, Artificial Sequence
  Synthetic oligonucleotide; AAG chr11 5194505 5194524 5194521 +
agaactttcatgtctagcta

SEQ ID NO: 5362 - DNA, 20 bp, Artificial Sequence
  Synthetic oligonucleotide; AGG chr11 5194506 5194525 5194522 +
gaactttcatgtctagctaa

SEQ ID NO: 5363 - DNA, 20 bp, Artificial Sequence
  Synthetic oligonucleotide; CGG chr11 5194529 5194548 5194545 +
tttgtaaatgcaatttattg

SEQ ID NO: 5364 - DNA, 20 bp, Artificial Sequence
  Synthetic oligonucleotide; TAG chr11 5194544 5194563 5194560 +
tattgcggcactattcacaa

SEQ ID NO: 5365 - DNA, 20 bp, Artificial Sequence
  Synthetic oligonucleotide; AAG chr11 5194549 5194568 5194565 +
cggcactattcacaatagca

SEQ ID NO: 5366 - DNA, 20 bp, Artificial Sequence
  Synthetic oligonucleotide; TGG chr11 5194555 5194574 5194571 +
tattcacaatagcaaagact

SEQ ID NO: 5367 - DNA, 20 bp, Artificial Sequence
  Synthetic oligonucleotide; TAG chr11 5194583 5194602 5194599 +
acccaaatgtccaacaatga

SEQ ID NO: 5368 - DNA, 20 bp, Artificial Sequence
  Synthetic oligonucleotide; TGG chr11 5194588 5194607 5194604 +
aatgtccaacaatgatagac

SEQ ID NO: 5369 - DNA, 20 bp, Artificial Sequence
  Synthetic oligonucleotide; AAG chr11 5194594 5194613 5194610 +
caacaatgatagactggatt

SEQ ID NO: 5370 - DNA, 20 bp, Artificial Sequence
  Synthetic oligonucleotide; TGG chr11 5194603 5194622 5194619 +
tagactggattaagaaaatg

SEQ ID NO: 5371 - DNA, 20 bp, Artificial Sequence
  Synthetic oligonucleotide; TGG chr11 5194619 5194638 5194635 +
aatgtggcacatacacacca

SEQ ID NO: 5372 - DNA, 20 bp, Artificial Sequence
  Synthetic oligonucleotide; CAG chr11 5194631 5194650 5194647 +
acacaccatggaatactatg

SEQ ID NO: 5373 - DNA, 20 bp, Artificial Sequence
  Synthetic oligonucleotide; AAG chr11 5194642 5194661 5194658 +
aatactatgcagccataaaa

SEQ ID NO: 5374 - DNA, 20 bp, Artificial Sequence
  Synthetic oligonucleotide; AGG chr11 5194643 5194662 5194659 +
atactatgcagccataaaaa

SEQ ID NO: 5375 - DNA, 20 bp, Artificial Sequence
  Synthetic oligonucleotide; GAG chr11 5194648 5194667 5194664 +
atgcagccataaaaaaggat

SEQ ID NO: 5376 - DNA, 20 bp, Artificial Sequence
  Synthetic oligonucleotide; TAG chr11 5194664 5194683 5194680 +
ggatgagttcatgtcctttg

SEQ ID NO: 5377 - DNA, 20 bp, Artificial Sequence
  Synthetic oligonucleotide; AGG chr11 5194665 5194684 5194681 +
gatgagttcatgtcctttgt

SEQ ID NO: 5378 - DNA, 20 bp, Artificial Sequence
  Synthetic oligonucleotide; GGG chr11 5194666 5194685 5194682 +
atgagttcatgtcctttgta

SEQ ID NO: 5379 - DNA, 20 bp, Artificial Sequence
  Synthetic oligonucleotide; TGG chr11 5194672 5194691 5194688 +
tcatgtcctttgtagggaca

SEQ ID NO: 5380 - DNA, 20 bp, Artificial Sequence
  Synthetic oligonucleotide; TGG chr11 5194682 5194701 5194698 +
tgtagggacatggatgaaat

SEQ ID NO: 5381 - DNA, 20 bp, Artificial Sequence
  Synthetic oligonucleotide; CAG chr11 5194698 5194717 5194714 +
aaattggaaatcatcattct

SEQ ID NO: 5382 - DNA, 20 bp, Artificial Sequence
  Synthetic oligonucleotide; AAG chr11 5194712 5194731 5194728 +
cattctcagtaaactatcgc

SEQ ID NO: 5383 - DNA, 20 bp, Artificial Sequence
  Synthetic oligonucleotide; AGG chr11 5194713 5194732 5194729 +
attctcagtaaactatcgca

SEQ ID NO: 5384 - DNA, 20 bp, Artificial Sequence
  Synthetic oligonucleotide; TAG chr11 5194748 5194767 5194764 +
acactgcatgttctcactca

SEQ ID NO: 5385 - DNA, 20 bp, Artificial Sequence
  Synthetic oligonucleotide; AGG chr11 5194749 5194768 5194765 +
cactgcatgttctcactcat

SEQ ID NO: 5386 - DNA, 20 bp, Artificial Sequence
  Synthetic oligonucleotide; TGG chr11 5194752 5194771 5194768 +
tgcatgttctcactcatagg

SEQ ID NO: 5387 - DNA, 20 bp, Artificial Sequence
  Synthetic oligonucleotide; GGG chr11 5194753 5194772 5194769 +
gcatgttctcactcataggt

SEQ ID NO: 5388 - DNA, 20 bp, Artificial Sequence
  Synthetic oligonucleotide; GAG chr11 5194767 5194786 5194783 +
ataggtgggaattgaacaat

SEQ ID NO: 5389 - DNA, 20 bp, Artificial Sequence
  Synthetic oligonucleotide; TGG chr11 5194776 5194795 5194792 +
aattgaacaatgagaacaca

SEQ ID NO: 5390 - DNA, 20 bp, Artificial Sequence
  Synthetic oligonucleotide; CAG chr11 5194782 5194801 5194798 +
acaatgagaacacatggaca

SEQ ID NO: 5391 - DNA, 20 bp, Artificial Sequence
  Synthetic oligonucleotide; AGG chr11 5194783 5194802 5194799 +
caatgagaacacatggacac

SEQ ID NO: 5392 - DNA, 20 bp, Artificial Sequence
  Synthetic oligonucleotide; AAG chr11 5194786 5194805 5194802 +
tgagaacacatggacacagg

SEQ ID NO: 5393 - DNA, 20 bp, Artificial Sequence
  Synthetic oligonucleotide; AGG chr11 5194787 5194806 5194803 +
gagaacacatggacacagga

SEQ ID NO: 5394 - DNA, 20 bp, Artificial Sequence
  Synthetic oligonucleotide; GGG chr11 5194788 5194807 5194804 +
agaacacatggacacaggaa

SEQ ID NO: 5395 - DNA, 20 bp, Artificial Sequence
  Synthetic oligonucleotide; GGG chr11 5194789 5194808 5194805 +
gaacacatggacacaggaag

SEQ ID NO: 5396 - DNA, 20 bp, Artificial Sequence
  Synthetic oligonucleotide; TGG chr11 5194804 5194823 5194820 +
ggaaggggaacatcacactc

SEQ ID NO: 5397 - DNA, 20 bp, Artificial Sequence
  Synthetic oligonucleotide; GGG chr11 5194805 5194824 5194821 +
gaaggggaacatcacactct

SEQ ID NO: 5398 - DNA, 20 bp, Artificial Sequence
  Synthetic oligonucleotide; GGG chr11 5194806 5194825 5194822 +
aaggggaacatcacactctg

SEQ ID NO: 5399 - DNA, 20 bp, Artificial Sequence
  Synthetic oligonucleotide; TGG chr11 5194816 5194835 5194832 +
tcacactctggggactgttg

SEQ ID NO: 5400 - DNA, 20 bp, Artificial Sequence
  Synthetic oligonucleotide; GGG chr11 5194817 5194836 5194833 +
cacactctggggactgttgt

SEQ ID NO: 5401 - DNA, 20 bp, Artificial Sequence
  Synthetic oligonucleotide; GGG chr11 5194818 5194837 5194834 +
acactctggggactgttgtg

SEQ ID NO: 5402 - DNA, 20 bp, Artificial Sequence
  Synthetic oligonucleotide; TGG chr11 5194821 5194840 5194837 +
ctctggggactgttgtgggg

SEQ ID NO: 5403 - DNA, 20 bp, Artificial Sequence
  Synthetic oligonucleotide; GGG chr11 5194822 5194841 5194838 +
tctggggactgttgtggggt

SEQ ID NO: 5404 - DNA, 20 bp, Artificial Sequence
  Synthetic oligonucleotide; GGG chr11 5194823 5194842 5194839 +
ctggggactgttgtggggtg

SEQ ID NO: 5405 - DNA, 20 bp, Artificial Sequence
  Synthetic oligonucleotide; GGG chr11 5194824 5194843 5194840 +
tggggactgttgtggggtgg

SEQ ID NO: 5406 - DNA, 20 bp, Artificial Sequence
  Synthetic oligonucleotide; GGG chr11 5194825 5194844 5194841 +
ggggactgttgtggggtggg

SEQ ID NO: 5407 - DNA, 20 bp, Artificial Sequence
  Synthetic oligonucleotide; GAG chr11 5194827 5194846 5194843 +
ggactgttgtggggtggggg

SEQ ID NO: 5408 - DNA, 20 bp, Artificial Sequence
  Synthetic oligonucleotide; AGG chr11 5194828 5194847 5194844 +
gactgttgtggggtgggggg

SEQ ID NO: 5409 - DNA, 20 bp, Artificial Sequence
  Synthetic oligonucleotide; GGG chr11 5194829 5194848 5194845 +
actgttgtggggtgggggga

SEQ ID NO: 5410 - DNA, 20 bp, Artificial Sequence
  Synthetic oligonucleotide; GAG chr11 5194831 5194850 5194847 +
tgttgtggggtggggggagg

SEQ ID NO: 5411 - DNA, 20 bp, Artificial Sequence
  Synthetic oligonucleotide; AGG chr11 5194832 5194851 5194848 +
gttgtggggtggggggaggg

SEQ ID NO: 5412 - DNA, 20 bp, Artificial Sequence
  Synthetic oligonucleotide; GAG chr11 5194834 5194853 5194850 +
tgtggggtggggggagggag

SEQ ID NO: 5413 - DNA, 20 bp, Artificial Sequence
  Synthetic oligonucleotide; AGG chr11 5194835 5194854 5194851 +
gtggggtggggggagggagg

SEQ ID NO: 5414 - DNA, 20 bp, Artificial Sequence
  Synthetic oligonucleotide; GGG chr11 5194836 5194855 5194852 +
tggggtggggggagggagga

SEQ ID NO: 5415 - DNA, 20 bp, Artificial Sequence
  Synthetic oligonucleotide; TAG chr11 5194840 5194859 5194856 +
gtggggggagggaggaggga

SEQ ID NO: 5416 - DNA, 20 bp, Artificial Sequence
  Synthetic oligonucleotide; TAG chr11 5194846 5194865 5194862 +
ggagggaggagggatagcat

SEQ ID NO: 5417 - DNA, 20 bp, Artificial Sequence
  Synthetic oligonucleotide; AGG chr11 5194847 5194866 5194863 +
gagggaggagggatagcatt

SEQ ID NO: 5418 - DNA, 20 bp, Artificial Sequence
  Synthetic oligonucleotide; GAG chr11 5194849 5194868 5194865 +
gggaggagggatagcattag

SEQ ID NO: 5419 - DNA, 20 bp, Artificial Sequence
  Synthetic oligonucleotide; GAG chr11 5194873 5194892 5194889 +
tatacctaatgctaaatgat

SEQ ID NO: 5420 - DNA, 20 bp, Artificial Sequence
  Synthetic oligonucleotide; TGG chr11 5194880 5194899 5194896 +
aatgctaaatgatgagttaa

SEQ ID NO: 5421 - DNA, 20 bp, Artificial Sequence
  Synthetic oligonucleotide; GGG chr11 5194881 5194900 5194897 +
atgctaaatgatgagttaat

SEQ ID NO: 5422 - DNA, 20 bp, Artificial Sequence
  Synthetic oligonucleotide; AAG chr11 5194886 5194905 5194902 +
aaatgatgagttaatgggtg

SEQ ID NO: 5423 - DNA, 20 bp, Artificial Sequence
  Synthetic oligonucleotide; CAG chr11 5194894 5194913 5194910 +
agttaatgggtgaagcacac

SEQ ID NO: 5424 - DNA, 20 bp, Artificial Sequence
  Synthetic oligonucleotide; TGG chr11 5194899 5194918 5194915 +
atgggtgaagcacaccagca

SEQ ID NO: 5425 - DNA, 20 bp, Artificial Sequence
  Synthetic oligonucleotide; AAG chr11 5194958 5194977 5194974 +
cacatgtaccctaaaactta

SEQ ID NO: 5426 - DNA, 20 bp, Artificial Sequence
  Synthetic oligonucleotide; AAG chr11 5194992 5195011 5195008 +
taaaataaaataattttaaa

SEQ ID NO: 5427 - DNA, 20 bp, Artificial Sequence
  Synthetic oligonucleotide; GAG chr11 5194994 5195013 5195010 +
aaataaaataattttaaaaa

SEQ ID NO: 5428 - DNA, 20 bp, Artificial Sequence
  Synthetic oligonucleotide; TAG chr11 5194999 5195018 5195015 +
aaataattttaaaaagagta

SEQ ID NO: 5429 - DNA, 20 bp, Artificial Sequence
  Synthetic oligonucleotide; TGG chr11 5195002 5195021 5195018 +
taattttaaaaagagtatag

SEQ ID NO: 5430 - DNA, 20 bp, Artificial Sequence
  Synthetic oligonucleotide; GGG chr11 5195003 5195022 5195019 +
aattttaaaaagagtatagt

SEQ ID NO: 5431 - DNA, 20 bp, Artificial Sequence
  Synthetic oligonucleotide; GGG chr11 5195004 5195023 5195020 +
attttaaaaagagtatagtg

SEQ ID NO: 5432 - DNA, 20 bp, Artificial Sequence
  Synthetic oligonucleotide; CGG chr11 5195020 5195039 5195036 +
agtggggatttctatgaaca

SEQ ID NO: 5433 - DNA, 20 bp, Artificial Sequence
  Synthetic oligonucleotide; TAG chr11 5195029 5195048 5195045 +
ttctatgaacacggtacaat

SEQ ID NO: 5434 - DNA, 20 bp, Artificial Sequence
  Synthetic oligonucleotide; TGG chr11 5195037 5195056 5195053 +
acacggtacaattagttatc

SEQ ID NO: 5435 - DNA, 20 bp, Artificial Sequence
  Synthetic oligonucleotide; CAG chr11 5195041 5195060 5195057 +
ggtacaattagttatctggc

SEQ ID NO: 5436 - DNA, 20 bp, Artificial Sequence
  Synthetic oligonucleotide; AAG chr11 5195052 5195071 5195068 +
ttatctggccagttactttg

SEQ ID NO: 5437 - DNA, 20 bp, Artificial Sequence
  Synthetic oligonucleotide; AGG chr11 5195053 5195072 5195069 +
tatctggccagttactttga

SEQ ID NO: 5438 - DNA, 20 bp, Artificial Sequence
  Synthetic oligonucleotide; CAG chr11 5195061 5195080 5195077 +
cagttactttgaaggctgat

SEQ ID NO: 5439 - DNA, 20 bp, Artificial Sequence
  Synthetic oligonucleotide; AAG chr11 5195065 5195084 5195081 +
tactttgaaggctgatcaga

SEQ ID NO: 5440 - DNA, 20 bp, Artificial Sequence
  Synthetic oligonucleotide; AAG chr11 5195068 5195087 5195084 +
tttgaaggctgatcagaaag

SEQ ID NO: 5441 - DNA, 20 bp, Artificial Sequence
  Synthetic oligonucleotide; TAG chr11 5195073 5195092 5195089 +
aggctgatcagaaagaagcc

SEQ ID NO: 5442 - DNA, 20 bp, Artificial Sequence
  Synthetic oligonucleotide; CAG chr11 5195082 5195101 5195098 +
agaaagaagcctagctaatc

SEQ ID NO: 5443 - DNA, 20 bp, Artificial Sequence
  Synthetic oligonucleotide; AAG chr11 5195086 5195105 5195102 +
agaagcctagctaatccagt

SEQ ID NO: 5444 - DNA, 20 bp, Artificial Sequence
  Synthetic oligonucleotide; TAG chr11 5195114 5195133 5195130 +
actcaaatgccaatatctat

SEQ ID NO: 5445 - DNA, 20 bp, Artificial Sequence
  Synthetic oligonucleotide; GAG chr11 5195128 5195147 5195144 +
atctattagtcctttctctt

SEQ ID NO: 5446 - DNA, 20 bp, Artificial Sequence
  Synthetic oligonucleotide; CAG chr11 5195132 5195151 5195148 +
attagtcctttctcttgaga

SEQ ID NO: 5447 - DNA, 20 bp, Artificial Sequence
  Synthetic oligonucleotide; TAG chr11 5195194 5195213 5195210 +
ctgtttcatatattacacct

SEQ ID NO: 5448 - DNA, 20 bp, Artificial Sequence
  Synthetic oligonucleotide; TGG chr11 5195200 5195219 5195216 +
catatattacaccttagtcc

SEQ ID NO: 5449 - DNA, 20 bp, Artificial Sequence
  Synthetic oligonucleotide; CAG chr11 5195224 5195243 5195240 +
atcctttgcactgaatttcc

SEQ ID NO: 5450 - DNA, 20 bp, Artificial Sequence
  Synthetic oligonucleotide; TGG chr11 5195231 5195250 5195247 +
gcactgaatttcccagtgtc

SEQ ID NO: 5451 - DNA, 20 bp, Artificial Sequence
  Synthetic oligonucleotide; TGG chr11 5195247 5195266 5195263 +
tgtctggatcatcattgatt

SEQ ID NO: 5452 - DNA, 20 bp, Artificial Sequence
  Synthetic oligonucleotide; CAG chr11 5195256 5195275 5195272 +
catcattgatttggttacta

SEQ ID NO: 5453 - DNA, 20 bp, Artificial Sequence
  Synthetic oligonucleotide; CAG chr11 5195275 5195294 5195291 +
acagacactaatcattttgc

SEQ ID NO: 5454 - DNA, 20 bp, Artificial Sequence
  Synthetic oligonucleotide; AAG chr11 5195283 5195302 5195299 +
taatcattttgccagaacta

SEQ ID NO: 5455 - DNA, 20 bp, Artificial Sequence
  Synthetic oligonucleotide; GAG chr11 5195285 5195304 5195301 +
atcattttgccagaactaaa

SEQ ID NO: 5456 - DNA, 20 bp, Artificial Sequence
  Synthetic oligonucleotide; GAG chr11 5195292 5195311 5195308 +
tgccagaactaaagagaaat

SEQ ID NO: 5457 - DNA, 20 bp, Artificial Sequence
  Synthetic oligonucleotide; TGG chr11 5195299 5195318 5195315 +
actaaagagaaatgagtacc

SEQ ID NO: 5458 - DNA, 20 bp, Artificial Sequence
  Synthetic oligonucleotide; TAG chr11 5195310 5195329 5195326 +
atgagtacctggctatcttt

SEQ ID NO: 5459 - DNA, 20 bp, Artificial Sequence
  Synthetic oligonucleotide; AGG chr11 5195311 5195330 5195327 +
tgagtacctggctatctttt

SEQ ID NO: 5460 - DNA, 20 bp, Artificial Sequence
  Synthetic oligonucleotide; CAG chr11 5195324 5195343 5195340 +
atcttttaggcaaccttaaa

SEQ ID NO: 5461 - DNA, 20 bp, Artificial Sequence
  Synthetic oligonucleotide; AGG chr11 5195325 5195344 5195341 +
tcttttaggcaaccttaaac

SEQ ID NO: 5462 - DNA, 20 bp, Artificial Sequence
  Synthetic oligonucleotide; TAG chr11 5195350 5195369 5195366 +
ttcaccttttctaccatttt

SEQ ID NO: 5463 - DNA, 20 bp, Artificial Sequence
  Synthetic oligonucleotide; AAG chr11 5195377 5195396 5195393 +
acccctcacgaatgctttat

SEQ ID NO: 5464 - DNA, 20 bp, Artificial Sequence
  Synthetic oligonucleotide; CAG chr11 5195397 5195416 5195413 +
aagtaatttctgtgtttttc

SEQ ID NO: 5465 - DNA, 20 bp, Artificial Sequence
  Synthetic oligonucleotide; CAG chr11 5195413 5195432 5195429 +
tttccagaaaatgctctttg

SEQ ID NO: 5466 - DNA, 20 bp, Artificial Sequence
  Synthetic oligonucleotide; TGG chr11 5195433 5195452 5195449 +
cagataacgttttttctcat

SEQ ID NO: 5467 - DNA, 20 bp, Artificial Sequence
  Synthetic oligonucleotide; TAG chr11 5195448 5195467 5195464 +
ctcattggtatccttttctg

SEQ ID NO: 5468 - DNA, 20 bp, Artificial Sequence
  Synthetic oligonucleotide; TAG chr11 5195456 5195475 5195472 +
tatccttttctgtagacata

SEQ ID NO: 5469 - DNA, 20 bp, Artificial Sequence
  Synthetic oligonucleotide; CAG chr11 5195463 5195482 5195479 +
ttctgtagacatatagattt

SEQ ID NO: 5470 - DNA, 20 bp, Artificial Sequence
  Synthetic oligonucleotide; CAG chr11 5195550 5195569 5195566 +
atattgtgctattttcttca

SEQ ID NO: 5471 - DNA, 20 bp, Artificial Sequence
  Synthetic oligonucleotide; TAG chr11 5195571 5195590 5195587 +
agtgtctctgtgtacatcta

SEQ ID NO: 5472 - DNA, 20 bp, Artificial Sequence
  Synthetic oligonucleotide; TAG chr11 5195577 5195596 5195593 +
tctgtgtacatctatagctt

SEQ ID NO: 5473 - DNA, 20 bp, Artificial Sequence
  Synthetic oligonucleotide; TGG chr11 5195580 5195599 5195596 +
gtgtacatctatagctttag

SEQ ID NO: 5474 - DNA, 20 bp, Artificial Sequence
  Synthetic oligonucleotide; TAG chr11 5195585 5195604 5195601 +
catctatagctttagtggat

SEQ ID NO: 5475 - DNA, 20 bp, Artificial Sequence
  Synthetic oligonucleotide; GAG chr11 5195587 5195606 5195603 +
tctatagctttagtggatta

SEQ ID NO: 5476 - DNA, 20 bp, Artificial Sequence
  Synthetic oligonucleotide; AAG chr11 5195591 5195610 5195607 +
tagctttagtggattagaga

SEQ ID NO: 5477 - DNA, 20 bp, Artificial Sequence
  Synthetic oligonucleotide; TAG chr11 5195594 5195613 5195610 +
ctttagtggattagagaaag

SEQ ID NO: 5478 - DNA, 20 bp, Artificial Sequence
  Synthetic oligonucleotide; CAG chr11 5195597 5195616 5195613 +
tagtggattagagaaagtag

SEQ ID NO: 5479 - DNA, 20 bp, Artificial Sequence
  Synthetic oligonucleotide; CAG chr11 5195615 5195634 5195631 +
agcagaaatgaacacatatt

SEQ ID NO: 5480 - DNA, 20 bp, Artificial Sequence
  Synthetic oligonucleotide; CAG chr11 5195623 5195642 5195639 +
tgaacacatattcagtctgc

SEQ ID NO: 5481 - DNA, 20 bp, Artificial Sequence
  Synthetic oligonucleotide; AGG chr11 5195624 5195643 5195640 +
gaacacatattcagtctgcc

SEQ ID NO: 5482 - DNA, 20 bp, Artificial Sequence
  Synthetic oligonucleotide; CAG chr11 5195682 5195701 5195698 +
taaatttatattttattatt

SEQ ID NO: 5483 - DNA, 20 bp, Artificial Sequence
  Synthetic oligonucleotide; CAG chr11 5195687 5195706 5195703 +
ttatattttattattcagta

SEQ ID NO: 5484 - DNA, 20 bp, Artificial Sequence
  Synthetic oligonucleotide; AAG chr11 5195706 5195725 5195722 +
acagaaaaatacataaataa

SEQ ID NO: 5485 - DNA, 20 bp, Artificial Sequence
  Synthetic oligonucleotide; CAG chr11 5195711 5195730 5195727 +
aaaatacataaataaaagta

SEQ ID NO: 5486 - DNA, 20 bp, Artificial Sequence
  Synthetic oligonucleotide; TAG chr11 5195735 5195754 5195751 +
ttgttaaattgacacaaaat

SEQ ID NO: 5487 - DNA, 20 bp, Artificial Sequence
  Synthetic oligonucleotide; AAG chr11 5195741 5195760 5195757 +
aattgacacaaaattagcaa

SEQ ID NO: 5488 - DNA, 20 bp, Artificial Sequence
  Synthetic oligonucleotide; CAG chr11 5195759 5195778 5195775 +
aaaagcttttaacaaacact

SEQ ID NO: 5489 - DNA, 20 bp, Artificial Sequence
  Synthetic oligonucleotide; AAG chr11 5195765 5195784 5195781 +
ttttaacaaacactcagacc

SEQ ID NO: 5490 - DNA, 20 bp, Artificial Sequence
  Synthetic oligonucleotide; AAG chr11 5195769 5195788 5195785 +
aacaaacactcagaccaaga

SEQ ID NO: 5491 - DNA, 20 bp, Artificial Sequence
  Synthetic oligonucleotide; GAG chr11 5195771 5195790 5195787 +
caaacactcagaccaagaaa

SEQ ID NO: 5492 - DNA, 20 bp, Artificial Sequence
  Synthetic oligonucleotide; CAG chr11 5195782 5195801 5195798 +
accaagaaagagaacattac

SEQ ID NO: 5493 - DNA, 20 bp, Artificial Sequence
  Synthetic oligonucleotide; AAG chr11 5195793 5195812 5195809 +
gaacattaccagcatctcaa

SEQ ID NO: 5494 - DNA, 20 bp, Artificial Sequence
  Synthetic oligonucleotide; CAG chr11 5195816 5195835 5195832 +
ctaaacaccgattgattcct

SEQ ID NO: 5495 - DNA, 20 bp, Artificial Sequence
  Synthetic oligonucleotide; TGG chr11 5195822 5195841 5195838 +
accgattgattcctcagttc

SEQ ID NO: 5496 - DNA, 20 bp, Artificial Sequence
  Synthetic oligonucleotide; AAG chr11 5195836 5195855 5195852 +
cagttctggctgcaacctga

SEQ ID NO: 5497 - DNA, 20 bp, Artificial Sequence
  Synthetic oligonucleotide; TGG chr11 5195864 5195883 5195880 +
attttctatgtgccattaca

SEQ ID NO: 5498 - DNA, 20 bp, Artificial Sequence
  Synthetic oligonucleotide; AAG chr11 5195871 5195890 5195887 +
atgtgccattacatggtgcc

SEQ ID NO: 5499 - DNA, 20 bp, Artificial Sequence
  Synthetic oligonucleotide; CAG chr11 5195878 5195897 5195894 +
attacatggtgccaagactg

SEQ ID NO: 5500 - DNA, 20 bp, Artificial Sequence
  Synthetic oligonucleotide; AGG chr11 5195879 5195898 5195895 +
ttacatggtgccaagactgc

SEQ ID NO: 5501 - DNA, 20 bp, Artificial Sequence
  Synthetic oligonucleotide; GGG chr11 5195880 5195899 5195896 +
tacatggtgccaagactgca

SEQ ID NO: 5502 - DNA, 20 bp, Artificial Sequence
  Synthetic oligonucleotide; GGG chr11 5195881 5195900 5195897 +
acatggtgccaagactgcag

SEQ ID NO: 5503 - DNA, 20 bp, Artificial Sequence
  Synthetic oligonucleotide; CAG chr11 5195884 5195903 5195900 +
tggtgccaagactgcagggg

SEQ ID NO: 5504 - DNA, 20 bp, Artificial Sequence
  Synthetic oligonucleotide; TGG chr11 5195902 5195921 5195918 +
ggcagaaaccacacttttac

SEQ ID NO: 5505 - DNA, 20 bp, Artificial Sequence
  Synthetic oligonucleotide; AAG chr11 5195907 5195926 5195923 +
aaaccacacttttactggaa

SEQ ID NO: 5506 - DNA, 20 bp, Artificial Sequence
  Synthetic oligonucleotide; TAG chr11 5195913 5195932 5195929 +
cacttttactggaaaagctt

SEQ ID NO: 5507 - DNA, 20 bp, Artificial Sequence
  Synthetic oligonucleotide; AGG chr11 5195914 5195933 5195930 +
acttttactggaaaagcttt

SEQ ID NO: 5508 - DNA, 20 bp, Artificial Sequence
  Synthetic oligonucleotide; CAG chr11 5195933 5195952 5195949 +
taggacatcgactcctactg

SEQ ID NO: 5509 - DNA, 20 bp, Artificial Sequence
  Synthetic oligonucleotide; AGG chr11 5195934 5195953 5195950 +
aggacatcgactcctactgc

SEQ ID NO: 5510 - DNA, 20 bp, Artificial Sequence
  Synthetic oligonucleotide; GGG chr11 5195935 5195954 5195951 +
ggacatcgactcctactgca

SEQ ID NO: 5511 - DNA, 20 bp, Artificial Sequence
  Synthetic oligonucleotide; GGG chr11 5195936 5195955 5195952 +
gacatcgactcctactgcag

SEQ ID NO: 5512 - DNA, 20 bp, Artificial Sequence
  Synthetic oligonucleotide; TGG chr11 5195945 5195964 5195961 +
tcctactgcaggggtgttct

SEQ ID NO: 5513 - DNA, 20 bp, Artificial Sequence
  Synthetic oligonucleotide; TAG chr11 5195949 5195968 5195965 +
actgcaggggtgttcttggc

SEQ ID NO: 5514 - DNA, 20 bp, Artificial Sequence
  Synthetic oligonucleotide; AGG chr11 5195950 5195969 5195966 +
ctgcaggggtgttcttggct

SEQ ID NO: 5515 - DNA, 20 bp, Artificial Sequence
  Synthetic oligonucleotide; TGG chr11 5195954 5195973 5195970 +
aggggtgttcttggctaggt

SEQ ID NO: 5516 - DNA, 20 bp, Artificial Sequence
  Synthetic oligonucleotide; AAG chr11 5195968 5195987 5195984 +
ctaggttggcattaattttt

SEQ ID NO: 5517 - DNA, 20 bp, Artificial Sequence
  Synthetic oligonucleotide; AAG chr11 5195978 5195997 5195994 +
attaatttttaagtttctgc

SEQ ID NO: 5518 - DNA, 20 bp, Artificial Sequence
  Synthetic oligonucleotide; GAG chr11 5195980 5195999 5195996 +
taatttttaagtttctgcaa

SEQ ID NO: 5519 - DNA, 20 bp, Artificial Sequence
  Synthetic oligonucleotide; TGG chr11 5195988 5196007 5196004 +
aagtttctgcaagagacttc

SEQ ID NO: 5520 - DNA, 20 bp, Artificial Sequence
  Synthetic oligonucleotide; GGG chr11 5195989 5196008 5196005 +
agtttctgcaagagacttct

SEQ ID NO: 5521 - DNA, 20 bp, Artificial Sequence
  Synthetic oligonucleotide; TGG chr11 5195996 5196015 5196012 +
gcaagagacttctgggaaaa

SEQ ID NO: 5522 - DNA, 20 bp, Artificial Sequence
  Synthetic oligonucleotide; TGG chr11 5196020 5196039 5196036 +
ctatttttatttccttcatc

SEQ ID NO: 5523 - DNA, 20 bp, Artificial Sequence
  Synthetic oligonucleotide; GAG chr11 5196022 5196041 5196038 +
atttttatttccttcatctg

SEQ ID NO: 5524 - DNA, 20 bp, Artificial Sequence
  Synthetic oligonucleotide; AGG chr11 5196023 5196042 5196039 +
tttttatttccttcatctgg

SEQ ID NO: 5525 - DNA, 20 bp, Artificial Sequence
  Synthetic oligonucleotide; TAG chr11 5196042 5196061 5196058 +
gaggcctctattcactactc

SEQ ID NO: 5526 - DNA, 20 bp, Artificial Sequence
  Synthetic oligonucleotide; AAG chr11 5196059 5196078 5196075 +
ctctagcaattatcttctgc

SEQ ID NO: 5527 - DNA, 20 bp, Artificial Sequence
  Synthetic oligonucleotide; TGG chr11 5196065 5196084 5196081 +
caattatcttctgcaagtaa

SEQ ID NO: 5528 - DNA, 20 bp, Artificial Sequence
  Synthetic oligonucleotide; TAG chr11 5196080 5196099 5196096 +
agtaatggtaacaaatatcc

SEQ ID NO: 5529 - DNA, 20 bp, Artificial Sequence
  Synthetic oligonucleotide; AGG chr11 5196081 5196100 5196097 +
gtaatggtaacaaatatcct

SEQ ID NO: 5530 - DNA, 20 bp, Artificial Sequence
  Synthetic oligonucleotide; GGG chr11 5196082 5196101 5196098 +
taatggtaacaaatatccta

SEQ ID NO: 5531 - DNA, 20 bp, Artificial Sequence
  Synthetic oligonucleotide; TGG chr11 5196087 5196106 5196103 +
gtaacaaatatcctagggaa

SEQ ID NO: 5532 - DNA, 20 bp, Artificial Sequence
  Synthetic oligonucleotide; GAG chr11 5196089 5196108 5196105 +
aacaaatatcctagggaatg

SEQ ID NO: 5533 - DNA, 20 bp, Artificial Sequence
  Synthetic oligonucleotide; AAG chr11 5196102 5196121 5196118 +
gggaatggagacacaacctc

SEQ ID NO: 5534 - DNA, 20 bp, Artificial Sequence
  Synthetic oligonucleotide; TAG chr11 5196105 5196124 5196121 +
aatggagacacaacctcaag

SEQ ID NO: 5535 - DNA, 20 bp, Artificial Sequence
  Synthetic oligonucleotide; AAG chr11 5196118 5196137 5196134 +
cctcaagtagaacatctctt

SEQ ID NO: 5536 - DNA, 20 bp, Artificial Sequence
  Synthetic oligonucleotide; AAG chr11 5196145 5196164 5196161 +
tttaacaatacgattttgat

SEQ ID NO: 5537 - DNA, 20 bp, Artificial Sequence
  Synthetic oligonucleotide; TAG chr11 5196150 5196169 5196166 +
caatacgattttgataagcc

SEQ ID NO: 5538 - DNA, 20 bp, Artificial Sequence
  Synthetic oligonucleotide; AGG chr11 5196151 5196170 5196167 +
aatacgattttgataagcct

SEQ ID NO: 5539 - DNA, 20 bp, Artificial Sequence
  Synthetic oligonucleotide; TAG chr11 5196158 5196177 5196174 +
ttttgataagcctaggaaaa

SEQ ID NO: 5540 - DNA, 20 bp, Artificial Sequence
  Synthetic oligonucleotide; AGG chr11 5196159 5196178 5196175 +
tttgataagcctaggaaaat

SEQ ID NO: 5541 - DNA, 20 bp, Artificial Sequence
  Synthetic oligonucleotide; GGG chr11 5196160 5196179 5196176 +
ttgataagcctaggaaaata

SEQ ID NO: 5542 - DNA, 20 bp, Artificial Sequence
  Synthetic oligonucleotide; GAG chr11 5196162 5196181 5196178 +
gataagcctaggaaaatagg

SEQ ID NO: 5543 - DNA, 20 bp, Artificial Sequence
  Synthetic oligonucleotide; AGG chr11 5196163 5196182 5196179 +
ataagcctaggaaaataggg

SEQ ID NO: 5544 - DNA, 20 bp, Artificial Sequence
  Synthetic oligonucleotide; TAG chr11 5196168 5196187 5196184 +
cctaggaaaatagggaggta

SEQ ID NO: 5545 - DNA, 20 bp, Artificial Sequence
  Synthetic oligonucleotide; TAG chr11 5196173 5196192 5196189 +
gaaaatagggaggtatagtg

SEQ ID NO: 5546 - DNA, 20 bp, Artificial Sequence
  Synthetic oligonucleotide; GAG chr11 5196175 5196194 5196191 +
aaatagggaggtatagtgta

SEQ ID NO: 5547 - DNA, 20 bp, Artificial Sequence
  Synthetic oligonucleotide; CAG chr11 5196178 5196197 5196194 +
tagggaggtatagtgtagag

SEQ ID NO: 5548 - DNA, 20 bp, Artificial Sequence
  Synthetic oligonucleotide; TGG chr11 5196184 5196203 5196200 +
ggtatagtgtagagcagtcc

SEQ ID NO: 5549 - DNA, 20 bp, Artificial Sequence
  Synthetic oligonucleotide; CAG chr11 5196195 5196214 5196211 +
gagcagtcctggccacttac

SEQ ID NO: 5550 - DNA, 20 bp, Artificial Sequence
  Synthetic oligonucleotide; TGG chr11 5196201 5196220 5196217 +
tcctggccacttaccagtac

SEQ ID NO: 5551 - DNA, 20 bp, Artificial Sequence
  Synthetic oligonucleotide; TGG chr11 5196208 5196227 5196224 +
cacttaccagtactggtccg

SEQ ID NO: 5552 - DNA, 20 bp, Artificial Sequence
  Synthetic oligonucleotide; TAG chr11 5196216 5196235 5196232 +
agtactggtccgtggcctgc

SEQ ID NO: 5553 - DNA, 20 bp, Artificial Sequence
  Synthetic oligonucleotide; AGG chr11 5196217 5196236 5196233 +
gtactggtccgtggcctgct

SEQ ID NO: 5554 - DNA, 20 bp, Artificial Sequence
  Synthetic oligonucleotide; TGG chr11 5196224 5196243 5196240 +
tccgtggcctgctaggaacc

SEQ ID NO: 5555 - DNA, 20 bp, Artificial Sequence
  Synthetic oligonucleotide; CAG chr11 5196232 5196251 5196248 +
ctgctaggaacctggtctca

SEQ ID NO: 5556 - DNA, 20 bp, Artificial Sequence
  Synthetic oligonucleotide; CAG chr11 5196235 5196254 5196251 +
ctaggaacctggtctcacag

SEQ ID NO: 5557 - DNA, 20 bp, Artificial Sequence
  Synthetic oligonucleotide; AGG chr11 5196236 5196255 5196252 +
taggaacctggtctcacagc

SEQ ID NO: 5558 - DNA, 20 bp, Artificial Sequence
  Synthetic oligonucleotide; GGG chr11 5196237 5196256 5196253 +
aggaacctggtctcacagca

SEQ ID NO: 5559 - DNA, 20 bp, Artificial Sequence
  Synthetic oligonucleotide; GGG chr11 5196238 5196257 5196254 +
ggaacctggtctcacagcag

SEQ ID NO: 5560 - DNA, 20 bp, Artificial Sequence
  Synthetic oligonucleotide; GGG chr11 5196239 5196258 5196255 +
gaacctggtctcacagcagg

SEQ ID NO: 5561 - DNA, 20 bp, Artificial Sequence
  Synthetic oligonucleotide; GAG chr11 5196244 5196263 5196260 +
tggtctcacagcagggggat

SEQ ID NO: 5562 - DNA, 20 bp, Artificial Sequence
  Synthetic oligonucleotide; AAG chr11 5196248 5196267 5196264 +
ctcacagcagggggatgagc

SEQ ID NO: 5563 - DNA, 20 bp, Artificial Sequence
  Synthetic oligonucleotide; GAG chr11 5196262 5196281 5196278 +
atgagcaagcattactgcct

SEQ ID NO: 5564 - DNA, 20 bp, Artificial Sequence
  Synthetic oligonucleotide; CGG chr11 5196283 5196302 5196299 +
agctcctcctcctgtcacat

SEQ ID NO: 5565 - DNA, 20 bp, Artificial Sequence
  Synthetic oligonucleotide; CAG chr11 5196286 5196305 5196302 +
tcctcctcctgtcacatcgg

SEQ ID NO: 5566 - DNA, 20 bp, Artificial Sequence
  Synthetic oligonucleotide; TGG chr11 5196289 5196308 5196305 +
tcctcctgtcacatcggcag

SEQ ID NO: 5567 - DNA, 20 bp, Artificial Sequence
  Synthetic oligonucleotide; CGG chr11 5196292 5196311 5196308 +
tcctgtcacatcggcagtgg

SEQ ID NO: 5568 - DNA, 20 bp, Artificial Sequence
  Synthetic oligonucleotide; TAG chr11 5196298 5196317 5196314 +
cacatcggcagtggcggcat

SEQ ID NO: 5569 - DNA, 20 bp, Artificial Sequence
  Synthetic oligonucleotide; TAG chr11 5196308 5196327 5196324 +
gtggcggcattagattctca

SEQ ID NO: 5570 - DNA, 20 bp, Artificial Sequence
  Synthetic oligonucleotide; GAG chr11 5196310 5196329 5196326 +
ggcggcattagattctcata

SEQ ID NO: 5571 - DNA, 20 bp, Artificial Sequence
  Synthetic oligonucleotide; AGG chr11 5196311 5196330 5196327 +
gcggcattagattctcatag

SEQ ID NO: 5572 - DNA, 20 bp, Artificial Sequence
  Synthetic oligonucleotide; AAG chr11 5196319 5196338 5196335 +
agattctcatagaggcatgc

SEQ ID NO: 5573 - DNA, 20 bp, Artificial Sequence
  Synthetic oligonucleotide; AGG chr11 5196320 5196339 5196336 +
gattctcatagaggcatgca

SEQ ID NO: 5574 - DNA, 20 bp, Artificial Sequence
  Synthetic oligonucleotide; GGG chr11 5196321 5196340 5196337 +
attctcatagaggcatgcaa

SEQ ID NO: 5575 - DNA, 20 bp, Artificial Sequence
  Synthetic oligonucleotide; TAG chr11 5196327 5196346 5196343 +
atagaggcatgcaagggatc

SEQ ID NO: 5576 - DNA, 20 bp, Artificial Sequence
  Synthetic oligonucleotide; AGG chr11 5196328 5196347 5196344 +
tagaggcatgcaagggatct

SEQ ID NO: 5577 - DNA, 20 bp, Artificial Sequence
  Synthetic oligonucleotide; CGG chr11 5196334 5196353 5196350 +
catgcaagggatctaggttg

SEQ ID NO: 5578 - DNA, 20 bp, Artificial Sequence
  Synthetic oligonucleotide; GAG chr11 5196345 5196364 5196361 +
tctaggttgcggcttcttat

SEQ ID NO: 5579 - DNA, 20 bp, Artificial Sequence
  Synthetic oligonucleotide; GAG chr11 5196368 5196387 5196384 +
aatctaatgcctaatgctct

SEQ ID NO: 5580 - DNA, 20 bp, Artificial Sequence
  Synthetic oligonucleotide; AGG chr11 5196369 5196388 5196385 +
atctaatgcctaatgctctg

SEQ ID NO: 5581 - DNA, 20 bp, Artificial Sequence
  Synthetic oligonucleotide; TGG chr11 5196372 5196391 5196388 +
taatgcctaatgctctgagg

SEQ ID NO: 5582 - DNA, 20 bp, Artificial Sequence
  Synthetic oligonucleotide; CAG chr11 5196377 5196396 5196393 +
cctaatgctctgaggtggaa

SEQ ID NO: 5583 - DNA, 20 bp, Artificial Sequence
  Synthetic oligonucleotide; AAG chr11 5196423 5196442 5196439 +
ctgcaccttgtcttccacaa

SEQ ID NO: 5584 - DNA, 20 bp, Artificial Sequence
  Synthetic oligonucleotide; CAG chr11 5196426 5196445 5196442 +
caccttgtcttccacaaaag

SEQ ID NO: 5585 - DNA, 20 bp, Artificial Sequence
  Synthetic oligonucleotide; TGG chr11 5196433 5196452 5196449 +
tcttccacaaaagcagtccc

SEQ ID NO: 5586 - DNA, 20 bp, Artificial Sequence
  Synthetic oligonucleotide; AAG chr11 5196450 5196469 5196466 +
ccctggtaccaaaaacattg

SEQ ID NO: 5587 - DNA, 20 bp, Artificial Sequence
  Synthetic oligonucleotide; TGG chr11 5196458 5196477 5196474 +
ccaaaaacattgaagactgc

SEQ ID NO: 5588 - DNA, 20 bp, Artificial Sequence
  Synthetic oligonucleotide; CAG chr11 5196465 5196484 5196481 +
cattgaagactgctggtgta

SEQ ID NO: 5589 - DNA, 20 bp, Artificial Sequence
  Synthetic oligonucleotide; TGG chr11 5196482 5196501 5196498 +
gtacagtgaacatctgcctg

SEQ ID NO: 5590 - DNA, 20 bp, Artificial Sequence
  Synthetic oligonucleotide; TAG chr11 5196494 5196513 5196510 +
tctgcctgtggatttattat

SEQ ID NO: 5591 - DNA, 20 bp, Artificial Sequence
  Synthetic oligonucleotide; CAG chr11 5196497 5196516 5196513 +
gcctgtggatttattattag

SEQ ID NO: 5592 - DNA, 20 bp, Artificial Sequence
  Synthetic oligonucleotide; AAG chr11 5196553 5196572 5196569 +
aatcatgtcctctcacttct

SEQ ID NO: 5593 - DNA, 20 bp, Artificial Sequence
  Synthetic oligonucleotide; TGG chr11 5196575 5196594 5196591 +
gaatcactgatttctcccac

SEQ ID NO: 5594 - DNA, 20 bp, Artificial Sequence
  Synthetic oligonucleotide; TAG chr11 5196582 5196601 5196598 +
tgatttctcccactggacct

SEQ ID NO: 5595 - DNA, 20 bp, Artificial Sequence
  Synthetic oligonucleotide; CGG chr11 5196590 5196609 5196606 +
cccactggaccttagctttt

SEQ ID NO: 5596 - DNA, 20 bp, Artificial Sequence
  Synthetic oligonucleotide; AAG chr11 5196596 5196615 5196612 +
ggaccttagcttttcggtgt

SEQ ID NO: 5597 - DNA, 20 bp, Artificial Sequence
  Synthetic oligonucleotide; GAG chr11 5196598 5196617 5196614 +
accttagcttttcggtgtaa

SEQ ID NO: 5598 - DNA, 20 bp, Artificial Sequence
  Synthetic oligonucleotide; TAG chr11 5196610 5196629 5196626 +
cggtgtaagagttaaatgaa

SEQ ID NO: 5599 - DNA, 20 bp, Artificial Sequence
  Synthetic oligonucleotide; TGG chr11 5196621 5196640 5196637 +
ttaaatgaatagcaattgaa

SEQ ID NO: 5600 - DNA, 20 bp, Artificial Sequence
  Synthetic oligonucleotide; TAG chr11 5196626 5196645 5196642 +
tgaatagcaattgaatggac

SEQ ID NO: 5601 - DNA, 20 bp, Artificial Sequence
  Synthetic oligonucleotide; CGG chr11 5196670 5196689 5196686 +
tacttttgtcaccttgttct

SEQ ID NO: 5602 - DNA, 20 bp, Artificial Sequence
  Synthetic oligonucleotide; AAG chr11 5196718 5196737 5196734 +
taataaccgtgacttcattt

SEQ ID NO: 5603 - DNA, 20 bp, Artificial Sequence
  Synthetic oligonucleotide; AGG chr11 5196719 5196738 5196735 +
aataaccgtgacttcattta

SEQ ID NO: 5604 - DNA, 20 bp, Artificial Sequence
  Synthetic oligonucleotide; CAG chr11 5196722 5196741 5196738 +
aaccgtgacttcatttaagg

SEQ ID NO: 5605 - DNA, 20 bp, Artificial Sequence
  Synthetic oligonucleotide; CAG chr11 5196725 5196744 5196741 +
cgtgacttcatttaaggcag

SEQ ID NO: 5606 - DNA, 20 bp, Artificial Sequence
  Synthetic oligonucleotide; CAG chr11 5196742 5196761 5196758 +
cagcagttacaatgatatga

SEQ ID NO: 5607 - DNA, 20 bp, Artificial Sequence
  Synthetic oligonucleotide; AAG chr11 5196764 5196783 5196780 +
gtctacctattaaaaaaaaa

SEQ ID NO: 5608 - DNA, 20 bp, Artificial Sequence
  Synthetic oligonucleotide; AGG chr11 5196765 5196784 5196781 +
tctacctattaaaaaaaaaa

SEQ ID NO: 5609 - DNA, 20 bp, Artificial Sequence
  Synthetic oligonucleotide; AAG chr11 5196771 5196790 5196787 +
tattaaaaaaaaaaaggcaa

SEQ ID NO: 5610 - DNA, 20 bp, Artificial Sequence
  Synthetic oligonucleotide; GAG chr11 5196773 5196792 5196789 +
ttaaaaaaaaaaaggcaaaa

SEQ ID NO: 5611 - DNA, 20 bp, Artificial Sequence
  Synthetic oligonucleotide; TGG chr11 5196800 5196819 5196816 +
gtgtttccctaacatcactg

SEQ ID NO: 5612 - DNA, 20 bp, Artificial Sequence
  Synthetic oligonucleotide; CAG chr11 5196822 5196841 5196838 +
gctgttttcgtaacgtttct

SEQ ID NO: 5613 - DNA, 20 bp, Artificial Sequence
  Synthetic oligonucleotide; TGG chr11 5196831 5196850 5196847 +
gtaacgtttctcagtgacgc

SEQ ID NO: 5614 - DNA, 20 bp, Artificial Sequence
  Synthetic oligonucleotide; TAG chr11 5196835 5196854 5196851 +
cgtttctcagtgacgctgga

SEQ ID NO: 5615 - DNA, 20 bp, Artificial Sequence
  Synthetic oligonucleotide; TAG chr11 5196838 5196857 5196854 +
ttctcagtgacgctggatag

SEQ ID NO: 5616 - DNA, 20 bp, Artificial Sequence
  Synthetic oligonucleotide; CAG chr11 5196846 5196865 5196862 +
gacgctggatagtagccttg

SEQ ID NO: 5617 - DNA, 20 bp, Artificial Sequence
  Synthetic oligonucleotide; AGG chr11 5196847 5196866 5196863 +
acgctggatagtagccttgc

SEQ ID NO: 5618 - DNA, 20 bp, Artificial Sequence
  Synthetic oligonucleotide; AAG chr11 5196857 5196876 5196873 +
gtagccttgcaggccttaca

SEQ ID NO: 5619 - DNA, 20 bp, Artificial Sequence
  Synthetic oligonucleotide; AGG chr11 5196858 5196877 5196874 +
tagccttgcaggccttacaa

SEQ ID NO: 5620 - DNA, 20 bp, Artificial Sequence
  Synthetic oligonucleotide; TGG chr11 5196882 5196901 5196898 +
atctgataactgcttctcac

SEQ ID NO: 5621 - DNA, 20 bp, Artificial Sequence
  Synthetic oligonucleotide; CAG chr11 5196890 5196909 5196906 +
actgcttctcactggctctg

SEQ ID NO: 5622 - DNA, 20 bp, Artificial Sequence
  Synthetic oligonucleotide; AGG chr11 5196891 5196910 5196907 +
ctgcttctcactggctctgc

SEQ ID NO: 5623 - DNA, 20 bp, Artificial Sequence
  Synthetic oligonucleotide; CAG chr11 5196909 5196928 5196925 +
gcaggctaccacatcaacaa

SEQ ID NO: 5624 - DNA, 20 bp, Artificial Sequence
  Synthetic oligonucleotide; CAG chr11 5196915 5196934 5196931 +
taccacatcaacaacagttt

SEQ ID NO: 5625 - DNA, 20 bp, Artificial Sequence
  Synthetic oligonucleotide; TGG chr11 5196936 5196955 5196952 +
agctgttgttgcctaattca

SEQ ID NO: 5626 - DNA, 20 bp, Artificial Sequence
  Synthetic oligonucleotide; AAG chr11 5196944 5196963 5196960 +
ttgcctaattcatggaaaac

SEQ ID NO: 5627 - DNA, 20 bp, Artificial Sequence
  Synthetic oligonucleotide; TAG chr11 5196953 5196972 5196969 +
tcatggaaaacaagtttcct

SEQ ID NO: 5628 - DNA, 20 bp, Artificial Sequence
  Synthetic oligonucleotide; AAG chr11 5196956 5196975 5196972 +
tggaaaacaagtttccttag

SEQ ID NO: 5629 - DNA, 20 bp, Artificial Sequence
  Synthetic oligonucleotide; TGG chr11 5196960 5196979 5196976 +
aaacaagtttccttagaagc

SEQ ID NO: 5630 - DNA, 20 bp, Artificial Sequence
  Synthetic oligonucleotide; GAG chr11 5196969 5196988 5196985 +
tccttagaagctggcttttt

SEQ ID NO: 5631 - DNA, 20 bp, Artificial Sequence
  Synthetic oligonucleotide; TGG chr11 5196977 5196996 5196993 +
agctggctttttgagatata

SEQ ID NO: 5632 - DNA, 20 bp, Artificial Sequence
  Synthetic oligonucleotide; TGG chr11 5196995 5197014 5197011 +
tatggaaaaatgtctccacc

SEQ ID NO: 5633 - DNA, 20 bp, Artificial Sequence
  Synthetic oligonucleotide; TAG chr11 5197006 5197025 5197022 +
gtctccacctggctactatg

SEQ ID NO: 5634 - DNA, 20 bp, Artificial Sequence
  Synthetic oligonucleotide; CAG chr11 5197019 5197038 5197035 +
tactatgtagcttttcaaaa

SEQ ID NO: 5635 - DNA, 20 bp, Artificial Sequence
  Synthetic oligonucleotide; CAG chr11 5197023 5197042 5197039 +
atgtagcttttcaaaacaga

SEQ ID NO: 5636 - DNA, 20 bp, Artificial Sequence
  Synthetic oligonucleotide; CAG chr11 5197066 5197085 5197082 +
tctccatctgctcttccttt

SEQ ID NO: 5637 - DNA, 20 bp, Artificial Sequence
  Synthetic oligonucleotide; AGG chr11 5197067 5197086 5197083 +
ctccatctgctcttcctttc

SEQ ID NO: 5638 - DNA, 20 bp, Artificial Sequence
  Synthetic oligonucleotide; TGG chr11 5197073 5197092 5197089 +
ctgctcttcctttcaggacc

SEQ ID NO: 5639 - DNA, 20 bp, Artificial Sequence
  Synthetic oligonucleotide; GGG chr11 5197074 5197093 5197090 +
tgctcttcctttcaggacct

SEQ ID NO: 5640 - DNA, 20 bp, Artificial Sequence
  Synthetic oligonucleotide; CAG chr11 5197107 5197126 5197123 +
tgaaattgccttttcttcct

SEQ ID NO: 5641 - DNA, 20 bp, Artificial Sequence
  Synthetic oligonucleotide; AGG chr11 5197108 5197127 5197124 +
gaaattgccttttcttcctc

SEQ ID NO: 5642 - DNA, 20 bp, Artificial Sequence
  Synthetic oligonucleotide; GAG chr11 5197110 5197129 5197126 +
aattgccttttcttcctcag

SEQ ID NO: 5643 - DNA, 20 bp, Artificial Sequence
  Synthetic oligonucleotide; GAG chr11 5197112 5197131 5197128 +
ttgccttttcttcctcagga

SEQ ID NO: 5644 - DNA, 20 bp, Artificial Sequence
  Synthetic oligonucleotide; AGG chr11 5197113 5197132 5197129 +
tgccttttcttcctcaggag

SEQ ID NO: 5645 - DNA, 20 bp, Artificial Sequence
  Synthetic oligonucleotide; TAG chr11 5197118 5197137 5197134 +
tttcttcctcaggagaggtt

SEQ ID NO: 5646 - DNA, 20 bp, Artificial Sequence
  Synthetic oligonucleotide; AAG chr11 5197131 5197150 5197147 +
agaggtttagttattttttt

SEQ ID NO: 5647 - DNA, 20 bp, Artificial Sequence
  Synthetic oligonucleotide; CAG chr11 5197144 5197163 5197160 +
tttttttaagtaattgcttc

SEQ ID NO: 5648 - DNA, 20 bp, Artificial Sequence
  Synthetic oligonucleotide; TAG chr11 5197148 5197167 5197164 +
tttaagtaattgcttccaga

SEQ ID NO: 5649 - DNA, 20 bp, Artificial Sequence
  Synthetic oligonucleotide; GAG chr11 5197150 5197169 5197166 +
taagtaattgcttccagata

SEQ ID NO: 5650 - DNA, 20 bp, Artificial Sequence
  Synthetic oligonucleotide; AGG chr11 5197151 5197170 5197167 +
aagtaattgcttccagatag

SEQ ID NO: 5651 - DNA, 20 bp, Artificial Sequence
  Synthetic oligonucleotide; AAG chr11 5197212 5197231 5197228 +
aacctgtttctttctgtata

SEQ ID NO: 5652 - DNA, 20 bp, Artificial Sequence
  Synthetic oligonucleotide; CAG chr11 5197217 5197236 5197233 +
gtttctttctgtataaagcc

SEQ ID NO: 5653 - DNA, 20 bp, Artificial Sequence
  Synthetic oligonucleotide; AAG chr11 5197230 5197249 5197246 +
taaagcccagtaatcatata

SEQ ID NO: 5654 - DNA, 20 bp, Artificial Sequence
  Synthetic oligonucleotide; TGG chr11 5197244 5197263 5197260 +
catataaagtttactttcat

SEQ ID NO: 5655 - DNA, 20 bp, Artificial Sequence
  Synthetic oligonucleotide; TGG chr11 5197282 5197301 5197298 +
tttactgattttcctccctt

SEQ ID NO: 5656 - DNA, 20 bp, Artificial Sequence
  Synthetic oligonucleotide; AAG chr11 5197295 5197314 5197311 +
ctccctttggctgaattgta

SEQ ID NO: 5657 - DNA, 20 bp, Artificial Sequence
  Synthetic oligonucleotide; AAG chr11 5197304 5197323 5197320 +
gctgaattgtaaagattctg

SEQ ID NO: 5658 - DNA, 20 bp, Artificial Sequence
  Synthetic oligonucleotide; TAG chr11 5197329 5197348 5197345 +
cttcataaatcttatcatca

SEQ ID NO: 5659 - DNA, 20 bp, Artificial Sequence
  Synthetic oligonucleotide; TAG chr11 5197342 5197361 5197358 +
atcatcatagtacaattata

SEQ ID NO: 5660 - DNA, 20 bp, Artificial Sequence
  Synthetic oligonucleotide; AAG chr11 5197354 5197373 5197370 +
caattatatagctctaaaat

SEQ ID NO: 5661 - DNA, 20 bp, Artificial Sequence
  Synthetic oligonucleotide; GAG chr11 5197368 5197387 5197384 +
taaaataagcaatgatttct

SEQ ID NO: 5662 - DNA, 20 bp, Artificial Sequence
  Synthetic oligonucleotide; AGG chr11 5197369 5197388 5197385 +
aaaataagcaatgatttctg

SEQ ID NO: 5663 - DNA, 20 bp, Artificial Sequence
  Synthetic oligonucleotide; TAG chr11 5197379 5197398 5197395 +
atgatttctgaggatactct

SEQ ID NO: 5664 - DNA, 20 bp, Artificial Sequence
  Synthetic oligonucleotide; AGG chr11 5197380 5197399 5197396 +
tgatttctgaggatactctt

SEQ ID NO: 5665 - DNA, 20 bp, Artificial Sequence
  Synthetic oligonucleotide; CGG chr11 5197407 5197426 5197423 +
ttttattaactgttttgtca

SEQ ID NO: 5666 - DNA, 20 bp, Artificial Sequence
  Synthetic oligonucleotide; TGG chr11 5197429 5197448 5197445 +
gccattatttcaaactattt

SEQ ID NO: 5667 - DNA, 20 bp, Artificial Sequence
  Synthetic oligonucleotide; TAG chr11 5197443 5197462 5197459 +
ctattttggttcacattcta

SEQ ID NO: 5668 - DNA, 20 bp, Artificial Sequence
  Synthetic oligonucleotide; AGG chr11 5197444 5197463 5197460 +
tattttggttcacattctat

SEQ ID NO: 5669 - DNA, 20 bp, Artificial Sequence
  Synthetic oligonucleotide; AAG chr11 5197459 5197478 5197475 +
tctataggttgcctaatctg

SEQ ID NO: 5670 - DNA, 20 bp, Artificial Sequence
  Synthetic oligonucleotide; TAG chr11 5197474 5197493 5197490 +
atctgaagcacaaacactca

SEQ ID NO: 5671 - DNA, 20 bp, Artificial Sequence
  Synthetic oligonucleotide; AAG chr11 5197481 5197500 5197497 +
gcacaaacactcatagtatg

SEQ ID NO: 5672 - DNA, 20 bp, Artificial Sequence
  Synthetic oligonucleotide; CAG chr11 5197488 5197507 5197504 +
cactcatagtatgaagtctt

SEQ ID NO: 5673 - DNA, 20 bp, Artificial Sequence
  Synthetic oligonucleotide; GAG chr11 5197493 5197512 5197509 +
atagtatgaagtcttcagat

SEQ ID NO: 5674 - DNA, 20 bp, Artificial Sequence
  Synthetic oligonucleotide; CAG chr11 5197540 5197559 5197556 +
taactctcaaaccaacaact

SEQ ID NO: 5675 - DNA, 20 bp, Artificial Sequence
  Synthetic oligonucleotide; CAG chr11 5197549 5197568 5197565 +
aaccaacaactcagttgtgt

SEQ ID NO: 5676 - DNA, 20 bp, Artificial Sequence
  Synthetic oligonucleotide; GAG chr11 5197605 5197624 5197621 +
tcattctgatgcttccctat

SEQ ID NO: 5677 - DNA, 20 bp, Artificial Sequence
  Synthetic oligonucleotide; TGG chr11 5197608 5197627 5197624 +
ttctgatgcttccctatgag

SEQ ID NO: 5678 - DNA, 20 bp, Artificial Sequence
  Synthetic oligonucleotide; TGG chr11 5197612 5197631 5197628 +
gatgcttccctatgagtggc

SEQ ID NO: 5679 - DNA, 20 bp, Artificial Sequence
  Synthetic oligonucleotide; TGG chr11 5197615 5197634 5197631 +
gcttccctatgagtggctgg

SEQ ID NO: 5680 - DNA, 20 bp, Artificial Sequence
  Synthetic oligonucleotide; CAG chr11 5197630 5197649 5197646 +
gctggtggaaaacatattgt

SEQ ID NO: 5681 - DNA, 20 bp, Artificial Sequence
  Synthetic oligonucleotide; AAG chr11 5197639 5197658 5197655 +
aaacatattgtcagttgttg

SEQ ID NO: 5682 - DNA, 20 bp, Artificial Sequence
  Synthetic oligonucleotide; CAG chr11 5197657 5197676 5197673 +
tgaagaattctctgcttccc

SEQ ID NO: 5683 - DNA, 20 bp, Artificial Sequence
  Synthetic oligonucleotide; CAG chr11 5197668 5197687 5197684 +
ctgcttccccagtgttgtgt

SEQ ID NO: 5684 - DNA, 20 bp, Artificial Sequence
  Synthetic oligonucleotide; CGG chr11 5197676 5197695 5197692 +
ccagtgttgtgtcagctctc

SEQ ID NO: 5685 - DNA, 20 bp, Artificial Sequence
  Synthetic oligonucleotide; TGG chr11 5197683 5197702 5197699 +
tgtgtcagctctccggcgta

SEQ ID NO: 5686 - DNA, 20 bp, Artificial Sequence
  Synthetic oligonucleotide; GGG chr11 5197684 5197703 5197700 +
gtgtcagctctccggcgtat

SEQ ID NO: 5687 - DNA, 20 bp, Artificial Sequence
  Synthetic oligonucleotide; GAG chr11 5197686 5197705 5197702 +
gtcagctctccggcgtatgg

SEQ ID NO: 5688 - DNA, 20 bp, Artificial Sequence
  Synthetic oligonucleotide; AGG chr11 5197687 5197706 5197703 +
tcagctctccggcgtatggg

SEQ ID NO: 5689 - DNA, 20 bp, Artificial Sequence
  Synthetic oligonucleotide; GGG chr11 5197688 5197707 5197704 +
cagctctccggcgtatggga

SEQ ID NO: 5690 - DNA, 20 bp, Artificial Sequence
  Synthetic oligonucleotide; TGG chr11 5197691 5197710 5197707 +
ctctccggcgtatgggaggg

SEQ ID NO: 5691 - DNA, 20 bp, Artificial Sequence
  Synthetic oligonucleotide; AAG chr11 5197711 5197730 5197727 +
tggatgcttattcactttca

SEQ ID NO: 5692 - DNA, 20 bp, Artificial Sequence
  Synthetic oligonucleotide; TAG chr11 5197717 5197736 5197733 +
cttattcactttcaaagcat

SEQ ID NO: 5693 - DNA, 20 bp, Artificial Sequence
  Synthetic oligonucleotide; AAG chr11 5197720 5197739 5197736 +
attcactttcaaagcattag

SEQ ID NO: 5694 - DNA, 20 bp, Artificial Sequence
  Synthetic oligonucleotide; AGG chr11 5197721 5197740 5197737 +
ttcactttcaaagcattaga

SEQ ID NO: 5695 - DNA, 20 bp, Artificial Sequence
  Synthetic oligonucleotide; AAG chr11 5197724 5197743 5197740 +
actttcaaagcattagaagg

SEQ ID NO: 5696 - DNA, 20 bp, Artificial Sequence
  Synthetic oligonucleotide; TGG chr11 5197733 5197752 5197749 +
gcattagaaggaagcttctt

SEQ ID NO: 5697 - DNA, 20 bp, Artificial Sequence
  Synthetic oligonucleotide; GAG chr11 5197741 5197760 5197757 +
aggaagcttctttggccatt

SEQ ID NO: 5698 - DNA, 20 bp, Artificial Sequence
  Synthetic oligonucleotide; GAG chr11 5197752 5197771 5197768 +
ttggccattgagaaatctat

SEQ ID NO: 5699 - DNA, 20 bp, Artificial Sequence
  Synthetic oligonucleotide; CAG chr11 5197773 5197792 5197789 +
agacattcacatgacctcta

SEQ ID NO: 5700 - DNA, 20 bp, Artificial Sequence
  Synthetic oligonucleotide; CAG chr11 5197779 5197798 5197795 +
tcacatgacctctacagatt

SEQ ID NO: 5701 - DNA, 20 bp, Artificial Sequence
  Synthetic oligonucleotide; CAG chr11 5197782 5197801 5197798 +
catgacctctacagattcag

SEQ ID NO: 5702 - DNA, 20 bp, Artificial Sequence
  Synthetic oligonucleotide; TGG chr11 5197810 5197829 5197826 +
ttctcttttcattataaaac

SEQ ID NO: 5703 - DNA, 20 bp, Artificial Sequence
  Synthetic oligonucleotide; GGG chr11 5197811 5197830 5197827 +
tctcttttcattataaaact

SEQ ID NO: 5704 - DNA, 20 bp, Artificial Sequence
  Synthetic oligonucleotide; GGG chr11 5197812 5197831 5197828 +
ctcttttcattataaaactg

SEQ ID NO: 5705 - DNA, 20 bp, Artificial Sequence
  Synthetic oligonucleotide; TAG chr11 5197817 5197836 5197833 +
ttcattataaaactggggca

SEQ ID NO: 5706 - DNA, 20 bp, Artificial Sequence
  Synthetic oligonucleotide; AGG chr11 5197818 5197837 5197834 +
tcattataaaactggggcat

SEQ ID NO: 5707 - DNA, 20 bp, Artificial Sequence
  Synthetic oligonucleotide; CAG chr11 5197829 5197848 5197845 +
ctggggcataggaatcttgt

SEQ ID NO: 5708 - DNA, 20 bp, Artificial Sequence
  Synthetic oligonucleotide; TGG chr11 5197834 5197853 5197850 +
gcataggaatcttgtcagat

SEQ ID NO: 5709 - DNA, 20 bp, Artificial Sequence
  Synthetic oligonucleotide; CAG chr11 5197845 5197864 5197861 +
ttgtcagattggccacattc

SEQ ID NO: 5710 - DNA, 20 bp, Artificial Sequence
  Synthetic oligonucleotide; CGG chr11 5197849 5197868 5197865 +
cagattggccacattccagt

SEQ ID NO: 5711 - DNA, 20 bp, Artificial Sequence
  Synthetic oligonucleotide; CAG chr11 5197853 5197872 5197869 +
ttggccacattccagtcggc

SEQ ID NO: 5712 - DNA, 20 bp, Artificial Sequence
  Synthetic oligonucleotide; AGG chr11 5197854 5197873 5197870 +
tggccacattccagtcggcc

SEQ ID NO: 5713 - DNA, 20 bp, Artificial Sequence
  Synthetic oligonucleotide; GAG chr11 5197856 5197875 5197872 +
gccacattccagtcggccag

SEQ ID NO: 5714 - DNA, 20 bp, Artificial Sequence
  Synthetic oligonucleotide; AGG chr11 5197857 5197876 5197873 +
ccacattccagtcggccagg

SEQ ID NO: 5715 - DNA, 20 bp, Artificial Sequence
  Synthetic oligonucleotide; GGG chr11 5197858 5197877 5197874 +
cacattccagtcggccagga

SEQ ID NO: 5716 - DNA, 20 bp, Artificial Sequence
  Synthetic oligonucleotide; CAG chr11 5197867 5197886 5197883 +
gtcggccaggagggaccatg

SEQ ID NO: 5717 - DNA, 20 bp, Artificial Sequence
  Synthetic oligonucleotide; TAG chr11 5197884 5197903 5197900 +
atgcagacatttattatcat

SEQ ID NO: 5718 - DNA, 20 bp, Artificial Sequence
  Synthetic oligonucleotide; AGG chr11 5197885 5197904 5197901 +
tgcagacatttattatcatt

SEQ ID NO: 5719 - DNA, 20 bp, Artificial Sequence
  Synthetic oligonucleotide; GGG chr11 5197886 5197905 5197902 +
gcagacatttattatcatta

SEQ ID NO: 5720 - DNA, 20 bp, Artificial Sequence
  Synthetic oligonucleotide; TGG chr11 5197893 5197912 5197909 +
tttattatcattagggaacc

SEQ ID NO: 5721 - DNA, 20 bp, Artificial Sequence
  Synthetic oligonucleotide; GAG chr11 5197895 5197914 5197911 +
tattatcattagggaacctg

SEQ ID NO: 5722 - DNA, 20 bp, Artificial Sequence
  Synthetic oligonucleotide; CAG chr11 5197898 5197917 5197914 +
tatcattagggaacctggag

SEQ ID NO: 5723 - DNA, 20 bp, Artificial Sequence
  Synthetic oligonucleotide; GAG chr11 5197961 5197980 5197977 +
ctcttttttttttttttttt

SEQ ID NO: 5724 - DNA, 20 bp, Artificial Sequence
  Synthetic oligonucleotide; CAG chr11 5197965 5197984 5197981 +
ttttttttttttttttgaga

SEQ ID NO: 5725 - DNA, 20 bp, Artificial Sequence
  Synthetic oligonucleotide; GAG chr11 5197967 5197986 5197983 +
ttttttttttttttgagaca

SEQ ID NO: 5726 - DNA, 20 bp, Artificial Sequence
  Synthetic oligonucleotide; CAG chr11 5197985 5198004 5198001 +
cagagtctctctctgtcgcc

SEQ ID NO: 5727 - DNA, 20 bp, Artificial Sequence
  Synthetic oligonucleotide; AGG chr11 5197986 5198005 5198002 +
agagtctctctctgtcgccc

SEQ ID NO: 5728 - DNA, 20 bp, Artificial Sequence
  Synthetic oligonucleotide; TGG chr11 5197990 5198009 5198006 +
tctctctctgtcgcccaggc

SEQ ID NO: 5729 - DNA, 20 bp, Artificial Sequence
  Synthetic oligonucleotide; GAG chr11 5197992 5198011 5198008 +
tctctctgtcgcccaggctg

SEQ ID NO: 5730 - DNA, 20 bp, Artificial Sequence
  Synthetic oligonucleotide; CAG chr11 5197997 5198016 5198013 +
ctgtcgcccaggctggagtg

SEQ ID NO: 5731 - DNA, 20 bp, Artificial Sequence
  Synthetic oligonucleotide; TGG chr11 5198000 5198019 5198016 +
tcgcccaggctggagtgcag

SEQ ID NO: 5732 - DNA, 20 bp, Artificial Sequence
  Synthetic oligonucleotide; AAG chr11 5198022 5198041 5198038 +
gcgtgatctcgactcactgc

SEQ ID NO: 5733 - DNA, 20 bp, Artificial Sequence
  Synthetic oligonucleotide; CGG chr11 5198035 5198054 5198051 +
tcactgcaagctccacctcc

SEQ ID NO: 5734 - DNA, 20 bp, Artificial Sequence
  Synthetic oligonucleotide; GGG chr11 5198036 5198055 5198052 +
cactgcaagctccacctccc

SEQ ID NO: 5735 - DNA, 20 bp, Artificial Sequence
  Synthetic oligonucleotide; CAG chr11 5198059 5198078 5198075 +
ttcacgccattctcctgtct

SEQ ID NO: 5736 - DNA, 20 bp, Artificial Sequence
  Synthetic oligonucleotide; GAG chr11 5198068 5198087 5198084 +
ttctcctgtctcagcctccc

SEQ ID NO: 5737 - DNA, 20 bp, Artificial Sequence
  Synthetic oligonucleotide; TGG chr11 5198075 5198094 5198091 +
gtctcagcctcccgagtacc

SEQ ID NO: 5738 - DNA, 20 bp, Artificial Sequence
  Synthetic oligonucleotide; GGG chr11 5198076 5198095 5198092 +
tctcagcctcccgagtacct

SEQ ID NO: 5739 - DNA, 20 bp, Artificial Sequence
  Synthetic oligonucleotide; CAG chr11 5198083 5198102 5198099 +
ctcccgagtacctgggacta

SEQ ID NO: 5740 - DNA, 20 bp, Artificial Sequence
  Synthetic oligonucleotide; AGG chr11 5198084 5198103 5198100 +
tcccgagtacctgggactac

SEQ ID NO: 5741 - DNA, 20 bp, Artificial Sequence
  Synthetic oligonucleotide; TGG chr11 5198103 5198122 5198119 +
caggtgcccgccaccacgcc

SEQ ID NO: 5742 - DNA, 20 bp, Artificial Sequence
  Synthetic oligonucleotide; TAG chr11 5198125 5198144 5198141 +
gatactttcttgtgtttttt

SEQ ID NO: 5743 - DNA, 20 bp, Artificial Sequence
  Synthetic oligonucleotide; TAG chr11 5198128 5198147 5198144 +
actttcttgtgtttttttag

SEQ ID NO: 5744 - DNA, 20 bp, Artificial Sequence
  Synthetic oligonucleotide; GAG chr11 5198130 5198149 5198146 +
tttcttgtgtttttttagta

SEQ ID NO: 5745 - DNA, 20 bp, Artificial Sequence
  Synthetic oligonucleotide; CGG chr11 5198134 5198153 5198150 +
ttgtgtttttttagtagaga

SEQ ID NO: 5746 - DNA, 20 bp, Artificial Sequence
  Synthetic oligonucleotide; GGG chr11 5198135 5198154 5198151 +
tgtgtttttttagtagagac

SEQ ID NO: 5747 - DNA, 20 bp, Artificial Sequence
  Synthetic oligonucleotide; GGG chr11 5198136 5198155 5198152 +
gtgtttttttagtagagacg

SEQ ID NO: 5748 - DNA, 20 bp, Artificial Sequence
  Synthetic oligonucleotide; TGG chr11 5198151 5198170 5198167 +
agacggggtttcaccattgc

SEQ ID NO: 5749 - DNA, 20 bp, Artificial Sequence
  Synthetic oligonucleotide; CAG chr11 5198155 5198174 5198171 +
ggggtttcaccattgctggc

SEQ ID NO: 5750 - DNA, 20 bp, Artificial Sequence
  Synthetic oligonucleotide; AGG chr11 5198156 5198175 5198172 +
gggtttcaccattgctggcc

SEQ ID NO: 5751 - DNA, 20 bp, Artificial Sequence
  Synthetic oligonucleotide; TGG chr11 5198160 5198179 5198176 +
ttcaccattgctggccagga

SEQ ID NO: 5752 - DNA, 20 bp, Artificial Sequence
  Synthetic oligonucleotide; CGG chr11 5198196 5198215 5198212 +
acctcatgatccgcccgcct

SEQ ID NO: 5753 - DNA, 20 bp, Artificial Sequence
  Synthetic oligonucleotide; CAG chr11 5198199 5198218 5198215 +
tcatgatccgcccgcctcgg

SEQ ID NO: 5754 - DNA, 20 bp, Artificial Sequence
  Synthetic oligonucleotide; TAG chr11 5198216 5198235 5198232 +
cggcagctactatgattata

SEQ ID NO: 5755 - DNA, 20 bp, Artificial Sequence
  Synthetic oligonucleotide; TAG chr11 5198250 5198269 5198266 +
tatattgacattttcccctc

SEQ ID NO: 5756 - DNA, 20 bp, Artificial Sequence
  Synthetic oligonucleotide; CAG chr11 5198264 5198283 5198280 +
cccctctagaacctacctca

SEQ ID NO: 5757 - DNA, 20 bp, Artificial Sequence
  Synthetic oligonucleotide; TAG chr11 5198280 5198299 5198296 +
ctcacagttttcacttctga

SEQ ID NO: 5758 - DNA, 20 bp, Artificial Sequence
  Synthetic oligonucleotide; CAG chr11 5198289 5198308 5198305 +
ttcacttctgatagctatac

SEQ ID NO: 5759 - DNA, 20 bp, Artificial Sequence
  Synthetic oligonucleotide; AAG chr11 5198292 5198311 5198308 +
acttctgatagctataccag

SEQ ID NO: 5760 - DNA, 20 bp, Artificial Sequence
  Synthetic oligonucleotide; TAG chr11 5198301 5198320 5198317 +
agctataccagaagatgcac

SEQ ID NO: 5761 - DNA, 20 bp, Artificial Sequence
  Synthetic oligonucleotide; CAG chr11 5198318 5198337 5198334 +
cactagatcctctttgacat

SEQ ID NO: 5762 - DNA, 20 bp, Artificial Sequence
  Synthetic oligonucleotide; AGG chr11 5198319 5198338 5198335 +
actagatcctctttgacatc

SEQ ID NO: 5763 - DNA, 20 bp, Artificial Sequence
  Synthetic oligonucleotide; CAG chr11 5198365 5198384 5198381 +
attaaccttatactgtaacc

SEQ ID NO: 5764 - DNA, 20 bp, Artificial Sequence
  Synthetic oligonucleotide; AAG chr11 5198368 5198387 5198384 +
aaccttatactgtaacccag

SEQ ID NO: 5765 - DNA, 20 bp, Artificial Sequence
  Synthetic oligonucleotide; TAG chr11 5198387 5198406 5198403 +
gaagacctaatttattgttc

SEQ ID NO: 5766 - DNA, 20 bp, Artificial Sequence
  Synthetic oligonucleotide; AGG chr11 5198388 5198407 5198404 +
aagacctaatttattgttct

SEQ ID NO: 5767 - DNA, 20 bp, Artificial Sequence
  Synthetic oligonucleotide; CAG chr11 5198417 5198436 5198433 +
tttacacttatctttctaac

SEQ ID NO: 5768 - DNA, 20 bp, Artificial Sequence
  Synthetic oligonucleotide; CAG chr11 5198435 5198454 5198451 +
accagatactttactctgtc

SEQ ID NO: 5769 - DNA, 20 bp, Artificial Sequence
  Synthetic oligonucleotide; GAG chr11 5198456 5198475 5198472 +
agaaacaatttcctcacttt

SEQ ID NO: 5770 - DNA, 20 bp, Artificial Sequence
  Synthetic oligonucleotide; AGG chr11 5198457 5198476 5198473 +
gaaacaatttcctcactttg

SEQ ID NO: 5771 - DNA, 20 bp, Artificial Sequence
  Synthetic oligonucleotide; AAG chr11 5198463 5198482 5198479 +
atttcctcactttgaggctt

SEQ ID NO: 5772 - DNA, 20 bp, Artificial Sequence
  Synthetic oligonucleotide; TAG chr11 5198470 5198489 5198486 +
cactttgaggcttaagctat

SEQ ID NO: 5773 - DNA, 20 bp, Artificial Sequence
  Synthetic oligonucleotide; AAG chr11 5198479 5198498 5198495 +
gcttaagctattagaaacca

SEQ ID NO: 5774 - DNA, 20 bp, Artificial Sequence
  Synthetic oligonucleotide; GAG chr11 5198503 5198522 5198519 +
ctgtatttttgtttccctct

SEQ ID NO: 5775 - DNA, 20 bp, Artificial Sequence
  Synthetic oligonucleotide; AAG chr11 5198512 5198531 5198528 +
tgtttccctctgagtcaaat

SEQ ID NO: 5776 - DNA, 20 bp, Artificial Sequence
  Synthetic oligonucleotide; TAG chr11 5198515 5198534 5198531 +
ttccctctgagtcaaataag

SEQ ID NO: 5777 - DNA, 20 bp, Artificial Sequence
  Synthetic oligonucleotide; CAG chr11 5198519 5198538 5198535 +
ctctgagtcaaataagtaga

SEQ ID NO: 5778 - DNA, 20 bp, Artificial Sequence
  Synthetic oligonucleotide; GAG chr11 5198521 5198540 5198537 +
ctgagtcaaataagtagaca

SEQ ID NO: 5779 - DNA, 20 bp, Artificial Sequence
  Synthetic oligonucleotide; AGG chr11 5198522 5198541 5198538 +
tgagtcaaataagtagacag

SEQ ID NO: 5780 - DNA, 20 bp, Artificial Sequence
  Synthetic oligonucleotide; AAG chr11 5198540 5198559 5198556 +
agaggctatgttattgaatg

SEQ ID NO: 5781 - DNA, 20 bp, Artificial Sequence
  Synthetic oligonucleotide; AAG chr11 5198547 5198566 5198563 +
atgttattgaatgaagtcca

SEQ ID NO: 5782 - DNA, 20 bp, Artificial Sequence
  Synthetic oligonucleotide; AAG chr11 5198553 5198572 5198569 +
ttgaatgaagtccaaagtga

SEQ ID NO: 5783 - DNA, 20 bp, Artificial Sequence
  Synthetic oligonucleotide; AGG chr11 5198554 5198573 5198570 +
tgaatgaagtccaaagtgaa

SEQ ID NO: 5784 - DNA, 20 bp, Artificial Sequence
  Synthetic oligonucleotide; AAG chr11 5198558 5198577 5198574 +
tgaagtccaaagtgaaagga

SEQ ID NO: 5785 - DNA, 20 bp, Artificial Sequence
  Synthetic oligonucleotide; AGG chr11 5198559 5198578 5198575 +
gaagtccaaagtgaaaggaa

SEQ ID NO: 5786 - DNA, 20 bp, Artificial Sequence
  Synthetic oligonucleotide; AAG chr11 5198562 5198581 5198578 +
gtccaaagtgaaaggaaagg

SEQ ID NO: 5787 - DNA, 20 bp, Artificial Sequence
  Synthetic oligonucleotide; AGG chr11 5198563 5198582 5198579 +
tccaaagtgaaaggaaagga

SEQ ID NO: 5788 - DNA, 20 bp, Artificial Sequence
  Synthetic oligonucleotide; CAG chr11 5198574 5198593 5198590 +
aggaaaggaaggcataatta

SEQ ID NO: 5789 - DNA, 20 bp, Artificial Sequence
  Synthetic oligonucleotide; AGG chr11 5198575 5198594 5198591 +
ggaaaggaaggcataattac

SEQ ID NO: 5790 - DNA, 20 bp, Artificial Sequence
  Synthetic oligonucleotide; AAG chr11 5198578 5198597 5198594 +
aaggaaggcataattacagg

SEQ ID NO: 5791 - DNA, 20 bp, Artificial Sequence
  Synthetic oligonucleotide; TGG chr11 5198588 5198607 5198604 +
taattacaggaagacaaatc

SEQ ID NO: 5792 - DNA, 20 bp, Artificial Sequence
  Synthetic oligonucleotide; TAG chr11 5198597 5198616 5198613 +
gaagacaaatctggttgttt

SEQ ID NO: 5793 - DNA, 20 bp, Artificial Sequence
  Synthetic oligonucleotide; TGG chr11 5198635 5198654 5198651 +
aaaaataaatatttgctttt

SEQ ID NO: 5794 - DNA, 20 bp, Artificial Sequence
  Synthetic oligonucleotide; TAG chr11 5198689 5198708 5198705 +
aattttaacacttaccttct

SEQ ID NO: 5795 - DNA, 20 bp, Artificial Sequence
  Synthetic oligonucleotide; TAG chr11 5198700 5198719 5198716 +
ttaccttcttagatacctaa

SEQ ID NO: 5796 - DNA, 20 bp, Artificial Sequence
  Synthetic oligonucleotide; TAG chr11 5198707 5198726 5198723 +
cttagatacctaatagaata

SEQ ID NO: 5797 - DNA, 20 bp, Artificial Sequence
  Synthetic oligonucleotide; AGG chr11 5198708 5198727 5198724 +
ttagatacctaatagaatat

SEQ ID NO: 5798 - DNA, 20 bp, Artificial Sequence
  Synthetic oligonucleotide; AAG chr11 5198711 5198730 5198727 +
gatacctaatagaatatagg

SEQ ID NO: 5799 - DNA, 20 bp, Artificial Sequence
  Synthetic oligonucleotide; TAG chr11 5198746 5198765 5198762 +
attttcttgttatccatgca

SEQ ID NO: 5800 - DNA, 20 bp, Artificial Sequence
  Synthetic oligonucleotide; TGG chr11 5198784 5198803 5198800 +
ccttcctttctttccttctt

SEQ ID NO: 5801 - DNA, 20 bp, Artificial Sequence
  Synthetic oligonucleotide; AAG chr11 5198788 5198807 5198804 +
cctttctttccttctttgga

SEQ ID NO: 5802 - DNA, 20 bp, Artificial Sequence
  Synthetic oligonucleotide; TAG chr11 5198797 5198816 5198813 +
ccttctttggaaagctgcac

SEQ ID NO: 5803 - DNA, 20 bp, Artificial Sequence
  Synthetic oligonucleotide; TAG chr11 5198806 5198825 5198822 +
gaaagctgcactagcttact

SEQ ID NO: 5804 - DNA, 20 bp, Artificial Sequence
  Synthetic oligonucleotide; AAG chr11 5198811 5198830 5198827 +
ctgcactagcttacttagaa

SEQ ID NO: 5805 - DNA, 20 bp, Artificial Sequence
  Synthetic oligonucleotide; CAG chr11 5198852 5198871 5198868 +
tatcttttttcttttaaact

SEQ ID NO: 5806 - DNA, 20 bp, Artificial Sequence
  Synthetic oligonucleotide; AAG chr11 5198858 5198877 5198874 +
ttttcttttaaactcagaat

SEQ ID NO: 5807 - DNA, 20 bp, Artificial Sequence
  Synthetic oligonucleotide; CGG chr11 5198862 5198881 5198878 +
cttttaaactcagaataagt

SEQ ID NO: 5808 - DNA, 20 bp, Artificial Sequence
  Synthetic oligonucleotide; TAG chr11 5198865 5198884 5198881 +
ttaaactcagaataagtcgg

SEQ ID NO: 5809 - DNA, 20 bp, Artificial Sequence
  Synthetic oligonucleotide; CGG chr11 5198868 5198887 5198884 +
aactcagaataagtcggtag

SEQ ID NO: 5810 - DNA, 20 bp, Artificial Sequence
  Synthetic oligonucleotide; CAG chr11 5198872 5198891 5198888 +
cagaataagtcggtagcgga

SEQ ID NO: 5811 - DNA, 20 bp, Artificial Sequence
  Synthetic oligonucleotide; CAG chr11 5198886 5198905 5198902 +
agcggacagtctcatctgtt

SEQ ID NO: 5812 - DNA, 20 bp, Artificial Sequence
  Synthetic oligonucleotide; AAG chr11 5198889 5198908 5198905 +
ggacagtctcatctgttcag

SEQ ID NO: 5813 - DNA, 20 bp, Artificial Sequence
  Synthetic oligonucleotide; TAG chr11 5198902 5198921 5198918 +
tgttcagaagatcccccact

SEQ ID NO: 5814 - DNA, 20 bp, Artificial Sequence
  Synthetic oligonucleotide; AAG chr11 5198911 5198930 5198927 +
gatcccccacttagatataa

SEQ ID NO: 5815 - DNA, 20 bp, Artificial Sequence
  Synthetic oligonucleotide; AAG chr11 5198917 5198936 5198933 +
ccacttagatataaaagcaa

SEQ ID NO: 5816 - DNA, 20 bp, Artificial Sequence
  Synthetic oligonucleotide; TAG chr11 5198923 5198942 5198939 +
agatataaaagcaaaagatc

SEQ ID NO: 5817 - DNA, 20 bp, Artificial Sequence
  Synthetic oligonucleotide; GAG chr11 5198925 5198944 5198941 +
atataaaagcaaaagatcta

SEQ ID NO: 5818 - DNA, 20 bp, Artificial Sequence
  Synthetic oligonucleotide; CAG chr11 5198941 5198960 5198957 +
tctagagcaaaatctgcttc

SEQ ID NO: 5819 - DNA, 20 bp, Artificial Sequence
  Synthetic oligonucleotide; TAG chr11 5198949 5198968 5198965 +
aaaatctgcttccagccttg

SEQ ID NO: 5820 - DNA, 20 bp, Artificial Sequence
  Synthetic oligonucleotide; CAG chr11 5198952 5198971 5198968 +
atctgcttccagccttgtag

SEQ ID NO: 5821 - DNA, 20 bp, Artificial Sequence
  Synthetic oligonucleotide; TGG chr11 5198955 5198974 5198971 +
tgcttccagccttgtagcag

SEQ ID NO: 5822 - DNA, 20 bp, Artificial Sequence
  Synthetic oligonucleotide; GAG chr11 5198957 5198976 5198973 +
cttccagccttgtagcagtg

SEQ ID NO: 5823 - DNA, 20 bp, Artificial Sequence
  Synthetic oligonucleotide; AAG chr11 5198983 5199002 5198999 +
acatataaaatctaaaaaat

SEQ ID NO: 5824 - DNA, 20 bp, Artificial Sequence
  Synthetic oligonucleotide; AGG chr11 5198984 5199003 5199000 +
catataaaatctaaaaaata

SEQ ID NO: 5825 - DNA, 20 bp, Artificial Sequence
  Synthetic oligonucleotide; TAG chr11 5199001 5199020 5199017 +
ataaggattctaatttaaat

SEQ ID NO: 5826 - DNA, 20 bp, Artificial Sequence
  Synthetic oligonucleotide; TGG chr11 5199007 5199026 5199023 +
attctaatttaaattagaca

SEQ ID NO: 5827 - DNA, 20 bp, Artificial Sequence
  Synthetic oligonucleotide; TAG chr11 5199010 5199029 5199026 +
ctaatttaaattagacatgg

SEQ ID NO: 5828 - DNA, 20 bp, Artificial Sequence
  Synthetic oligonucleotide; AAG chr11 5199013 5199032 5199029 +
atttaaattagacatggtag

SEQ ID NO: 5829 - DNA, 20 bp, Artificial Sequence
  Synthetic oligonucleotide; AAG chr11 5199025 5199044 5199041 +
catggtagaagttgaatcca

SEQ ID NO: 5830 - DNA, 20 bp, Artificial Sequence
  Synthetic oligonucleotide; TAG chr11 5199059 5199078 5199075 +
tgtgtcctctttatgaactg

SEQ ID NO: 5831 - DNA, 20 bp, Artificial Sequence
  Synthetic oligonucleotide; TAG chr11 5199077 5199096 5199093 +
tgtagcttccctgtccaata

SEQ ID NO: 5832 - DNA, 20 bp, Artificial Sequence
  Synthetic oligonucleotide; TGG chr11 5199080 5199099 5199096 +
agcttccctgtccaatatag

SEQ ID NO: 5833 - DNA, 20 bp, Artificial Sequence
  Synthetic oligonucleotide; AAG chr11 5199107 5199126 5199123 +
tgaactgaactgtccaatac

SEQ ID NO: 5834 - DNA, 20 bp, Artificial Sequence
  Synthetic oligonucleotide; AGG chr11 5199108 5199127 5199124 +
gaactgaactgtccaataca

SEQ ID NO: 5835 - DNA, 20 bp, Artificial Sequence
  Synthetic oligonucleotide; AAG chr11 5199141 5199160 5199157 +
tttaaatataaattaactta

SEQ ID NO: 5836 - DNA, 20 bp, Artificial Sequence
  Synthetic oligonucleotide; CAG chr11 5199162 5199181 5199178 +
agtaactgaaattgtaaatg

SEQ ID NO: 5837 - DNA, 20 bp, Artificial Sequence
  Synthetic oligonucleotide; AAG chr11 5199191 5199210 5199207 +
aattacactaccatcatttc

SEQ ID NO: 5838 - DNA, 20 bp, Artificial Sequence
  Synthetic oligonucleotide; CAG chr11 5199198 5199217 5199214 +
ctaccatcatttcaagcgca

SEQ ID NO: 5839 - DNA, 20 bp, Artificial Sequence
  Synthetic oligonucleotide; AGG chr11 5199199 5199218 5199215 +
taccatcatttcaagcgcac

SEQ ID NO: 5840 - DNA, 20 bp, Artificial Sequence
  Synthetic oligonucleotide; GAG chr11 5199201 5199220 5199217 +
ccatcatttcaagcgcacag

SEQ ID NO: 5841 - DNA, 20 bp, Artificial Sequence
  Synthetic oligonucleotide; TAG chr11 5199219 5199238 5199235 +
aggagccatatattccactt

SEQ ID NO: 5842 - DNA, 20 bp, Artificial Sequence
  Synthetic oligonucleotide; TGG chr11 5199230 5199249 5199246 +
attccactttagccatttta

SEQ ID NO: 5843 - DNA, 20 bp, Artificial Sequence
  Synthetic oligonucleotide; TAG chr11 5199240 5199259 5199256 +
agccattttatggtatttta

SEQ ID NO: 5844 - DNA, 20 bp, Artificial Sequence
  Synthetic oligonucleotide; CAG chr11 5199254 5199273 5199270 +
attttatagaacatcgccat

SEQ ID NO: 5845 - DNA, 20 bp, Artificial Sequence
  Synthetic oligonucleotide; TAG chr11 5199259 5199278 5199275 +
atagaacatcgccatcagtt

SEQ ID NO: 5846 - DNA, 20 bp, Artificial Sequence
  Synthetic oligonucleotide; AAG chr11 5199264 5199283 5199280 +
acatcgccatcagtttagaa

SEQ ID NO: 5847 - DNA, 20 bp, Artificial Sequence
  Synthetic oligonucleotide; TGG chr11 5199273 5199292 5199289 +
tcagtttagaaaagttccct

SEQ ID NO: 5848 - DNA, 20 bp, Artificial Sequence
  Synthetic oligonucleotide; TGG chr11 5199283 5199302 5199299 +
aaagttcccttggacaattc

SEQ ID NO: 5849 - DNA, 20 bp, Artificial Sequence
  Synthetic oligonucleotide; CAG chr11 5199292 5199311 5199308 +
ttggacaattctggtccata

SEQ ID NO: 5850 - DNA, 20 bp, Artificial Sequence
  Synthetic oligonucleotide; GAG chr11 5199313 5199332 5199329 +
agatatcacaacattcctgt

SEQ ID NO: 5851 - DNA, 20 bp, Artificial Sequence
  Synthetic oligonucleotide; TGG chr11 5199317 5199336 5199333 +
atcacaacattcctgtgagt

SEQ ID NO: 5852 - DNA, 20 bp, Artificial Sequence
  Synthetic oligonucleotide; TAG chr11 5199323 5199342 5199339 +
acattcctgtgagttggcta

SEQ ID NO: 5853 - DNA, 20 bp, Artificial Sequence
  Synthetic oligonucleotide; AAG chr11 5199337 5199356 5199353 +
tggctatagtctccattttg

SEQ ID NO: 5854 - DNA, 20 bp, Artificial Sequence
  Synthetic oligonucleotide; AGG chr11 5199338 5199357 5199354 +
ggctatagtctccattttga

SEQ ID NO: 5855 - DNA, 20 bp, Artificial Sequence
  Synthetic oligonucleotide; AAG chr11 5199347 5199366 5199363 +
ctccattttgaaggttaatt

SEQ ID NO: 5856 - DNA, 20 bp, Artificial Sequence
  Synthetic oligonucleotide; CAG chr11 5199357 5199376 5199373 +
aaggttaattaagtaaacct

SEQ ID NO: 5857 - DNA, 20 bp, Artificial Sequence
  Synthetic oligonucleotide; GAG chr11 5199359 5199378 5199375 +
ggttaattaagtaaacctca

SEQ ID NO: 5858 - DNA, 20 bp, Artificial Sequence
  Synthetic oligonucleotide; AAG chr11 5199367 5199386 5199383 +
aagtaaacctcagagaatga

SEQ ID NO: 5859 - DNA, 20 bp, Artificial Sequence
  Synthetic oligonucleotide; AAG chr11 5199377 5199396 5199393 +
cagagaatgaaagaaacttc

SEQ ID NO: 5860 - DNA, 20 bp, Artificial Sequence
  Synthetic oligonucleotide; TAG chr11 5199405 5199424 5199421 +
tactttgaaacttgaaaacc

SEQ ID NO: 5861 - DNA, 20 bp, Artificial Sequence
  Synthetic oligonucleotide; AGG chr11 5199406 5199425 5199422 +
actttgaaacttgaaaacct

SEQ ID NO: 5862 - DNA, 20 bp, Artificial Sequence
  Synthetic oligonucleotide; CAG chr11 5199418 5199437 5199434 +
gaaaacctaggtttttaatc

SEQ ID NO: 5863 - DNA, 20 bp, Artificial Sequence
  Synthetic oligonucleotide; CAG chr11 5199431 5199450 5199447 +
tttaatccagctttgtttta

SEQ ID NO: 5864 - DNA, 20 bp, Artificial Sequence
  Synthetic oligonucleotide; AAG chr11 5199436 5199455 5199452 +
tccagctttgttttacagca

SEQ ID NO: 5865 - DNA, 20 bp, Artificial Sequence
  Synthetic oligonucleotide; AGG chr11 5199437 5199456 5199453 +
ccagctttgttttacagcaa

SEQ ID NO: 5866 - DNA, 20 bp, Artificial Sequence
  Synthetic oligonucleotide; AAG chr11 5199450 5199469 5199466 +
acagcaaaggaaatgctcaa

SEQ ID NO: 5867 - DNA, 20 bp, Artificial Sequence
  Synthetic oligonucleotide; CAG chr11 5199460 5199479 5199476 +
aaatgctcaaaagtacattt

SEQ ID NO: 5868 - DNA, 20 bp, Artificial Sequence
  Synthetic oligonucleotide; AGG chr11 5199461 5199480 5199477 +
aatgctcaaaagtacatttc

SEQ ID NO: 5869 - DNA, 20 bp, Artificial Sequence
  Synthetic oligonucleotide; TGG chr11 5199496 5199515 5199512 +
tttttcctctttcttaaata

SEQ ID NO: 5870 - DNA, 20 bp, Artificial Sequence
  Synthetic oligonucleotide; CAG chr11 5199500 5199519 5199516 +
tcctctttcttaaatatggt

SEQ ID NO: 5871 - DNA, 20 bp, Artificial Sequence
  Synthetic oligonucleotide; TAG chr11 5199508 5199527 5199524 +
cttaaatatggtcagactga

SEQ ID NO: 5872 - DNA, 20 bp, Artificial Sequence
  Synthetic oligonucleotide; GAG chr11 5199510 5199529 5199526 +
taaatatggtcagactgata

SEQ ID NO: 5873 - DNA, 20 bp, Artificial Sequence
  Synthetic oligonucleotide; CAG chr11 5199528 5199547 5199544 +
tagagtgacctacatgtgtc

SEQ ID NO: 5874 - DNA, 20 bp, Artificial Sequence
  Synthetic oligonucleotide; AGG chr11 5199529 5199548 5199545 +
agagtgacctacatgtgtcc

SEQ ID NO: 5875 - DNA, 20 bp, Artificial Sequence
  Synthetic oligonucleotide; TGG chr11 5199541 5199560 5199557 +
atgtgtccaggctgacacaa

SEQ ID NO: 5876 - DNA, 20 bp, Artificial Sequence
  Synthetic oligonucleotide; AAG chr11 5199585 5199604 5199601 +
actatatttaaatatttttt

SEQ ID NO: 5877 - DNA, 20 bp, Artificial Sequence
  Synthetic oligonucleotide; AGG chr11 5199586 5199605 5199602 +
ctatatttaaatatttttta

SEQ ID NO: 5878 - DNA, 20 bp, Artificial Sequence
  Synthetic oligonucleotide; TGG chr11 5199599 5199618 5199615 +
ttttttaaggtcatttgtca

SEQ ID NO: 5879 - DNA, 20 bp, Artificial Sequence
  Synthetic oligonucleotide; CAG chr11 5199605 5199624 5199621 +
aaggtcatttgtcatggact

SEQ ID NO: 5880 - DNA, 20 bp, Artificial Sequence
  Synthetic oligonucleotide; GAG chr11 5199607 5199626 5199623 +
ggtcatttgtcatggactca

SEQ ID NO: 5881 - DNA, 20 bp, Artificial Sequence
  Synthetic oligonucleotide; TGG chr11 5199644 5199663 5199660 +
taataattttttctttttta

SEQ ID NO: 5882 - DNA, 20 bp, Artificial Sequence
  Synthetic oligonucleotide; TAG chr11 5199692 5199711 5199708 +
ctgcttttctttcttttttt

SEQ ID NO: 5883 - DNA, 20 bp, Artificial Sequence
  Synthetic oligonucleotide; AGG chr11 5199693 5199712 5199709 +
tgcttttctttctttttttt

SEQ ID NO: 5884 - DNA, 20 bp, Artificial Sequence
  Synthetic oligonucleotide; CAG chr11 5199727 5199746 5199743 +
aatatctctcaatatctttt

SEQ ID NO: 5885 - DNA, 20 bp, Artificial Sequence
  Synthetic oligonucleotide; GAG chr11 5199729 5199748 5199745 +
tatctctcaatatcttttca

SEQ ID NO: 5886 - DNA, 20 bp, Artificial Sequence
  Synthetic oligonucleotide; AAG chr11 5199734 5199753 5199750 +
ctcaatatcttttcagagaa

SEQ ID NO: 5887 - DNA, 20 bp, Artificial Sequence
  Synthetic oligonucleotide; GAG chr11 5199736 5199755 5199752 +
caatatcttttcagagaaaa

SEQ ID NO: 5888 - DNA, 20 bp, Artificial Sequence
  Synthetic oligonucleotide; AAG chr11 5199742 5199761 5199758 +
cttttcagagaaaagagtct

SEQ ID NO: 5889 - DNA, 20 bp, Artificial Sequence
  Synthetic oligonucleotide; TGG chr11 5199750 5199769 5199766 +
agaaaagagtctaagcattc

SEQ ID NO: 5890 - DNA, 20 bp, Artificial Sequence
  Synthetic oligonucleotide; TGG chr11 5199764 5199783 5199780 +
gcattctggtatgaatctgt

SEQ ID NO: 5891 - DNA, 20 bp, Artificial Sequence
  Synthetic oligonucleotide; GGG chr11 5199765 5199784 5199781 +
cattctggtatgaatctgtt

SEQ ID NO: 5892 - DNA, 20 bp, Artificial Sequence
  Synthetic oligonucleotide; TAG chr11 5199779 5199798 5199795 +
tctgttgggtcttgacactg

SEQ ID NO: 5893 - DNA, 20 bp, Artificial Sequence
  Synthetic oligonucleotide; TGG chr11 5199786 5199805 5199802 +
ggtcttgacactgtagatga

SEQ ID NO: 5894 - DNA, 20 bp, Artificial Sequence
  Synthetic oligonucleotide; GGG chr11 5199787 5199806 5199803 +
gtcttgacactgtagatgat

SEQ ID NO: 5895 - DNA, 20 bp, Artificial Sequence
  Synthetic oligonucleotide; AAG chr11 5199798 5199817 5199814 +
gtagatgatgggattcatta

SEQ ID NO: 5896 - DNA, 20 bp, Artificial Sequence
  Synthetic oligonucleotide; AGG chr11 5199799 5199818 5199815 +
tagatgatgggattcattaa

SEQ ID NO: 5897 - DNA, 20 bp, Artificial Sequence
  Synthetic oligonucleotide; TGG chr11 5199802 5199821 5199818 +
atgatgggattcattaaagg

SEQ ID NO: 5898 - DNA, 20 bp, Artificial Sequence
  Synthetic oligonucleotide; GGG chr11 5199803 5199822 5199819 +
tgatgggattcattaaaggt

SEQ ID NO: 5899 - DNA, 20 bp, Artificial Sequence
  Synthetic oligonucleotide; AAG chr11 5199808 5199827 5199824 +
ggattcattaaaggtgggaa

SEQ ID NO: 5900 - DNA, 20 bp, Artificial Sequence
  Synthetic oligonucleotide; AGG chr11 5199809 5199828 5199825 +
gattcattaaaggtgggaaa

SEQ ID NO: 5901 - DNA, 20 bp, Artificial Sequence
  Synthetic oligonucleotide; TAG chr11 5199815 5199834 5199831 +
ttaaaggtgggaaaaggatg

SEQ ID NO: 5902 - DNA, 20 bp, Artificial Sequence
  Synthetic oligonucleotide; GAG chr11 5199829 5199848 5199845 +
aggatgtagatgttgccaat

SEQ ID NO: 5903 - DNA, 20 bp, Artificial Sequence
  Synthetic oligonucleotide; TGG chr11 5199836 5199855 5199852 +
agatgttgccaatgagaacg

SEQ ID NO: 5904 - DNA, 20 bp, Artificial Sequence
  Synthetic oligonucleotide; GGG chr11 5199837 5199856 5199853 +
gatgttgccaatgagaacgt

SEQ ID NO: 5905 - DNA, 20 bp, Artificial Sequence
  Synthetic oligonucleotide; CGG chr11 5199843 5199862 5199859 +
gccaatgagaacgtgggcca

SEQ ID NO: 5906 - DNA, 20 bp, Artificial Sequence
  Synthetic oligonucleotide; GGG chr11 5199844 5199863 5199860 +
ccaatgagaacgtgggccac

SEQ ID NO: 5907 - DNA, 20 bp, Artificial Sequence
  Synthetic oligonucleotide; GGG chr11 5199845 5199864 5199861 +
caatgagaacgtgggccacg

SEQ ID NO: 5908 - DNA, 20 bp, Artificial Sequence
  Synthetic oligonucleotide; GGG chr11 5199846 5199865 5199862 +
aatgagaacgtgggccacgg

SEQ ID NO: 5909 - DNA, 20 bp, Artificial Sequence
  Synthetic oligonucleotide; AAG chr11 5199850 5199869 5199866 +
agaacgtgggccacggggga

SEQ ID NO: 5910 - DNA, 20 bp, Artificial Sequence
  Synthetic oligonucleotide; AGG chr11 5199851 5199870 5199867 +
gaacgtgggccacgggggaa

SEQ ID NO: 5911 - DNA, 20 bp, Artificial Sequence
  Synthetic oligonucleotide; CGG chr11 5199866 5199885 5199882 +
gggaaaggtgcttgccaaaa

SEQ ID NO: 5912 - DNA, 20 bp, Artificial Sequence
  Synthetic oligonucleotide; GAG chr11 5199880 5199899 5199896 +
ccaaaacggtgcaccattgt

SEQ ID NO: 5913 - DNA, 20 bp, Artificial Sequence
  Synthetic oligonucleotide; AGG chr11 5199881 5199900 5199897 +
caaaacggtgcaccattgtg

SEQ ID NO: 5914 - DNA, 20 bp, Artificial Sequence
  Synthetic oligonucleotide; TAG chr11 5199891 5199910 5199907 +
caccattgtgaggctaatga

SEQ ID NO: 5915 - DNA, 20 bp, Artificial Sequence
  Synthetic oligonucleotide; AGG chr11 5199892 5199911 5199908 +
accattgtgaggctaatgat

SEQ ID NO: 5916 - DNA, 20 bp, Artificial Sequence
  Synthetic oligonucleotide; GGG chr11 5199893 5199912 5199909 +
ccattgtgaggctaatgata

SEQ ID NO: 5917 - DNA, 20 bp, Artificial Sequence
  Synthetic oligonucleotide; TAG chr11 5199899 5199918 5199915 +
tgaggctaatgatagggatg

SEQ ID NO: 5918 - DNA, 20 bp, Artificial Sequence
  Synthetic oligonucleotide; AAG chr11 5199907 5199926 5199923 +
atgatagggatgtagaacac

SEQ ID NO: 5919 - DNA, 20 bp, Artificial Sequence
  Synthetic oligonucleotide; AGG chr11 5199908 5199927 5199924 +
tgatagggatgtagaacaca

SEQ ID NO: 5920 - DNA, 20 bp, Artificial Sequence
  Synthetic oligonucleotide; CAG chr11 5199912 5199931 5199928 +
agggatgtagaacacaagga

SEQ ID NO: 5921 - DNA, 20 bp, Artificial Sequence
  Synthetic oligonucleotide; CAG chr11 5199917 5199936 5199933 +
tgtagaacacaaggacagca

SEQ ID NO: 5922 - DNA, 20 bp, Artificial Sequence
  Synthetic oligonucleotide; TGG chr11 5199923 5199942 5199939 +
acacaaggacagcacagatg

SEQ ID NO: 5923 - DNA, 20 bp, Artificial Sequence
  Synthetic oligonucleotide; GGG chr11 5199924 5199943 5199940 +
cacaaggacagcacagatgt

SEQ ID NO: 5924 - DNA, 20 bp, Artificial Sequence
  Synthetic oligonucleotide; GAG chr11 5199926 5199945 5199942 +
caaggacagcacagatgtgg

SEQ ID NO: 5925 - DNA, 20 bp, Artificial Sequence
  Synthetic oligonucleotide; CAG chr11 5199932 5199951 5199948 +
cagcacagatgtgggagatg

SEQ ID NO: 5926 - DNA, 20 bp, Artificial Sequence
  Synthetic oligonucleotide; AGG chr11 5199933 5199952 5199949 +
agcacagatgtgggagatgc

SEQ ID NO: 5927 - DNA, 20 bp, Artificial Sequence
  Synthetic oligonucleotide; GAG chr11 5199963 5199982 5199979 +
taatttatgcctctcttcct

SEQ ID NO: 5928 - DNA, 20 bp, Artificial Sequence
  Synthetic oligonucleotide; GAG chr11 5199965 5199984 5199981 +
atttatgcctctcttcctga

SEQ ID NO: 5929 - DNA, 20 bp, Artificial Sequence
  Synthetic oligonucleotide; AGG chr11 5199966 5199985 5199982 +
tttatgcctctcttcctgag

SEQ ID NO: 5930 - DNA, 20 bp, Artificial Sequence
  Synthetic oligonucleotide; CAG chr11 5199976 5199995 5199992 +
tcttcctgagaggcaactgc

SEQ ID NO: 5931 - DNA, 20 bp, Artificial Sequence
  Synthetic oligonucleotide; AGG chr11 5199977 5199996 5199993 +
cttcctgagaggcaactgcc

SEQ ID NO: 5932 - DNA, 20 bp, Artificial Sequence
  Synthetic oligonucleotide; AAG chr11 5199988 5200007 5200004 +
gcaactgccaggactgactt

SEQ ID NO: 5933 - DNA, 20 bp, Artificial Sequence
  Synthetic oligonucleotide; CAG chr11 5199994 5200013 5200010 +
gccaggactgacttaagaat

SEQ ID NO: 5934 - DNA, 20 bp, Artificial Sequence
  Synthetic oligonucleotide; AGG chr11 5199995 5200014 5200011 +
ccaggactgacttaagaatc

SEQ ID NO: 5935 - DNA, 20 bp, Artificial Sequence
  Synthetic oligonucleotide; TAG chr11 5200001 5200020 5200017 +
ctgacttaagaatcaggatg

SEQ ID NO: 5936 - DNA, 20 bp, Artificial Sequence
  Synthetic oligonucleotide; AGG chr11 5200002 5200021 5200018 +
tgacttaagaatcaggatgt

SEQ ID NO: 5937 - DNA, 20 bp, Artificial Sequence
  Synthetic oligonucleotide; GAG chr11 5200004 5200023 5200020 +
acttaagaatcaggatgtag

SEQ ID NO: 5938 - DNA, 20 bp, Artificial Sequence
  Synthetic oligonucleotide; AAG chr11 5200009 5200028 5200025 +
agaatcaggatgtaggagaa

SEQ ID NO: 5939 - DNA, 20 bp, Artificial Sequence
  Synthetic oligonucleotide; AGG chr11 5200010 5200029 5200026 +
gaatcaggatgtaggagaaa

SEQ ID NO: 5940 - DNA, 20 bp, Artificial Sequence
  Synthetic oligonucleotide; GAG chr11 5200015 5200034 5200031 +
aggatgtaggagaaaaggat

SEQ ID NO: 5941 - DNA, 20 bp, Artificial Sequence
  Synthetic oligonucleotide; TAG chr11 5200020 5200039 5200036 +
gtaggagaaaaggatgagta

SEQ ID NO: 5942 - DNA, 20 bp, Artificial Sequence
  Synthetic oligonucleotide; CAG chr11 5200033 5200052 5200049 +
atgagtatagcatccaacaa

SEQ ID NO: 5943 - DNA, 20 bp, Artificial Sequence
  Synthetic oligonucleotide; CAG chr11 5200048 5200067 5200064 +
aacaacagtatgcaaataac

SEQ ID NO: 5944 - DNA, 20 bp, Artificial Sequence
  Synthetic oligonucleotide; CAG chr11 5200054 5200073 5200070 +
agtatgcaaataaccagcat

SEQ ID NO: 5945 - DNA, 20 bp, Artificial Sequence
  Synthetic oligonucleotide; AGG chr11 5200055 5200074 5200071 +
gtatgcaaataaccagcatc

SEQ ID NO: 5946 - DNA, 20 bp, Artificial Sequence
  Synthetic oligonucleotide; GGG chr11 5200056 5200075 5200072 +
tatgcaaataaccagcatca

SEQ ID NO: 5947 - DNA, 20 bp, Artificial Sequence
  Synthetic oligonucleotide; TAG chr11 5200061 5200080 5200077 +
aaataaccagcatcagggca

SEQ ID NO: 5948 - DNA, 20 bp, Artificial Sequence
  Synthetic oligonucleotide; CGG chr11 5200076 5200095 5200092 +
gggcatagtaactattgaat

SEQ ID NO: 5949 - DNA, 20 bp, Artificial Sequence
  Synthetic oligonucleotide; CAG chr11 5200088 5200107 5200104 +
tattgaatcggatgtctgaa

SEQ ID NO: 5950 - DNA, 20 bp, Artificial Sequence
  Synthetic oligonucleotide; AGG chr11 5200089 5200108 5200105 +
attgaatcggatgtctgaac

SEQ ID NO: 5951 - DNA, 20 bp, Artificial Sequence
  Synthetic oligonucleotide; AAG chr11 5200094 5200113 5200110 +
atcggatgtctgaacaggct

SEQ ID NO: 5952 - DNA, 20 bp, Artificial Sequence
  Synthetic oligonucleotide; CGG chr11 5200097 5200116 5200113 +
ggatgtctgaacaggctaag

SEQ ID NO: 5953 - DNA, 20 bp, Artificial Sequence
  Synthetic oligonucleotide; GAG chr11 5200099 5200118 5200115 +
atgtctgaacaggctaagcg

SEQ ID NO: 5954 - DNA, 20 bp, Artificial Sequence
  Synthetic oligonucleotide; AAG chr11 5200102 5200121 5200118 +
tctgaacaggctaagcggag

SEQ ID NO: 5955 - DNA, 20 bp, Artificial Sequence
  Synthetic oligonucleotide; TGG chr11 5200109 5200128 5200125 +
aggctaagcggagaagatcc

SEQ ID NO: 5956 - DNA, 20 bp, Artificial Sequence
  Synthetic oligonucleotide; CAG chr11 5200114 5200133 5200130 +
aagcggagaagatcctggtg

SEQ ID NO: 5957 - DNA, 20 bp, Artificial Sequence
  Synthetic oligonucleotide; AGG chr11 5200115 5200134 5200131 +
agcggagaagatcctggtgc

SEQ ID NO: 5958 - DNA, 20 bp, Artificial Sequence
  Synthetic oligonucleotide; CAG chr11 5200118 5200137 5200134 +
ggagaagatcctggtgcagg

SEQ ID NO: 5959 - DNA, 20 bp, Artificial Sequence
  Synthetic oligonucleotide; AAG chr11 5200122 5200141 5200138 +
aagatcctggtgcaggcaga

SEQ ID NO: 5960 - DNA, 20 bp, Artificial Sequence
  Synthetic oligonucleotide; GAG chr11 5200124 5200143 5200140 +
gatcctggtgcaggcagaaa

SEQ ID NO: 5961 - DNA, 20 bp, Artificial Sequence
  Synthetic oligonucleotide; GAG chr11 5200128 5200147 5200144 +
ctggtgcaggcagaaagagt

SEQ ID NO: 5962 - DNA, 20 bp, Artificial Sequence
  Synthetic oligonucleotide; AAG chr11 5200132 5200151 5200148 +
tgcaggcagaaagagtgaga

SEQ ID NO: 5963 - DNA, 20 bp, Artificial Sequence
  Synthetic oligonucleotide; AGG chr11 5200133 5200152 5200149 +
gcaggcagaaagagtgagaa

SEQ ID NO: 5964 - DNA, 20 bp, Artificial Sequence
  Synthetic oligonucleotide; TGG chr11 5200139 5200158 5200155 +
agaaagagtgagaaaggatg

SEQ ID NO: 5965 - DNA, 20 bp, Artificial Sequence
  Synthetic oligonucleotide; CAG chr11 5200148 5200167 5200164 +
gagaaaggatgtggaaatga

SEQ ID NO: 5966 - DNA, 20 bp, Artificial Sequence
  Synthetic oligonucleotide; CAG chr11 5200165 5200184 5200181 +
tgacagtaattaaaaaattt

SEQ ID NO: 5967 - DNA, 20 bp, Artificial Sequence
  Synthetic oligonucleotide; CAG chr11 5200169 5200188 5200185 +
agtaattaaaaaatttcaga

SEQ ID NO: 5968 - DNA, 20 bp, Artificial Sequence
  Synthetic oligonucleotide; TGG chr11 5200176 5200195 5200192 +
aaaaaatttcagacagatga

SEQ ID NO: 5969 - DNA, 20 bp, Artificial Sequence
  Synthetic oligonucleotide; GGG chr11 5200177 5200196 5200193 +
aaaaatttcagacagatgat

SEQ ID NO: 5970 - DNA, 20 bp, Artificial Sequence
  Synthetic oligonucleotide; GGG chr11 5200178 5200197 5200194 +
aaaatttcagacagatgatg

SEQ ID NO: 5971 - DNA, 20 bp, Artificial Sequence
  Synthetic oligonucleotide; GGG chr11 5200179 5200198 5200195 +
aaatttcagacagatgatgg

SEQ ID NO: 5972 - DNA, 20 bp, Artificial Sequence
  Synthetic oligonucleotide; GGG chr11 5200180 5200199 5200196 +
aatttcagacagatgatggg

SEQ ID NO: 5973 - DNA, 20 bp, Artificial Sequence
  Synthetic oligonucleotide; AAG chr11 5200190 5200209 5200206 +
agatgatggggggtgtaata

SEQ ID NO: 5974 - DNA, 20 bp, Artificial Sequence
  Synthetic oligonucleotide; TAG chr11 5200212 5200231 5200228 +
gaaaaaactcctacctatta

SEQ ID NO: 5975 - DNA, 20 bp, Artificial Sequence
  Synthetic oligonucleotide; GAG chr11 5200216 5200235 5200232 +
aaactcctacctattatagt

SEQ ID NO: 5976 - DNA, 20 bp, Artificial Sequence
  Synthetic oligonucleotide; TGG chr11 5200236 5200255 5200252 +
gagcccaattttgataattc

SEQ ID NO: 5977 - DNA, 20 bp, Artificial Sequence
  Synthetic oligonucleotide; TAG chr11 5200242 5200261 5200258 +
aattttgataattctggaat

SEQ ID NO: 5978 - DNA, 20 bp, Artificial Sequence
  Synthetic oligonucleotide; CAG chr11 5200246 5200265 5200262 +
ttgataattctggaattagt

SEQ ID NO: 5979 - DNA, 20 bp, Artificial Sequence
  Synthetic oligonucleotide; AGG chr11 5200247 5200266 5200263 +
tgataattctggaattagtc

SEQ ID NO: 5980 - DNA, 20 bp, Artificial Sequence
  Synthetic oligonucleotide; TGG chr11 5200251 5200270 5200267 +
aattctggaattagtcagga

SEQ ID NO: 5981 - DNA, 20 bp, Artificial Sequence
  Synthetic oligonucleotide; GAG chr11 5200253 5200272 5200269 +
ttctggaattagtcaggatg

SEQ ID NO: 5982 - DNA, 20 bp, Artificial Sequence
  Synthetic oligonucleotide; AGG chr11 5200254 5200273 5200270 +
tctggaattagtcaggatgg

SEQ ID NO: 5983 - DNA, 20 bp, Artificial Sequence
  Synthetic oligonucleotide; TAG chr11 5200264 5200283 5200280 +
gtcaggatggaggaataacg

SEQ ID NO: 5984 - DNA, 20 bp, Artificial Sequence
  Synthetic oligonucleotide; TGG chr11 5200267 5200286 5200283 +
aggatggaggaataacgtag

SEQ ID NO: 5985 - DNA, 20 bp, Artificial Sequence
  Synthetic oligonucleotide; CGG chr11 5200289 5200308 5200305 +
gattgcaaattgcaatgtac

SEQ ID NO: 5986 - DNA, 20 bp, Artificial Sequence
  Synthetic oligonucleotide; AAG chr11 5200295 5200314 5200311 +
aaattgcaatgtaccggtca

SEQ ID NO: 5987 - DNA, 20 bp, Artificial Sequence
  Synthetic oligonucleotide; AGG chr11 5200296 5200315 5200312 +
aattgcaatgtaccggtcaa

SEQ ID NO: 5988 - DNA, 20 bp, Artificial Sequence
  Synthetic oligonucleotide; TAG chr11 5200302 5200321 5200318 +
aatgtaccggtcaaaggcca

SEQ ID NO: 5989 - DNA, 20 bp, Artificial Sequence
  Synthetic oligonucleotide; GAG chr11 5200306 5200325 5200322 +
taccggtcaaaggccatagt

SEQ ID NO: 5990 - DNA, 20 bp, Artificial Sequence
  Synthetic oligonucleotide; AGG chr11 5200307 5200326 5200323 +
accggtcaaaggccatagtg

SEQ ID NO: 5991 - DNA, 20 bp, Artificial Sequence
  Synthetic oligonucleotide; GAG chr11 5200309 5200328 5200325 +
cggtcaaaggccatagtgag

SEQ ID NO: 5992 - DNA, 20 bp, Artificial Sequence
  Synthetic oligonucleotide; AGG chr11 5200310 5200329 5200326 +
ggtcaaaggccatagtgagg

SEQ ID NO: 5993 - DNA, 20 bp, Artificial Sequence
  Synthetic oligonucleotide; CAG chr11 5200314 5200333 5200330 +
aaaggccatagtgaggagga

SEQ ID NO: 5994 - DNA, 20 bp, Artificial Sequence
  Synthetic oligonucleotide; GAG chr11 5200316 5200335 5200332 +
aggccatagtgaggaggaca

SEQ ID NO: 5995 - DNA, 20 bp, Artificial Sequence
  Synthetic oligonucleotide; AGG chr11 5200317 5200336 5200333 +
ggccatagtgaggaggacag

SEQ ID NO: 5996 - DNA, 20 bp, Artificial Sequence
  Synthetic oligonucleotide; AAG chr11 5200328 5200347 5200344 +
ggaggacagaggactccatg

SEQ ID NO: 5997 - DNA, 20 bp, Artificial Sequence
  Synthetic oligonucleotide; AGG chr11 5200329 5200348 5200345 +
gaggacagaggactccatga

SEQ ID NO: 5998 - DNA, 20 bp, Artificial Sequence
  Synthetic oligonucleotide; CAG chr11 5200333 5200352 5200349 +
acagaggactccatgaagga

SEQ ID NO: 5999 - DNA, 20 bp, Artificial Sequence
  Synthetic oligonucleotide; TGG chr11 5200340 5200359 5200356 +
actccatgaaggacagacca

SEQ ID NO: 6000 - DNA, 20 bp, Artificial Sequence
  Synthetic oligonucleotide; TAG chr11 5200349 5200368 5200365 +
aggacagaccatggatgaaa

SEQ ID NO: 6001 - DNA, 20 bp, Artificial Sequence
  Synthetic oligonucleotide; AGG chr11 5200350 5200369 5200366 +
ggacagaccatggatgaaat

SEQ ID NO: 6002 - DNA, 20 bp, Artificial Sequence
  Synthetic oligonucleotide; TGG chr11 5200355 5200374 5200371 +
gaccatggatgaaataggac

SEQ ID NO: 6003 - DNA, 20 bp, Artificial Sequence
  Synthetic oligonucleotide; GGG chr11 5200356 5200375 5200372 +
accatggatgaaataggact

SEQ ID NO: 6004 - DNA, 20 bp, Artificial Sequence
  Synthetic oligonucleotide; CAG chr11 5200364 5200383 5200380 +
tgaaataggactgggcaatg

SEQ ID NO: 6005 - DNA, 20 bp, Artificial Sequence
  Synthetic oligonucleotide; AGG chr11 5200365 5200384 5200381 +
gaaataggactgggcaatgc

SEQ ID NO: 6006 - DNA, 20 bp, Artificial Sequence
  Synthetic oligonucleotide; AAG chr11 5200373 5200392 5200389 +
actgggcaatgcaggaatcc

SEQ ID NO: 6007 - DNA, 20 bp, Artificial Sequence
  Synthetic oligonucleotide; CAG chr11 5200399 5200418 5200415 +
atctctcgaatgatccccca

SEQ ID NO: 6008 - DNA, 20 bp, Artificial Sequence
  Synthetic oligonucleotide; AGG chr11 5200400 5200419 5200416 +
tctctcgaatgatcccccac

SEQ ID NO: 6009 - DNA, 20 bp, Artificial Sequence
  Synthetic oligonucleotide; CAG chr11 5200408 5200427 5200424 +
atgatcccccacaggatccc

SEQ ID NO: 6010 - DNA, 20 bp, Artificial Sequence
  Synthetic oligonucleotide; CAG chr11 5200422 5200441 5200438 +
gatccccagcactgtgtaca

SEQ ID NO: 6011 - DNA, 20 bp, Artificial Sequence
  Synthetic oligonucleotide; TGG chr11 5200425 5200444 5200441 +
ccccagcactgtgtacacag

SEQ ID NO: 6012 - DNA, 20 bp, Artificial Sequence
  Synthetic oligonucleotide; CAG chr11 5200429 5200448 5200445 +
agcactgtgtacacagtgga

SEQ ID NO: 6013 - DNA, 20 bp, Artificial Sequence
  Synthetic oligonucleotide; CAG chr11 5200441 5200460 5200457 +
acagtggacagccccatgca

SEQ ID NO: 6014 - DNA, 20 bp, Artificial Sequence
  Synthetic oligonucleotide; AGG chr11 5200442 5200461 5200458 +
cagtggacagccccatgcac

SEQ ID NO: 6015 - DNA, 20 bp, Artificial Sequence
  Synthetic oligonucleotide; CAG chr11 5200446 5200465 5200462 +
ggacagccccatgcacaggt

SEQ ID NO: 6016 - DNA, 20 bp, Artificial Sequence
  Synthetic oligonucleotide; GAG chr11 5200450 5200469 5200466 +
agccccatgcacaggtcagt

SEQ ID NO: 6017 - DNA, 20 bp, Artificial Sequence
  Synthetic oligonucleotide; AGG chr11 5200451 5200470 5200467 +
gccccatgcacaggtcagtg

SEQ ID NO: 6018 - DNA, 20 bp, Artificial Sequence
  Synthetic oligonucleotide; GGG chr11 5200452 5200471 5200468 +
ccccatgcacaggtcagtga

SEQ ID NO: 6019 - DNA, 20 bp, Artificial Sequence
  Synthetic oligonucleotide; CAG chr11 5200456 5200475 5200472 +
atgcacaggtcagtgagggc

SEQ ID NO: 6020 - DNA, 20 bp, Artificial Sequence
  Synthetic oligonucleotide; TGG chr11 5200461 5200480 5200477 +
caggtcagtgagggccagca

SEQ ID NO: 6021 - DNA, 20 bp, Artificial Sequence
  Synthetic oligonucleotide; CAG chr11 5200465 5200484 5200481 +
tcagtgagggccagcatgga

SEQ ID NO: 6022 - DNA, 20 bp, Artificial Sequence
  Synthetic oligonucleotide; AGG chr11 5200466 5200485 5200482 +
cagtgagggccagcatggac

SEQ ID NO: 6023 - DNA, 20 bp, Artificial Sequence
  Synthetic oligonucleotide; AAG chr11 5200469 5200488 5200485 +
tgagggccagcatggacagg

SEQ ID NO: 6024 - DNA, 20 bp, Artificial Sequence
  Synthetic oligonucleotide; TAG chr11 5200479 5200498 5200495 +
catggacaggaagtaaaaca

SEQ ID NO: 6025 - DNA, 20 bp, Artificial Sequence
  Synthetic oligonucleotide; AGG chr11 5200480 5200499 5200496 +
atggacaggaagtaaaacat

SEQ ID NO: 6026 - DNA, 20 bp, Artificial Sequence
  Synthetic oligonucleotide; TGG chr11 5200484 5200503 5200500 +
acaggaagtaaaacataggc

SEQ ID NO: 6027 - DNA, 20 bp, Artificial Sequence
  Synthetic oligonucleotide; CAG chr11 5200489 5200508 5200505 +
aagtaaaacataggctggtg

SEQ ID NO: 6028 - DNA, 20 bp, Artificial Sequence
  Synthetic oligonucleotide; AGG chr11 5200490 5200509 5200506 +
agtaaaacataggctggtgc

SEQ ID NO: 6029 - DNA, 20 bp, Artificial Sequence
  Synthetic oligonucleotide; TGG chr11 5200495 5200514 5200511 +
aacataggctggtgcaggct

SEQ ID NO: 6030 - DNA, 20 bp, Artificial Sequence
  Synthetic oligonucleotide; CAG chr11 5200500 5200519 5200516 +
aggctggtgcaggcttggct

SEQ ID NO: 6031 - DNA, 20 bp, Artificial Sequence
  Synthetic oligonucleotide; TGG chr11 5200514 5200533 5200530 +
ttggctcagtccatatcaca

SEQ ID NO: 6032 - DNA, 20 bp, Artificial Sequence
  Synthetic oligonucleotide; GAG chr11 5200516 5200535 5200532 +
ggctcagtccatatcacatg

SEQ ID NO: 6033 - DNA, 20 bp, Artificial Sequence
  Synthetic oligonucleotide; AAG chr11 5200537 5200556 5200553 +
agaaccatgcaattgcccaa

SEQ ID NO: 6034 - DNA, 20 bp, Artificial Sequence
  Synthetic oligonucleotide; TGG chr11 5200545 5200564 5200561 +
gcaattgcccaaaagcacca

SEQ ID NO: 6035 - DNA, 20 bp, Artificial Sequence
  Synthetic oligonucleotide; TAG chr11 5200550 5200569 5200566 +
tgcccaaaagcaccatggca

SEQ ID NO: 6036 - DNA, 20 bp, Artificial Sequence
  Synthetic oligonucleotide; GAG chr11 5200556 5200575 5200572 +
aaagcaccatggcatagatt

SEQ ID NO: 6037 - DNA, 20 bp, Artificial Sequence
  Synthetic oligonucleotide; AGG chr11 5200557 5200576 5200573 +
aagcaccatggcatagattg

SEQ ID NO: 6038 - DNA, 20 bp, Artificial Sequence
  Synthetic oligonucleotide; GAG chr11 5200559 5200578 5200575 +
gcaccatggcatagattgag

SEQ ID NO: 6039 - DNA, 20 bp, Artificial Sequence
  Synthetic oligonucleotide; AAG chr11 5200562 5200581 5200578 +
ccatggcatagattgaggag

SEQ ID NO: 6040 - DNA, 20 bp, Artificial Sequence
  Synthetic oligonucleotide; AGG chr11 5200563 5200582 5200579 +
catggcatagattgaggaga

SEQ ID NO: 6041 - DNA, 20 bp, Artificial Sequence
  Synthetic oligonucleotide; GGG chr11 5200564 5200583 5200580 +
atggcatagattgaggagaa

SEQ ID NO: 6042 - DNA, 20 bp, Artificial Sequence
  Synthetic oligonucleotide; GGG chr11 5200565 5200584 5200581 +
tggcatagattgaggagaag

SEQ ID NO: 6043 - DNA, 20 bp, Artificial Sequence
  Synthetic oligonucleotide; TGG chr11 5200569 5200588 5200585 +
atagattgaggagaagggga

SEQ ID NO: 6044 - DNA, 20 bp, Artificial Sequence
  Synthetic oligonucleotide; AAG chr11 5200573 5200592 5200589 +
attgaggagaaggggatgga

SEQ ID NO: 6045 - DNA, 20 bp, Artificial Sequence
  Synthetic oligonucleotide; CAG chr11 5200577 5200596 5200593 +
aggagaaggggatggaaagc

SEQ ID NO: 6046 - DNA, 20 bp, Artificial Sequence
  Synthetic oligonucleotide; AGG chr11 5200578 5200597 5200594 +
ggagaaggggatggaaagcc

SEQ ID NO: 6047 - DNA, 20 bp, Artificial Sequence
  Synthetic oligonucleotide; GGG chr11 5200579 5200598 5200595 +
gagaaggggatggaaagcca

SEQ ID NO: 6048 - DNA, 20 bp, Artificial Sequence
  Synthetic oligonucleotide; GGG chr11 5200580 5200599 5200596 +
agaaggggatggaaagccag

SEQ ID NO: 6049 - DNA, 20 bp, Artificial Sequence
  Synthetic oligonucleotide; CAG chr11 5200599 5200618 5200615 +
ggggtattgctgctccatgc

SEQ ID NO: 6050 - DNA, 20 bp, Artificial Sequence
  Synthetic oligonucleotide; CAG chr11 5200608 5200627 5200624 +
ctgctccatgccagaaaatc

SEQ ID NO: 6051 - DNA, 20 bp, Artificial Sequence
  Synthetic oligonucleotide; GAG chr11 5200612 5200631 5200628 +
tccatgccagaaaatccagt

SEQ ID NO: 6052 - DNA, 20 bp, Artificial Sequence
  Synthetic oligonucleotide; AAG chr11 5200615 5200634 5200631 +
atgccagaaaatccagtgag

SEQ ID NO: 6053 - DNA, 20 bp, Artificial Sequence
  Synthetic oligonucleotide; AAG chr11 5200619 5200638 5200635 +
cagaaaatccagtgagaaga

SEQ ID NO: 6054 - DNA, 20 bp, Artificial Sequence
  Synthetic oligonucleotide; AGG chr11 5200620 5200639 5200636 +
agaaaatccagtgagaagaa

SEQ ID NO: 6055 - DNA, 20 bp, Artificial Sequence
  Synthetic oligonucleotide; AAG chr11 5200623 5200642 5200639 +
aaatccagtgagaagaaagg

SEQ ID NO: 6056 - DNA, 20 bp, Artificial Sequence
  Synthetic oligonucleotide; TGG chr11 5200635 5200654 5200651 +
aagaaaggaagaattcgtgc

SEQ ID NO: 6057 - DNA, 20 bp, Artificial Sequence
  Synthetic oligonucleotide; TAG chr11 5200641 5200660 5200657 +
ggaagaattcgtgctggtgc

SEQ ID NO: 6058 - DNA, 20 bp, Artificial Sequence
  Synthetic oligonucleotide; AGG chr11 5200642 5200661 5200658 +
gaagaattcgtgctggtgct

SEQ ID NO: 6059 - DNA, 20 bp, Artificial Sequence
  Synthetic oligonucleotide; GGG chr11 5200643 5200662 5200659 +
aagaattcgtgctggtgcta

SEQ ID NO: 6060 - DNA, 20 bp, Artificial Sequence
  Synthetic oligonucleotide; AAG chr11 5200653 5200672 5200669 +
gctggtgctagggcttactg

SEQ ID NO: 6061 - DNA, 20 bp, Artificial Sequence
  Synthetic oligonucleotide; TGG chr11 5200665 5200684 5200681 +
gcttactgaagtaatcattc

SEQ ID NO: 6062 - DNA, 20 bp, Artificial Sequence
  Synthetic oligonucleotide; GAG chr11 5200672 5200691 5200688 +
gaagtaatcattctggaact

SEQ ID NO: 6063 - DNA, 20 bp, Artificial Sequence
  Synthetic oligonucleotide; GAG chr11 5200683 5200702 5200699 +
tctggaactgagaaacatgt

SEQ ID NO: 6064 - DNA, 20 bp, Artificial Sequence
  Synthetic oligonucleotide; GAG chr11 5200685 5200704 5200701 +
tggaactgagaaacatgtga

SEQ ID NO: 6065 - DNA, 20 bp, Artificial Sequence
  Synthetic oligonucleotide; AAG chr11 5200698 5200717 5200714 +
catgtgagagtattttttca

SEQ ID NO: 6066 - DNA, 20 bp, Artificial Sequence
  Synthetic oligonucleotide; AGG chr11 5200699 5200718 5200715 +
atgtgagagtattttttcaa

SEQ ID NO: 6067 - DNA, 20 bp, Artificial Sequence
  Synthetic oligonucleotide; AAG chr11 5200739 5200758 5200755 +
ctgaatacaatgaaatttct

SEQ ID NO: 6068 - DNA, 20 bp, Artificial Sequence
  Synthetic oligonucleotide; CAG chr11 5200780 5200799 5200796 +
acttactgacttaaaaaaaa

SEQ ID NO: 6069 - DNA, 20 bp, Artificial Sequence
  Synthetic oligonucleotide; GAG chr11 5200785 5200804 5200801 +
ctgacttaaaaaaaacagct

SEQ ID NO: 6070 - DNA, 20 bp, Artificial Sequence
  Synthetic oligonucleotide; GAG chr11 5200803 5200822 5200819 +
ctgagaaattctgtttcttt

SEQ ID NO: 6071 - DNA, 20 bp, Artificial Sequence
  Synthetic oligonucleotide; TAG chr11 5200809 5200828 5200825 +
aattctgtttctttgagaca

SEQ ID NO: 6072 - DNA, 20 bp, Artificial Sequence
  Synthetic oligonucleotide; GAG chr11 5200826 5200845 5200842 +
acatagtatccattgccttt

SEQ ID NO: 6073 - DNA, 20 bp, Artificial Sequence
  Synthetic oligonucleotide; TGG chr11 5200833 5200852 5200849 +
atccattgcctttgagaaaa

SEQ ID NO: 6074 - DNA, 20 bp, Artificial Sequence
  Synthetic oligonucleotide; AAG chr11 5200857 5200876 5200873 +
cttcttttgatgtcatttaa

SEQ ID NO: 6075 - DNA, 20 bp, Artificial Sequence
  Synthetic oligonucleotide; TGG chr11 5200879 5200898 5200895 +
gtcattattttttcactgtc

SEQ ID NO: 6076 - DNA, 20 bp, Artificial Sequence
  Synthetic oligonucleotide; TAG chr11 5200897 5200916 5200913 +
tctggatgtgaacatatcct

SEQ ID NO: 6077 - DNA, 20 bp, Artificial Sequence
  Synthetic oligonucleotide; AAG chr11 5200900 5200919 5200916 +
ggatgtgaacatatccttag

SEQ ID NO: 6078 - DNA, 20 bp, Artificial Sequence
  Synthetic oligonucleotide; AAG chr11 5200907 5200926 5200923 +
aacatatccttagaagccat

SEQ ID NO: 6079 - DNA, 20 bp, Artificial Sequence
  Synthetic oligonucleotide; AAG chr11 5200921 5200940 5200937 +
agccataagcaaaaacaaat

SEQ ID NO: 6080 - DNA, 20 bp, Artificial Sequence
  Synthetic oligonucleotide; AGG chr11 5200922 5200941 5200938 +
gccataagcaaaaacaaata

SEQ ID NO: 6081 - DNA, 20 bp, Artificial Sequence
  Synthetic oligonucleotide; AAG chr11 5200925 5200944 5200941 +
ataagcaaaaacaaataagg

SEQ ID NO: 6082 - DNA, 20 bp, Artificial Sequence
  Synthetic oligonucleotide; GAG chr11 5200927 5200946 5200943 +
aagcaaaaacaaataaggaa

SEQ ID NO: 6083 - DNA, 20 bp, Artificial Sequence
  Synthetic oligonucleotide; TAG chr11 5200932 5200951 5200948 +
aaaacaaataaggaagagat

SEQ ID NO: 6084 - DNA, 20 bp, Artificial Sequence
  Synthetic oligonucleotide; AAG chr11 5200938 5200957 5200954 +
aataaggaagagattagtaa

SEQ ID NO: 6085 - DNA, 20 bp, Artificial Sequence
  Synthetic oligonucleotide; AGG chr11 5200939 5200958 5200955 +
ataaggaagagattagtaaa

SEQ ID NO: 6086 - DNA, 20 bp, Artificial Sequence
  Synthetic oligonucleotide; GAG chr11 5200941 5200960 5200957 +
aaggaagagattagtaaaag

SEQ ID NO: 6087 - DNA, 20 bp, Artificial Sequence
  Synthetic oligonucleotide; AAG chr11 5200944 5200963 5200960 +
gaagagattagtaaaaggag

SEQ ID NO: 6088 - DNA, 20 bp, Artificial Sequence
  Synthetic oligonucleotide; AGG chr11 5200945 5200964 5200961 +
aagagattagtaaaaggaga

SEQ ID NO: 6089 - DNA, 20 bp, Artificial Sequence
  Synthetic oligonucleotide; TAG chr11 5200949 5200968 5200965 +
gattagtaaaaggagaaggc

SEQ ID NO: 6090 - DNA, 20 bp, Artificial Sequence
  Synthetic oligonucleotide; TAG chr11 5200972 5200991 5200988 +
ttttaaaaaaatacgttgct

SEQ ID NO: 6091 - DNA, 20 bp, Artificial Sequence
  Synthetic oligonucleotide; AAG chr11 5200985 5201004 5201001 +
cgttgcttagacattttccc

SEQ ID NO: 6092 - DNA, 20 bp, Artificial Sequence
  Synthetic oligonucleotide; AGG chr11 5200986 5201005 5201002 +
gttgcttagacattttccca

SEQ ID NO: 6093 - DNA, 20 bp, Artificial Sequence
  Synthetic oligonucleotide; TAG chr11 5200990 5201009 5201006 +
cttagacattttcccaagga

SEQ ID NO: 6094 - DNA, 20 bp, Artificial Sequence
  Synthetic oligonucleotide; TGG chr11 5200993 5201012 5201009 +
agacattttcccaaggatag

SEQ ID NO: 6095 - DNA, 20 bp, Artificial Sequence
  Synthetic oligonucleotide; CAG chr11 5201010 5201029 5201026 +
tagtggtaaaaattttatac

SEQ ID NO: 6096 - DNA, 20 bp, Artificial Sequence
  Synthetic oligonucleotide; AAG chr11 5201015 5201034 5201031 +
gtaaaaattttataccagta

SEQ ID NO: 6097 - DNA, 20 bp, Artificial Sequence
  Synthetic oligonucleotide; GAG chr11 5201017 5201036 5201033 +
aaaaattttataccagtaaa

SEQ ID NO: 6098 - DNA, 20 bp, Artificial Sequence
  Synthetic oligonucleotide; GAG chr11 5201022 5201041 5201038 +
ttttataccagtaaagagcc

SEQ ID NO: 6099 - DNA, 20 bp, Artificial Sequence
  Synthetic oligonucleotide; AGG chr11 5201023 5201042 5201039 +
tttataccagtaaagagccg

SEQ ID NO: 6100 - DNA, 20 bp, Artificial Sequence
  Synthetic oligonucleotide; AAG chr11 5201070 5201089 5201086 +
tccaattcattaaacattcg

SEQ ID NO: 6101 - DNA, 20 bp, Artificial Sequence
  Synthetic oligonucleotide; AAG chr11 5201075 5201094 5201091 +
ttcattaaacattcgaagtg

SEQ ID NO: 6102 - DNA, 20 bp, Artificial Sequence
  Synthetic oligonucleotide; GAG chr11 5201077 5201096 5201093 +
cattaaacattcgaagtgaa

SEQ ID NO: 6103 - DNA, 20 bp, Artificial Sequence
  Synthetic oligonucleotide; TGG chr11 5201087 5201106 5201103 +
tcgaagtgaagagtaatctt

SEQ ID NO: 6104 - DNA, 20 bp, Artificial Sequence
  Synthetic oligonucleotide; GGG chr11 5201088 5201107 5201104 +
cgaagtgaagagtaatcttt

SEQ ID NO: 6105 - DNA, 20 bp, Artificial Sequence
  Synthetic oligonucleotide; AAG chr11 5201104 5201123 5201120 +
ctttgggctttaaatatcat

SEQ ID NO: 6106 - DNA, 20 bp, Artificial Sequence
  Synthetic oligonucleotide; TAG chr11 5201116 5201135 5201132 +
aatatcataagtctattaaa

SEQ ID NO: 6107 - DNA, 20 bp, Artificial Sequence
  Synthetic oligonucleotide; AAG chr11 5201155 5201174 5201171 +
ttccattttgtgccgtctcc

SEQ ID NO: 6108 - DNA, 20 bp, Artificial Sequence
  Synthetic oligonucleotide; AAG chr11 5201187 5201206 5201203 +
tctccaaatactatttaatg

SEQ ID NO: 6109 - DNA, 20 bp, Artificial Sequence
  Synthetic oligonucleotide; CAG chr11 5201212 5201231 5201228 +
actcctgttttctccccctc

SEQ ID NO: 6110 - DNA, 20 bp, Artificial Sequence
  Synthetic oligonucleotide; TAG chr11 5201221 5201240 5201237 +
ttctccccctccagatgacg

SEQ ID NO: 6111 - DNA, 20 bp, Artificial Sequence
  Synthetic oligonucleotide; CAG chr11 5201225 5201244 5201241 +
ccccctccagatgacgtagc

SEQ ID NO: 6112 - DNA, 20 bp, Artificial Sequence
  Synthetic oligonucleotide; TGG chr11 5201246 5201265 5201262 +
agcaattactttttcttcat

SEQ ID NO: 6113 - DNA, 20 bp, Artificial Sequence
  Synthetic oligonucleotide; AAG chr11 5201253 5201272 5201269 +
actttttcttcattggtgat

SEQ ID NO: 6114 - DNA, 20 bp, Artificial Sequence
  Synthetic oligonucleotide; CAG chr11 5201256 5201275 5201272 +
ttttcttcattggtgataag

SEQ ID NO: 6115 - DNA, 20 bp, Artificial Sequence
  Synthetic oligonucleotide; CAG chr11 5201260 5201279 5201276 +
cttcattggtgataagcaga

SEQ ID NO: 6116 - DNA, 20 bp, Artificial Sequence
  Synthetic oligonucleotide; AGG chr11 5201261 5201280 5201277 +
ttcattggtgataagcagac

SEQ ID NO: 6117 - DNA, 20 bp, Artificial Sequence
  Synthetic oligonucleotide; GAG chr11 5201277 5201296 5201293 +
agacaggaatatttatgcat

SEQ ID NO: 6118 - DNA, 20 bp, Artificial Sequence
  Synthetic oligonucleotide; TGG chr11 5201284 5201303 5201300 +
aatatttatgcatgagacct

SEQ ID NO: 6119 - DNA, 20 bp, Artificial Sequence
  Synthetic oligonucleotide; GGG chr11 5201285 5201304 5201301 +
atatttatgcatgagacctt

SEQ ID NO: 6120 - DNA, 20 bp, Artificial Sequence
  Synthetic oligonucleotide; TGG chr11 5201303 5201322 5201319 +
ttgggtaaatgatttctcac

SEQ ID NO: 6121 - DNA, 20 bp, Artificial Sequence
  Synthetic oligonucleotide; GAG chr11 5201305 5201324 5201321 +
gggtaaatgatttctcactg

SEQ ID NO: 6122 - DNA, 20 bp, Artificial Sequence
  Synthetic oligonucleotide; TGG chr11 5201311 5201330 5201327 +
atgatttctcactggagctc

SEQ ID NO: 6123 - DNA, 20 bp, Artificial Sequence
  Synthetic oligonucleotide; GAG chr11 5201320 5201339 5201336 +
cactggagctctggcctctt

SEQ ID NO: 6124 - DNA, 20 bp, Artificial Sequence
  Synthetic oligonucleotide; TAG chr11 5201352 5201371 5201368 +
tcatttgtgcctttgtgatg

SEQ ID NO: 6125 - DNA, 20 bp, Artificial Sequence
  Synthetic oligonucleotide; GAG chr11 5201354 5201373 5201370 +
atttgtgcctttgtgatgta

SEQ ID NO: 6126 - DNA, 20 bp, Artificial Sequence
  Synthetic oligonucleotide; TAG chr11 5201360 5201379 5201376 +
gcctttgtgatgtagagaat

SEQ ID NO: 6127 - DNA, 20 bp, Artificial Sequence
  Synthetic oligonucleotide; AAG chr11 5201367 5201386 5201383 +
tgatgtagagaattagattg

SEQ ID NO: 6128 - DNA, 20 bp, Artificial Sequence
  Synthetic oligonucleotide; GAG chr11 5201375 5201394 5201391 +
agaattagattgaagacact

SEQ ID NO: 6129 - DNA, 20 bp, Artificial Sequence
  Synthetic oligonucleotide; TAG chr11 5201385 5201404 5201401 +
tgaagacactgagcctttga

SEQ ID NO: 6130 - DNA, 20 bp, Artificial Sequence
  Synthetic oligonucleotide; CAG chr11 5201388 5201407 5201404 +
agacactgagcctttgatag

SEQ ID NO: 6131 - DNA, 20 bp, Artificial Sequence
  Synthetic oligonucleotide; CAG chr11 5201393 5201412 5201409 +
ctgagcctttgatagcagct

SEQ ID NO: 6132 - DNA, 20 bp, Artificial Sequence
  Synthetic oligonucleotide; CAG chr11 5201419 5201438 5201435 +
ttcccattcctttatttatt

SEQ ID NO: 6133 - DNA, 20 bp, Artificial Sequence
  Synthetic oligonucleotide; GAG chr11 5201427 5201446 5201443 +
cctttatttattcagttaat

SEQ ID NO: 6134 - DNA, 20 bp, Artificial Sequence
  Synthetic oligonucleotide; TGG chr11 5201470 5201489 5201486 +
tatacatttattcaatgtat

SEQ ID NO: 6135 - DNA, 20 bp, Artificial Sequence
  Synthetic oligonucleotide; TAG chr11 5201492 5201511 5201508 +
gccaattgtgttttctttct

SEQ ID NO: 6136 - DNA, 20 bp, Artificial Sequence
  Synthetic oligonucleotide; CAG chr11 5201501 5201520 5201517 +
gttttctttcttagaacctg

SEQ ID NO: 6137 - DNA, 20 bp, Artificial Sequence
  Synthetic oligonucleotide; CAG chr11 5201509 5201528 5201525 +
tcttagaacctgcagttcta

SEQ ID NO: 6138 - DNA, 20 bp, Artificial Sequence
  Synthetic oligonucleotide; AAG chr11 5201518 5201537 5201534 +
ctgcagttctacagatcaca

SEQ ID NO: 6139 - DNA, 20 bp, Artificial Sequence
  Synthetic oligonucleotide; CAG chr11 5201522 5201541 5201538 +
agttctacagatcacaaagc

SEQ ID NO: 6140 - DNA, 20 bp, Artificial Sequence
  Synthetic oligonucleotide; AGG chr11 5201523 5201542 5201539 +
gttctacagatcacaaagcc

SEQ ID NO: 6141 - DNA, 20 bp, Artificial Sequence
  Synthetic oligonucleotide; AAG chr11 5201533 5201552 5201549 +
tcacaaagccaggctcaaac

SEQ ID NO: 6142 - DNA, 20 bp, Artificial Sequence
  Synthetic oligonucleotide; AAG chr11 5201537 5201556 5201553 +
aaagccaggctcaaacaagc

SEQ ID NO: 6143 - DNA, 20 bp, Artificial Sequence
  Synthetic oligonucleotide; AAG chr11 5201553 5201572 5201569 +
aagcaagcttataatttcaa

SEQ ID NO: 6144 - DNA, 20 bp, Artificial Sequence
  Synthetic oligonucleotide; TGG chr11 5201561 5201580 5201577 +
ttataatttcaaaagcctca

SEQ ID NO: 6145 - DNA, 20 bp, Artificial Sequence
  Synthetic oligonucleotide; TAG chr11 5201564 5201583 5201580 +
taatttcaaaagcctcatgg

SEQ ID NO: 6146 - DNA, 20 bp, Artificial Sequence
  Synthetic oligonucleotide; CAG chr11 5201567 5201586 5201583 +
tttcaaaagcctcatggtag

SEQ ID NO: 6147 - DNA, 20 bp, Artificial Sequence
  Synthetic oligonucleotide; TGG chr11 5201577 5201596 5201593 +
ctcatggtagcagaatcaat

SEQ ID NO: 6148 - DNA, 20 bp, Artificial Sequence
  Synthetic oligonucleotide; AAG chr11 5201608 5201627 5201624 +
ttacattgtttgcctgcttt

SEQ ID NO: 6149 - DNA, 20 bp, Artificial Sequence
  Synthetic oligonucleotide; CAG chr11 5201614 5201633 5201630 +
tgtttgcctgctttaagttc

SEQ ID NO: 6150 - DNA, 20 bp, Artificial Sequence
  Synthetic oligonucleotide; GAG chr11 5201621 5201640 5201637 +
ctgctttaagttccagacct

SEQ ID NO: 6151 - DNA, 20 bp, Artificial Sequence
  Synthetic oligonucleotide; AAG chr11 5201633 5201652 5201649 +
ccagacctgagaatcatcat

SEQ ID NO: 6152 - DNA, 20 bp, Artificial Sequence
  Synthetic oligonucleotide; AAG chr11 5201644 5201663 5201660 +
aatcatcataagttttttta

SEQ ID NO: 6153 - DNA, 20 bp, Artificial Sequence
  Synthetic oligonucleotide; CAG chr11 5201662 5201681 5201678 +
taaagctctaataatgtaaa

SEQ ID NO: 6154 - DNA, 20 bp, Artificial Sequence
  Synthetic oligonucleotide; AAG chr11 5201673 5201692 5201689 +
taatgtaaacagatgttcaa

SEQ ID NO: 6155 - DNA, 20 bp, Artificial Sequence
  Synthetic oligonucleotide; GAG chr11 5201697 5201716 5201713 +
ccatactttcatgtttgatt

SEQ ID NO: 6156 - DNA, 20 bp, Artificial Sequence
  Synthetic oligonucleotide; GAG chr11 5201707 5201726 5201723 +
atgtttgattgagtaacttc

SEQ ID NO: 6157 - DNA, 20 bp, Artificial Sequence
  Synthetic oligonucleotide; AAG chr11 5201716 5201735 5201732 +
tgagtaacttcgagatgtta

SEQ ID NO: 6158 - DNA, 20 bp, Artificial Sequence
  Synthetic oligonucleotide; CAG chr11 5201725 5201744 5201741 +
tcgagatgttaaagtaactt

SEQ ID NO: 6159 - DNA, 20 bp, Artificial Sequence
  Synthetic oligonucleotide; TGG chr11 5201731 5201750 5201747 +
tgttaaagtaacttcagatt

SEQ ID NO: 6160 - DNA, 20 bp, Artificial Sequence
  Synthetic oligonucleotide; GGG chr11 5201732 5201751 5201748 +
gttaaagtaacttcagattt

SEQ ID NO: 6161 - DNA, 20 bp, Artificial Sequence
  Synthetic oligonucleotide; CAG chr11 5201757 5201776 5201773 +
gccctttatgtcctactttt

SEQ ID NO: 6162 - DNA, 20 bp, Artificial Sequence
  Synthetic oligonucleotide; TAG chr11 5201771 5201790 5201787 +
acttttcagctttgtcttat

SEQ ID NO: 6163 - DNA, 20 bp, Artificial Sequence
  Synthetic oligonucleotide; CAG chr11 5201784 5201803 5201800 +
gtcttattagcctcacaaca

SEQ ID NO: 6164 - DNA, 20 bp, Artificial Sequence
  Synthetic oligonucleotide; CAG chr11 5201792 5201811 5201808 +
agcctcacaacacagttcca

SEQ ID NO: 6165 - DNA, 20 bp, Artificial Sequence
  Synthetic oligonucleotide; TAG chr11 5201837 5201856 5201853 +
tatactacactgacgtcttc

SEQ ID NO: 6166 - DNA, 20 bp, Artificial Sequence
  Synthetic oligonucleotide; CAG chr11 5201840 5201859 5201856 +
actacactgacgtcttctag

SEQ ID NO: 6167 - DNA, 20 bp, Artificial Sequence
  Synthetic oligonucleotide; CAG chr11 5201877 5201896 5201893 +
ttcttgccctgactccttct

SEQ ID NO: 6168 - DNA, 20 bp, Artificial Sequence
  Synthetic oligonucleotide; TAG chr11 5201892 5201911 5201908 +
cttctcagcattgaataact

SEQ ID NO: 6169 - DNA, 20 bp, Artificial Sequence
  Synthetic oligonucleotide; TAG chr11 5201923 5201942 5201939 +
ttttaatacttttttctcca

SEQ ID NO: 6170 - DNA, 20 bp, Artificial Sequence
  Synthetic oligonucleotide; AAG chr11 5201934 5201953 5201950 +
ttttctccatagaatgcttg

SEQ ID NO: 6171 - DNA, 20 bp, Artificial Sequence
  Synthetic oligonucleotide; CAG chr11 5201952 5201971 5201968 +
tgaagtttcttcgtttcttg

SEQ ID NO: 6172 - DNA, 20 bp, Artificial Sequence
  Synthetic oligonucleotide; GAG chr11 5201954 5201973 5201970 +
aagtttcttcgtttcttgca

SEQ ID NO: 6173 - DNA, 20 bp, Artificial Sequence
  Synthetic oligonucleotide; AGG chr11 5201955 5201974 5201971 +
agtttcttcgtttcttgcag

SEQ ID NO: 6174 - DNA, 20 bp, Artificial Sequence
  Synthetic oligonucleotide; CAG chr11 5201964 5201983 5201980 +
gtttcttgcagaggattttt

SEQ ID NO: 6175 - DNA, 20 bp, Artificial Sequence
  Synthetic oligonucleotide; AAG chr11 5202127 5202146 5202143 +
caactcaacaatcacttttc

SEQ ID NO: 6176 - DNA, 20 bp, Artificial Sequence
  Synthetic oligonucleotide; AAG chr11 5202130 5202149 5202146 +
ctcaacaatcacttttcaag

SEQ ID NO: 6177 - DNA, 20 bp, Artificial Sequence
  Synthetic oligonucleotide; AAG chr11 5202139 5202158 5202155 +
cacttttcaagaagtttctt

SEQ ID NO: 6178 - DNA, 20 bp, Artificial Sequence
  Synthetic oligonucleotide; TGG chr11 5202169 5202188 5202185 +
tatccatatatctattattt

SEQ ID NO: 6179 - DNA, 20 bp, Artificial Sequence
  Synthetic oligonucleotide; TAG chr11 5202216 5202235 5202232 +
acttataattttgtatttat

SEQ ID NO: 6180 - DNA, 20 bp, Artificial Sequence
  Synthetic oligonucleotide; CAG chr11 5202283 5202302 5202299 +
tctgttacaaactaaattct

SEQ ID NO: 6181 - DNA, 20 bp, Artificial Sequence
  Synthetic oligonucleotide; CAG chr11 5202298 5202317 5202314 +
attctcagttccttaatgtg

SEQ ID NO: 6182 - DNA, 20 bp, Artificial Sequence
  Synthetic oligonucleotide; GAG chr11 5202365 5202384 5202381 +
tctgattcctgaccactcct

SEQ ID NO: 6183 - DNA, 20 bp, Artificial Sequence
  Synthetic oligonucleotide; GAG chr11 5202367 5202386 5202383 +
tgattcctgaccactcctga

SEQ ID NO: 6184 - DNA, 20 bp, Artificial Sequence
  Synthetic oligonucleotide; TGG chr11 5202390 5202409 5202406 +
ctcaaattcatgaatacaac

SEQ ID NO: 6185 - DNA, 20 bp, Artificial Sequence
  Synthetic oligonucleotide; GAG chr11 5202412 5202431 5202428 +
gctatttaatatattcatct

SEQ ID NO: 6186 - DNA, 20 bp, Artificial Sequence
  Synthetic oligonucleotide; AAG chr11 5202431 5202450 5202447 +
tgagtgtttaatcttaaaat

SEQ ID NO: 6187 - DNA, 20 bp, Artificial Sequence
  Synthetic oligonucleotide; AAG chr11 5202447 5202466 5202463 +
aaataagaatgatgccaata

SEQ ID NO: 6188 - DNA, 20 bp, Artificial Sequence
  Synthetic oligonucleotide; AAG chr11 5202504 5202523 5202520 +
ccttttctcctaatattata

SEQ ID NO: 6189 - DNA, 20 bp, Artificial Sequence
  Synthetic oligonucleotide; AAG chr11 5202533 5202552 5202549 +
caccaataacacaattgcat

SEQ ID NO: 6190 - DNA, 20 bp, Artificial Sequence
  Synthetic oligonucleotide; AAG chr11 5202538 5202557 5202554 +
ataacacaattgcataagac

SEQ ID NO: 6191 - DNA, 20 bp, Artificial Sequence
  Synthetic oligonucleotide; GAG chr11 5202545 5202564 5202561 +
aattgcataagacaagtctt

SEQ ID NO: 6192 - DNA, 20 bp, Artificial Sequence
  Synthetic oligonucleotide; CAG chr11 5202630 5202649 5202646 +
tcaatttctaccatttctac

SEQ ID NO: 6193 - DNA, 20 bp, Artificial Sequence
  Synthetic oligonucleotide; CAG chr11 5202643 5202662 5202659 +
tttctaccagaaacacatcc

SEQ ID NO: 6194 - DNA, 20 bp, Artificial Sequence
  Synthetic oligonucleotide; TAG chr11 5202647 5202666 5202663 +
taccagaaacacatcccaga

SEQ ID NO: 6195 - DNA, 20 bp, Artificial Sequence
  Synthetic oligonucleotide; AGG chr11 5202648 5202667 5202664 +
accagaaacacatcccagat

SEQ ID NO: 6196 - DNA, 20 bp, Artificial Sequence
  Synthetic oligonucleotide; TGG chr11 5202675 5202694 5202691 +
cttttacacattgcccgtct

SEQ ID NO: 6197 - DNA, 20 bp, Artificial Sequence
  Synthetic oligonucleotide; TGG chr11 5202699 5202718 5202715 +
ttataatatcattgtttccc

SEQ ID NO: 6198 - DNA, 20 bp, Artificial Sequence
  Synthetic oligonucleotide; TAG chr11 5202747 5202766 5202763 +
taataatttaatattattac

SEQ ID NO: 6199 - DNA, 20 bp, Artificial Sequence
  Synthetic oligonucleotide; CAG chr11 5202797 5202816 5202813 +
tctaaaaaatgtattatctc

SEQ ID NO: 6200 - DNA, 20 bp, Artificial Sequence
  Synthetic oligonucleotide; AGG chr11 5202798 5202817 5202814 +
ctaaaaaatgtattatctcc

SEQ ID NO: 6201 - DNA, 20 bp, Artificial Sequence
  Synthetic oligonucleotide; GGG chr11 5202799 5202818 5202815 +
taaaaaatgtattatctcca

SEQ ID NO: 6202 - DNA, 20 bp, Artificial Sequence
  Synthetic oligonucleotide; TGG chr11 5202868 5202887 5202884 +
ttgttgaaaaaactctttga

SEQ ID NO: 6203 - DNA, 20 bp, Artificial Sequence
  Synthetic oligonucleotide; TAG chr11 5202915 5202934 5202931 +
aaaatacaaattctttatca

SEQ ID NO: 6204 - DNA, 20 bp, Artificial Sequence
  Synthetic oligonucleotide; AAG chr11 5202923 5202942 5202939 +
aattctttatcatagtcaaa

SEQ ID NO: 6205 - DNA, 20 bp, Artificial Sequence
  Synthetic oligonucleotide; TGG chr11 5202938 5202957 5202954 +
tcaaaaagccttgtataacg

SEQ ID NO: 6206 - DNA, 20 bp, Artificial Sequence
  Synthetic oligonucleotide; TAG chr11 5202967 5202986 5202983 +
tgcctcttctattacatctt

SEQ ID NO: 6207 - DNA, 20 bp, Artificial Sequence
  Synthetic oligonucleotide; TAG chr11 5202998 5203017 5203014 +
tgcctacactccttaatatt

SEQ ID NO: 6208 - DNA, 20 bp, Artificial Sequence
  Synthetic oligonucleotide; AGG chr11 5202999 5203018 5203015 +
gcctacactccttaatattt

SEQ ID NO: 6209 - DNA, 20 bp, Artificial Sequence
  Synthetic oligonucleotide; AAG chr11 5203023 5203042 5203039 +
atctttatcttcctcaaaac

SEQ ID NO: 6210 - DNA, 20 bp, Artificial Sequence
  Synthetic oligonucleotide; AAG chr11 5203028 5203047 5203044 +
tatcttcctcaaaacaagct

SEQ ID NO: 6211 - DNA, 20 bp, Artificial Sequence
  Synthetic oligonucleotide; CAG chr11 5203044 5203063 5203060 +
agctaagtacatgcatgtct

SEQ ID NO: 6212 - DNA, 20 bp, Artificial Sequence
  Synthetic oligonucleotide; AGG chr11 5203045 5203064 5203061 +
gctaagtacatgcatgtctc

SEQ ID NO: 6213 - DNA, 20 bp, Artificial Sequence
  Synthetic oligonucleotide; TGG chr11 5203059 5203078 5203075 +
tgtctcaggatctttgccca

SEQ ID NO: 6214 - DNA, 20 bp, Artificial Sequence
  Synthetic oligonucleotide; AAG chr11 5203091 5203110 5203107 +
tgctccgaattatctacccc

SEQ ID NO: 6215 - DNA, 20 bp, Artificial Sequence
  Synthetic oligonucleotide; CAG chr11 5203102 5203121 5203118 +
atctaccccaagtatttgca

SEQ ID NO: 6216 - DNA, 20 bp, Artificial Sequence
  Synthetic oligonucleotide; GAG chr11 5203129 5203148 5203145 +
tcctttcaccattaactttt

SEQ ID NO: 6217 - DNA, 20 bp, Artificial Sequence
  Synthetic oligonucleotide; CAG chr11 5203150 5203169 5203166 +
agttaaaatgattacttcct

SEQ ID NO: 6218 - DNA, 20 bp, Artificial Sequence
  Synthetic oligonucleotide; AGG chr11 5203151 5203170 5203167 +
gttaaaatgattacttcctc

SEQ ID NO: 6219 - DNA, 20 bp, Artificial Sequence
  Synthetic oligonucleotide; GGG chr11 5203152 5203171 5203168 +
ttaaaatgattacttcctca

SEQ ID NO: 6220 - DNA, 20 bp, Artificial Sequence
  Synthetic oligonucleotide; GGG chr11 5203153 5203172 5203169 +
taaaatgattacttcctcag

SEQ ID NO: 6221 - DNA, 20 bp, Artificial Sequence
  Synthetic oligonucleotide; GGG chr11 5203154 5203173 5203170 +
aaaatgattacttcctcagg

SEQ ID NO: 6222 - DNA, 20 bp, Artificial Sequence
  Synthetic oligonucleotide; TAG chr11 5203181 5203200 5203197 +
ttctaatactgctccccacc

SEQ ID NO: 6223 - DNA, 20 bp, Artificial Sequence
  Synthetic oligonucleotide; CAG chr11 5203228 5203247 5203244 +
taactaacttactctcatca

SEQ ID NO: 6224 - DNA, 20 bp, Artificial Sequence
  Synthetic oligonucleotide; TAG chr11 5203236 5203255 5203252 +
ttactctcatcacagtatac

SEQ ID NO: 6225 - DNA, 20 bp, Artificial Sequence
  Synthetic oligonucleotide; TAG chr11 5203277 5203296 5203293 +
attatacactgaatttccat

SEQ ID NO: 6226 - DNA, 20 bp, Artificial Sequence
  Synthetic oligonucleotide; TAG chr11 5203286 5203305 5203302 +
tgaatttccattagattcat

SEQ ID NO: 6227 - DNA, 20 bp, Artificial Sequence
  Synthetic oligonucleotide; GAG chr11 5203288 5203307 5203304 +
aatttccattagattcatta

SEQ ID NO: 6228 - DNA, 20 bp, Artificial Sequence
  Synthetic oligonucleotide; AGG chr11 5203289 5203308 5203305 +
atttccattagattcattag

SEQ ID NO: 6229 - DNA, 20 bp, Artificial Sequence
  Synthetic oligonucleotide; TAG chr11 5203295 5203314 5203311 +
attagattcattagaggctg

SEQ ID NO: 6230 - DNA, 20 bp, Artificial Sequence
  Synthetic oligonucleotide; AAG chr11 5203298 5203317 5203314 +
agattcattagaggctgtag

SEQ ID NO: 6231 - DNA, 20 bp, Artificial Sequence
  Synthetic oligonucleotide; TAG chr11 5203303 5203322 5203319 +
cattagaggctgtagaagat

SEQ ID NO: 6232 - DNA, 20 bp, Artificial Sequence
  Synthetic oligonucleotide; AGG chr11 5203304 5203323 5203320 +
attagaggctgtagaagatt

SEQ ID NO: 6233 - DNA, 20 bp, Artificial Sequence
  Synthetic oligonucleotide; AAG chr11 5203328 5203347 5203344 +
accatatctgttttttgctc

SEQ ID NO: 6234 - DNA, 20 bp, Artificial Sequence
  Synthetic oligonucleotide; AAG chr11 5203343 5203362 5203359 +
tgctcaagaatatgaaaaat

SEQ ID NO: 6235 - DNA, 20 bp, Artificial Sequence
  Synthetic oligonucleotide; AGG chr11 5203344 5203363 5203360 +
gctcaagaatatgaaaaata

SEQ ID NO: 6236 - DNA, 20 bp, Artificial Sequence
  Synthetic oligonucleotide; GGG chr11 5203345 5203364 5203361 +
ctcaagaatatgaaaaataa

SEQ ID NO: 6237 - DNA, 20 bp, Artificial Sequence
  Synthetic oligonucleotide; TAG chr11 5203349 5203368 5203365 +
agaatatgaaaaataagggt

SEQ ID NO: 6238 - DNA, 20 bp, Artificial Sequence
  Synthetic oligonucleotide; TAG chr11 5203354 5203373 5203370 +
atgaaaaataagggttagca

SEQ ID NO: 6239 - DNA, 20 bp, Artificial Sequence
  Synthetic oligonucleotide; TGG chr11 5203359 5203378 5203375 +
aaataagggttagcatagaa

SEQ ID NO: 6240 - DNA, 20 bp, Artificial Sequence
  Synthetic oligonucleotide; GGG chr11 5203360 5203379 5203376 +
aataagggttagcatagaat

SEQ ID NO: 6241 - DNA, 20 bp, Artificial Sequence
  Synthetic oligonucleotide; AAG chr11 5203402 5203421 5203418 +
aattaattattctatgaaat

SEQ ID NO: 6242 - DNA, 20 bp, Artificial Sequence
  Synthetic oligonucleotide; GAG chr11 5203404 5203423 5203420 +
ttaattattctatgaaataa

SEQ ID NO: 6243 - DNA, 20 bp, Artificial Sequence
  Synthetic oligonucleotide; TAG chr11 5203408 5203427 5203424 +
ttattctatgaaataagagc

SEQ ID NO: 6244 - DNA, 20 bp, Artificial Sequence
  Synthetic oligonucleotide; CAG chr11 5203418 5203437 5203434 +
aaataagagctagacaatca

SEQ ID NO: 6245 - DNA, 20 bp, Artificial Sequence
  Synthetic oligonucleotide; GAG chr11 5203420 5203439 5203436 +
ataagagctagacaatcaca

SEQ ID NO: 6246 - DNA, 20 bp, Artificial Sequence
  Synthetic oligonucleotide; AAG chr11 5203428 5203447 5203444 +
tagacaatcacagagatata

SEQ ID NO: 6247 - DNA, 20 bp, Artificial Sequence
  Synthetic oligonucleotide; AAG chr11 5203458 5203477 5203474 +
gaatgtgaacactcctatca

SEQ ID NO: 6248 - DNA, 20 bp, Artificial Sequence
  Synthetic oligonucleotide; TAG chr11 5203487 5203506 5203503 +
taaaatcatctgtgtacact

SEQ ID NO: 6249 - DNA, 20 bp, Artificial Sequence
  Synthetic oligonucleotide; TGG chr11 5203504 5203523 5203520 +
acttagtcttttctgacctt

SEQ ID NO: 6250 - DNA, 20 bp, Artificial Sequence
  Synthetic oligonucleotide; GAG chr11 5203516 5203535 5203532 +
ctgacctttggccaccaatt

SEQ ID NO: 6251 - DNA, 20 bp, Artificial Sequence
  Synthetic oligonucleotide; AAG chr11 5203531 5203550 5203547 +
caattgagtcatcatatacc

SEQ ID NO: 6252 - DNA, 20 bp, Artificial Sequence
  Synthetic oligonucleotide; TGG chr11 5203540 5203559 5203556 +
catcatataccaagtttgaa

SEQ ID NO: 6253 - DNA, 20 bp, Artificial Sequence
  Synthetic oligonucleotide; CAG chr11 5203552 5203571 5203568 +
agtttgaatggtttataaaa

SEQ ID NO: 6254 - DNA, 20 bp, Artificial Sequence
  Synthetic oligonucleotide; CAG chr11 5203564 5203583 5203580 +
ttataaaacagatgctgctc

SEQ ID NO: 6255 - DNA, 20 bp, Artificial Sequence
  Synthetic oligonucleotide; AGG chr11 5203565 5203584 5203581 +
tataaaacagatgctgctcc

SEQ ID NO: 6256 - DNA, 20 bp, Artificial Sequence
  Synthetic oligonucleotide; GGG chr11 5203566 5203585 5203582 +
ataaaacagatgctgctcca

SEQ ID NO: 6257 - DNA, 20 bp, Artificial Sequence
  Synthetic oligonucleotide; CAG chr11 5203624 5203643 5203640 +
aacatgatttctctcatttc

SEQ ID NO: 6258 - DNA, 20 bp, Artificial Sequence
  Synthetic oligonucleotide; CAG chr11 5203634 5203653 5203650 +
ctctcatttccagcctgact

SEQ ID NO: 6259 - DNA, 20 bp, Artificial Sequence
  Synthetic oligonucleotide; AAG chr11 5203647 5203666 5203663 +
cctgactcagacatatcgtc

SEQ ID NO: 6260 - DNA, 20 bp, Artificial Sequence
  Synthetic oligonucleotide; AGG chr11 5203648 5203667 5203664 +
ctgactcagacatatcgtca

SEQ ID NO: 6261 - DNA, 20 bp, Artificial Sequence
  Synthetic oligonucleotide; TGG chr11 5203654 5203673 5203670 +
cagacatatcgtcaaggatc

SEQ ID NO: 6262 - DNA, 20 bp, Artificial Sequence
  Synthetic oligonucleotide; GGG chr11 5203655 5203674 5203671 +
agacatatcgtcaaggatct

SEQ ID NO: 6263 - DNA, 20 bp, Artificial Sequence
  Synthetic oligonucleotide; AAG chr11 5203669 5203688 5203685 +
ggatctgggattgatcacaa

SEQ ID NO: 6264 - DNA, 20 bp, Artificial Sequence
  Synthetic oligonucleotide; TAG chr11 5203691 5203710 5203707 +
gatttaatattctgtgaatg

SEQ ID NO: 6265 - DNA, 20 bp, Artificial Sequence
  Synthetic oligonucleotide; AGG chr11 5203692 5203711 5203708 +
atttaatattctgtgaatgt

SEQ ID NO: 6266 - DNA, 20 bp, Artificial Sequence
  Synthetic oligonucleotide; AAG chr11 5203705 5203724 5203721 +
tgaatgtaggtatgtgttaa

SEQ ID NO: 6267 - DNA, 20 bp, Artificial Sequence
  Synthetic oligonucleotide; CAG chr11 5203718 5203737 5203734 +
gtgttaaaagtatctacttt

SEQ ID NO: 6268 - DNA, 20 bp, Artificial Sequence
  Synthetic oligonucleotide; CAG chr11 5203722 5203741 5203738 +
taaaagtatctactttcagc

SEQ ID NO: 6269 - DNA, 20 bp, Artificial Sequence
  Synthetic oligonucleotide; AGG chr11 5203723 5203742 5203739 +
aaaagtatctactttcagcc

SEQ ID NO: 6270 - DNA, 20 bp, Artificial Sequence
  Synthetic oligonucleotide; TGG chr11 5203728 5203747 5203744 +
tatctactttcagccaggct

SEQ ID NO: 6271 - DNA, 20 bp, Artificial Sequence
  Synthetic oligonucleotide; TGG chr11 5203731 5203750 5203747 +
ctactttcagccaggcttgg

SEQ ID NO: 6272 - DNA, 20 bp, Artificial Sequence
  Synthetic oligonucleotide; TAG chr11 5203750 5203769 5203766 +
gtggctcacgcctgtaatcc

SEQ ID NO: 6273 - DNA, 20 bp, Artificial Sequence
  Synthetic oligonucleotide; TGG chr11 5203758 5203777 5203774 +
cgcctgtaatcctagcactt

SEQ ID NO: 6274 - DNA, 20 bp, Artificial Sequence
  Synthetic oligonucleotide; GGG chr11 5203759 5203778 5203775 +
gcctgtaatcctagcacttt

SEQ ID NO: 6275 - DNA, 20 bp, Artificial Sequence
  Synthetic oligonucleotide; GAG chr11 5203761 5203780 5203777 +
ctgtaatcctagcactttgg

SEQ ID NO: 6276 - DNA, 20 bp, Artificial Sequence
  Synthetic oligonucleotide; AGG chr11 5203762 5203781 5203778 +
tgtaatcctagcactttggg

SEQ ID NO: 6277 - DNA, 20 bp, Artificial Sequence
  Synthetic oligonucleotide; GAG chr11 5203767 5203786 5203783 +
tcctagcactttgggaggcc

SEQ ID NO: 6278 - DNA, 20 bp, Artificial Sequence
  Synthetic oligonucleotide; AGG chr11 5203768 5203787 5203784 +
cctagcactttgggaggccg

SEQ ID NO: 6279 - DNA, 20 bp, Artificial Sequence
  Synthetic oligonucleotide; CAG chr11 5203771 5203790 5203787 +
agcactttgggaggccgagg

SEQ ID NO: 6280 - DNA, 20 bp, Artificial Sequence
  Synthetic oligonucleotide; AGG chr11 5203772 5203791 5203788 +
gcactttgggaggccgaggc

SEQ ID NO: 6281 - DNA, 20 bp, Artificial Sequence
  Synthetic oligonucleotide; TGG chr11 5203775 5203794 5203791 +
ctttgggaggccgaggcagg

SEQ ID NO: 6282 - DNA, 20 bp, Artificial Sequence
  Synthetic oligonucleotide; TGG chr11 5203780 5203799 5203796 +
ggaggccgaggcaggtggat

SEQ ID NO: 6283 - DNA, 20 bp, Artificial Sequence
  Synthetic oligonucleotide; GAG chr11 5203785 5203804 5203801 +
ccgaggcaggtggattggct

SEQ ID NO: 6284 - DNA, 20 bp, Artificial Sequence
  Synthetic oligonucleotide; CAG chr11 5203790 5203809 5203806 +
gcaggtggattggctgagct

SEQ ID NO: 6285 - DNA, 20 bp, Artificial Sequence
  Synthetic oligonucleotide; AGG chr11 5203791 5203810 5203807 +
caggtggattggctgagctc

SEQ ID NO: 6286 - DNA, 20 bp, Artificial Sequence
  Synthetic oligonucleotide; GAG chr11 5203793 5203812 5203809 +
ggtggattggctgagctcag

SEQ ID NO: 6287 - DNA, 20 bp, Artificial Sequence
  Synthetic oligonucleotide; TGG chr11 5203797 5203816 5203813 +
gattggctgagctcaggagt

SEQ ID NO: 6288 - DNA, 20 bp, Artificial Sequence
  Synthetic oligonucleotide; GAG chr11 5203799 5203818 5203815 +
ttggctgagctcaggagttg

SEQ ID NO: 6289 - DNA, 20 bp, Artificial Sequence
  Synthetic oligonucleotide; TGG chr11 5203809 5203828 5203825 +
tcaggagttggagaccaacc

SEQ ID NO: 6290 - DNA, 20 bp, Artificial Sequence
  Synthetic oligonucleotide; GGG chr11 5203810 5203829 5203826 +
caggagttggagaccaacct

SEQ ID NO: 6291 - DNA, 20 bp, Artificial Sequence
  Synthetic oligonucleotide; TGG chr11 5203818 5203837 5203834 +
ggagaccaacctgggcaaaa

SEQ ID NO: 6292 - DNA, 20 bp, Artificial Sequence
  Synthetic oligonucleotide; TAG chr11 5203855 5203874 5203871 +
tactaaaacacaaaaataat

SEQ ID NO: 6293 - DNA, 20 bp, Artificial Sequence
  Synthetic oligonucleotide; TGG chr11 5203859 5203878 5203875 +
aaaacacaaaaataattagc

SEQ ID NO: 6294 - DNA, 20 bp, Artificial Sequence
  Synthetic oligonucleotide; GGG chr11 5203860 5203879 5203876 +
aaacacaaaaataattagct

SEQ ID NO: 6295 - DNA, 20 bp, Artificial Sequence
  Synthetic oligonucleotide; TGG chr11 5203865 5203884 5203881 +
caaaaataattagctgggca

SEQ ID NO: 6296 - DNA, 20 bp, Artificial Sequence
  Synthetic oligonucleotide; CAG chr11 5203868 5203887 5203884 +
aaataattagctgggcatgg

SEQ ID NO: 6297 - DNA, 20 bp, Artificial Sequence
  Synthetic oligonucleotide; CAG chr11 5203887 5203906 5203903 +
gcagtgtgctcctgtaatcc

SEQ ID NO: 6298 - DNA, 20 bp, Artificial Sequence
  Synthetic oligonucleotide; TGG chr11 5203895 5203914 5203911 +
ctcctgtaatcccagttact

SEQ ID NO: 6299 - DNA, 20 bp, Artificial Sequence
  Synthetic oligonucleotide; GGG chr11 5203896 5203915 5203912 +
tcctgtaatcccagttactt

SEQ ID NO: 6300 - DNA, 20 bp, Artificial Sequence
  Synthetic oligonucleotide; GAG chr11 5203898 5203917 5203914 +
ctgtaatcccagttacttgg

SEQ ID NO: 6301 - DNA, 20 bp, Artificial Sequence
  Synthetic oligonucleotide; GAG chr11 5203904 5203923 5203920 +
tcccagttacttgggagact

SEQ ID NO: 6302 - DNA, 20 bp, Artificial Sequence
  Synthetic oligonucleotide; AGG chr11 5203905 5203924 5203921 +
cccagttacttgggagactg

SEQ ID NO: 6303 - DNA, 20 bp, Artificial Sequence
  Synthetic oligonucleotide; CAG chr11 5203908 5203927 5203924 +
agttacttgggagactgagg

SEQ ID NO: 6304 - DNA, 20 bp, Artificial Sequence
  Synthetic oligonucleotide; AGG chr11 5203909 5203928 5203925 +
gttacttgggagactgaggc

SEQ ID NO: 6305 - DNA, 20 bp, Artificial Sequence
  Synthetic oligonucleotide; GAG chr11 5203911 5203930 5203927 +
tacttgggagactgaggcag

SEQ ID NO: 6306 - DNA, 20 bp, Artificial Sequence
  Synthetic oligonucleotide; TGG chr11 5203927 5203946 5203943 +
gcaggagaattgcttgatcc

SEQ ID NO: 6307 - DNA, 20 bp, Artificial Sequence
  Synthetic oligonucleotide; GGG chr11 5203928 5203947 5203944 +
caggagaattgcttgatcct

SEQ ID NO: 6308 - DNA, 20 bp, Artificial Sequence
  Synthetic oligonucleotide; GAG chr11 5203930 5203949 5203946 +
ggagaattgcttgatcctgg

SEQ ID NO: 6309 - DNA, 20 bp, Artificial Sequence
  Synthetic oligonucleotide; AGG chr11 5203931 5203950 5203947 +
gagaattgcttgatcctggg

SEQ ID NO: 6310 - DNA, 20 bp, Artificial Sequence
  Synthetic oligonucleotide; TGG chr11 5203934 5203953 5203950 +
aattgcttgatcctgggagg

SEQ ID NO: 6311 - DNA, 20 bp, Artificial Sequence
  Synthetic oligonucleotide; AAG chr11 5203937 5203956 5203953 +
tgcttgatcctgggaggtgg

SEQ ID NO: 6312 - DNA, 20 bp, Artificial Sequence
  Synthetic oligonucleotide; CAG chr11 5203943 5203962 5203959 +
atcctgggaggtggaagttg

SEQ ID NO: 6313 - DNA, 20 bp, Artificial Sequence
  Synthetic oligonucleotide; GAG chr11 5203947 5203966 5203963 +
tgggaggtggaagttgcagt

SEQ ID NO: 6314 - DNA, 20 bp, Artificial Sequence
  Synthetic oligonucleotide; GAG chr11 5203952 5203971 5203968 +
ggtggaagttgcagtgagcc

SEQ ID NO: 6315 - DNA, 20 bp, Artificial Sequence
  Synthetic oligonucleotide; CAG chr11 5203972 5203991 5203988 +
gagatcgcgccattgcactc

SEQ ID NO: 6316 - DNA, 20 bp, Artificial Sequence
  Synthetic oligonucleotide; TGG chr11 5203977 5203996 5203993 +
cgcgccattgcactccagtc

SEQ ID NO: 6317 - DNA, 20 bp, Artificial Sequence
  Synthetic oligonucleotide; GGG chr11 5203978 5203997 5203994 +
gcgccattgcactccagtct

SEQ ID NO: 6318 - DNA, 20 bp, Artificial Sequence
  Synthetic oligonucleotide; CAG chr11 5203984 5204003 5204000 +
ttgcactccagtctgggcga

SEQ ID NO: 6319 - DNA, 20 bp, Artificial Sequence
  Synthetic oligonucleotide; GAG chr11 5203986 5204005 5204002 +
gcactccagtctgggcgaca

SEQ ID NO: 6320 - DNA, 20 bp, Artificial Sequence
  Synthetic oligonucleotide; AAG chr11 5203990 5204009 5204006 +
tccagtctgggcgacagagc

SEQ ID NO: 6321 - DNA, 20 bp, Artificial Sequence
  Synthetic oligonucleotide; AAG chr11 5204004 5204023 5204020 +
cagagcaagactctgtccca

SEQ ID NO: 6322 - DNA, 20 bp, Artificial Sequence
  Synthetic oligonucleotide; AGG chr11 5204005 5204024 5204021 +
agagcaagactctgtcccaa

SEQ ID NO: 6323 - DNA, 20 bp, Artificial Sequence
  Synthetic oligonucleotide; CAG chr11 5204030 5204049 5204046 +
aaaaaaaatctattttcatg

SEQ ID NO: 6324 - DNA, 20 bp, Artificial Sequence
  Synthetic oligonucleotide; AGG chr11 5204031 5204050 5204047 +
aaaaaaatctattttcatgc

SEQ ID NO: 6325 - DNA, 20 bp, Artificial Sequence
  Synthetic oligonucleotide; CAG chr11 5204040 5204059 5204056 +
tattttcatgcaggtttctt

SEQ ID NO: 6326 - DNA, 20 bp, Artificial Sequence
  Synthetic oligonucleotide; AAG chr11 5204053 5204072 5204069 +
gtttcttcagactgactaca

SEQ ID NO: 6327 - DNA, 20 bp, Artificial Sequence
  Synthetic oligonucleotide; AGG chr11 5204054 5204073 5204070 +
tttcttcagactgactacaa

SEQ ID NO: 6328 - DNA, 20 bp, Artificial Sequence
  Synthetic oligonucleotide; CAG chr11 5204060 5204079 5204076 +
cagactgactacaaaggctt

SEQ ID NO: 6329 - DNA, 20 bp, Artificial Sequence
  Synthetic oligonucleotide; TAG chr11 5204065 5204084 5204081 +
tgactacaaaggcttcagac

SEQ ID NO: 6330 - DNA, 20 bp, Artificial Sequence
  Synthetic oligonucleotide; AAG chr11 5204073 5204092 5204089 +
aaggcttcagactagctaca

SEQ ID NO: 6331 - DNA, 20 bp, Artificial Sequence
  Synthetic oligonucleotide; CAG chr11 5204096 5204115 5204112 +
cttaaaaatctactttcatt

SEQ ID NO: 6332 - DNA, 20 bp, Artificial Sequence
  Synthetic oligonucleotide; AGG chr11 5204097 5204116 5204113 +
ttaaaaatctactttcattc

SEQ ID NO: 6333 - DNA, 20 bp, Artificial Sequence
  Synthetic oligonucleotide; CAG chr11 5204106 5204125 5204122 +
tactttcattcaggcttctt

SEQ ID NO: 6334 - DNA, 20 bp, Artificial Sequence
  Synthetic oligonucleotide; TAG chr11 5204111 5204130 5204127 +
tcattcaggcttcttcagac

SEQ ID NO: 6335 - DNA, 20 bp, Artificial Sequence
  Synthetic oligonucleotide; CAG chr11 5204117 5204136 5204133 +
aggcttcttcagactagata

SEQ ID NO: 6336 - DNA, 20 bp, Artificial Sequence
  Synthetic oligonucleotide; AAG chr11 5204120 5204139 5204136 +
cttcttcagactagatacag

SEQ ID NO: 6337 - DNA, 20 bp, Artificial Sequence
  Synthetic oligonucleotide; GAG chr11 5204127 5204146 5204143 +
agactagatacagaagaaat

SEQ ID NO: 6338 - DNA, 20 bp, Artificial Sequence
  Synthetic oligonucleotide; TAG chr11 5204136 5204155 5204152 +
acagaagaaatgagaccatc

SEQ ID NO: 6339 - DNA, 20 bp, Artificial Sequence
  Synthetic oligonucleotide; TGG chr11 5204140 5204159 5204156 +
aagaaatgagaccatctaga

SEQ ID NO: 6340 - DNA, 20 bp, Artificial Sequence
  Synthetic oligonucleotide; GGG chr11 5204141 5204160 5204157 +
agaaatgagaccatctagat

SEQ ID NO: 6341 - DNA, 20 bp, Artificial Sequence
  Synthetic oligonucleotide; GGG chr11 5204142 5204161 5204158 +
gaaatgagaccatctagatg

SEQ ID NO: 6342 - DNA, 20 bp, Artificial Sequence
  Synthetic oligonucleotide; CAG chr11 5204147 5204166 5204163 +
gagaccatctagatggggaa

SEQ ID NO: 6343 - DNA, 20 bp, Artificial Sequence
  Synthetic oligonucleotide; TAG chr11 5204170 5204189 5204186 +
tattatccatgttgccacca

SEQ ID NO: 6344 - DNA, 20 bp, Artificial Sequence
  Synthetic oligonucleotide; GAG chr11 5204172 5204191 5204188 +
ttatccatgttgccaccata

SEQ ID NO: 6345 - DNA, 20 bp, Artificial Sequence
  Synthetic oligonucleotide; CAG chr11 5204180 5204199 5204196 +
gttgccaccatagagactat

SEQ ID NO: 6346 - DNA, 20 bp, Artificial Sequence
  Synthetic oligonucleotide; TGG chr11 5204188 5204207 5204204 +
catagagactatcagccttt

SEQ ID NO: 6347 - DNA, 20 bp, Artificial Sequence
  Synthetic oligonucleotide; GGG chr11 5204189 5204208 5204205 +
atagagactatcagcctttt

SEQ ID NO: 6348 - DNA, 20 bp, Artificial Sequence
  Synthetic oligonucleotide; CAG chr11 5204197 5204216 5204213 +
tatcagccttttgggattac

SEQ ID NO: 6349 - DNA, 20 bp, Artificial Sequence
  Synthetic oligonucleotide; GAG chr11 5204199 5204218 5204215 +
tcagccttttgggattacca

SEQ ID NO: 6350 - DNA, 20 bp, Artificial Sequence
  Synthetic oligonucleotide; TGG chr11 5204214 5204233 5204230 +
taccagagcaaaatacatgt

SEQ ID NO: 6351 - DNA, 20 bp, Artificial Sequence
  Synthetic oligonucleotide; GAG chr11 5204216 5204235 5204232 +
ccagagcaaaatacatgttg

SEQ ID NO: 6352 - DNA, 20 bp, Artificial Sequence
  Synthetic oligonucleotide; AGG chr11 5204217 5204236 5204233 +
cagagcaaaatacatgttgg

SEQ ID NO: 6353 - DNA, 20 bp, Artificial Sequence
  Synthetic oligonucleotide; AAG chr11 5204241 5204260 5204257 +
ttttttaaaatatgttttga

SEQ ID NO: 6354 - DNA, 20 bp, Artificial Sequence
  Synthetic oligonucleotide; AGG chr11 5204242 5204261 5204258 +
tttttaaaatatgttttgaa

SEQ ID NO: 6355 - DNA, 20 bp, Artificial Sequence
  Synthetic oligonucleotide; TAG chr11 5204245 5204264 5204261 +
ttaaaatatgttttgaaagg

SEQ ID NO: 6356 - DNA, 20 bp, Artificial Sequence
  Synthetic oligonucleotide; AGG chr11 5204246 5204265 5204262 +
taaaatatgttttgaaaggt

SEQ ID NO: 6357 - DNA, 20 bp, Artificial Sequence
  Synthetic oligonucleotide; AAG chr11 5204253 5204272 5204269 +
tgttttgaaaggtaggatga

SEQ ID NO: 6358 - DNA, 20 bp, Artificial Sequence
  Synthetic oligonucleotide; GAG chr11 5204255 5204274 5204271 +
ttttgaaaggtaggatgaaa

SEQ ID NO: 6359 - DNA, 20 bp, Artificial Sequence
  Synthetic oligonucleotide; TAG chr11 5204260 5204279 5204276 +
aaaggtaggatgaaagagca

SEQ ID NO: 6360 - DNA, 20 bp, Artificial Sequence
  Synthetic oligonucleotide; AAG chr11 5204270 5204289 5204286 +
tgaaagagcatagttttgat

SEQ ID NO: 6361 - DNA, 20 bp, Artificial Sequence
  Synthetic oligonucleotide; AGG chr11 5204271 5204290 5204287 +
gaaagagcatagttttgata

SEQ ID NO: 6362 - DNA, 20 bp, Artificial Sequence
  Synthetic oligonucleotide; AAG chr11 5204284 5204303 5204300 +
tttgataaggtaaataaatg

SEQ ID NO: 6363 - DNA, 20 bp, Artificial Sequence
  Synthetic oligonucleotide; AAG chr11 5204292 5204311 5204308 +
ggtaaataaatgaagattta

SEQ ID NO: 6364 - DNA, 20 bp, Artificial Sequence
  Synthetic oligonucleotide; AAG chr11 5204301 5204320 5204317 +
atgaagatttaaagaaaaac

SEQ ID NO: 6365 - DNA, 20 bp, Artificial Sequence
  Synthetic oligonucleotide; CAG chr11 5204314 5204333 5204330 +
gaaaaacaagatcaatatgt

SEQ ID NO: 6366 - DNA, 20 bp, Artificial Sequence
  Synthetic oligonucleotide; AGG chr11 5204315 5204334 5204331 +
aaaaacaagatcaatatgtc

SEQ ID NO: 6367 - DNA, 20 bp, Artificial Sequence
  Synthetic oligonucleotide; CAG chr11 5204323 5204342 5204339 +
gatcaatatgtcaggtgtgc

SEQ ID NO: 6368 - DNA, 20 bp, Artificial Sequence
  Synthetic oligonucleotide; AAG chr11 5204353 5204372 5204369 +
acctgtatttaaaaaacaaa

SEQ ID NO: 6369 - DNA, 20 bp, Artificial Sequence
  Synthetic oligonucleotide; CAG chr11 5204361 5204380 5204377 +
ttaaaaaacaaaaagattta

SEQ ID NO: 6370 - DNA, 20 bp, Artificial Sequence
  Synthetic oligonucleotide; AAG chr11 5204370 5204389 5204386 +
aaaaagatttacagttttcc

SEQ ID NO: 6371 - DNA, 20 bp, Artificial Sequence
  Synthetic oligonucleotide; GAG chr11 5204397 5204416 5204413 +
catgttgtgttatgctatct

SEQ ID NO: 6372 - DNA, 20 bp, Artificial Sequence
  Synthetic oligonucleotide; GAG chr11 5204399 5204418 5204415 +
tgttgtgttatgctatctga

SEQ ID NO: 6373 - DNA, 20 bp, Artificial Sequence
  Synthetic oligonucleotide; CAG chr11 5204403 5204422 5204419 +
gtgttatgctatctgagagt

SEQ ID NO: 6374 - DNA, 20 bp, Artificial Sequence
  Synthetic oligonucleotide; TGG chr11 5204410 5204429 5204426 +
gctatctgagagtcagtgta

SEQ ID NO: 6375 - DNA, 20 bp, Artificial Sequence
  Synthetic oligonucleotide; CAG chr11 5204418 5204437 5204434 +
agagtcagtgtatggtatct

SEQ ID NO: 6376 - DNA, 20 bp, Artificial Sequence
  Synthetic oligonucleotide; GAG chr11 5204424 5204443 5204440 +
agtgtatggtatctcagtct

SEQ ID NO: 6377 - DNA, 20 bp, Artificial Sequence
  Synthetic oligonucleotide; CAG chr11 5204431 5204450 5204447 +
ggtatctcagtctgagttcc

SEQ ID NO: 6378 - DNA, 20 bp, Artificial Sequence
  Synthetic oligonucleotide; CAG chr11 5204438 5204457 5204454 +
cagtctgagttcccagcaac

SEQ ID NO: 6379 - DNA, 20 bp, Artificial Sequence
  Synthetic oligonucleotide; TAG chr11 5204464 5204483 5204480 +
aatgcctataataaaataaa

SEQ ID NO: 6380 - DNA, 20 bp, Artificial Sequence
  Synthetic oligonucleotide; GAG chr11 5204466 5204485 5204482 +
tgcctataataaaataaata

SEQ ID NO: 6381 - DNA, 20 bp, Artificial Sequence
  Synthetic oligonucleotide; AAG chr11 5204469 5204488 5204485 +
ctataataaaataaatagag

SEQ ID NO: 6382 - DNA, 20 bp, Artificial Sequence
  Synthetic oligonucleotide; TAG chr11 5204477 5204496 5204493 +
aaataaatagagaagacaaa

SEQ ID NO: 6383 - DNA, 20 bp, Artificial Sequence
  Synthetic oligonucleotide; CAG chr11 5204480 5204499 5204496 +
taaatagagaagacaaatag

SEQ ID NO: 6384 - DNA, 20 bp, Artificial Sequence
  Synthetic oligonucleotide; GAG chr11 5204490 5204509 5204506 +
agacaaatagcagtgaattt

SEQ ID NO: 6385 - DNA, 20 bp, Artificial Sequence
  Synthetic oligonucleotide; TGG chr11 5204495 5204514 5204511 +
aatagcagtgaatttgagtc

SEQ ID NO: 6386 - DNA, 20 bp, Artificial Sequence
  Synthetic oligonucleotide; GAG chr11 5204497 5204516 5204513 +
tagcagtgaatttgagtctg

SEQ ID NO: 6387 - DNA, 20 bp, Artificial Sequence
  Synthetic oligonucleotide; AAG chr11 5204506 5204525 5204522 +
atttgagtctggagaaataa

SEQ ID NO: 6388 - DNA, 20 bp, Artificial Sequence
  Synthetic oligonucleotide; AGG chr11 5204507 5204526 5204523 +
tttgagtctggagaaataaa

SEQ ID NO: 6389 - DNA, 20 bp, Artificial Sequence
  Synthetic oligonucleotide; GGG chr11 5204508 5204527 5204524 +
ttgagtctggagaaataaaa

SEQ ID NO: 6390 - DNA, 20 bp, Artificial Sequence
  Synthetic oligonucleotide; GAG chr11 5204527 5204546 5204543 +
agggttttcgtatcccctct

SEQ ID NO: 6391 - DNA, 20 bp, Artificial Sequence
  Synthetic oligonucleotide; TGG chr11 5204537 5204556 5204553 +
tatcccctctgagcactgtc

SEQ ID NO: 6392 - DNA, 20 bp, Artificial Sequence
  Synthetic oligonucleotide; TGG chr11 5204550 5204569 5204566 +
cactgtctggaatgttgact

SEQ ID NO: 6393 - DNA, 20 bp, Artificial Sequence
  Synthetic oligonucleotide; AAG chr11 5204554 5204573 5204570 +
gtctggaatgttgacttgga

SEQ ID NO: 6394 - DNA, 20 bp, Artificial Sequence
  Synthetic oligonucleotide; CAG chr11 5204578 5204597 5204594 +
aaatctgtgattataataac

SEQ ID NO: 6395 - DNA, 20 bp, Artificial Sequence
  Synthetic oligonucleotide; AGG chr11 5204579 5204598 5204595 +
aatctgtgattataataacc

SEQ ID NO: 6396 - DNA, 20 bp, Artificial Sequence
  Synthetic oligonucleotide; CAG chr11 5204591 5204610 5204607 +
taataaccaggtcattcttt

SEQ ID NO: 6397 - DNA, 20 bp, Artificial Sequence
  Synthetic oligonucleotide; AGG chr11 5204592 5204611 5204608 +
aataaccaggtcattctttc

SEQ ID NO: 6398 - DNA, 20 bp, Artificial Sequence
  Synthetic oligonucleotide; GAG chr11 5204594 5204613 5204610 +
taaccaggtcattctttcag

SEQ ID NO: 6399 - DNA, 20 bp, Artificial Sequence
  Synthetic oligonucleotide; CAG chr11 5204637 5204656 5204653 +
ttaaaactgacctacatatg

SEQ ID NO: 6400 - DNA, 20 bp, Artificial Sequence
  Synthetic oligonucleotide; TGG chr11 5204648 5204667 5204664 +
ctacatatgcagaaatctct

SEQ ID NO: 6401 - DNA, 20 bp, Artificial Sequence
  Synthetic oligonucleotide; CAG chr11 5204674 5204693 5204690 +
tttttttttttctgtctttt

SEQ ID NO: 6402 - DNA, 20 bp, Artificial Sequence
  Synthetic oligonucleotide; TAG chr11 5204713 5204732 5204729 +
attacttgcttactttaaaa

SEQ ID NO: 6403 - DNA, 20 bp, Artificial Sequence
  Synthetic oligonucleotide; AGG chr11 5204714 5204733 5204730 +
ttacttgcttactttaaaat

SEQ ID NO: 6404 - DNA, 20 bp, Artificial Sequence
  Synthetic oligonucleotide; GGG chr11 5204715 5204734 5204731 +
tacttgcttactttaaaata

SEQ ID NO: 6405 - DNA, 20 bp, Artificial Sequence
  Synthetic oligonucleotide; TAG chr11 5204728 5204747 5204744 +
taaaatagggtaatgaccaa

SEQ ID NO: 6406 - DNA, 20 bp, Artificial Sequence
  Synthetic oligonucleotide; AAG chr11 5204742 5204761 5204758 +
gaccaatagtcattgttcca

SEQ ID NO: 6407 - DNA, 20 bp, Artificial Sequence
  Synthetic oligonucleotide; TAG chr11 5204748 5204767 5204764 +
tagtcattgttccaaagaca

SEQ ID NO: 6408 - DNA, 20 bp, Artificial Sequence
  Synthetic oligonucleotide; GAG chr11 5204750 5204769 5204766 +
gtcattgttccaaagacata

SEQ ID NO: 6409 - DNA, 20 bp, Artificial Sequence
  Synthetic oligonucleotide; AAG chr11 5204754 5204773 5204770 +
ttgttccaaagacatagaga

SEQ ID NO: 6410 - DNA, 20 bp, Artificial Sequence
  Synthetic oligonucleotide; AAG chr11 5204771 5204790 5204787 +
agaaagtatattgtgtttaa

SEQ ID NO: 6411 - DNA, 20 bp, Artificial Sequence
  Synthetic oligonucleotide; CAG chr11 5204775 5204794 5204791 +
agtatattgtgtttaaaaga

SEQ ID NO: 6412 - DNA, 20 bp, Artificial Sequence
  Synthetic oligonucleotide; TAG chr11 5204794 5204813 5204810 +
acagcttctttataattcta

SEQ ID NO: 6413 - DNA, 20 bp, Artificial Sequence
  Synthetic oligonucleotide; AAG chr11 5204819 5204838 5204835 +
ctaaaacattcctatttgcc

SEQ ID NO: 6414 - DNA, 20 bp, Artificial Sequence
  Synthetic oligonucleotide; AGG chr11 5204820 5204839 5204836 +
taaaacattcctatttgcca

SEQ ID NO: 6415 - DNA, 20 bp, Artificial Sequence
  Synthetic oligonucleotide; CAG chr11 5204823 5204842 5204839 +
aacattcctatttgccaagg

SEQ ID NO: 6416 - DNA, 20 bp, Artificial Sequence
  Synthetic oligonucleotide; TGG chr11 5204826 5204845 5204842 +
attcctatttgccaaggcag

SEQ ID NO: 6417 - DNA, 20 bp, Artificial Sequence
  Synthetic oligonucleotide; GAG chr11 5204828 5204847 5204844 +
tcctatttgccaaggcagtg

SEQ ID NO: 6418 - DNA, 20 bp, Artificial Sequence
  Synthetic oligonucleotide; TAG chr11 5204844 5204863 5204860 +
agtggagtttttgctgttct

SEQ ID NO: 6419 - DNA, 20 bp, Artificial Sequence
  Synthetic oligonucleotide; AAG chr11 5204861 5204880 5204877 +
tcttagaacataattactga

SEQ ID NO: 6420 - DNA, 20 bp, Artificial Sequence
  Synthetic oligonucleotide; TGG chr11 5204885 5204904 5204901 +
cacccacacatgtcctgcct

SEQ ID NO: 6421 - DNA, 20 bp, Artificial Sequence
  Synthetic oligonucleotide; AAG chr11 5204914 5204933 5204930 +
aattgtatgtccatccttta

SEQ ID NO: 6422 - DNA, 20 bp, Artificial Sequence
  Synthetic oligonucleotide; AGG chr11 5204915 5204934 5204931 +
attgtatgtccatcctttaa

SEQ ID NO: 6423 - DNA, 20 bp, Artificial Sequence
  Synthetic oligonucleotide; TGG chr11 5204930 5204949 5204946 +
tttaaaggtcattcctttaa

SEQ ID NO: 6424 - DNA, 20 bp, Artificial Sequence
  Synthetic oligonucleotide; TGG chr11 5204940 5204959 5204956 +
attcctttaatggtcttttc

SEQ ID NO: 6425 - DNA, 20 bp, Artificial Sequence
  Synthetic oligonucleotide; TAG chr11 5204950 5204969 5204966 +
tggtcttttctggacaccac

SEQ ID NO: 6426 - DNA, 20 bp, Artificial Sequence
  Synthetic oligonucleotide; AGG chr11 5204951 5204970 5204967 +
ggtcttttctggacaccact

SEQ ID NO: 6427 - DNA, 20 bp, Artificial Sequence
  Synthetic oligonucleotide; GGG chr11 5204952 5204971 5204968 +
gtcttttctggacaccacta

SEQ ID NO: 6428 - DNA, 20 bp, Artificial Sequence
  Synthetic oligonucleotide; GGG chr11 5204953 5204972 5204969 +
tcttttctggacaccactag

SEQ ID NO: 6429 - DNA, 20 bp, Artificial Sequence
  Synthetic oligonucleotide; CAG chr11 5204957 5204976 5204973 +
ttctggacaccactaggggt

SEQ ID NO: 6430 - DNA, 20 bp, Artificial Sequence
  Synthetic oligonucleotide; AAG chr11 5204960 5204979 5204976 +
tggacaccactaggggtcag

SEQ ID NO: 6431 - DNA, 20 bp, Artificial Sequence
  Synthetic oligonucleotide; TAG chr11 5204963 5204982 5204979 +
acaccactaggggtcagaag

SEQ ID NO: 6432 - DNA, 20 bp, Artificial Sequence
  Synthetic oligonucleotide; CAG chr11 5204994 5205013 5205010 +
actttcttccctccctactt

SEQ ID NO: 6433 - DNA, 20 bp, Artificial Sequence
  Synthetic oligonucleotide; AAG chr11 5205005 5205024 5205021 +
tccctacttcagtgatgcat

SEQ ID NO: 6434 - DNA, 20 bp, Artificial Sequence
  Synthetic oligonucleotide; AGG chr11 5205006 5205025 5205022 +
ccctacttcagtgatgcata

SEQ ID NO: 6435 - DNA, 20 bp, Artificial Sequence
  Synthetic oligonucleotide; CAG chr11 5205009 5205028 5205025 +
tacttcagtgatgcataagg

SEQ ID NO: 6436 - DNA, 20 bp, Artificial Sequence
  Synthetic oligonucleotide; TAG chr11 5205020 5205039 5205036 +
tgcataaggcagatctgctt

SEQ ID NO: 6437 - DNA, 20 bp, Artificial Sequence
  Synthetic oligonucleotide; AAG chr11 5205026 5205045 5205042 +
aggcagatctgctttagtgt

SEQ ID NO: 6438 - DNA, 20 bp, Artificial Sequence
  Synthetic oligonucleotide; GAG chr11 5205030 5205049 5205046 +
agatctgctttagtgtaagc

SEQ ID NO: 6439 - DNA, 20 bp, Artificial Sequence
  Synthetic oligonucleotide; AGG chr11 5205031 5205050 5205047 +
gatctgctttagtgtaagcg

SEQ ID NO: 6440 - DNA, 20 bp, Artificial Sequence
  Synthetic oligonucleotide; CAG chr11 5205035 5205054 5205051 +
tgctttagtgtaagcgaggt

SEQ ID NO: 6441 - DNA, 20 bp, Artificial Sequence
  Synthetic oligonucleotide; AGG chr11 5205036 5205055 5205052 +
gctttagtgtaagcgaggtc

SEQ ID NO: 6442 - DNA, 20 bp, Artificial Sequence
  Synthetic oligonucleotide; AAG chr11 5205044 5205063 5205060 +
gtaagcgaggtcaggccctc

SEQ ID NO: 6443 - DNA, 20 bp, Artificial Sequence
  Synthetic oligonucleotide; GAG chr11 5205046 5205065 5205062 +
aagcgaggtcaggccctcaa

SEQ ID NO: 6444 - DNA, 20 bp, Artificial Sequence
  Synthetic oligonucleotide; TGG chr11 5205052 5205071 5205068 +
ggtcaggccctcaagagtct

SEQ ID NO: 6445 - DNA, 20 bp, Artificial Sequence
  Synthetic oligonucleotide; GGG chr11 5205053 5205072 5205069 +
gtcaggccctcaagagtctt

SEQ ID NO: 6446 - DNA, 20 bp, Artificial Sequence
  Synthetic oligonucleotide; TGG chr11 5205057 5205076 5205073 +
ggccctcaagagtcttggga

SEQ ID NO: 6447 - DNA, 20 bp, Artificial Sequence
  Synthetic oligonucleotide; AAG chr11 5205063 5205082 5205079 +
caagagtcttgggatggctg

SEQ ID NO: 6448 - DNA, 20 bp, Artificial Sequence
  Synthetic oligonucleotide; GAG chr11 5205065 5205084 5205081 +
agagtcttgggatggctgaa

SEQ ID NO: 6449 - DNA, 20 bp, Artificial Sequence
  Synthetic oligonucleotide; AGG chr11 5205066 5205085 5205082 +
gagtcttgggatggctgaag

SEQ ID NO: 6450 - DNA, 20 bp, Artificial Sequence
  Synthetic oligonucleotide; AAG chr11 5205070 5205089 5205086 +
cttgggatggctgaagaggt

SEQ ID NO: 6451 - DNA, 20 bp, Artificial Sequence
  Synthetic oligonucleotide; AAG chr11 5205083 5205102 5205099 +
aagaggtaagaacattctat

SEQ ID NO: 6452 - DNA, 20 bp, Artificial Sequence
  Synthetic oligonucleotide; AAG chr11 5205095 5205114 5205111 +
cattctataagacttgtcca

SEQ ID NO: 6453 - DNA, 20 bp, Artificial Sequence
  Synthetic oligonucleotide; TAG chr11 5205127 5205146 5205143 +
tttaatgattctgaatatgc

SEQ ID NO: 6454 - DNA, 20 bp, Artificial Sequence
  Synthetic oligonucleotide; CAG chr11 5205132 5205151 5205148 +
tgattctgaatatgctagtt

SEQ ID NO: 6455 - DNA, 20 bp, Artificial Sequence
  Synthetic oligonucleotide; GAG chr11 5205134 5205153 5205150 +
attctgaatatgctagttca

SEQ ID NO: 6456 - DNA, 20 bp, Artificial Sequence
  Synthetic oligonucleotide; GAG chr11 5205136 5205155 5205152 +
tctgaatatgctagttcaga

SEQ ID NO: 6457 - DNA, 20 bp, Artificial Sequence
  Synthetic oligonucleotide; AAG chr11 5205160 5205179 5205176 +
atctatttaccacaaacctg

SEQ ID NO: 6458 - DNA, 20 bp, Artificial Sequence
  Synthetic oligonucleotide; TAG chr11 5205163 5205182 5205179 +
tatttaccacaaacctgaag

SEQ ID NO: 6459 - DNA, 20 bp, Artificial Sequence
  Synthetic oligonucleotide; AGG chr11 5205164 5205183 5205180 +
atttaccacaaacctgaagt

SEQ ID NO: 6460 - DNA, 20 bp, Artificial Sequence
  Synthetic oligonucleotide; CAG chr11 5205177 5205196 5205193 +
ctgaagtaggcttaaatttc

SEQ ID NO: 6461 - DNA, 20 bp, Artificial Sequence
  Synthetic oligonucleotide; TGG chr11 5205190 5205209 5205206 +
aaatttccagtttacctgaa

SEQ ID NO: 6462 - DNA, 20 bp, Artificial Sequence
  Synthetic oligonucleotide; TAG chr11 5205205 5205224 5205221 +
ctgaatggttatgacctaat

SEQ ID NO: 6463 - DNA, 20 bp, Artificial Sequence
  Synthetic oligonucleotide; GAG chr11 5205207 5205226 5205223 +
gaatggttatgacctaatta

SEQ ID NO: 6464 - DNA, 20 bp, Artificial Sequence
  Synthetic oligonucleotide; AGG chr11 5205208 5205227 5205224 +
aatggttatgacctaattag

SEQ ID NO: 6465 - DNA, 20 bp, Artificial Sequence
  Synthetic oligonucleotide; TAG chr11 5205231 5205250 5205247 +
aatgactttataaacatata

SEQ ID NO: 6466 - DNA, 20 bp, Artificial Sequence
  Synthetic oligonucleotide; TAG chr11 5205245 5205264 5205261 +
catatatagatacaaatata

SEQ ID NO: 6467 - DNA, 20 bp, Artificial Sequence
  Synthetic oligonucleotide; AAG chr11 5205289 5205308 5205305 +
atatttattatatattatat

SEQ ID NO: 6468 - DNA, 20 bp, Artificial Sequence
  Synthetic oligonucleotide; TAG chr11 5205304 5205323 5205320 +
tatataagcataaaatgtaa

SEQ ID NO: 6469 - DNA, 20 bp, Artificial Sequence
  Synthetic oligonucleotide; TAG chr11 5205461 5205480 5205477 +
tatgtatatacacatttatc

SEQ ID NO: 6470 - DNA, 20 bp, Artificial Sequence
  Synthetic oligonucleotide; AAG chr11 5205495 5205514 5205511 +
tatttcattatatattttat

SEQ ID NO: 6471 - DNA, 20 bp, Artificial Sequence
  Synthetic oligonucleotide; TAG chr11 5205546 5205565 5205562 +
ctaaaatattttttaaaaat

SEQ ID NO: 6472 - DNA, 20 bp, Artificial Sequence
  Synthetic oligonucleotide; TAG chr11 5205557 5205576 5205573 +
tttaaaaattagccatacct

SEQ ID NO: 6473 - DNA, 20 bp, Artificial Sequence
  Synthetic oligonucleotide; AAG chr11 5205560 5205579 5205576 +
aaaaattagccataccttag

SEQ ID NO: 6474 - DNA, 20 bp, Artificial Sequence
  Synthetic oligonucleotide; TGG chr11 5205584 5205603 5205600 +
attataaaaaatatatgaca

SEQ ID NO: 6475 - DNA, 20 bp, Artificial Sequence
  Synthetic oligonucleotide; TAG chr11 5205603 5205622 5205619 +
atggtccatctgttcaactg

SEQ ID NO: 6476 - DNA, 20 bp, Artificial Sequence
  Synthetic oligonucleotide; GAG chr11 5205620 5205639 5205636 +
ctgtagccatctaaccattt

SEQ ID NO: 6477 - DNA, 20 bp, Artificial Sequence
  Synthetic oligonucleotide; AAG chr11 5205623 5205642 5205639 +
tagccatctaaccatttgag

SEQ ID NO: 6478 - DNA, 20 bp, Artificial Sequence
  Synthetic oligonucleotide; AAG chr11 5205633 5205652 5205649 +
accatttgagaagtttttat

SEQ ID NO: 6479 - DNA, 20 bp, Artificial Sequence
  Synthetic oligonucleotide; TAG chr11 5205641 5205660 5205657 +
agaagtttttataagattta

SEQ ID NO: 6480 - DNA, 20 bp, Artificial Sequence
  Synthetic oligonucleotide; AAG chr11 5205679 5205698 5205695 +
tgacataaatcatctcatgc

SEQ ID NO: 6481 - DNA, 20 bp, Artificial Sequence
  Synthetic oligonucleotide; TAG chr11 5205683 5205702 5205699 +
ataaatcatctcatgcaaga

SEQ ID NO: 6482 - DNA, 20 bp, Artificial Sequence
  Synthetic oligonucleotide; TGG chr11 5205700 5205719 5205716 +
agatagtgtatttgttttgt

SEQ ID NO: 6483 - DNA, 20 bp, Artificial Sequence
  Synthetic oligonucleotide; CAG chr11 5205725 5205744 5205741 +
ttaatatgttcccttttctt

SEQ ID NO: 6484 - DNA, 20 bp, Artificial Sequence
  Synthetic oligonucleotide; GAG chr11 5205735 5205754 5205751 +
cccttttcttcagaaaatgt

SEQ ID NO: 6485 - DNA, 20 bp, Artificial Sequence
  Synthetic oligonucleotide; CAG chr11 5205739 5205758 5205755 +
tttcttcagaaaatgtgaga

SEQ ID NO: 6486 - DNA, 20 bp, Artificial Sequence
  Synthetic oligonucleotide; AAG chr11 5205762 5205781 5205778 +
cttaaaataaaattaactat

SEQ ID NO: 6487 - DNA, 20 bp, Artificial Sequence
  Synthetic oligonucleotide; TGG chr11 5205769 5205788 5205785 +
taaaattaactataagaaac

SEQ ID NO: 6488 - DNA, 20 bp, Artificial Sequence
  Synthetic oligonucleotide; AAG chr11 5205786 5205805 5205802 +
aactggtaaacactgaatga

SEQ ID NO: 6489 - DNA, 20 bp, Artificial Sequence
  Synthetic oligonucleotide; AAG chr11 5205789 5205808 5205805 +
tggtaaacactgaatgaaag

SEQ ID NO: 6490 - DNA, 20 bp, Artificial Sequence
  Synthetic oligonucleotide; AAG chr11 5205798 5205817 5205814 +
ctgaatgaaagaagaaaacc

SEQ ID NO: 6491 - DNA, 20 bp, Artificial Sequence
  Synthetic oligonucleotide; CAG chr11 5205801 5205820 5205817 +
aatgaaagaagaaaaccaag

SEQ ID NO: 6492 - DNA, 20 bp, Artificial Sequence
  Synthetic oligonucleotide; AAG chr11 5205806 5205825 5205822 +
aagaagaaaaccaagcagaa

SEQ ID NO: 6493 - DNA, 20 bp, Artificial Sequence
  Synthetic oligonucleotide; AAG chr11 5205812 5205831 5205828 +
aaaaccaagcagaaaagtaa

SEQ ID NO: 6494 - DNA, 20 bp, Artificial Sequence
  Synthetic oligonucleotide; AGG chr11 5205813 5205832 5205829 +
aaaccaagcagaaaagtaaa

SEQ ID NO: 6495 - DNA, 20 bp, Artificial Sequence
  Synthetic oligonucleotide; GAG chr11 5205815 5205834 5205831 +
accaagcagaaaagtaaaag

SEQ ID NO: 6496 - DNA, 20 bp, Artificial Sequence
  Synthetic oligonucleotide; AGG chr11 5205816 5205835 5205832 +
ccaagcagaaaagtaaaagg

SEQ ID NO: 6497 - DNA, 20 bp, Artificial Sequence
  Synthetic oligonucleotide; TGG chr11 5205860 5205879 5205876 +
aaaaacattttttatttgcc

SEQ ID NO: 6498 - DNA, 20 bp, Artificial Sequence
  Synthetic oligonucleotide; AAG chr11 5205871 5205890 5205887 +
ttatttgcctggcaaataat

SEQ ID NO: 6499 - DNA, 20 bp, Artificial Sequence
  Synthetic oligonucleotide; TGG chr11 5205886 5205905 5205902 +
ataataagtgcatatattaa

SEQ ID NO: 6500 - DNA, 20 bp, Artificial Sequence
  Synthetic oligonucleotide; TGG chr11 5205937 5205956 5205953 +
ataatatatataatatgtta

SEQ ID NO: 6501 - DNA, 20 bp, Artificial Sequence
  Synthetic oligonucleotide; GGG chr11 5205938 5205957 5205954 +
taatatatataatatgttat

SEQ ID NO: 6502 - DNA, 20 bp, Artificial Sequence
  Synthetic oligonucleotide; TAG chr11 5205974 5205993 5205990 +
tttgatctatatatacattg

SEQ ID NO: 6503 - DNA, 20 bp, Artificial Sequence
  Synthetic oligonucleotide; GAG chr11 5205976 5205995 5205992 +
tgatctatatatacattgta

SEQ ID NO: 6504 - DNA, 20 bp, Artificial Sequence
  Synthetic oligonucleotide; GAG chr11 5205978 5205997 5205994 +
atctatatatacattgtaga

SEQ ID NO: 6505 - DNA, 20 bp, Artificial Sequence
  Synthetic oligonucleotide; GAG chr11 5205980 5205999 5205996 +
ctatatatacattgtagaga

SEQ ID NO: 6506 - DNA, 20 bp, Artificial Sequence
  Synthetic oligonucleotide; AAG chr11 5205989 5206008 5206005 +
cattgtagagagagtctatc

SEQ ID NO: 6507 - DNA, 20 bp, Artificial Sequence
  Synthetic oligonucleotide; TAG chr11 5205997 5206016 5206013 +
agagagtctatcaagctaat

SEQ ID NO: 6508 - DNA, 20 bp, Artificial Sequence
  Synthetic oligonucleotide; TGG chr11 5206028 5206047 5206044 +
tcaccttccaactttttttg

SEQ ID NO: 6509 - DNA, 20 bp, Artificial Sequence
  Synthetic oligonucleotide; GAG chr11 5206032 5206051 5206048 +
cttccaactttttttgtggt

SEQ ID NO: 6510 - DNA, 20 bp, Artificial Sequence
  Synthetic oligonucleotide; TAG chr11 5206055 5206074 5206071 +
aacataaaatatttattttt

SEQ ID NO: 6511 - DNA, 20 bp, Artificial Sequence
  Synthetic oligonucleotide; CAG chr11 5206106 5206125 5206122 +
tattaactgtgttcactatg

SEQ ID NO: 6512 - DNA, 20 bp, Artificial Sequence
  Synthetic oligonucleotide; GAG chr11 5206112 5206131 5206128 +
ctgtgttcactatgcagtgt

SEQ ID NO: 6513 - DNA, 20 bp, Artificial Sequence
  Synthetic oligonucleotide; GAG chr11 5206114 5206133 5206130 +
gtgttcactatgcagtgtga

SEQ ID NO: 6514 - DNA, 20 bp, Artificial Sequence
  Synthetic oligonucleotide; TAG chr11 5206137 5206156 5206153 +
atcactaaaacttattcctc

SEQ ID NO: 6515 - DNA, 20 bp, Artificial Sequence
  Synthetic oligonucleotide; AAG chr11 5206148 5206167 5206164 +
ttattcctctagtctaactg

SEQ ID NO: 6516 - DNA, 20 bp, Artificial Sequence
  Synthetic oligonucleotide; CAG chr11 5206189 5206208 5206205 +
ccatccctcctctacactct

SEQ ID NO: 6517 - DNA, 20 bp, Artificial Sequence
  Synthetic oligonucleotide; CAG chr11 5206193 5206212 5206209 +
ccctcctctacactctcagt

SEQ ID NO: 6518 - DNA, 20 bp, Artificial Sequence
  Synthetic oligonucleotide; TGG chr11 5206200 5206219 5206216 +
ctacactctcagtcagccta

SEQ ID NO: 6519 - DNA, 20 bp, Artificial Sequence
  Synthetic oligonucleotide; CAG chr11 5206275 5206294 5206291 +
cttaaatatattaaaatgaa

SEQ ID NO: 6520 - DNA, 20 bp, Artificial Sequence
  Synthetic oligonucleotide; GAG chr11 5206288 5206307 5206304 +
aaatgaacagttaaatttat

SEQ ID NO: 6521 - DNA, 20 bp, Artificial Sequence
  Synthetic oligonucleotide; AGG chr11 5206289 5206308 5206305 +
aatgaacagttaaatttatg

SEQ ID NO: 6522 - DNA, 20 bp, Artificial Sequence
  Synthetic oligonucleotide; AAG chr11 5206322 5206341 5206338 +
aaaactattacacatatttt

SEQ ID NO: 6523 - DNA, 20 bp, Artificial Sequence
  Synthetic oligonucleotide; TAG chr11 5206342 5206361 5206358 +
aagttgtcctctgaaaattc

SEQ ID NO: 6524 - DNA, 20 bp, Artificial Sequence
  Synthetic oligonucleotide; AAG chr11 5206371 5206390 5206387 +
acttcaatacccttattttt

SEQ ID NO: 6525 - DNA, 20 bp, Artificial Sequence
  Synthetic oligonucleotide; AAG chr11 5206377 5206396 5206393 +
atacccttatttttaagata

SEQ ID NO: 6526 - DNA, 20 bp, Artificial Sequence
  Synthetic oligonucleotide; AGG chr11 5206378 5206397 5206394 +
tacccttatttttaagataa

SEQ ID NO: 6527 - DNA, 20 bp, Artificial Sequence
  Synthetic oligonucleotide; AAG chr11 5206389 5206408 5206405 +
ttaagataaaggaaattgta

SEQ ID NO: 6528 - DNA, 20 bp, Artificial Sequence
  Synthetic oligonucleotide; AGG chr11 5206390 5206409 5206406 +
taagataaaggaaattgtaa

SEQ ID NO: 6529 - DNA, 20 bp, Artificial Sequence
  Synthetic oligonucleotide; AAG chr11 5206399 5206418 5206415 +
ggaaattgtaaaggctttct

SEQ ID NO: 6530 - DNA, 20 bp, Artificial Sequence
  Synthetic oligonucleotide; GAG chr11 5206407 5206426 5206423 +
taaaggctttctaagaaatc

SEQ ID NO: 6531 - DNA, 20 bp, Artificial Sequence
  Synthetic oligonucleotide; TAG chr11 5206420 5206439 5206436 +
agaaatcgagtacccatacc

SEQ ID NO: 6532 - DNA, 20 bp, Artificial Sequence
  Synthetic oligonucleotide; AGG chr11 5206421 5206440 5206437 +
gaaatcgagtacccatacct

SEQ ID NO: 6533 - DNA, 20 bp, Artificial Sequence
  Synthetic oligonucleotide; TAG chr11 5206428 5206447 5206444 +
agtacccatacctaggctgc

SEQ ID NO: 6534 - DNA, 20 bp, Artificial Sequence
  Synthetic oligonucleotide; CAG chr11 5206435 5206454 5206451 +
atacctaggctgctagactc

SEQ ID NO: 6535 - DNA, 20 bp, Artificial Sequence
  Synthetic oligonucleotide; AGG chr11 5206436 5206455 5206452 +
tacctaggctgctagactcc

SEQ ID NO: 6536 - DNA, 20 bp, Artificial Sequence
  Synthetic oligonucleotide; CAG chr11 5206452 5206471 5206468 +
ctccaggtccaatttttctc

SEQ ID NO: 6537 - DNA, 20 bp, Artificial Sequence
  Synthetic oligonucleotide; AGG chr11 5206453 5206472 5206469 +
tccaggtccaatttttctcc

SEQ ID NO: 6538 - DNA, 20 bp, Artificial Sequence
  Synthetic oligonucleotide; GGG chr11 5206454 5206473 5206470 +
ccaggtccaatttttctcca

SEQ ID NO: 6539 - DNA, 20 bp, Artificial Sequence
  Synthetic oligonucleotide; GGG chr11 5206455 5206474 5206471 +
caggtccaatttttctccag

SEQ ID NO: 6540 - DNA, 20 bp, Artificial Sequence
  Synthetic oligonucleotide; GGG chr11 5206456 5206475 5206472 +
aggtccaatttttctccagg

SEQ ID NO: 6541 - DNA, 20 bp, Artificial Sequence
  Synthetic oligonucleotide; TGG chr11 5206465 5206484 5206481 +
ttttctccagggggttacta

SEQ ID NO: 6542 - DNA, 20 bp, Artificial Sequence
  Synthetic oligonucleotide; CAG chr11 5206471 5206490 5206487 +
ccagggggttactatggctt

SEQ ID NO: 6543 - DNA, 20 bp, Artificial Sequence
  Synthetic oligonucleotide; AGG chr11 5206472 5206491 5206488 +
cagggggttactatggcttc

SEQ ID NO: 6544 - DNA, 20 bp, Artificial Sequence
  Synthetic oligonucleotide; GGG chr11 5206473 5206492 5206489 +
agggggttactatggcttca

SEQ ID NO: 6545 - DNA, 20 bp, Artificial Sequence
  Synthetic oligonucleotide; AAG chr11 5206476 5206495 5206492 +
gggttactatggcttcaggg

SEQ ID NO: 6546 - DNA, 20 bp, Artificial Sequence
  Synthetic oligonucleotide; CAG chr11 5206499 5206518 5206515 +
ctatctataatcaccatctc

SEQ ID NO: 6547 - DNA, 20 bp, Artificial Sequence
  Synthetic oligonucleotide; CAG chr11 5206529 5206548 5206545 +
ctcactttctcatcaccaca

SEQ ID NO: 6548 - DNA, 20 bp, Artificial Sequence
  Synthetic oligonucleotide; TGG chr11 5206532 5206551 5206548 +
actttctcatcaccacacag

SEQ ID NO: 6549 - DNA, 20 bp, Artificial Sequence
  Synthetic oligonucleotide; AAG chr11 5206538 5206557 5206554 +
tcatcaccacacagtggaat

SEQ ID NO: 6550 - DNA, 20 bp, Artificial Sequence
  Synthetic oligonucleotide; TAG chr11 5206543 5206562 5206559 +
accacacagtggaataagaa

SEQ ID NO: 6551 - DNA, 20 bp, Artificial Sequence
  Synthetic oligonucleotide; TGG chr11 5206549 5206568 5206565 +
cagtggaataagaatagttt

SEQ ID NO: 6552 - DNA, 20 bp, Artificial Sequence
  Synthetic oligonucleotide; CAG chr11 5206552 5206571 5206568 +
tggaataagaatagttttgg

SEQ ID NO: 6553 - DNA, 20 bp, Artificial Sequence
  Synthetic oligonucleotide; AAG chr11 5206563 5206582 5206579 +
tagttttggcagcaataaaa

SEQ ID NO: 6554 - DNA, 20 bp, Artificial Sequence
  Synthetic oligonucleotide; TAG chr11 5206582 5206601 5206598 +
aaagtaatgccatatcaaat

SEQ ID NO: 6555 - DNA, 20 bp, Artificial Sequence
  Synthetic oligonucleotide; AAG chr11 5206587 5206606 5206603 +
aatgccatatcaaattagta

SEQ ID NO: 6556 - DNA, 20 bp, Artificial Sequence
  Synthetic oligonucleotide; CAG chr11 5206594 5206613 5206610 +
tatcaaattagtaaagcctt

SEQ ID NO: 6557 - DNA, 20 bp, Artificial Sequence
  Synthetic oligonucleotide; AAG chr11 5206600 5206619 5206616 +
attagtaaagccttcagaaa

SEQ ID NO: 6558 - DNA, 20 bp, Artificial Sequence
  Synthetic oligonucleotide; CAG chr11 5206616 5206635 5206632 +
gaaaaagtatgaatattaca

SEQ ID NO: 6559 - DNA, 20 bp, Artificial Sequence
  Synthetic oligonucleotide; TAG chr11 5206631 5206650 5206647 +
ttacacagttacacttatat

SEQ ID NO: 6560 - DNA, 20 bp, Artificial Sequence
  Synthetic oligonucleotide; AAG chr11 5206698 5206717 5206714 +
tgtctgattaaatgttatta

SEQ ID NO: 6561 - DNA, 20 bp, Artificial Sequence
  Synthetic oligonucleotide; CAG chr11 5206736 5206755 5206752 +
tatatactactattaatttc

SEQ ID NO: 6562 - DNA, 20 bp, Artificial Sequence
  Synthetic oligonucleotide; AAG chr11 5206755 5206774 5206771 +
ccagttctatctttctgttc

SEQ ID NO: 6563 - DNA, 20 bp, Artificial Sequence
  Synthetic oligonucleotide; AAG chr11 5206760 5206779 5206776 +
tctatctttctgttcaagaa

SEQ ID NO: 6564 - DNA, 20 bp, Artificial Sequence
  Synthetic oligonucleotide; GAG chr11 5206768 5206787 5206784 +
tctgttcaagaaaagaatgt

SEQ ID NO: 6565 - DNA, 20 bp, Artificial Sequence
  Synthetic oligonucleotide; AAG chr11 5206771 5206790 5206787 +
gttcaagaaaagaatgtgag

SEQ ID NO: 6566 - DNA, 20 bp, Artificial Sequence
  Synthetic oligonucleotide; TAG chr11 5206779 5206798 5206795 +
aaagaatgtgagaagtaaat

SEQ ID NO: 6567 - DNA, 20 bp, Artificial Sequence
  Synthetic oligonucleotide; CAG chr11 5206811 5206830 5206827 +
tttgcctacttcatccccaa

SEQ ID NO: 6568 - DNA, 20 bp, Artificial Sequence
  Synthetic oligonucleotide; GAG chr11 5206813 5206832 5206829 +
tgcctacttcatccccaaca

SEQ ID NO: 6569 - DNA, 20 bp, Artificial Sequence
  Synthetic oligonucleotide; AGG chr11 5206814 5206833 5206830 +
gcctacttcatccccaacag

SEQ ID NO: 6570 - DNA, 20 bp, Artificial Sequence
  Synthetic oligonucleotide; GAG chr11 5206816 5206835 5206832 +
ctacttcatccccaacagag

SEQ ID NO: 6571 - DNA, 20 bp, Artificial Sequence
  Synthetic oligonucleotide; TGG chr11 5206838 5206857 5206854 +
gatcatgactatatcaataa

SEQ ID NO: 6572 - DNA, 20 bp, Artificial Sequence
  Synthetic oligonucleotide; GAG chr11 5206840 5206859 5206856 +
tcatgactatatcaataatg

SEQ ID NO: 6573 - DNA, 20 bp, Artificial Sequence
  Synthetic oligonucleotide; TGG chr11 5206845 5206864 5206861 +
actatatcaataatggagcc

SEQ ID NO: 6574 - DNA, 20 bp, Artificial Sequence
  Synthetic oligonucleotide; GGG chr11 5206846 5206865 5206862 +
ctatatcaataatggagcct

SEQ ID NO: 6575 - DNA, 20 bp, Artificial Sequence
  Synthetic oligonucleotide; CAG chr11 5206851 5206870 5206867 +
tcaataatggagcctgggcc

SEQ ID NO: 6576 - DNA, 20 bp, Artificial Sequence
  Synthetic oligonucleotide; TGG chr11 5206859 5206878 5206875 +
ggagcctgggcccagacaac

SEQ ID NO: 6577 - DNA, 20 bp, Artificial Sequence
  Synthetic oligonucleotide; AAG chr11 5206864 5206883 5206880 +
ctgggcccagacaactggtt

SEQ ID NO: 6578 - DNA, 20 bp, Artificial Sequence
  Synthetic oligonucleotide; GAG chr11 5206866 5206885 5206882 +
gggcccagacaactggttaa

SEQ ID NO: 6579 - DNA, 20 bp, Artificial Sequence
  Synthetic oligonucleotide; GAG chr11 5206868 5206887 5206884 +
gcccagacaactggttaaga

SEQ ID NO: 6580 - DNA, 20 bp, Artificial Sequence
  Synthetic oligonucleotide; GAG chr11 5206870 5206889 5206886 +
ccagacaactggttaagaga

SEQ ID NO: 6581 - DNA, 20 bp, Artificial Sequence
  Synthetic oligonucleotide; AGG chr11 5206871 5206890 5206887 +
cagacaactggttaagagag

SEQ ID NO: 6582 - DNA, 20 bp, Artificial Sequence
  Synthetic oligonucleotide; CAG chr11 5206886 5206905 5206902 +
gagagaggtcattctgacct

SEQ ID NO: 6583 - DNA, 20 bp, Artificial Sequence
  Synthetic oligonucleotide; TAG chr11 5206893 5206912 5206909 +
gtcattctgacctcagaaca

SEQ ID NO: 6584 - DNA, 20 bp, Artificial Sequence
  Synthetic oligonucleotide; AGG chr11 5206894 5206913 5206910 +
tcattctgacctcagaacat

SEQ ID NO: 6585 - DNA, 20 bp, Artificial Sequence
  Synthetic oligonucleotide; GAG chr11 5206896 5206915 5206912 +
attctgacctcagaacatag

SEQ ID NO: 6586 - DNA, 20 bp, Artificial Sequence
  Synthetic oligonucleotide; GAG chr11 5206898 5206917 5206914 +
tctgacctcagaacatagga

SEQ ID NO: 6587 - DNA, 20 bp, Artificial Sequence
  Synthetic oligonucleotide; TGG chr11 5206902 5206921 5206918 +
acctcagaacataggagaga

SEQ ID NO: 6588 - DNA, 20 bp, Artificial Sequence
  Synthetic oligonucleotide; CAG chr11 5206918 5206937 5206934 +
gagatggatattgtacacca

SEQ ID NO: 6589 - DNA, 20 bp, Artificial Sequence
  Synthetic oligonucleotide; GAG chr11 5206920 5206939 5206936 +
gatggatattgtacaccaca

SEQ ID NO: 6590 - DNA, 20 bp, Artificial Sequence
  Synthetic oligonucleotide; CAG chr11 5206925 5206944 5206941 +
atattgtacaccacagagtc

SEQ ID NO: 6591 - DNA, 20 bp, Artificial Sequence
  Synthetic oligonucleotide; AGG chr11 5206926 5206945 5206942 +
tattgtacaccacagagtcc

SEQ ID NO: 6592 - DNA, 20 bp, Artificial Sequence
  Synthetic oligonucleotide; TAG chr11 5206934 5206953 5206950 +
accacagagtccaggatgac

SEQ ID NO: 6593 - DNA, 20 bp, Artificial Sequence
  Synthetic oligonucleotide; CAG chr11 5206937 5206956 5206953 +
acagagtccaggatgactag

SEQ ID NO: 6594 - DNA, 20 bp, Artificial Sequence
  Synthetic oligonucleotide; AAG chr11 5206942 5206961 5206958 +
gtccaggatgactagcagtg

SEQ ID NO: 6595 - DNA, 20 bp, Artificial Sequence
  Synthetic oligonucleotide; AGG chr11 5206943 5206962 5206959 +
tccaggatgactagcagtga

SEQ ID NO: 6596 - DNA, 20 bp, Artificial Sequence
  Synthetic oligonucleotide; TGG chr11 5206957 5206976 5206973 +
cagtgaaggattcaaatgcc

SEQ ID NO: 6597 - DNA, 20 bp, Artificial Sequence
  Synthetic oligonucleotide; CGG chr11 5206978 5206997 5206994 +
ggcgaaatctcctatacaac

SEQ ID NO: 6598 - DNA, 20 bp, Artificial Sequence
  Synthetic oligonucleotide; GAG chr11 5206980 5206999 5206996 +
cgaaatctcctatacaaccg

SEQ ID NO: 6599 - DNA, 20 bp, Artificial Sequence
  Synthetic oligonucleotide; GAG chr11 5206982 5207001 5206998 +
aaatctcctatacaaccgga

SEQ ID NO: 6600 - DNA, 20 bp, Artificial Sequence
  Synthetic oligonucleotide; AAG chr11 5206989 5207008 5207005 +
ctatacaaccggagagaccc

SEQ ID NO: 6601 - DNA, 20 bp, Artificial Sequence
  Synthetic oligonucleotide; AAG chr11 5206998 5207017 5207014 +
cggagagacccaagtcccca

SEQ ID NO: 6602 - DNA, 20 bp, Artificial Sequence
  Synthetic oligonucleotide; AAG chr11 5207003 5207022 5207019 +
agacccaagtccccaaagac

SEQ ID NO: 6603 - DNA, 20 bp, Artificial Sequence
  Synthetic oligonucleotide; AAG chr11 5207006 5207025 5207022 +
cccaagtccccaaagacaag

SEQ ID NO: 6604 - DNA, 20 bp, Artificial Sequence
  Synthetic oligonucleotide; AGG chr11 5207007 5207026 5207023 +
ccaagtccccaaagacaaga

SEQ ID NO: 6605 - DNA, 20 bp, Artificial Sequence
  Synthetic oligonucleotide; GGG chr11 5207008 5207027 5207024 +
caagtccccaaagacaagaa

SEQ ID NO: 6606 - DNA, 20 bp, Artificial Sequence
  Synthetic oligonucleotide; TGG chr11 5207020 5207039 5207036 +
gacaagaagggatgatgaaa

SEQ ID NO: 6607 - DNA, 20 bp, Artificial Sequence
  Synthetic oligonucleotide; GAG chr11 5207048 5207067 5207064 +
gcatgacatgacttgcctat

SEQ ID NO: 6608 - DNA, 20 bp, Artificial Sequence
  Synthetic oligonucleotide; AAG chr11 5207066 5207085 5207082 +
atgagccctcccattgctat

SEQ ID NO: 6609 - DNA, 20 bp, Artificial Sequence
  Synthetic oligonucleotide; AGG chr11 5207067 5207086 5207083 +
tgagccctcccattgctata

SEQ ID NO: 6610 - DNA, 20 bp, Artificial Sequence
  Synthetic oligonucleotide; TGG chr11 5207071 5207090 5207087 +
ccctcccattgctataagga

SEQ ID NO: 6611 - DNA, 20 bp, Artificial Sequence
  Synthetic oligonucleotide; GGG chr11 5207072 5207091 5207088 +
cctcccattgctataaggat

SEQ ID NO: 6612 - DNA, 20 bp, Artificial Sequence
  Synthetic oligonucleotide; GGG chr11 5207073 5207092 5207089 +
ctcccattgctataaggatg

SEQ ID NO: 6613 - DNA, 20 bp, Artificial Sequence
  Synthetic oligonucleotide; TAG chr11 5207080 5207099 5207096 +
tgctataaggatggggatct

SEQ ID NO: 6614 - DNA, 20 bp, Artificial Sequence
  Synthetic oligonucleotide; CAG chr11 5207085 5207104 5207101 +
taaggatggggatcttagca

SEQ ID NO: 6615 - DNA, 20 bp, Artificial Sequence
  Synthetic oligonucleotide; CAG chr11 5207101 5207120 5207117 +
agcacagtgccttgtgtgaa

SEQ ID NO: 6616 - DNA, 20 bp, Artificial Sequence
  Synthetic oligonucleotide; TAG chr11 5207110 5207129 5207126 +
ccttgtgtgaacagtaatgc

SEQ ID NO: 6617 - DNA, 20 bp, Artificial Sequence
  Synthetic oligonucleotide; TGG chr11 5207127 5207146 5207143 +
tgctagccttgattttacca

SEQ ID NO: 6618 - DNA, 20 bp, Artificial Sequence
  Synthetic oligonucleotide; AAG chr11 5207131 5207150 5207147 +
agccttgattttaccatggc

SEQ ID NO: 6619 - DNA, 20 bp, Artificial Sequence
  Synthetic oligonucleotide; TAG chr11 5207140 5207159 5207156 +
tttaccatggcaagtttgtt

SEQ ID NO: 6620 - DNA, 20 bp, Artificial Sequence
  Synthetic oligonucleotide; AGG chr11 5207141 5207160 5207157 +
ttaccatggcaagtttgttt

SEQ ID NO: 6621 - DNA, 20 bp, Artificial Sequence
  Synthetic oligonucleotide; GGG chr11 5207142 5207161 5207158 +
taccatggcaagtttgttta

SEQ ID NO: 6622 - DNA, 20 bp, Artificial Sequence
  Synthetic oligonucleotide; GAG chr11 5207187 5207206 5207203 +
aattccaacctcaaccaaat

SEQ ID NO: 6623 - DNA, 20 bp, Artificial Sequence
  Synthetic oligonucleotide; AGG chr11 5207188 5207207 5207204 +
attccaacctcaaccaaatg

SEQ ID NO: 6624 - DNA, 20 bp, Artificial Sequence
  Synthetic oligonucleotide; GGG chr11 5207189 5207208 5207205 +
ttccaacctcaaccaaatga

SEQ ID NO: 6625 - DNA, 20 bp, Artificial Sequence
  Synthetic oligonucleotide; TGG chr11 5207193 5207212 5207209 +
aacctcaaccaaatgaggga

SEQ ID NO: 6626 - DNA, 20 bp, Artificial Sequence
  Synthetic oligonucleotide; TGG chr11 5207197 5207216 5207213 +
tcaaccaaatgagggatggc

SEQ ID NO: 6627 - DNA, 20 bp, Artificial Sequence
  Synthetic oligonucleotide; GGG chr11 5207198 5207217 5207214 +
caaccaaatgagggatggct

SEQ ID NO: 6628 - DNA, 20 bp, Artificial Sequence
  Synthetic oligonucleotide; GGG chr11 5207199 5207218 5207215 +
aaccaaatgagggatggctg

SEQ ID NO: 6629 - DNA, 20 bp, Artificial Sequence
  Synthetic oligonucleotide; AAG chr11 5207213 5207232 5207229 +
tggctggggatgcaaccaca

SEQ ID NO: 6630 - DNA, 20 bp, Artificial Sequence
  Synthetic oligonucleotide; TAG chr11 5207227 5207246 5207243 +
accacaaagatactgtatct

SEQ ID NO: 6631 - DNA, 20 bp, Artificial Sequence
  Synthetic oligonucleotide; AGG chr11 5207228 5207247 5207244 +
ccacaaagatactgtatctt

SEQ ID NO: 6632 - DNA, 20 bp, Artificial Sequence
  Synthetic oligonucleotide; GAG chr11 5207230 5207249 5207246 +
acaaagatactgtatcttag

SEQ ID NO: 6633 - DNA, 20 bp, Artificial Sequence
  Synthetic oligonucleotide; AGG chr11 5207231 5207250 5207247 +
caaagatactgtatcttagg

SEQ ID NO: 6634 - DNA, 20 bp, Artificial Sequence
  Synthetic oligonucleotide; GGG chr11 5207232 5207251 5207248 +
aaagatactgtatcttagga

SEQ ID NO: 6635 - DNA, 20 bp, Artificial Sequence
  Synthetic oligonucleotide; GGG chr11 5207233 5207252 5207249 +
aagatactgtatcttaggag

SEQ ID NO: 6636 - DNA, 20 bp, Artificial Sequence
  Synthetic oligonucleotide; GAG chr11 5207235 5207254 5207251 +
gatactgtatcttaggaggg

SEQ ID NO: 6637 - DNA, 20 bp, Artificial Sequence
  Synthetic oligonucleotide; TAG chr11 5207251 5207270 5207267 +
aggggagtttttttttttta

SEQ ID NO: 6638 - DNA, 20 bp, Artificial Sequence
  Synthetic oligonucleotide; CAG chr11 5207262 5207281 5207278 +
ttttttttatagaaactcgt

SEQ ID NO: 6639 - DNA, 20 bp, Artificial Sequence
  Synthetic oligonucleotide; AGG chr11 5207263 5207282 5207279 +
tttttttatagaaactcgtc

SEQ ID NO: 6640 - DNA, 20 bp, Artificial Sequence
  Synthetic oligonucleotide; TAG chr11 5207276 5207295 5207292 +
actcgtcaggatattattgc

SEQ ID NO: 6641 - DNA, 20 bp, Artificial Sequence
  Synthetic oligonucleotide; AGG chr11 5207277 5207296 5207293 +
ctcgtcaggatattattgct

SEQ ID NO: 6642 - DNA, 20 bp, Artificial Sequence
  Synthetic oligonucleotide; TGG chr11 5207292 5207311 5207308 +
ttgctaggatgtgttgttac

SEQ ID NO: 6643 - DNA, 20 bp, Artificial Sequence
  Synthetic oligonucleotide; GGG chr11 5207293 5207312 5207309 +
tgctaggatgtgttgttact

SEQ ID NO: 6644 - DNA, 20 bp, Artificial Sequence
  Synthetic oligonucleotide; AAG chr11 5207300 5207319 5207316 +
atgtgttgttactgggaaaa

SEQ ID NO: 6645 - DNA, 20 bp, Artificial Sequence
  Synthetic oligonucleotide; TGG chr11 5207307 5207326 5207323 +
gttactgggaaaaaagctga

SEQ ID NO: 6646 - DNA, 20 bp, Artificial Sequence
  Synthetic oligonucleotide; AAG chr11 5207317 5207336 5207333 +
aaaaagctgatggaatacaa

SEQ ID NO: 6647 - DNA, 20 bp, Artificial Sequence
  Synthetic oligonucleotide; GAG chr11 5207319 5207338 5207335 +
aaagctgatggaatacaaaa

SEQ ID NO: 6648 - DNA, 20 bp, Artificial Sequence
  Synthetic oligonucleotide; TAG chr11 5207322 5207341 5207338 +
gctgatggaatacaaaagag

SEQ ID NO: 6649 - DNA, 20 bp, Artificial Sequence
  Synthetic oligonucleotide; CAG chr11 5207334 5207353 5207350 +
caaaagagtagacatcccca

SEQ ID NO: 6650 - DNA, 20 bp, Artificial Sequence
  Synthetic oligonucleotide; AGG chr11 5207335 5207354 5207351 +
aaaagagtagacatccccac

SEQ ID NO: 6651 - DNA, 20 bp, Artificial Sequence
  Synthetic oligonucleotide; GGG chr11 5207336 5207355 5207352 +
aaagagtagacatccccaca

SEQ ID NO: 6652 - DNA, 20 bp, Artificial Sequence
  Synthetic oligonucleotide; GAG chr11 5207346 5207365 5207362 +
catccccacagggattattt

SEQ ID NO: 6653 - DNA, 20 bp, Artificial Sequence
  Synthetic oligonucleotide; AGG chr11 5207347 5207366 5207363 +
atccccacagggattatttg

SEQ ID NO: 6654 - DNA, 20 bp, Artificial Sequence
  Synthetic oligonucleotide; CAG chr11 5207354 5207373 5207370 +
cagggattatttgaggcaat

SEQ ID NO: 6655 - DNA, 20 bp, Artificial Sequence
  Synthetic oligonucleotide; CAG chr11 5207388 5207407 5207404 +
accactttgctttctctatg

SEQ ID NO: 6656 - DNA, 20 bp, Artificial Sequence
  Synthetic oligonucleotide; AGG chr11 5207389 5207408 5207405 +
ccactttgctttctctatgc

SEQ ID NO: 6657 - DNA, 20 bp, Artificial Sequence
  Synthetic oligonucleotide; TAG chr11 5207409 5207428 5207425 +
aggtgtcatctattgtgata

SEQ ID NO: 6658 - DNA, 20 bp, Artificial Sequence
  Synthetic oligonucleotide; CAG chr11 5207415 5207434 5207431 +
catctattgtgatatagtgc

SEQ ID NO: 6659 - DNA, 20 bp, Artificial Sequence
  Synthetic oligonucleotide; AGG chr11 5207416 5207435 5207432 +
atctattgtgatatagtgcc

SEQ ID NO: 6660 - DNA, 20 bp, Artificial Sequence
  Synthetic oligonucleotide; GAG chr11 5207418 5207437 5207434 +
ctattgtgatatagtgccag

SEQ ID NO: 6661 - DNA, 20 bp, Artificial Sequence
  Synthetic oligonucleotide; AGG chr11 5207419 5207438 5207435 +
tattgtgatatagtgccagg

SEQ ID NO: 6662 - DNA, 20 bp, Artificial Sequence
  Synthetic oligonucleotide; TGG chr11 5207434 5207453 5207450 +
ccaggaggttgcctttgctg

SEQ ID NO: 6663 - DNA, 20 bp, Artificial Sequence
  Synthetic oligonucleotide; TAG chr11 5207447 5207466 5207463 +
tttgctgtggctttcgaccc

SEQ ID NO: 6664 - DNA, 20 bp, Artificial Sequence
  Synthetic oligonucleotide; TGG chr11 5207510 5207529 5207526 +
aataaaatgtccgtgtttat

SEQ ID NO: 6665 - DNA, 20 bp, Artificial Sequence
  Synthetic oligonucleotide; TAG chr11 5207535 5207554 5207551 +
attgttatattgtgaaattg

SEQ ID NO: 6666 - DNA, 20 bp, Artificial Sequence
  Synthetic oligonucleotide; TAG chr11 5207538 5207557 5207554 +
gttatattgtgaaattgtag

SEQ ID NO: 6667 - DNA, 20 bp, Artificial Sequence
  Synthetic oligonucleotide; TGG chr11 5207560 5207579 5207576 +
gatctaaaattgtaatttct

SEQ ID NO: 6668 - DNA, 20 bp, Artificial Sequence
  Synthetic oligonucleotide; TAG chr11 5207568 5207587 5207584 +
attgtaatttcttggattcc

SEQ ID NO: 6669 - DNA, 20 bp, Artificial Sequence
  Synthetic oligonucleotide; TGG chr11 5207585 5207604 5207601 +
tcctagaatttctaaatctg

SEQ ID NO: 6670 - DNA, 20 bp, Artificial Sequence
  Synthetic oligonucleotide; TAG chr11 5207593 5207612 5207609 +
tttctaaatctgtggatttt

SEQ ID NO: 6671 - DNA, 20 bp, Artificial Sequence
  Synthetic oligonucleotide; TAG chr11 5207603 5207622 5207619 +
tgtggatttttagaattctc

SEQ ID NO: 6672 - DNA, 20 bp, Artificial Sequence
  Synthetic oligonucleotide; GAG chr11 5207605 5207624 5207621 +
tggatttttagaattctcta

SEQ ID NO: 6673 - DNA, 20 bp, Artificial Sequence
  Synthetic oligonucleotide; AGG chr11 5207606 5207625 5207622 +
ggatttttagaattctctag

SEQ ID NO: 6674 - DNA, 20 bp, Artificial Sequence
  Synthetic oligonucleotide; AAG chr11 5207614 5207633 5207630 +
agaattctctagaggtgaca

SEQ ID NO: 6675 - DNA, 20 bp, Artificial Sequence
  Synthetic oligonucleotide; AGG chr11 5207615 5207634 5207631 +
gaattctctagaggtgacaa

SEQ ID NO: 6676 - DNA, 20 bp, Artificial Sequence
  Synthetic oligonucleotide; AAG chr11 5207628 5207647 5207644 +
gtgacaaaggtttattatct

SEQ ID NO: 6677 - DNA, 20 bp, Artificial Sequence
  Synthetic oligonucleotide; CGG chr11 5207635 5207654 5207651 +
aggtttattatctaagctac

SEQ ID NO: 6678 - DNA, 20 bp, Artificial Sequence
  Synthetic oligonucleotide; GAG chr11 5207637 5207656 5207653 +
gtttattatctaagctaccg

SEQ ID NO: 6679 - DNA, 20 bp, Artificial Sequence
  Synthetic oligonucleotide; TGG chr11 5207651 5207670 5207667 +
ctaccggagctatgtacttt

SEQ ID NO: 6680 - DNA, 20 bp, Artificial Sequence
  Synthetic oligonucleotide; AAG chr11 5207658 5207677 5207674 +
agctatgtacttttggatat

SEQ ID NO: 6681 - DNA, 20 bp, Artificial Sequence
  Synthetic oligonucleotide; GAG chr11 5207660 5207679 5207676 +
ctatgtacttttggatataa

SEQ ID NO: 6682 - DNA, 20 bp, Artificial Sequence
  Synthetic oligonucleotide; CAG chr11 5207690 5207709 5207706 +
atctccattgccttacaaat

SEQ ID NO: 6683 - DNA, 20 bp, Artificial Sequence
  Synthetic oligonucleotide; AGG chr11 5207691 5207710 5207707 +
tctccattgccttacaaatc

SEQ ID NO: 6684 - DNA, 20 bp, Artificial Sequence
  Synthetic oligonucleotide; GAG chr11 5207697 5207716 5207713 +
ttgccttacaaatcaggtgt

SEQ ID NO: 6685 - DNA, 20 bp, Artificial Sequence
  Synthetic oligonucleotide; CAG chr11 5207701 5207720 5207717 +
cttacaaatcaggtgtgagc

SEQ ID NO: 6686 - DNA, 20 bp, Artificial Sequence
  Synthetic oligonucleotide; AGG chr11 5207702 5207721 5207718 +
ttacaaatcaggtgtgagcc

SEQ ID NO: 6687 - DNA, 20 bp, Artificial Sequence
  Synthetic oligonucleotide; CAG chr11 5207714 5207733 5207730 +
tgtgagccaggcatgtctct

SEQ ID NO: 6688 - DNA, 20 bp, Artificial Sequence
  Synthetic oligonucleotide; TGG chr11 5207719 5207738 5207735 +
gccaggcatgtctctcagac

SEQ ID NO: 6689 - DNA, 20 bp, Artificial Sequence
  Synthetic oligonucleotide; AAG chr11 5207724 5207743 5207740 +
gcatgtctctcagactggaa

SEQ ID NO: 6690 - DNA, 20 bp, Artificial Sequence
  Synthetic oligonucleotide; AGG chr11 5207725 5207744 5207741 +
catgtctctcagactggaaa

SEQ ID NO: 6691 - DNA, 20 bp, Artificial Sequence
  Synthetic oligonucleotide; CAG chr11 5207736 5207755 5207752 +
gactggaaaaggtaactaat

SEQ ID NO: 6692 - DNA, 20 bp, Artificial Sequence
  Synthetic oligonucleotide; AAG chr11 5207739 5207758 5207755 +
tggaaaaggtaactaatcag

SEQ ID NO: 6693 - DNA, 20 bp, Artificial Sequence
  Synthetic oligonucleotide; AGG chr11 5207740 5207759 5207756 +
ggaaaaggtaactaatcaga

SEQ ID NO: 6694 - DNA, 20 bp, Artificial Sequence
  Synthetic oligonucleotide; TAG chr11 5207754 5207773 5207770 +
atcagaaggaaccattgtcc

SEQ ID NO: 6695 - DNA, 20 bp, Artificial Sequence
  Synthetic oligonucleotide; TGG chr11 5207759 5207778 5207775 +
aaggaaccattgtcctagaa

SEQ ID NO: 6696 - DNA, 20 bp, Artificial Sequence
  Synthetic oligonucleotide; GGG chr11 5207760 5207779 5207776 +
aggaaccattgtcctagaat

SEQ ID NO: 6697 - DNA, 20 bp, Artificial Sequence
  Synthetic oligonucleotide; GGG chr11 5207761 5207780 5207777 +
ggaaccattgtcctagaatg

SEQ ID NO: 6698 - DNA, 20 bp, Artificial Sequence
  Synthetic oligonucleotide; AAG chr11 5207765 5207784 5207781 +
ccattgtcctagaatggggc

SEQ ID NO: 6699 - DNA, 20 bp, Artificial Sequence
  Synthetic oligonucleotide; CAG chr11 5207779 5207798 5207795 +
tggggcaagtgtacaatacc

SEQ ID NO: 6700 - DNA, 20 bp, Artificial Sequence
  Synthetic oligonucleotide; AAG chr11 5207783 5207802 5207799 +
gcaagtgtacaatacccaga

SEQ ID NO: 6701 - DNA, 20 bp, Artificial Sequence
  Synthetic oligonucleotide; TGG chr11 5207791 5207810 5207807 +
acaatacccagaaagaccac

SEQ ID NO: 6702 - DNA, 20 bp, Artificial Sequence
  Synthetic oligonucleotide; TAG chr11 5207799 5207818 5207815 +
cagaaagaccactggtgccg

SEQ ID NO: 6703 - DNA, 20 bp, Artificial Sequence
  Synthetic oligonucleotide; TAG chr11 5207877 5207896 5207893 +
tatttattttatttatttat

SEQ ID NO: 6704 - DNA, 20 bp, Artificial Sequence
  Synthetic oligonucleotide; GAG chr11 5207879 5207898 5207895 +
tttattttatttatttatta

SEQ ID NO: 6705 - DNA, 20 bp, Artificial Sequence
  Synthetic oligonucleotide; TAG chr11 5207886 5207905 5207902 +
tatttatttattagagatca

SEQ ID NO: 6706 - DNA, 20 bp, Artificial Sequence
  Synthetic oligonucleotide; CAG chr11 5207908 5207927 5207924 +
gtgtgtgcaacacctatgtc

SEQ ID NO: 6707 - DNA, 20 bp, Artificial Sequence
  Synthetic oligonucleotide; AGG chr11 5207909 5207928 5207925 +
tgtgtgcaacacctatgtcc

SEQ ID NO: 6708 - DNA, 20 bp, Artificial Sequence
  Synthetic oligonucleotide; TGG chr11 5207917 5207936 5207933 +
acacctatgtccaggttctg

SEQ ID NO: 6709 - DNA, 20 bp, Artificial Sequence
  Synthetic oligonucleotide; CAG chr11 5207927 5207946 5207943 +
ccaggttctgtggtaaacgt

SEQ ID NO: 6710 - DNA, 20 bp, Artificial Sequence
  Synthetic oligonucleotide; TGG chr11 5207932 5207951 5207948 +
ttctgtggtaaacgtcagcg

SEQ ID NO: 6711 - DNA, 20 bp, Artificial Sequence
  Synthetic oligonucleotide; GAG chr11 5207934 5207953 5207950 +
ctgtggtaaacgtcagcgtg

SEQ ID NO: 6712 - DNA, 20 bp, Artificial Sequence
  Synthetic oligonucleotide; TAG chr11 5207941 5207960 5207957 +
aaacgtcagcgtggagaaat

SEQ ID NO: 6713 - DNA, 20 bp, Artificial Sequence
  Synthetic oligonucleotide; TAG chr11 5207944 5207963 5207960 +
cgtcagcgtggagaaattag

SEQ ID NO: 6714 - DNA, 20 bp, Artificial Sequence
  Synthetic oligonucleotide; TAG chr11 5207951 5207970 5207967 +
gtggagaaattagtagctat

SEQ ID NO: 6715 - DNA, 20 bp, Artificial Sequence
  Synthetic oligonucleotide; AAG chr11 5207962 5207981 5207978 +
agtagctattagatcataaa

SEQ ID NO: 6716 - DNA, 20 bp, Artificial Sequence
  Synthetic oligonucleotide; AGG chr11 5207963 5207982 5207979 +
gtagctattagatcataaaa

SEQ ID NO: 6717 - DNA, 20 bp, Artificial Sequence
  Synthetic oligonucleotide; GAG chr11 5207967 5207986 5207983 +
ctattagatcataaaaaggt

SEQ ID NO: 6718 - DNA, 20 bp, Artificial Sequence
  Synthetic oligonucleotide; AGG chr11 5207968 5207987 5207984 +
tattagatcataaaaaggtg

SEQ ID NO: 6719 - DNA, 20 bp, Artificial Sequence
  Synthetic oligonucleotide; GAG chr11 5207990 5208009 5208006 +
gcataatcatatttgtcttt

SEQ ID NO: 6720 - DNA, 20 bp, Artificial Sequence
  Synthetic oligonucleotide; AAG chr11 5207993 5208012 5208009 +
taatcatatttgtctttgag

SEQ ID NO: 6721 - DNA, 20 bp, Artificial Sequence
  Synthetic oligonucleotide; TGG chr11 5208003 5208022 5208019 +
tgtctttgagaagctgactg

SEQ ID NO: 6722 - DNA, 20 bp, Artificial Sequence
  Synthetic oligonucleotide; TAG chr11 5208009 5208028 5208025 +
tgagaagctgactgtggcta

SEQ ID NO: 6723 - DNA, 20 bp, Artificial Sequence
  Synthetic oligonucleotide; AGG chr11 5208010 5208029 5208026 +
gagaagctgactgtggctat

SEQ ID NO: 6724 - DNA, 20 bp, Artificial Sequence
  Synthetic oligonucleotide; AAG chr11 5208015 5208034 5208031 +
gctgactgtggctataggtg

SEQ ID NO: 6725 - DNA, 20 bp, Artificial Sequence
  Synthetic oligonucleotide; TAG chr11 5208034 5208053 5208050 +
gaagaaaaaaattataattt

SEQ ID NO: 6726 - DNA, 20 bp, Artificial Sequence
  Synthetic oligonucleotide; AAG chr11 5208073 5208092 5208089 +
accatgatcatcatgataaa

SEQ ID NO: 6727 - DNA, 20 bp, Artificial Sequence
  Synthetic oligonucleotide; TGG chr11 5208087 5208106 5208103 +
gataaaaagttaatatttac

SEQ ID NO: 6728 - DNA, 20 bp, Artificial Sequence
  Synthetic oligonucleotide; GGG chr11 5208088 5208107 5208104 +
ataaaaagttaatatttact

SEQ ID NO: 6729 - DNA, 20 bp, Artificial Sequence
  Synthetic oligonucleotide; TGG chr11 5208099 5208118 5208115 +
atatttactgggaacttatt

SEQ ID NO: 6730 - DNA, 20 bp, Artificial Sequence
  Synthetic oligonucleotide; AAG chr11 5208116 5208135 5208132 +
atttggtttgtcatttttcg

SEQ ID NO: 6731 - DNA, 20 bp, Artificial Sequence
  Synthetic oligonucleotide; AGG chr11 5208117 5208136 5208133 +
tttggtttgtcatttttcga

SEQ ID NO: 6732 - DNA, 20 bp, Artificial Sequence
  Synthetic oligonucleotide; AAG chr11 5208144 5208163 5208160 +
tatgttaatttactcactat

SEQ ID NO: 6733 - DNA, 20 bp, Artificial Sequence
  Synthetic oligonucleotide; AAG chr11 5208156 5208175 5208172 +
ctcactataagaaatttata

SEQ ID NO: 6734 - DNA, 20 bp, Artificial Sequence
  Synthetic oligonucleotide; TAG chr11 5208159 5208178 5208175 +
actataagaaatttataaag

SEQ ID NO: 6735 - DNA, 20 bp, Artificial Sequence
  Synthetic oligonucleotide; TAG chr11 5208171 5208190 5208187 +
ttataaagtagattccatta

SEQ ID NO: 6736 - DNA, 20 bp, Artificial Sequence
  Synthetic oligonucleotide; GAG chr11 5208190 5208209 5208206 +
atagctcttaatttattatt

SEQ ID NO: 6737 - DNA, 20 bp, Artificial Sequence
  Synthetic oligonucleotide; AGG chr11 5208191 5208210 5208207 +
tagctcttaatttattattg

SEQ ID NO: 6738 - DNA, 20 bp, Artificial Sequence
  Synthetic oligonucleotide; AAG chr11 5208199 5208218 5208215 +
aatttattattgaggaatgt

SEQ ID NO: 6739 - DNA, 20 bp, Artificial Sequence
  Synthetic oligonucleotide; AGG chr11 5208200 5208219 5208216 +
atttattattgaggaatgta

SEQ ID NO: 6740 - DNA, 20 bp, Artificial Sequence
  Synthetic oligonucleotide; TAG chr11 5208205 5208224 5208221 +
ttattgaggaatgtaaggca

SEQ ID NO: 6741 - DNA, 20 bp, Artificial Sequence
  Synthetic oligonucleotide; GAG chr11 5208207 5208226 5208223 +
attgaggaatgtaaggcata

SEQ ID NO: 6742 - DNA, 20 bp, Artificial Sequence
  Synthetic oligonucleotide; AAG chr11 5208210 5208229 5208226 +
gaggaatgtaaggcatagag

SEQ ID NO: 6743 - DNA, 20 bp, Artificial Sequence
  Synthetic oligonucleotide; AAG chr11 5208231 5208250 5208247 +
agtaacttatcctcaaaaca

SEQ ID NO: 6744 - DNA, 20 bp, Artificial Sequence
  Synthetic oligonucleotide; TGG chr11 5208245 5208264 5208261 +
aaaacaaagctattaactta

SEQ ID NO: 6745 - DNA, 20 bp, Artificial Sequence
  Synthetic oligonucleotide; GAG chr11 5208252 5208271 5208268 +
agctattaacttatggacct

SEQ ID NO: 6746 - DNA, 20 bp, Artificial Sequence
  Synthetic oligonucleotide; GAG chr11 5208254 5208273 5208270 +
ctattaacttatggacctga

SEQ ID NO: 6747 - DNA, 20 bp, Artificial Sequence
  Synthetic oligonucleotide; TAG chr11 5208257 5208276 5208273 +
ttaacttatggacctgagag

SEQ ID NO: 6748 - DNA, 20 bp, Artificial Sequence
  Synthetic oligonucleotide; GAG chr11 5208259 5208278 5208275 +
aacttatggacctgagagta

SEQ ID NO: 6749 - DNA, 20 bp, Artificial Sequence
  Synthetic oligonucleotide; CGG chr11 5208264 5208283 5208280 +
atggacctgagagtagagcc

SEQ ID NO: 6750 - DNA, 20 bp, Artificial Sequence
  Synthetic oligonucleotide; GGG chr11 5208265 5208284 5208281 +
tggacctgagagtagagccc

SEQ ID NO: 6751 - DNA, 20 bp, Artificial Sequence
  Synthetic oligonucleotide; CAG chr11 5208279 5208298 5208295 +
gagcccgggctgtctcatgc

SEQ ID NO: 6752 - DNA, 20 bp, Artificial Sequence
  Synthetic oligonucleotide; AAG chr11 5208302 5208321 5208318 +
aacctattatcccatgttgc

SEQ ID NO: 6753 - DNA, 20 bp, Artificial Sequence
  Synthetic oligonucleotide; TAG chr11 5208312 5208331 5208328 +
cccatgttgcaagacacaaa

SEQ ID NO: 6754 - DNA, 20 bp, Artificial Sequence
  Synthetic oligonucleotide; AGG chr11 5208313 5208332 5208329 +
ccatgttgcaagacacaaat

SEQ ID NO: 6755 - DNA, 20 bp, Artificial Sequence
  Synthetic oligonucleotide; TAG chr11 5208320 5208339 5208336 +
gcaagacacaaataggaaaa

SEQ ID NO: 6756 - DNA, 20 bp, Artificial Sequence
  Synthetic oligonucleotide; CGG chr11 5208326 5208345 5208342 +
cacaaataggaaaatagaac

SEQ ID NO: 6757 - DNA, 20 bp, Artificial Sequence
  Synthetic oligonucleotide; TAG chr11 5208330 5208349 5208346 +
aataggaaaatagaaccggt

SEQ ID NO: 6758 - DNA, 20 bp, Artificial Sequence
  Synthetic oligonucleotide; AAG chr11 5208333 5208352 5208349 +
aggaaaatagaaccggttag

SEQ ID NO: 6759 - DNA, 20 bp, Artificial Sequence
  Synthetic oligonucleotide; AAG chr11 5208342 5208361 5208358 +
gaaccggttagaagttattg

SEQ ID NO: 6760 - DNA, 20 bp, Artificial Sequence
  Synthetic oligonucleotide; AGG chr11 5208343 5208362 5208359 +
aaccggttagaagttattga

SEQ ID NO: 6761 - DNA, 20 bp, Artificial Sequence
  Synthetic oligonucleotide; GGG chr11 5208344 5208363 5208360 +
accggttagaagttattgaa

SEQ ID NO: 6762 - DNA, 20 bp, Artificial Sequence
  Synthetic oligonucleotide; TAG chr11 5208357 5208376 5208373 +
tattgaagggcatgaaataa

SEQ ID NO: 6763 - DNA, 20 bp, Artificial Sequence
  Synthetic oligonucleotide; TGG chr11 5208360 5208379 5208376 +
tgaagggcatgaaataatag

SEQ ID NO: 6764 - DNA, 20 bp, Artificial Sequence
  Synthetic oligonucleotide; GAG chr11 5208373 5208392 5208389 +
ataatagtggtttgaaattt

SEQ ID NO: 6765 - DNA, 20 bp, Artificial Sequence
  Synthetic oligonucleotide; TAG chr11 5208376 5208395 5208392 +
atagtggtttgaaatttgag

SEQ ID NO: 6766 - DNA, 20 bp, Artificial Sequence
  Synthetic oligonucleotide; GAG chr11 5208378 5208397 5208394 +
agtggtttgaaatttgagta

SEQ ID NO: 6767 - DNA, 20 bp, Artificial Sequence
  Synthetic oligonucleotide; TAG chr11 5208381 5208400 5208397 +
ggtttgaaatttgagtagag

SEQ ID NO: 6768 - DNA, 20 bp, Artificial Sequence
  Synthetic oligonucleotide; AGG chr11 5208382 5208401 5208398 +
gtttgaaatttgagtagagt

SEQ ID NO: 6769 - DNA, 20 bp, Artificial Sequence
  Synthetic oligonucleotide; AAG chr11 5208388 5208407 5208404 +
aatttgagtagagtaggacc

SEQ ID NO: 6770 - DNA, 20 bp, Artificial Sequence
  Synthetic oligonucleotide; CAG chr11 5208404 5208423 5208420 +
gaccaagaaaatgcatattt

SEQ ID NO: 6771 - DNA, 20 bp, Artificial Sequence
  Synthetic oligonucleotide; AGG chr11 5208405 5208424 5208421 +
accaagaaaatgcatatttc

SEQ ID NO: 6772 - DNA, 20 bp, Artificial Sequence
  Synthetic oligonucleotide; GGG chr11 5208406 5208425 5208422 +
ccaagaaaatgcatatttca

SEQ ID NO: 6773 - DNA, 20 bp, Artificial Sequence
  Synthetic oligonucleotide; GAG chr11 5208416 5208435 5208432 +
gcatatttcagggaatacct

SEQ ID NO: 6774 - DNA, 20 bp, Artificial Sequence
  Synthetic oligonucleotide; GAG chr11 5208418 5208437 5208434 +
atatttcagggaatacctga

SEQ ID NO: 6775 - DNA, 20 bp, Artificial Sequence
  Synthetic oligonucleotide; AGG chr11 5208419 5208438 5208435 +
tatttcagggaatacctgag

SEQ ID NO: 6776 - DNA, 20 bp, Artificial Sequence
  Synthetic oligonucleotide; AAG chr11 5208438 5208457 5208454 +
gaggaaaaaaaaaaactatg

SEQ ID NO: 6777 - DNA, 20 bp, Artificial Sequence
  Synthetic oligonucleotide; AGG chr11 5208439 5208458 5208455 +
aggaaaaaaaaaaactatga

SEQ ID NO: 6778 - DNA, 20 bp, Artificial Sequence
  Synthetic oligonucleotide; CAG chr11 5208446 5208465 5208462 +
aaaaaaactatgaaggaacg

SEQ ID NO: 6779 - DNA, 20 bp, Artificial Sequence
  Synthetic oligonucleotide; TAG chr11 5208453 5208472 5208469 +
ctatgaaggaacgcagtaat

SEQ ID NO: 6780 - DNA, 20 bp, Artificial Sequence
  Synthetic oligonucleotide; TAG chr11 5208461 5208480 5208477 +
gaacgcagtaattagctcct

SEQ ID NO: 6781 - DNA, 20 bp, Artificial Sequence
  Synthetic oligonucleotide; AAG chr11 5208468 5208487 5208484 +
gtaattagctccttagctga

SEQ ID NO: 6782 - DNA, 20 bp, Artificial Sequence
  Synthetic oligonucleotide; TGG chr11 5208481 5208500 5208497 +
tagctgaaagaatgatcttc

SEQ ID NO: 6783 - DNA, 20 bp, Artificial Sequence
  Synthetic oligonucleotide; CAG chr11 5208485 5208504 5208501 +
tgaaagaatgatcttctggt

SEQ ID NO: 6784 - DNA, 20 bp, Artificial Sequence
  Synthetic oligonucleotide; GAG chr11 5208489 5208508 5208505 +
agaatgatcttctggtcagt

SEQ ID NO: 6785 - DNA, 20 bp, Artificial Sequence
  Synthetic oligonucleotide; TGG chr11 5208495 5208514 5208511 +
atcttctggtcagtgagaac

SEQ ID NO: 6786 - DNA, 20 bp, Artificial Sequence
  Synthetic oligonucleotide; TGG chr11 5208508 5208527 5208524 +
tgagaactggtttcaaatct

SEQ ID NO: 6787 - DNA, 20 bp, Artificial Sequence
  Synthetic oligonucleotide; TAG chr11 5208524 5208543 5208540 +
atcttggttttgtcatttct

SEQ ID NO: 6788 - DNA, 20 bp, Artificial Sequence
  Synthetic oligonucleotide; AGG chr11 5208525 5208544 5208541 +
tcttggttttgtcatttctt

SEQ ID NO: 6789 - DNA, 20 bp, Artificial Sequence
  Synthetic oligonucleotide; TAG chr11 5208539 5208558 5208555 +
tttcttaggtatataatttt

SEQ ID NO: 6790 - DNA, 20 bp, Artificial Sequence
  Synthetic oligonucleotide; TAG chr11 5208551 5208570 5208567 +
ataatttttagctcaacact

SEQ ID NO: 6791 - DNA, 20 bp, Artificial Sequence
  Synthetic oligonucleotide; TGG chr11 5208578 5208597 5208594 +
acaatttttaaaaatattgt

SEQ ID NO: 6792 - DNA, 20 bp, Artificial Sequence
  Synthetic oligonucleotide; CGG chr11 5208602 5208621 5208618 +
atgatgataatatataaaaa

SEQ ID NO: 6793 - DNA, 20 bp, Artificial Sequence
  Synthetic oligonucleotide; AAG chr11 5208624 5208643 5208640 +
gctcattatctgccactcaa

SEQ ID NO: 6794 - DNA, 20 bp, Artificial Sequence
  Synthetic oligonucleotide; CAG chr11 5208631 5208650 5208647 +
atctgccactcaaaagctat

SEQ ID NO: 6795 - DNA, 20 bp, Artificial Sequence
  Synthetic oligonucleotide; TAG chr11 5208652 5208671 5208668 +
agtatttatgataataattc

SEQ ID NO: 6796 - DNA, 20 bp, Artificial Sequence
  Synthetic oligonucleotide; GAG chr11 5208659 5208678 5208675 +
atgataataattctagttgt

SEQ ID NO: 6797 - DNA, 20 bp, Artificial Sequence
  Synthetic oligonucleotide; AAG chr11 5208684 5208703 5208700 +
attgattattaaatatatat

SEQ ID NO: 6798 - DNA, 20 bp, Artificial Sequence
  Synthetic oligonucleotide; AGG chr11 5208685 5208704 5208701 +
ttgattattaaatatatata

SEQ ID NO: 6799 - DNA, 20 bp, Artificial Sequence
  Synthetic oligonucleotide; GGG chr11 5208686 5208705 5208702 +
tgattattaaatatatataa

SEQ ID NO: 6800 - DNA, 20 bp, Artificial Sequence
  Synthetic oligonucleotide; TAG chr11 5208690 5208709 5208706 +
tattaaatatatataaggga

SEQ ID NO: 6801 - DNA, 20 bp, Artificial Sequence
  Synthetic oligonucleotide; AAG chr11 5208693 5208712 5208709 +
taaatatatataagggatag

SEQ ID NO: 6802 - DNA, 20 bp, Artificial Sequence
  Synthetic oligonucleotide; GAG chr11 5208695 5208714 5208711 +
aatatatataagggatagaa

SEQ ID NO: 6803 - DNA, 20 bp, Artificial Sequence
  Synthetic oligonucleotide; GAG chr11 5208697 5208716 5208713 +
tatatataagggatagaaga

SEQ ID NO: 6804 - DNA, 20 bp, Artificial Sequence
  Synthetic oligonucleotide; TGG chr11 5208700 5208719 5208716 +
atataagggatagaagagag

SEQ ID NO: 6805 - DNA, 20 bp, Artificial Sequence
  Synthetic oligonucleotide; GAG chr11 5208702 5208721 5208718 +
ataagggatagaagagagtg

SEQ ID NO: 6806 - DNA, 20 bp, Artificial Sequence
  Synthetic oligonucleotide; GAG chr11 5208704 5208723 5208720 +
aagggatagaagagagtgga

SEQ ID NO: 6807 - DNA, 20 bp, Artificial Sequence
  Synthetic oligonucleotide; AAG chr11 5208709 5208728 5208725 +
atagaagagagtggagagta

SEQ ID NO: 6808 - DNA, 20 bp, Artificial Sequence
  Synthetic oligonucleotide; AGG chr11 5208710 5208729 5208726 +
tagaagagagtggagagtaa

SEQ ID NO: 6809 - DNA, 20 bp, Artificial Sequence
  Synthetic oligonucleotide; TGG chr11 5208739 5208758 5208755 +
tgattgacaaaattttgtct

SEQ ID NO: 6810 - DNA, 20 bp, Artificial Sequence
  Synthetic oligonucleotide; GAG chr11 5208748 5208767 5208764 +
aaattttgtcttggaaatct

SEQ ID NO: 6811 - DNA, 20 bp, Artificial Sequence
  Synthetic oligonucleotide; AAG chr11 5208764 5208783 5208780 +
atctgagtgaaccattcatc

SEQ ID NO: 6812 - DNA, 20 bp, Artificial Sequence
  Synthetic oligonucleotide; TGG chr11 5208769 5208788 5208785 +
agtgaaccattcatcaagtt

SEQ ID NO: 6813 - DNA, 20 bp, Artificial Sequence
  Synthetic oligonucleotide; AAG chr11 5208772 5208791 5208788 +
gaaccattcatcaagtttgg

SEQ ID NO: 6814 - DNA, 20 bp, Artificial Sequence
  Synthetic oligonucleotide; TAG chr11 5208778 5208797 5208794 +
ttcatcaagtttggaagcat

SEQ ID NO: 6815 - DNA, 20 bp, Artificial Sequence
  Synthetic oligonucleotide; GAG chr11 5208780 5208799 5208796 +
catcaagtttggaagcatta

SEQ ID NO: 6816 - DNA, 20 bp, Artificial Sequence
  Synthetic oligonucleotide; AGG chr11 5208781 5208800 5208797 +
atcaagtttggaagcattag

SEQ ID NO: 6817 - DNA, 20 bp, Artificial Sequence
  Synthetic oligonucleotide; AAG chr11 5208791 5208810 5208807 +
gaagcattagaggaaactga

SEQ ID NO: 6818 - DNA, 20 bp, Artificial Sequence
  Synthetic oligonucleotide; AAG chr11 5208794 5208813 5208810 +
gcattagaggaaactgaaag

SEQ ID NO: 6819 - DNA, 20 bp, Artificial Sequence
  Synthetic oligonucleotide; TGG chr11 5208797 5208816 5208813 +
ttagaggaaactgaaagaag

SEQ ID NO: 6820 - DNA, 20 bp, Artificial Sequence
  Synthetic oligonucleotide; GAG chr11 5208799 5208818 5208815 +
agaggaaactgaaagaagtg

SEQ ID NO: 6821 - DNA, 20 bp, Artificial Sequence
  Synthetic oligonucleotide; AGG chr11 5208800 5208819 5208816 +
gaggaaactgaaagaagtgg

SEQ ID NO: 6822 - DNA, 20 bp, Artificial Sequence
  Synthetic oligonucleotide; GAG chr11 5208829 5208848 5208845 +
tactatcttttcaactcgct

SEQ ID NO: 6823 - DNA, 20 bp, Artificial Sequence
  Synthetic oligonucleotide; AAG chr11 5208835 5208854 5208851 +
cttttcaactcgctgagttt

SEQ ID NO: 6824 - DNA, 20 bp, Artificial Sequence
  Synthetic oligonucleotide; GAG chr11 5208837 5208856 5208853 +
tttcaactcgctgagtttaa

SEQ ID NO: 6825 - DNA, 20 bp, Artificial Sequence
  Synthetic oligonucleotide; AGG chr11 5208838 5208857 5208854 +
ttcaactcgctgagtttaag

SEQ ID NO: 6826 - DNA, 20 bp, Artificial Sequence
  Synthetic oligonucleotide; TAG chr11 5208845 5208864 5208861 +
cgctgagtttaagaggtcca

SEQ ID NO: 6827 - DNA, 20 bp, Artificial Sequence
  Synthetic oligonucleotide; AGG chr11 5208846 5208865 5208862 +
gctgagtttaagaggtccat

SEQ ID NO: 6828 - DNA, 20 bp, Artificial Sequence
  Synthetic oligonucleotide; AAG chr11 5208855 5208874 5208871 +
aagaggtccataggtcatat

SEQ ID NO: 6829 - DNA, 20 bp, Artificial Sequence
  Synthetic oligonucleotide; TGG chr11 5208858 5208877 5208874 +
aggtccataggtcatataag

SEQ ID NO: 6830 - DNA, 20 bp, Artificial Sequence
  Synthetic oligonucleotide; GAG chr11 5208860 5208879 5208876 +
gtccataggtcatataagtg

SEQ ID NO: 6831 - DNA, 20 bp, Artificial Sequence
  Synthetic oligonucleotide; AGG chr11 5208861 5208880 5208877 +
tccataggtcatataagtgg

SEQ ID NO: 6832 - DNA, 20 bp, Artificial Sequence
  Synthetic oligonucleotide; AAG chr11 5208872 5208891 5208888 +
tataagtggaggtgacctgt

SEQ ID NO: 6833 - DNA, 20 bp, Artificial Sequence
  Synthetic oligonucleotide; CAG chr11 5208924 5208943 5208940 +
aaatgttaatgtatccctaa

SEQ ID NO: 6834 - DNA, 20 bp, Artificial Sequence
  Synthetic oligonucleotide; GAG chr11 5208926 5208945 5208942 +
atgttaatgtatccctaaca

SEQ ID NO: 6835 - DNA, 20 bp, Artificial Sequence
  Synthetic oligonucleotide; GAG chr11 5208928 5208947 5208944 +
gttaatgtatccctaacaga

SEQ ID NO: 6836 - DNA, 20 bp, Artificial Sequence
  Synthetic oligonucleotide; AAG chr11 5208936 5208955 5208952 +
atccctaacagagagcaatg

SEQ ID NO: 6837 - DNA, 20 bp, Artificial Sequence
  Synthetic oligonucleotide; TAG chr11 5208946 5208965 5208962 +
gagagcaatgaagttctttt

SEQ ID NO: 6838 - DNA, 20 bp, Artificial Sequence
  Synthetic oligonucleotide; TGG chr11 5208949 5208968 5208965 +
agcaatgaagttctttttag

SEQ ID NO: 6839 - DNA, 20 bp, Artificial Sequence
  Synthetic oligonucleotide; GAG chr11 5208951 5208970 5208967 +
caatgaagttctttttagtg

SEQ ID NO: 6840 - DNA, 20 bp, Artificial Sequence
  Synthetic oligonucleotide; TAG chr11 5208970 5208989 5208986 +
ggagtttctctttcttgaca

SEQ ID NO: 6841 - DNA, 20 bp, Artificial Sequence
  Synthetic oligonucleotide; TAG chr11 5208980 5208999 5208996 +
tttcttgacatagtaccatg

SEQ ID NO: 6842 - DNA, 20 bp, Artificial Sequence
  Synthetic oligonucleotide; AAG chr11 5208985 5209004 5209001 +
tgacatagtaccatgtagtg

SEQ ID NO: 6843 - DNA, 20 bp, Artificial Sequence
  Synthetic oligonucleotide; TGG chr11 5209001 5209020 5209017 +
agtgaagacactgctgactt

SEQ ID NO: 6844 - DNA, 20 bp, Artificial Sequence
  Synthetic oligonucleotide; AAG chr11 5209010 5209029 5209026 +
actgctgactttggaattga

SEQ ID NO: 6845 - DNA, 20 bp, Artificial Sequence
  Synthetic oligonucleotide; TAG chr11 5209018 5209037 5209034 +
ctttggaattgaaagaatct

SEQ ID NO: 6846 - DNA, 20 bp, Artificial Sequence
  Synthetic oligonucleotide; CAG chr11 5209023 5209042 5209039 +
gaattgaaagaatcttagct

SEQ ID NO: 6847 - DNA, 20 bp, Artificial Sequence
  Synthetic oligonucleotide; TAG chr11 5209034 5209053 5209050 +
atcttagctcagctacttac

SEQ ID NO: 6848 - DNA, 20 bp, Artificial Sequence
  Synthetic oligonucleotide; GAG chr11 5209039 5209058 5209055 +
agctcagctacttactagct

SEQ ID NO: 6849 - DNA, 20 bp, Artificial Sequence
  Synthetic oligonucleotide; TAG chr11 5209042 5209061 5209058 +
tcagctacttactagctgag

SEQ ID NO: 6850 - DNA, 20 bp, Artificial Sequence
  Synthetic oligonucleotide; AAG chr11 5209069 5209088 5209085 +
aacaccttaatgcccatccc

SEQ ID NO: 6851 - DNA, 20 bp, Artificial Sequence
  Synthetic oligonucleotide; CAG chr11 5209073 5209092 5209089 +
ccttaatgcccatcccaaga

SEQ ID NO: 6852 - DNA, 20 bp, Artificial Sequence
  Synthetic oligonucleotide; AAG chr11 5209085 5209104 5209101 +
tcccaagacagtgtgtgtaa

SEQ ID NO: 6853 - DNA, 20 bp, Artificial Sequence
  Synthetic oligonucleotide; CAG chr11 5209104 5209123 5209120 +
aaagacgaataacaacatct

SEQ ID NO: 6854 - DNA, 20 bp, Artificial Sequence
  Synthetic oligonucleotide; AGG chr11 5209105 5209124 5209121 +
aagacgaataacaacatctc

SEQ ID NO: 6855 - DNA, 20 bp, Artificial Sequence
  Synthetic oligonucleotide; AAG chr11 5209108 5209127 5209124 +
acgaataacaacatctcagg

SEQ ID NO: 6856 - DNA, 20 bp, Artificial Sequence
  Synthetic oligonucleotide; CAG chr11 5209113 5209132 5209129 +
taacaacatctcaggaagca

SEQ ID NO: 6857 - DNA, 20 bp, Artificial Sequence
  Synthetic oligonucleotide; AGG chr11 5209114 5209133 5209130 +
aacaacatctcaggaagcac

SEQ ID NO: 6858 - DNA, 20 bp, Artificial Sequence
  Synthetic oligonucleotide; CAG chr11 5209123 5209142 5209139 +
tcaggaagcacaggatgtac

SEQ ID NO: 6859 - DNA, 20 bp, Artificial Sequence
  Synthetic oligonucleotide; GAG chr11 5209125 5209144 5209141 +
aggaagcacaggatgtacca

SEQ ID NO: 6860 - DNA, 20 bp, Artificial Sequence
  Synthetic oligonucleotide; GAG chr11 5209127 5209146 5209143 +
gaagcacaggatgtaccaga

SEQ ID NO: 6861 - DNA, 20 bp, Artificial Sequence
  Synthetic oligonucleotide; TAG chr11 5209154 5209173 5209170 +
atcttttcatgttgctttcc

SEQ ID NO: 6862 - DNA, 20 bp, Artificial Sequence
  Synthetic oligonucleotide; AGG chr11 5209155 5209174 5209171 +
tcttttcatgttgctttcct

SEQ ID NO: 6863 - DNA, 20 bp, Artificial Sequence
  Synthetic oligonucleotide; TAG chr11 5209176 5209195 5209192 +
ggctttttatttccctcctc

SEQ ID NO: 6864 - DNA, 20 bp, Artificial Sequence
  Synthetic oligonucleotide; AGG chr11 5209177 5209196 5209193 +
gctttttatttccctcctct

SEQ ID NO: 6865 - DNA, 20 bp, Artificial Sequence
  Synthetic oligonucleotide; CAG chr11 5209224 5209243 5209240 +
attatttcttccctcttctt

SEQ ID NO: 6866 - DNA, 20 bp, Artificial Sequence
  Synthetic oligonucleotide; AGG chr11 5209225 5209244 5209241 +
ttatttcttccctcttcttc

SEQ ID NO: 6867 - DNA, 20 bp, Artificial Sequence
  Synthetic oligonucleotide; AAG chr11 5209228 5209247 5209244 +
tttcttccctcttcttcagg

SEQ ID NO: 6868 - DNA, 20 bp, Artificial Sequence
  Synthetic oligonucleotide; AAG chr11 5209233 5209252 5209249 +
tccctcttcttcaggaagtt

SEQ ID NO: 6869 - DNA, 20 bp, Artificial Sequence
  Synthetic oligonucleotide; CAG chr11 5209237 5209256 5209253 +
tcttcttcaggaagttaaga

SEQ ID NO: 6870 - DNA, 20 bp, Artificial Sequence
  Synthetic oligonucleotide; TAG chr11 5209246 5209265 5209262 +
ggaagttaagacagtctacc

SEQ ID NO: 6871 - DNA, 20 bp, Artificial Sequence
  Synthetic oligonucleotide; TAG chr11 5209252 5209271 5209268 +
taagacagtctacctagatt

SEQ ID NO: 6872 - DNA, 20 bp, Artificial Sequence
  Synthetic oligonucleotide; AAG chr11 5209255 5209274 5209271 +
gacagtctacctagatttag

SEQ ID NO: 6873 - DNA, 20 bp, Artificial Sequence
  Synthetic oligonucleotide; TAG chr11 5209270 5209289 5209286 +
tttagaagcaaatgtttata

SEQ ID NO: 6874 - DNA, 20 bp, Artificial Sequence
  Synthetic oligonucleotide; TGG chr11 5209273 5209292 5209289 +
agaagcaaatgtttatatag

SEQ ID NO: 6875 - DNA, 20 bp, Artificial Sequence
  Synthetic oligonucleotide; AAG chr11 5209285 5209304 5209301 +
ttatatagtggtgaaattta

SEQ ID NO: 6876 - DNA, 20 bp, Artificial Sequence
  Synthetic oligonucleotide; AAG chr11 5209300 5209319 5209316 +
atttaaagcctaattgacta

SEQ ID NO: 6877 - DNA, 20 bp, Artificial Sequence
  Synthetic oligonucleotide; AAG chr11 5209309 5209328 5209325 +
ctaattgactaaagccattt

SEQ ID NO: 6878 - DNA, 20 bp, Artificial Sequence
  Synthetic oligonucleotide; CAG chr11 5209324 5209343 5209340 +
catttaagaatgtaatatct

SEQ ID NO: 6879 - DNA, 20 bp, Artificial Sequence
  Synthetic oligonucleotide; TAG chr11 5209328 5209347 5209344 +
taagaatgtaatatctcagt

SEQ ID NO: 6880 - DNA, 20 bp, Artificial Sequence
  Synthetic oligonucleotide; AAG chr11 5209351 5209370 5209367 +
tatgcacttcttgaaatgca

SEQ ID NO: 6881 - DNA, 20 bp, Artificial Sequence
  Synthetic oligonucleotide; TGG chr11 5209357 5209376 5209373 +
cttcttgaaatgcaaagaaa

SEQ ID NO: 6882 - DNA, 20 bp, Artificial Sequence
  Synthetic oligonucleotide; TAG chr11 5209380 5209399 5209396 +
tctgacttttttccattgtt

SEQ ID NO: 6883 - DNA, 20 bp, Artificial Sequence
  Synthetic oligonucleotide; TAG chr11 5209393 5209412 5209409 +
cattgtttagtttctaaatt

SEQ ID NO: 6884 - DNA, 20 bp, Artificial Sequence
  Synthetic oligonucleotide; AAG chr11 5209414 5209433 5209430 +
agtttttattttaatatttt

SEQ ID NO: 6885 - DNA, 20 bp, Artificial Sequence
  Synthetic oligonucleotide; CAG chr11 5209419 5209438 5209435 +
ttattttaatattttaagta

SEQ ID NO: 6886 - DNA, 20 bp, Artificial Sequence
  Synthetic oligonucleotide; AAG chr11 5209435 5209454 5209451 +
agtacagcatgcatatataa

SEQ ID NO: 6887 - DNA, 20 bp, Artificial Sequence
  Synthetic oligonucleotide; CAG chr11 5209457 5209476 5209473 +
gtacacaaattatacatgca

SEQ ID NO: 6888 - DNA, 20 bp, Artificial Sequence
  Synthetic oligonucleotide; TGG chr11 5209473 5209492 5209489 +
tgcacagctgaattaacttt

SEQ ID NO: 6889 - DNA, 20 bp, Artificial Sequence
  Synthetic oligonucleotide; AAG chr11 5209476 5209495 5209492 +
acagctgaattaacttttgg

SEQ ID NO: 6890 - DNA, 20 bp, Artificial Sequence
  Synthetic oligonucleotide; AGG chr11 5209477 5209496 5209493 +
cagctgaattaacttttgga

SEQ ID NO: 6891 - DNA, 20 bp, Artificial Sequence
  Synthetic oligonucleotide; AAG chr11 5209505 5209524 5209521 +
acacccatgtaacaactaat

SEQ ID NO: 6892 - DNA, 20 bp, Artificial Sequence
  Synthetic oligonucleotide; TAG chr11 5209509 5209528 5209525 +
ccatgtaacaactaataaga

SEQ ID NO: 6893 - DNA, 20 bp, Artificial Sequence
  Synthetic oligonucleotide; AGG chr11 5209510 5209529 5209526 +
catgtaacaactaataagat

SEQ ID NO: 6894 - DNA, 20 bp, Artificial Sequence
  Synthetic oligonucleotide; AAG chr11 5209519 5209538 5209535 +
actaataagataggaaatta

SEQ ID NO: 6895 - DNA, 20 bp, Artificial Sequence
  Synthetic oligonucleotide; GAG chr11 5209521 5209540 5209537 +
taataagataggaaattaaa

SEQ ID NO: 6896 - DNA, 20 bp, Artificial Sequence
  Synthetic oligonucleotide; AAG chr11 5209566 5209585 5209582 +
cattccactaattgtctcca

SEQ ID NO: 6897 - DNA, 20 bp, Artificial Sequence
  Synthetic oligonucleotide; AAG chr11 5209629 5209648 5209645 +
actcatgtccctttttttaa

SEQ ID NO: 6898 - DNA, 20 bp, Artificial Sequence
  Synthetic oligonucleotide; TAG chr11 5209708 5209727 5209724 +
tttgtgaattgcattcatac

SEQ ID NO: 6899 - DNA, 20 bp, Artificial Sequence
  Synthetic oligonucleotide; TAG chr11 5209721 5209740 5209737 +
ttcatactagtgtatgactg

SEQ ID NO: 6900 - DNA, 20 bp, Artificial Sequence
  Synthetic oligonucleotide; CAG chr11 5209789 5209808 5209805 +
caatatatttattgactcca

SEQ ID NO: 6901 - DNA, 20 bp, Artificial Sequence
  Synthetic oligonucleotide; TAG chr11 5209796 5209815 5209812 +
tttattgactccacagttga

SEQ ID NO: 6902 - DNA, 20 bp, Artificial Sequence
  Synthetic oligonucleotide; GAG chr11 5209805 5209824 5209821 +
tccacagttgatagatattt

SEQ ID NO: 6903 - DNA, 20 bp, Artificial Sequence
  Synthetic oligonucleotide; TAG chr11 5209815 5209834 5209831 +
atagatatttgagtaccttc

SEQ ID NO: 6904 - DNA, 20 bp, Artificial Sequence
  Synthetic oligonucleotide; TGG chr11 5209822 5209841 5209838 +
tttgagtaccttctagcttt

SEQ ID NO: 6905 - DNA, 20 bp, Artificial Sequence
  Synthetic oligonucleotide; AAG chr11 5209848 5209867 5209864 +
taatataaattgctgctatg

SEQ ID NO: 6906 - DNA, 20 bp, Artificial Sequence
  Synthetic oligonucleotide; TAG chr11 5209889 5209908 5209905 +
atatatattctgtaaattgc

SEQ ID NO: 6907 - DNA, 20 bp, Artificial Sequence
  Synthetic oligonucleotide; AGG chr11 5209890 5209909 5209906 +
tatatattctgtaaattgct

SEQ ID NO: 6908 - DNA, 20 bp, Artificial Sequence
  Synthetic oligonucleotide; TGG chr11 5209969 5209988 5209985 +
cactataatttaatgtcatt

SEQ ID NO: 6909 - DNA, 20 bp, Artificial Sequence
  Synthetic oligonucleotide; TAG chr11 5209988 5210007 5210004 +
ttggtcaacctataatatca

SEQ ID NO: 6910 - DNA, 20 bp, Artificial Sequence
  Synthetic oligonucleotide; TAG chr11 5210004 5210023 5210020 +
atcatagatgttttctctta

SEQ ID NO: 6911 - DNA, 20 bp, Artificial Sequence
  Synthetic oligonucleotide; CAG chr11 5210007 5210026 5210023 +
atagatgttttctcttatag

SEQ ID NO: 6912 - DNA, 20 bp, Artificial Sequence
  Synthetic oligonucleotide; CAG chr11 5210022 5210041 5210038 +
tatagcagcctgcatgtgcc

SEQ ID NO: 6913 - DNA, 20 bp, Artificial Sequence
  Synthetic oligonucleotide; TAG chr11 5210056 5210075 5210072 +
atcctttgtatatttacatt

SEQ ID NO: 6914 - DNA, 20 bp, Artificial Sequence
  Synthetic oligonucleotide; TAG chr11 5210076 5210095 5210092 +
tagttctgtattattacaat

SEQ ID NO: 6915 - DNA, 20 bp, Artificial Sequence
  Synthetic oligonucleotide; TAG chr11 5210083 5210102 5210099 +
gtattattacaattagttcg

SEQ ID NO: 6916 - DNA, 20 bp, Artificial Sequence
  Synthetic oligonucleotide; TAG chr11 5210110 5210129 5210126 +
gttattattattctcatttg

SEQ ID NO: 6917 - DNA, 20 bp, Artificial Sequence
  Synthetic oligonucleotide; AAG chr11 5210116 5210135 5210132 +
attattctcatttgtagttg

SEQ ID NO: 6918 - DNA, 20 bp, Artificial Sequence
  Synthetic oligonucleotide; CAG chr11 5210130 5210149 5210146 +
tagttgaagaaattgcactc

SEQ ID NO: 6919 - DNA, 20 bp, Artificial Sequence
  Synthetic oligonucleotide; AAG chr11 5210134 5210153 5210150 +
tgaagaaattgcactccagc

SEQ ID NO: 6920 - DNA, 20 bp, Artificial Sequence
  Synthetic oligonucleotide; TGG chr11 5210150 5210169 5210166 +
cagcaagtttaaattgctcc

SEQ ID NO: 6921 - DNA, 20 bp, Artificial Sequence
  Synthetic oligonucleotide; CAG chr11 5210161 5210180 5210177 +
aattgctcctggctacatcc

SEQ ID NO: 6922 - DNA, 20 bp, Artificial Sequence
  Synthetic oligonucleotide; TAG chr11 5210206 5210225 5210222 +
actttttgcccctacttgac

SEQ ID NO: 6923 - DNA, 20 bp, Artificial Sequence
  Synthetic oligonucleotide; AGG chr11 5210207 5210226 5210223 +
ctttttgcccctacttgact

SEQ ID NO: 6924 - DNA, 20 bp, Artificial Sequence
  Synthetic oligonucleotide; AAG chr11 5210219 5210238 5210235 +
acttgactaggaattgtata

SEQ ID NO: 6925 - DNA, 20 bp, Artificial Sequence
  Synthetic oligonucleotide; GAG chr11 5210221 5210240 5210237 +
ttgactaggaattgtataaa

SEQ ID NO: 6926 - DNA, 20 bp, Artificial Sequence
  Synthetic oligonucleotide; CAG chr11 5210226 5210245 5210242 +
taggaattgtataaagagaa

SEQ ID NO: 6927 - DNA, 20 bp, Artificial Sequence
  Synthetic oligonucleotide; TAG chr11 5210238 5210257 5210254 +
aaagagaacagttattcttc

SEQ ID NO: 6928 - DNA, 20 bp, Artificial Sequence
  Synthetic oligonucleotide; TGG chr11 5210241 5210260 5210257 +
gagaacagttattcttctag

SEQ ID NO: 6929 - DNA, 20 bp, Artificial Sequence
  Synthetic oligonucleotide; GGG chr11 5210242 5210261 5210258 +
agaacagttattcttctagt

SEQ ID NO: 6930 - DNA, 20 bp, Artificial Sequence
  Synthetic oligonucleotide; AAG chr11 5210245 5210264 5210261 +
acagttattcttctagtggg

SEQ ID NO: 6931 - DNA, 20 bp, Artificial Sequence
  Synthetic oligonucleotide; AAG chr11 5210249 5210268 5210265 +
ttattcttctagtgggaagc

SEQ ID NO: 6932 - DNA, 20 bp, Artificial Sequence
  Synthetic oligonucleotide; TGG chr11 5210253 5210272 5210269 +
tcttctagtgggaagcaagc

SEQ ID NO: 6933 - DNA, 20 bp, Artificial Sequence
  Synthetic oligonucleotide; TGG chr11 5210263 5210282 5210279 +
ggaagcaagctggcctcaac

SEQ ID NO: 6934 - DNA, 20 bp, Artificial Sequence
  Synthetic oligonucleotide; CAG chr11 5210268 5210287 5210284 +
caagctggcctcaactggaa

SEQ ID NO: 6935 - DNA, 20 bp, Artificial Sequence
  Synthetic oligonucleotide; GAG chr11 5210274 5210293 5210290 +
ggcctcaactggaacagaat

SEQ ID NO: 6936 - DNA, 20 bp, Artificial Sequence
  Synthetic oligonucleotide; GAG chr11 5210276 5210295 5210292 +
cctcaactggaacagaatga

SEQ ID NO: 6937 - DNA, 20 bp, Artificial Sequence
  Synthetic oligonucleotide; AAG chr11 5210285 5210304 5210301 +
gaacagaatgagagaaatgc

SEQ ID NO: 6938 - DNA, 20 bp, Artificial Sequence
  Synthetic oligonucleotide; CAG chr11 5210304 5210323 5210320 +
caagacatctaataatccaa

SEQ ID NO: 6939 - DNA, 20 bp, Artificial Sequence
  Synthetic oligonucleotide; TGG chr11 5210345 5210364 5210361 +
gtactttttccttttcccca

SEQ ID NO: 6940 - DNA, 20 bp, Artificial Sequence
  Synthetic oligonucleotide; GAG chr11 5210347 5210366 5210363 +
actttttccttttccccatg

SEQ ID NO: 6941 - DNA, 20 bp, Artificial Sequence
  Synthetic oligonucleotide; AAG chr11 5210352 5210371 5210368 +
ttccttttccccatggagtc

SEQ ID NO: 6942 - DNA, 20 bp, Artificial Sequence
  Synthetic oligonucleotide; AGG chr11 5210353 5210372 5210369 +
tccttttccccatggagtca

SEQ ID NO: 6943 - DNA, 20 bp, Artificial Sequence
  Synthetic oligonucleotide; AAG chr11 5210373 5210392 5210389 +
aggctatctaaacttccttt

SEQ ID NO: 6944 - DNA, 20 bp, Artificial Sequence
  Synthetic oligonucleotide; AAG chr11 5210381 5210400 5210397 +
taaacttcctttaagtgcac

SEQ ID NO: 6945 - DNA, 20 bp, Artificial Sequence
  Synthetic oligonucleotide; TGG chr11 5210390 5210409 5210406 +
tttaagtgcacaagctaata

SEQ ID NO: 6946 - DNA, 20 bp, Artificial Sequence
  Synthetic oligonucleotide; TAG chr11 5210393 5210412 5210409 +
aagtgcacaagctaatatgg

SEQ ID NO: 6947 - DNA, 20 bp, Artificial Sequence
  Synthetic oligonucleotide; AGG chr11 5210394 5210413 5210410 +
agtgcacaagctaatatggt

SEQ ID NO: 6948 - DNA, 20 bp, Artificial Sequence
  Synthetic oligonucleotide; GGG chr11 5210395 5210414 5210411 +
gtgcacaagctaatatggta

SEQ ID NO: 6949 - DNA, 20 bp, Artificial Sequence
  Synthetic oligonucleotide; AAG chr11 5210405 5210424 5210421 +
taatatggtagggaaatata

SEQ ID NO: 6950 - DNA, 20 bp, Artificial Sequence
  Synthetic oligonucleotide; CAG chr11 5210423 5210442 5210439 +
taaagcctaatcctgccatc

SEQ ID NO: 6951 - DNA, 20 bp, Artificial Sequence
  Synthetic oligonucleotide; GAG chr11 5210429 5210448 5210445 +
ctaatcctgccatccagaat

SEQ ID NO: 6952 - DNA, 20 bp, Artificial Sequence
  Synthetic oligonucleotide; AAG chr11 5210433 5210452 5210449 +
tcctgccatccagaatgagc

SEQ ID NO: 6953 - DNA, 20 bp, Artificial Sequence
  Synthetic oligonucleotide; TGG chr11 5210436 5210455 5210452 +
tgccatccagaatgagcaag

SEQ ID NO: 6954 - DNA, 20 bp, Artificial Sequence
  Synthetic oligonucleotide; TGG chr11 5210440 5210459 5210456 +
atccagaatgagcaagtgga

SEQ ID NO: 6955 - DNA, 20 bp, Artificial Sequence
  Synthetic oligonucleotide; GGG chr11 5210441 5210460 5210457 +
tccagaatgagcaagtggat

SEQ ID NO: 6956 - DNA, 20 bp, Artificial Sequence
  Synthetic oligonucleotide; GGG chr11 5210442 5210461 5210458 +
ccagaatgagcaagtggatg

SEQ ID NO: 6957 - DNA, 20 bp, Artificial Sequence
  Synthetic oligonucleotide; AAG chr11 5210447 5210466 5210463 +
atgagcaagtggatggggaa

SEQ ID NO: 6958 - DNA, 20 bp, Artificial Sequence
  Synthetic oligonucleotide; AGG chr11 5210448 5210467 5210464 +
tgagcaagtggatggggaaa

SEQ ID NO: 6959 - DNA, 20 bp, Artificial Sequence
  Synthetic oligonucleotide; GGG chr11 5210449 5210468 5210465 +
gagcaagtggatggggaaaa

SEQ ID NO: 6960 - DNA, 20 bp, Artificial Sequence
  Synthetic oligonucleotide; AAG chr11 5210452 5210471 5210468 +
caagtggatggggaaaaggg

SEQ ID NO: 6961 - DNA, 20 bp, Artificial Sequence
  Synthetic oligonucleotide; AGG chr11 5210453 5210472 5210469 +
aagtggatggggaaaaggga

SEQ ID NO: 6962 - DNA, 20 bp, Artificial Sequence
  Synthetic oligonucleotide; GGG chr11 5210454 5210473 5210470 +
agtggatggggaaaagggaa

SEQ ID NO: 6963 - DNA, 20 bp, Artificial Sequence
  Synthetic oligonucleotide; AAG chr11 5210460 5210479 5210476 +
tggggaaaagggaagggaaa

SEQ ID NO: 6964 - DNA, 20 bp, Artificial Sequence
  Synthetic oligonucleotide; AGG chr11 5210461 5210480 5210477 +
ggggaaaagggaagggaaaa

SEQ ID NO: 6965 - DNA, 20 bp, Artificial Sequence
  Synthetic oligonucleotide; GAG chr11 5210463 5210482 5210479 +
ggaaaagggaagggaaaaag

SEQ ID NO: 6966 - DNA, 20 bp, Artificial Sequence
  Synthetic oligonucleotide; CAG chr11 5210466 5210485 5210482 +
aaagggaagggaaaaaggag

SEQ ID NO: 6967 - DNA, 20 bp, Artificial Sequence
  Synthetic oligonucleotide; AAG chr11 5210477 5210496 5210493 +
aaaaaggagcagaatctgcc

SEQ ID NO: 6968 - DNA, 20 bp, Artificial Sequence
  Synthetic oligonucleotide; CAG chr11 5210517 5210536 5210533 +
tgtttctcccacttgctctg

SEQ ID NO: 6969 - DNA, 20 bp, Artificial Sequence
  Synthetic oligonucleotide; AGG chr11 5210518 5210537 5210534 +
gtttctcccacttgctctgc

SEQ ID NO: 6970 - DNA, 20 bp, Artificial Sequence
  Synthetic oligonucleotide; TGG chr11 5210522 5210541 5210538 +
ctcccacttgctctgcagga

SEQ ID NO: 6971 - DNA, 20 bp, Artificial Sequence
  Synthetic oligonucleotide; TAG chr11 5210527 5210546 5210543 +
acttgctctgcaggatggct

SEQ ID NO: 6972 - DNA, 20 bp, Artificial Sequence
  Synthetic oligonucleotide; CAG chr11 5210530 5210549 5210546 +
tgctctgcaggatggcttag

SEQ ID NO: 6973 - DNA, 20 bp, Artificial Sequence
  Synthetic oligonucleotide; CAG chr11 5210537 5210556 5210553 +
caggatggcttagcagctcc

SEQ ID NO: 6974 - DNA, 20 bp, Artificial Sequence
  Synthetic oligonucleotide; CAG chr11 5210542 5210561 5210558 +
tggcttagcagctcccagct

SEQ ID NO: 6975 - DNA, 20 bp, Artificial Sequence
  Synthetic oligonucleotide; AGG chr11 5210543 5210562 5210559 +
ggcttagcagctcccagctc

SEQ ID NO: 6976 - DNA, 20 bp, Artificial Sequence
  Synthetic oligonucleotide; GGG chr11 5210544 5210563 5210560 +
gcttagcagctcccagctca

SEQ ID NO: 6977 - DNA, 20 bp, Artificial Sequence
  Synthetic oligonucleotide; CAG chr11 5210552 5210571 5210568 +
gctcccagctcagggcctat

SEQ ID NO: 6978 - DNA, 20 bp, Artificial Sequence
  Synthetic oligonucleotide; GAG chr11 5210554 5210573 5210570 +
tcccagctcagggcctatca

SEQ ID NO: 6979 - DNA, 20 bp, Artificial Sequence
  Synthetic oligonucleotide; AGG chr11 5210555 5210574 5210571 +
cccagctcagggcctatcag

SEQ ID NO: 6980 - DNA, 20 bp, Artificial Sequence
  Synthetic oligonucleotide; GAG chr11 5210560 5210579 5210576 +
ctcagggcctatcagaggct

SEQ ID NO: 6981 - DNA, 20 bp, Artificial Sequence
  Synthetic oligonucleotide; AAG chr11 5210563 5210582 5210579 +
agggcctatcagaggctgag

SEQ ID NO: 6982 - DNA, 20 bp, Artificial Sequence
  Synthetic oligonucleotide; AGG chr11 5210564 5210583 5210580 +
gggcctatcagaggctgaga

SEQ ID NO: 6983 - DNA, 20 bp, Artificial Sequence
  Synthetic oligonucleotide; CGG chr11 5210568 5210587 5210584 +
ctatcagaggctgagaaggt

SEQ ID NO: 6984 - DNA, 20 bp, Artificial Sequence
  Synthetic oligonucleotide; AAG chr11 5210602 5210621 5210618 +
attttattccttcactaaca

SEQ ID NO: 6985 - DNA, 20 bp, Artificial Sequence
  Synthetic oligonucleotide; CAG chr11 5210611 5210630 5210627 +
cttcactaacaaagcaaacc

SEQ ID NO: 6986 - DNA, 20 bp, Artificial Sequence
  Synthetic oligonucleotide; CGG chr11 5210647 5210666 5210663 +
ctctcctctatgcactctct

SEQ ID NO: 6987 - DNA, 20 bp, Artificial Sequence
  Synthetic oligonucleotide; GGG chr11 5210648 5210667 5210664 +
tctcctctatgcactctctc

SEQ ID NO: 6988 - DNA, 20 bp, Artificial Sequence
  Synthetic oligonucleotide; GGG chr11 5210649 5210668 5210665 +
ctcctctatgcactctctcg

SEQ ID NO: 6989 - DNA, 20 bp, Artificial Sequence
  Synthetic oligonucleotide; TAG chr11 5210668 5210687 5210684 +
ggggcacttcctaatctcgt

SEQ ID NO: 6990 - DNA, 20 bp, Artificial Sequence
  Synthetic oligonucleotide; TAG chr11 5210683 5210702 5210699 +
ctcgttagtaccttttgaat

SEQ ID NO: 6991 - DNA, 20 bp, Artificial Sequence
  Synthetic oligonucleotide; AAG chr11 5210691 5210710 5210707 +
taccttttgaattagttttc

SEQ ID NO: 6992 - DNA, 20 bp, Artificial Sequence
  Synthetic oligonucleotide; TAG chr11 5210695 5210714 5210711 +
ttttgaattagttttcaaga

SEQ ID NO: 6993 - DNA, 20 bp, Artificial Sequence
  Synthetic oligonucleotide; AGG chr11 5210696 5210715 5210712 +
tttgaattagttttcaagat

SEQ ID NO: 6994 - DNA, 20 bp, Artificial Sequence
  Synthetic oligonucleotide; GAG chr11 5210703 5210722 5210719 +
tagttttcaagataggactt

SEQ ID NO: 6995 - DNA, 20 bp, Artificial Sequence
  Synthetic oligonucleotide; AAG chr11 5210713 5210732 5210729 +
gataggacttgagttcctcg

SEQ ID NO: 6996 - DNA, 20 bp, Artificial Sequence
  Synthetic oligonucleotide; AGG chr11 5210714 5210733 5210730 +
ataggacttgagttcctcga

SEQ ID NO: 6997 - DNA, 20 bp, Artificial Sequence
  Synthetic oligonucleotide; TAG chr11 5210719 5210738 5210735 +
acttgagttcctcgaaggat

SEQ ID NO: 6998 - DNA, 20 bp, Artificial Sequence
  Synthetic oligonucleotide; CAG chr11 5210729 5210748 5210745 +
ctcgaaggattagaaaataa

SEQ ID NO: 6999 - DNA, 20 bp, Artificial Sequence
  Synthetic oligonucleotide; CAG chr11 5210735 5210754 5210751 +
ggattagaaaataacagtaa

SEQ ID NO: 7000 - DNA, 20 bp, Artificial Sequence
  Synthetic oligonucleotide; TGG chr11 5210749 5210768 5210765 +
cagtaacagttcatgttgtc

SEQ ID NO: 7001 - DNA, 20 bp, Artificial Sequence
  Synthetic oligonucleotide; GGG chr11 5210750 5210769 5210766 +
agtaacagttcatgttgtct

SEQ ID NO: 7002 - DNA, 20 bp, Artificial Sequence
  Synthetic oligonucleotide; AAG chr11 5210755 5210774 5210771 +
cagttcatgttgtctgggcc

SEQ ID NO: 7003 - DNA, 20 bp, Artificial Sequence
  Synthetic oligonucleotide; CAG chr11 5210760 5210779 5210776 +
catgttgtctgggccaagca

SEQ ID NO: 7004 - DNA, 20 bp, Artificial Sequence
  Synthetic oligonucleotide; TGG chr11 5210763 5210782 5210779 +
gttgtctgggccaagcacag

SEQ ID NO: 7005 - DNA, 20 bp, Artificial Sequence
  Synthetic oligonucleotide; CAG chr11 5210782 5210801 5210798 +
gtggctcacacctgtaatca

SEQ ID NO: 7006 - DNA, 20 bp, Artificial Sequence
  Synthetic oligonucleotide; GAG chr11 5210787 5210806 5210803 +
tcacacctgtaatcacagcc

SEQ ID NO: 7007 - DNA, 20 bp, Artificial Sequence
  Synthetic oligonucleotide; AGG chr11 5210788 5210807 5210804 +
cacacctgtaatcacagccg

SEQ ID NO: 7008 - DNA, 20 bp, Artificial Sequence
  Synthetic oligonucleotide; CGG chr11 5210792 5210811 5210808 +
cctgtaatcacagccgaggc

SEQ ID NO: 7009 - DNA, 20 bp, Artificial Sequence
  Synthetic oligonucleotide; GAG chr11 5210794 5210813 5210810 +
tgtaatcacagccgaggccg

SEQ ID NO: 7010 - DNA, 20 bp, Artificial Sequence
  Synthetic oligonucleotide; AGG chr11 5210795 5210814 5210811 +
gtaatcacagccgaggccgg

SEQ ID NO: 7011 - DNA, 20 bp, Artificial Sequence
  Synthetic oligonucleotide; GGG chr11 5210796 5210815 5210812 +
taatcacagccgaggccgga

SEQ ID NO: 7012 - DNA, 20 bp, Artificial Sequence
  Synthetic oligonucleotide; GAG chr11 5210798 5210817 5210814 +
atcacagccgaggccggagg

SEQ ID NO: 7013 - DNA, 20 bp, Artificial Sequence
  Synthetic oligonucleotide; GAG chr11 5210809 5210828 5210825 +
ggccggagggagaacgattt

SEQ ID NO: 7014 - DNA, 20 bp, Artificial Sequence
  Synthetic oligonucleotide; CAG chr11 5210814 5210833 5210830 +
gagggagaacgatttgagct

SEQ ID NO: 7015 - DNA, 20 bp, Artificial Sequence
  Synthetic oligonucleotide; AGG chr11 5210815 5210834 5210831 +
agggagaacgatttgagctc

SEQ ID NO: 7016 - DNA, 20 bp, Artificial Sequence
  Synthetic oligonucleotide; GAG chr11 5210817 5210836 5210833 +
ggagaacgatttgagctcag

SEQ ID NO: 7017 - DNA, 20 bp, Artificial Sequence
  Synthetic oligonucleotide; TGG chr11 5210821 5210840 5210837 +
aacgatttgagctcaggagt

SEQ ID NO: 7018 - DNA, 20 bp, Artificial Sequence
  Synthetic oligonucleotide; GAG chr11 5210823 5210842 5210839 +
cgatttgagctcaggagttg

SEQ ID NO: 7019 - DNA, 20 bp, Artificial Sequence
  Synthetic oligonucleotide; CAG chr11 5210828 5210847 5210844 +
tgagctcaggagttggagac

SEQ ID NO: 7020 - DNA, 20 bp, Artificial Sequence
  Synthetic oligonucleotide; TGG chr11 5210833 5210852 5210849 +
tcaggagttggagaccagct

SEQ ID NO: 7021 - DNA, 20 bp, Artificial Sequence
  Synthetic oligonucleotide; GGG chr11 5210834 5210853 5210850 +
caggagttggagaccagctt

SEQ ID NO: 7022 - DNA, 20 bp, Artificial Sequence
  Synthetic oligonucleotide; TGG chr11 5210842 5210861 5210858 +
ggagaccagcttgggcaaca

SEQ ID NO: 7023 - DNA, 20 bp, Artificial Sequence
  Synthetic oligonucleotide; GAG chr11 5210844 5210863 5210860 +
agaccagcttgggcaacatg

SEQ ID NO: 7024 - DNA, 20 bp, Artificial Sequence
  Synthetic oligonucleotide; AAG chr11 5210874 5210893 5210890 +
tctctacaaaaaattttaaa

SEQ ID NO: 7025 - DNA, 20 bp, Artificial Sequence
  Synthetic oligonucleotide; TAG chr11 5210877 5210896 5210893 +
ctacaaaaaattttaaaaag

SEQ ID NO: 7026 - DNA, 20 bp, Artificial Sequence
  Synthetic oligonucleotide; TGG chr11 5210887 5210906 5210903 +
ttttaaaaagtagccgaata

SEQ ID NO: 7027 - DNA, 20 bp, Artificial Sequence
  Synthetic oligonucleotide; TAG chr11 5210903 5210922 5210919 +
aatatggtgttacgtgcctg

SEQ ID NO: 7028 - DNA, 20 bp, Artificial Sequence
  Synthetic oligonucleotide; CAG chr11 5210909 5210928 5210925 +
gtgttacgtgcctgtagtcc

SEQ ID NO: 7029 - DNA, 20 bp, Artificial Sequence
  Synthetic oligonucleotide; TGG chr11 5210917 5210936 5210933 +
tgcctgtagtcccagctact

SEQ ID NO: 7030 - DNA, 20 bp, Artificial Sequence
  Synthetic oligonucleotide; GGG chr11 5210918 5210937 5210934 +
gcctgtagtcccagctactt

SEQ ID NO: 7031 - DNA, 20 bp, Artificial Sequence
  Synthetic oligonucleotide; GAG chr11 5210920 5210939 5210936 +
ctgtagtcccagctacttgg

SEQ ID NO: 7032 - DNA, 20 bp, Artificial Sequence
  Synthetic oligonucleotide; AGG chr11 5210921 5210940 5210937 +
tgtagtcccagctacttggg

SEQ ID NO: 7033 - DNA, 20 bp, Artificial Sequence
  Synthetic oligonucleotide; GAG chr11 5210926 5210945 5210942 +
tcccagctacttgggaggct

SEQ ID NO: 7034 - DNA, 20 bp, Artificial Sequence
  Synthetic oligonucleotide; AGG chr11 5210927 5210946 5210943 +
cccagctacttgggaggctg

SEQ ID NO: 7035 - DNA, 20 bp, Artificial Sequence
  Synthetic oligonucleotide; TGG chr11 5210930 5210949 5210946 +
agctacttgggaggctgagg

SEQ ID NO: 7036 - DNA, 20 bp, Artificial Sequence
  Synthetic oligonucleotide; AAG chr11 5210933 5210952 5210949 +
tacttgggaggctgaggtgg

SEQ ID NO: 7037 - DNA, 20 bp, Artificial Sequence
  Synthetic oligonucleotide; AGG chr11 5210934 5210953 5210950 +
acttgggaggctgaggtgga

SEQ ID NO: 7038 - DNA, 20 bp, Artificial Sequence
  Synthetic oligonucleotide; GAG chr11 5210944 5210963 5210960 +
ctgaggtggaaggatatctt

SEQ ID NO: 7039 - DNA, 20 bp, Artificial Sequence
  Synthetic oligonucleotide; AAG chr11 5210949 5210968 5210965 +
gtggaaggatatcttgagcc

SEQ ID NO: 7040 - DNA, 20 bp, Artificial Sequence
  Synthetic oligonucleotide; AGG chr11 5210950 5210969 5210966 +
tggaaggatatcttgagcca

SEQ ID NO: 7041 - DNA, 20 bp, Artificial Sequence
  Synthetic oligonucleotide; GAG chr11 5210952 5210971 5210968 +
gaaggatatcttgagccaag

SEQ ID NO: 7042 - DNA, 20 bp, Artificial Sequence
  Synthetic oligonucleotide; AGG chr11 5210953 5210972 5210969 +
aaggatatcttgagccaagg

SEQ ID NO: 7043 - DNA, 20 bp, Artificial Sequence
  Synthetic oligonucleotide; GGG chr11 5210954 5210973 5210970 +
aggatatcttgagccaagga

SEQ ID NO: 7044 - DNA, 20 bp, Artificial Sequence
  Synthetic oligonucleotide; GGG chr11 5210955 5210974 5210971 +
ggatatcttgagccaaggag

SEQ ID NO: 7045 - DNA, 20 bp, Artificial Sequence
  Synthetic oligonucleotide; GGG chr11 5210956 5210975 5210972 +
gatatcttgagccaaggagg

SEQ ID NO: 7046 - DNA, 20 bp, Artificial Sequence
  Synthetic oligonucleotide; GAG chr11 5210958 5210977 5210974 +
tatcttgagccaaggagggg

SEQ ID NO: 7047 - DNA, 20 bp, Artificial Sequence
  Synthetic oligonucleotide; CAG chr11 5210965 5210984 5210981 +
agccaaggagggggagattg

SEQ ID NO: 7048 - DNA, 20 bp, Artificial Sequence
  Synthetic oligonucleotide; GAG chr11 5210969 5210988 5210985 +
aaggagggggagattgcagt

SEQ ID NO: 7049 - DNA, 20 bp, Artificial Sequence
  Synthetic oligonucleotide; AAG chr11 5210974 5210993 5210990 +
gggggagattgcagtgagca

SEQ ID NO: 7050 - DNA, 20 bp, Artificial Sequence
  Synthetic oligonucleotide; TGG chr11 5210999 5211018 5211015 +
tgtaccactgcactccaacc

SEQ ID NO: 7051 - DNA, 20 bp, Artificial Sequence
  Synthetic oligonucleotide; GGG chr11 5211000 5211019 5211016 +
gtaccactgcactccaacct

SEQ ID NO: 7052 - DNA, 20 bp, Artificial Sequence
  Synthetic oligonucleotide; CAG chr11 5211008 5211027 5211024 +
gcactccaacctgggcaaca

SEQ ID NO: 7053 - DNA, 20 bp, Artificial Sequence
  Synthetic oligonucleotide; GAG chr11 5211012 5211031 5211028 +
tccaacctgggcaacacagc

SEQ ID NO: 7054 - DNA, 20 bp, Artificial Sequence
  Synthetic oligonucleotide; AAG chr11 5211035 5211054 5211051 +
accctgtcaaaaaaaaaaaa

SEQ ID NO: 7055 - DNA, 20 bp, Artificial Sequence
  Synthetic oligonucleotide; GAG chr11 5211037 5211056 5211053 +
cctgtcaaaaaaaaaaaaaa

SEQ ID NO: 7056 - DNA, 20 bp, Artificial Sequence
  Synthetic oligonucleotide; GAG chr11 5211039 5211058 5211055 +
tgtcaaaaaaaaaaaaaaga

SEQ ID NO: 7057 - DNA, 20 bp, Artificial Sequence
  Synthetic oligonucleotide; TAG chr11 5211043 5211062 5211059 +
aaaaaaaaaaaaaagagagc

SEQ ID NO: 7058 - DNA, 20 bp, Artificial Sequence
  Synthetic oligonucleotide; AAG chr11 5211047 5211066 5211063 +
aaaaaaaaaagagagctaga

SEQ ID NO: 7059 - DNA, 20 bp, Artificial Sequence
  Synthetic oligonucleotide; AAG chr11 5211051 5211070 5211067 +
aaaaaagagagctagaaaga

SEQ ID NO: 7060 - DNA, 20 bp, Artificial Sequence
  Synthetic oligonucleotide; CAG chr11 5211066 5211085 5211082 +
aaagaaagaaattaacaatt

SEQ ID NO: 7061 - DNA, 20 bp, Artificial Sequence
  Synthetic oligonucleotide; AGG chr11 5211067 5211086 5211083 +
aagaaagaaattaacaattc

SEQ ID NO: 7062 - DNA, 20 bp, Artificial Sequence
  Synthetic oligonucleotide; CAG chr11 5211074 5211093 5211090 +
aaattaacaattcaggttgt

SEQ ID NO: 7063 - DNA, 20 bp, Artificial Sequence
  Synthetic oligonucleotide; AAG chr11 5211077 5211096 5211093 +
ttaacaattcaggttgtcag

SEQ ID NO: 7064 - DNA, 20 bp, Artificial Sequence
  Synthetic oligonucleotide; TAG chr11 5211101 5211120 5211117 +
aactgaatgtctttaacaaa

SEQ ID NO: 7065 - DNA, 20 bp, Artificial Sequence
  Synthetic oligonucleotide; AGG chr11 5211102 5211121 5211118 +
actgaatgtctttaacaaat

SEQ ID NO: 7066 - DNA, 20 bp, Artificial Sequence
  Synthetic oligonucleotide; GAG chr11 5211104 5211123 5211120 +
tgaatgtctttaacaaatag

SEQ ID NO: 7067 - DNA, 20 bp, Artificial Sequence
  Synthetic oligonucleotide; TAG chr11 5211110 5211129 5211126 +
tctttaacaaataggagcca

SEQ ID NO: 7068 - DNA, 20 bp, Artificial Sequence
  Synthetic oligonucleotide; AGG chr11 5211111 5211130 5211127 +
ctttaacaaataggagccat

SEQ ID NO: 7069 - DNA, 20 bp, Artificial Sequence
  Synthetic oligonucleotide; GAG chr11 5211136 5211155 5211152 +
taaattgctcacattatttt

SEQ ID NO: 7070 - DNA, 20 bp, Artificial Sequence
  Synthetic oligonucleotide; AGG chr11 5211137 5211156 5211153 +
aaattgctcacattattttg

SEQ ID NO: 7071 - DNA, 20 bp, Artificial Sequence
  Synthetic oligonucleotide; GGG chr11 5211138 5211157 5211154 +
aattgctcacattattttga

SEQ ID NO: 7072 - DNA, 20 bp, Artificial Sequence
  Synthetic oligonucleotide; CAG chr11 5211183 5211202 5211199 +
ttttacctccaacatatata

SEQ ID NO: 7073 - DNA, 20 bp, Artificial Sequence
  Synthetic oligonucleotide; TAG chr11 5211203 5211222 5211219 +
cagtttttatatttactata

SEQ ID NO: 7074 - DNA, 20 bp, Artificial Sequence
  Synthetic oligonucleotide; AGG chr11 5211204 5211223 5211220 +
agtttttatatttactatat

SEQ ID NO: 7075 - DNA, 20 bp, Artificial Sequence
  Synthetic oligonucleotide; AAG chr11 5211244 5211263 5211260 +
ttgcataaaatcaaattaca

SEQ ID NO: 7076 - DNA, 20 bp, Artificial Sequence
  Synthetic oligonucleotide; AAG chr11 5211247 5211266 5211263 +
cataaaatcaaattacaaag

SEQ ID NO: 7077 - DNA, 20 bp, Artificial Sequence
  Synthetic oligonucleotide; AGG chr11 5211248 5211267 5211264 +
ataaaatcaaattacaaaga

SEQ ID NO: 7078 - DNA, 20 bp, Artificial Sequence
  Synthetic oligonucleotide; CAG chr11 5211252 5211271 5211268 +
aatcaaattacaaagaagga

SEQ ID NO: 7079 - DNA, 20 bp, Artificial Sequence
  Synthetic oligonucleotide; GAG chr11 5211254 5211273 5211270 +
tcaaattacaaagaaggaca

SEQ ID NO: 7080 - DNA, 20 bp, Artificial Sequence
  Synthetic oligonucleotide; TAG chr11 5211301 5211320 5211317 +
cgcataaaacaacattttgt

SEQ ID NO: 7081 - DNA, 20 bp, Artificial Sequence
  Synthetic oligonucleotide; AAG chr11 5211314 5211333 5211330 +
attttgttagacttaaaaac

SEQ ID NO: 7082 - DNA, 20 bp, Artificial Sequence
  Synthetic oligonucleotide; AAG chr11 5211334 5211353 5211350 +
aagctgattataactataaa

SEQ ID NO: 7083 - DNA, 20 bp, Artificial Sequence
  Synthetic oligonucleotide; TAG chr11 5211349 5211368 5211365 +
ataaaaagatatgtgactaa

SEQ ID NO: 7084 - DNA, 20 bp, Artificial Sequence
  Synthetic oligonucleotide; AGG chr11 5211350 5211369 5211366 +
taaaaagatatgtgactaat

SEQ ID NO: 7085 - DNA, 20 bp, Artificial Sequence
  Synthetic oligonucleotide; TGG chr11 5211353 5211372 5211369 +
aaagatatgtgactaatagg

SEQ ID NO: 7086 - DNA, 20 bp, Artificial Sequence
  Synthetic oligonucleotide; AAG chr11 5211357 5211376 5211373 +
atatgtgactaataggtgga

SEQ ID NO: 7087 - DNA, 20 bp, Artificial Sequence
  Synthetic oligonucleotide; GAG chr11 5211359 5211378 5211375 +
atgtgactaataggtggaaa

SEQ ID NO: 7088 - DNA, 20 bp, Artificial Sequence
  Synthetic oligonucleotide; AGG chr11 5211360 5211379 5211376 +
tgtgactaataggtggaaag

SEQ ID NO: 7089 - DNA, 20 bp, Artificial Sequence
  Synthetic oligonucleotide; GAG chr11 5211362 5211381 5211378 +
tgactaataggtggaaagag

SEQ ID NO: 7090 - DNA, 20 bp, Artificial Sequence
  Synthetic oligonucleotide; AAG chr11 5211366 5211385 5211382 +
taataggtggaaagaggagc

SEQ ID NO: 7091 - DNA, 20 bp, Artificial Sequence
  Synthetic oligonucleotide; AGG chr11 5211367 5211386 5211383 +
aataggtggaaagaggagca

SEQ ID NO: 7092 - DNA, 20 bp, Artificial Sequence
  Synthetic oligonucleotide; AAG chr11 5211370 5211389 5211386 +
aggtggaaagaggagcaagg

SEQ ID NO: 7093 - DNA, 20 bp, Artificial Sequence
  Synthetic oligonucleotide; TGG chr11 5211380 5211399 5211396 +
aggagcaaggaagaataaaa

SEQ ID NO: 7094 - DNA, 20 bp, Artificial Sequence
  Synthetic oligonucleotide; GGG chr11 5211381 5211400 5211397 +
ggagcaaggaagaataaaat

SEQ ID NO: 7095 - DNA, 20 bp, Artificial Sequence
  Synthetic oligonucleotide; GAG chr11 5211383 5211402 5211399 +
agcaaggaagaataaaatgg

SEQ ID NO: 7096 - DNA, 20 bp, Artificial Sequence
  Synthetic oligonucleotide; AGG chr11 5211384 5211403 5211400 +
gcaaggaagaataaaatggg

SEQ ID NO: 7097 - DNA, 20 bp, Artificial Sequence
  Synthetic oligonucleotide; AAG chr11 5211388 5211407 5211404 +
ggaagaataaaatgggagga

SEQ ID NO: 7098 - DNA, 20 bp, Artificial Sequence
  Synthetic oligonucleotide; AAG chr11 5211399 5211418 5211415 +
atgggaggaaagaactgcta

SEQ ID NO: 7099 - DNA, 20 bp, Artificial Sequence
  Synthetic oligonucleotide; TGG chr11 5211410 5211429 5211426 +
gaactgctaaagactcacga

SEQ ID NO: 7100 - DNA, 20 bp, Artificial Sequence
  Synthetic oligonucleotide; TAG chr11 5211422 5211441 5211438 +
actcacgatggtttgttaca

SEQ ID NO: 7101 - DNA, 20 bp, Artificial Sequence
  Synthetic oligonucleotide; TGG chr11 5211439 5211458 5211455 +
acatagctaaacacatgtca

SEQ ID NO: 7102 - DNA, 20 bp, Artificial Sequence
  Synthetic oligonucleotide; GGG chr11 5211440 5211459 5211456 +
catagctaaacacatgtcat

SEQ ID NO: 7103 - DNA, 20 bp, Artificial Sequence
  Synthetic oligonucleotide; CAG chr11 5211452 5211471 5211468 +
catgtcatgggtttgtcgta

SEQ ID NO: 7104 - DNA, 20 bp, Artificial Sequence
  Synthetic oligonucleotide; CAG chr11 5211469 5211488 5211485 +
gtacagattatttcatctcc

SEQ ID NO: 7105 - DNA, 20 bp, Artificial Sequence
  Synthetic oligonucleotide; TAG chr11 5211479 5211498 5211495 +
tttcatctcccagtactcaa

SEQ ID NO: 7106 - DNA, 20 bp, Artificial Sequence
  Synthetic oligonucleotide; TAG chr11 5211527 5211546 5211543 +
tcccaccctccaaactcaat

SEQ ID NO: 7107 - DNA, 20 bp, Artificial Sequence
  Synthetic oligonucleotide; AGG chr11 5211528 5211547 5211544 +
cccaccctccaaactcaatt

SEQ ID NO: 7108 - DNA, 20 bp, Artificial Sequence
  Synthetic oligonucleotide; CAG chr11 5211534 5211553 5211550 +
ctccaaactcaattaggctg

SEQ ID NO: 7109 - DNA, 20 bp, Artificial Sequence
  Synthetic oligonucleotide; TAG chr11 5211578 5211597 5211594 +
gtgcatgttttctcatcatt

SEQ ID NO: 7110 - DNA, 20 bp, Artificial Sequence
  Synthetic oligonucleotide; AAG chr11 5211592 5211611 5211608 +
atcatttagttcctacttgt

SEQ ID NO: 7111 - DNA, 20 bp, Artificial Sequence
  Synthetic oligonucleotide; TAG chr11 5211605 5211624 5211621 +
tacttgtaagtgataatatg

SEQ ID NO: 7112 - DNA, 20 bp, Artificial Sequence
  Synthetic oligonucleotide; TGG chr11 5211612 5211631 5211628 +
aagtgataatatgtagtatt

SEQ ID NO: 7113 - DNA, 20 bp, Artificial Sequence
  Synthetic oligonucleotide; TAG chr11 5211631 5211650 5211647 +
ttggttttctgttcttacat

SEQ ID NO: 7114 - DNA, 20 bp, Artificial Sequence
  Synthetic oligonucleotide; AAG chr11 5211640 5211659 5211656 +
tgttcttacattagtttgtt

SEQ ID NO: 7115 - DNA, 20 bp, Artificial Sequence
  Synthetic oligonucleotide; AGG chr11 5211641 5211660 5211657 +
gttcttacattagtttgtta

SEQ ID NO: 7116 - DNA, 20 bp, Artificial Sequence
  Synthetic oligonucleotide; TGG chr11 5211648 5211667 5211664 +
cattagtttgttaaggataa

SEQ ID NO: 7117 - DNA, 20 bp, Artificial Sequence
  Synthetic oligonucleotide; CGG chr11 5211655 5211674 5211671 +
ttgttaaggataatggtgtc

SEQ ID NO: 7118 - DNA, 20 bp, Artificial Sequence
  Synthetic oligonucleotide; AAG chr11 5211677 5211696 5211693 +
gctccatccatgttcctgca

SEQ ID NO: 7119 - DNA, 20 bp, Artificial Sequence
  Synthetic oligonucleotide; AGG chr11 5211678 5211697 5211694 +
ctccatccatgttcctgcaa

SEQ ID NO: 7120 - DNA, 20 bp, Artificial Sequence
  Synthetic oligonucleotide; TGG chr11 5211702 5211721 5211718 +
catgatctcattctttttta

SEQ ID NO: 7121 - DNA, 20 bp, Artificial Sequence
  Synthetic oligonucleotide; TAG chr11 5211710 5211729 5211726 +
cattcttttttatggccaca

SEQ ID NO: 7122 - DNA, 20 bp, Artificial Sequence
  Synthetic oligonucleotide; TGG chr11 5211720 5211739 5211736 +
tatggccacatagtattcca

SEQ ID NO: 7123 - DNA, 20 bp, Artificial Sequence
  Synthetic oligonucleotide; CGG chr11 5211745 5211764 5211761 +
tatatgtacatgttctttat

SEQ ID NO: 7124 - DNA, 20 bp, Artificial Sequence
  Synthetic oligonucleotide; TGG chr11 5211759 5211778 5211775 +
ctttatcggtataccactaa

SEQ ID NO: 7125 - DNA, 20 bp, Artificial Sequence
  Synthetic oligonucleotide; GGG chr11 5211760 5211779 5211776 +
tttatcggtataccactaat

SEQ ID NO: 7126 - DNA, 20 bp, Artificial Sequence
  Synthetic oligonucleotide; CAG chr11 5211767 5211786 5211783 +
gtataccactaatgggcctt

SEQ ID NO: 7127 - DNA, 20 bp, Artificial Sequence
  Synthetic oligonucleotide; AGG chr11 5211768 5211787 5211784 +
tataccactaatgggccttc

SEQ ID NO: 7128 - DNA, 20 bp, Artificial Sequence
  Synthetic oligonucleotide; TGG chr11 5211808 5211827 5211824 +
ctattgtgattatgctgcaa

SEQ ID NO: 7129 - DNA, 20 bp, Artificial Sequence
  Synthetic oligonucleotide; CAG chr11 5211814 5211833 5211830 +
tgattatgctgcaatggaca

SEQ ID NO: 7130 - DNA, 20 bp, Artificial Sequence
  Synthetic oligonucleotide; AGG chr11 5211815 5211834 5211831 +
gattatgctgcaatggacac

SEQ ID NO: 7131 - DNA, 20 bp, Artificial Sequence
  Synthetic oligonucleotide; TAG chr11 5211837 5211856 5211853 +
gtgtgcatgtgtctttgtga

SEQ ID NO: 7132 - DNA, 20 bp, Artificial Sequence
  Synthetic oligonucleotide; TGG chr11 5211842 5211861 5211858 +
catgtgtctttgtgatagaa

SEQ ID NO: 7133 - DNA, 20 bp, Artificial Sequence
  Synthetic oligonucleotide; TAG chr11 5211857 5211876 5211873 +
tagaatggtttattttcctt

SEQ ID NO: 7134 - DNA, 20 bp, Artificial Sequence
  Synthetic oligonucleotide; AGG chr11 5211858 5211877 5211874 +
agaatggtttattttccttt

SEQ ID NO: 7135 - DNA, 20 bp, Artificial Sequence
  Synthetic oligonucleotide; TAG chr11 5211875 5211894 5211891 +
tttaggtatatactcaataa

SEQ ID NO: 7136 - DNA, 20 bp, Artificial Sequence
  Synthetic oligonucleotide; AGG chr11 5211876 5211895 5211892 +
ttaggtatatactcaataat

SEQ ID NO: 7137 - DNA, 20 bp, Artificial Sequence
  Synthetic oligonucleotide; TGG chr11 5211884 5211903 5211900 +
atactcaataataggattgt

SEQ ID NO: 7138 - DNA, 20 bp, Artificial Sequence
  Synthetic oligonucleotide; GGG chr11 5211885 5211904 5211901 +
tactcaataataggattgtt

SEQ ID NO: 7139 - DNA, 20 bp, Artificial Sequence
  Synthetic oligonucleotide; TGG chr11 5211893 5211912 5211909 +
aataggattgttgggttaaa

SEQ ID NO: 7140 - DNA, 20 bp, Artificial Sequence
  Synthetic oligonucleotide; TAG chr11 5211908 5211927 5211924 +
ttaaatggtatttctgtttt

SEQ ID NO: 7141 - DNA, 20 bp, Artificial Sequence
  Synthetic oligonucleotide; AGG chr11 5211909 5211928 5211925 +
taaatggtatttctgttttt

SEQ ID NO: 7142 - DNA, 20 bp, Artificial Sequence
  Synthetic oligonucleotide; TAG chr11 5211916 5211935 5211932 +
tatttctgtttttaggtctt

SEQ ID NO: 7143 - DNA, 20 bp, Artificial Sequence
  Synthetic oligonucleotide; AGG chr11 5211917 5211936 5211933 +
atttctgtttttaggtcttt

SEQ ID NO: 7144 - DNA, 20 bp, Artificial Sequence
  Synthetic oligonucleotide; GGG chr11 5211918 5211937 5211934 +
tttctgtttttaggtcttta

SEQ ID NO: 7145 - DNA, 20 bp, Artificial Sequence
  Synthetic oligonucleotide; TGG chr11 5211944 5211963 5211960 +
tgccacactgctgtctacaa

SEQ ID NO: 7146 - DNA, 20 bp, Artificial Sequence
  Synthetic oligonucleotide; TGG chr11 5211972 5211991 5211988 +
ctaatttatattgccaccaa

SEQ ID NO: 7147 - DNA, 20 bp, Artificial Sequence
  Synthetic oligonucleotide; TAG chr11 5212039 5212058 5212055 +
attttttgactatttaatta

SEQ ID NO: 7148 - DNA, 20 bp, Artificial Sequence
  Synthetic oligonucleotide; AAG chr11 5212049 5212068 5212065 +
tatttaattatagatatttt

SEQ ID NO: 7149 - DNA, 20 bp, Artificial Sequence
  Synthetic oligonucleotide; GAG chr11 5212058 5212077 5212074 +
atagatattttaagtgatgt

SEQ ID NO: 7150 - DNA, 20 bp, Artificial Sequence
  Synthetic oligonucleotide; TAG chr11 5212062 5212081 5212078 +
atattttaagtgatgtgaga

SEQ ID NO: 7151 - DNA, 20 bp, Artificial Sequence
  Synthetic oligonucleotide; TGG chr11 5212075 5212094 5212091 +
tgtgagatagtatctcattt

SEQ ID NO: 7152 - DNA, 20 bp, Artificial Sequence
  Synthetic oligonucleotide; GGG chr11 5212076 5212095 5212092 +
gtgagatagtatctcatttt

SEQ ID NO: 7153 - DNA, 20 bp, Artificial Sequence
  Synthetic oligonucleotide; TGG chr11 5212085 5212104 5212101 +
tatctcattttgggtttgat

SEQ ID NO: 7154 - DNA, 20 bp, Artificial Sequence
  Synthetic oligonucleotide; CAG chr11 5212103 5212122 5212119 +
attggcatttctctaatgat

SEQ ID NO: 7155 - DNA, 20 bp, Artificial Sequence
  Synthetic oligonucleotide; GAG chr11 5212113 5212132 5212129 +
ctctaatgatcagtgacact

SEQ ID NO: 7156 - DNA, 20 bp, Artificial Sequence
  Synthetic oligonucleotide; TGG chr11 5212131 5212150 5212147 +
ctgagcttttttcatatgct

SEQ ID NO: 7157 - DNA, 20 bp, Artificial Sequence
  Synthetic oligonucleotide; TGG chr11 5212134 5212153 5212150 +
agcttttttcatatgcttgg

SEQ ID NO: 7158 - DNA, 20 bp, Artificial Sequence
  Synthetic oligonucleotide; TGG chr11 5212193 5212212 5212209 +
tgtcctttacccattttttg

SEQ ID NO: 7159 - DNA, 20 bp, Artificial Sequence
  Synthetic oligonucleotide; TAG chr11 5212216 5212235 5212232 +
cattgtttgttttgttcttg

SEQ ID NO: 7160 - DNA, 20 bp, Artificial Sequence
  Synthetic oligonucleotide; AAG chr11 5212227 5212246 5212243 +
ttgttcttgtagattcattt

SEQ ID NO: 7161 - DNA, 20 bp, Artificial Sequence
  Synthetic oligonucleotide; TAG chr11 5212237 5212256 5212253 +
agattcatttaagttcctta

SEQ ID NO: 7162 - DNA, 20 bp, Artificial Sequence
  Synthetic oligonucleotide; TAG chr11 5212251 5212270 5212267 +
tccttatagattctgaatat

SEQ ID NO: 7163 - DNA, 20 bp, Artificial Sequence
  Synthetic oligonucleotide; AGG chr11 5212252 5212271 5212268 +
ccttatagattctgaatatt

SEQ ID NO: 7164 - DNA, 20 bp, Artificial Sequence
  Synthetic oligonucleotide; TGG chr11 5212262 5212281 5212278 +
tctgaatattaggcctttgt

SEQ ID NO: 7165 - DNA, 20 bp, Artificial Sequence
  Synthetic oligonucleotide; TAG chr11 5212270 5212289 5212286 +
ttaggcctttgttggatgca

SEQ ID NO: 7166 - DNA, 20 bp, Artificial Sequence
  Synthetic oligonucleotide; TAG chr11 5212298 5212317 5212314 +
aaaaattttctcccattcta

SEQ ID NO: 7167 - DNA, 20 bp, Artificial Sequence
  Synthetic oligonucleotide; AGG chr11 5212299 5212318 5212315 +
aaaattttctcccattctat

SEQ ID NO: 7168 - DNA, 20 bp, Artificial Sequence
  Synthetic oligonucleotide; CAG chr11 5212311 5212330 5212327 +
cattctataggttgtttact

SEQ ID NO: 7169 - DNA, 20 bp, Artificial Sequence
  Synthetic oligonucleotide; TAG chr11 5212318 5212337 5212334 +
taggttgtttactcagttga

SEQ ID NO: 7170 - DNA, 20 bp, Artificial Sequence
  Synthetic oligonucleotide; CAG chr11 5212335 5212354 5212351 +
tgatagtttcttttgctgtg

SEQ ID NO: 7171 - DNA, 20 bp, Artificial Sequence
  Synthetic oligonucleotide; TAG chr11 5212353 5212372 5212369 +
tgcagaaactttattttaat

SEQ ID NO: 7172 - DNA, 20 bp, Artificial Sequence
  Synthetic oligonucleotide; TGG chr11 5212395 5212414 5212411 +
gcttttgctgcaatgactgt

SEQ ID NO: 7173 - DNA, 20 bp, Artificial Sequence
  Synthetic oligonucleotide; CGG chr11 5212434 5212453 5212450 +
tctttgcccctgcttatgtc

SEQ ID NO: 7174 - DNA, 20 bp, Artificial Sequence
  Synthetic oligonucleotide; TGG chr11 5212439 5212458 5212455 +
gcccctgcttatgtccggaa

SEQ ID NO: 7175 - DNA, 20 bp, Artificial Sequence
  Synthetic oligonucleotide; TAG chr11 5212449 5212468 5212465 +
atgtccggaatggtattgcc

SEQ ID NO: 7176 - DNA, 20 bp, Artificial Sequence
  Synthetic oligonucleotide; AGG chr11 5212450 5212469 5212466 +
tgtccggaatggtattgcct

SEQ ID NO: 7177 - DNA, 20 bp, Artificial Sequence
  Synthetic oligonucleotide; AAG chr11 5212461 5212480 5212477 +
gtattgcctaggttgctttc

SEQ ID NO: 7178 - DNA, 20 bp, Artificial Sequence
  Synthetic oligonucleotide; TAG chr11 5212472 5212491 5212488 +
gttgctttcaagcattttta

SEQ ID NO: 7179 - DNA, 20 bp, Artificial Sequence
  Synthetic oligonucleotide; TGG chr11 5212477 5212496 5212493 +
tttcaagcatttttatagtt

SEQ ID NO: 7180 - DNA, 20 bp, Artificial Sequence
  Synthetic oligonucleotide; GGG chr11 5212478 5212497 5212494 +
ttcaagcatttttatagttt

SEQ ID NO: 7181 - DNA, 20 bp, Artificial Sequence
  Synthetic oligonucleotide; AAG chr11 5212491 5212510 5212507 +
atagtttgggttttgcattt

SEQ ID NO: 7182 - DNA, 20 bp, Artificial Sequence
  Synthetic oligonucleotide; GAG chr11 5212509 5212528 5212525 +
ttaagtctctaatccatctt

SEQ ID NO: 7183 - DNA, 20 bp, Artificial Sequence
  Synthetic oligonucleotide; TAG chr11 5212531 5212550 5212547 +
gtttatttgtgtatatgata

SEQ ID NO: 7184 - DNA, 20 bp, Artificial Sequence
  Synthetic oligonucleotide; CGG chr11 5212536 5212555 5212552 +
tttgtgtatatgatatagaa

SEQ ID NO: 7185 - DNA, 20 bp, Artificial Sequence
  Synthetic oligonucleotide; GGG chr11 5212537 5212556 5212553 +
ttgtgtatatgatatagaac

SEQ ID NO: 7186 - DNA, 20 bp, Artificial Sequence
  Synthetic oligonucleotide; GGG chr11 5212538 5212557 5212554 +
tgtgtatatgatatagaacg

SEQ ID NO: 7187 - DNA, 20 bp, Artificial Sequence
  Synthetic oligonucleotide; TGG chr11 5212543 5212562 5212559 +
atatgatatagaacggggtc

SEQ ID NO: 7188 - DNA, 20 bp, Artificial Sequence
  Synthetic oligonucleotide; CGG chr11 5212563 5212582 5212579 +
tggtttcaatcttctacata

SEQ ID NO: 7189 - DNA, 20 bp, Artificial Sequence
  Synthetic oligonucleotide; TAG chr11 5212567 5212586 5212583 +
ttcaatcttctacatacggt

SEQ ID NO: 7190 - DNA, 20 bp, Artificial Sequence
  Synthetic oligonucleotide; CAG chr11 5212571 5212590 5212587 +
atcttctacatacggttagt

SEQ ID NO: 7191 - DNA, 20 bp, Artificial Sequence
  Synthetic oligonucleotide; TAG chr11 5212597 5212616 5212613 +
tcccaacaccacttgttgaa

SEQ ID NO: 7192 - DNA, 20 bp, Artificial Sequence
  Synthetic oligonucleotide; AGG chr11 5212598 5212617 5212614 +
cccaacaccacttgttgaat

SEQ ID NO: 7193 - DNA, 20 bp, Artificial Sequence
  Synthetic oligonucleotide; GGG chr11 5212599 5212618 5212615 +
ccaacaccacttgttgaata

SEQ ID NO: 7194 - DNA, 20 bp, Artificial Sequence
  Synthetic oligonucleotide; CAG chr11 5212629 5212648 5212645 +
tcctcattgcttgtttttat

SEQ ID NO: 7195 - DNA, 20 bp, Artificial Sequence
  Synthetic oligonucleotide; AAG chr11 5212640 5212659 5212656 +
tgtttttatcagctttgtca

SEQ ID NO: 7196 - DNA, 20 bp, Artificial Sequence
  Synthetic oligonucleotide; CAG chr11 5212645 5212664 5212661 +
ttatcagctttgtcaaagat

SEQ ID NO: 7197 - DNA, 20 bp, Artificial Sequence
  Synthetic oligonucleotide; TGG chr11 5212649 5212668 5212665 +
cagctttgtcaaagatcaga

SEQ ID NO: 7198 - DNA, 20 bp, Artificial Sequence
  Synthetic oligonucleotide; TAG chr11 5212655 5212674 5212671 +
tgtcaaagatcagatggttg

SEQ ID NO: 7199 - DNA, 20 bp, Artificial Sequence
  Synthetic oligonucleotide; AGG chr11 5212656 5212675 5212672 +
gtcaaagatcagatggttgt

SEQ ID NO: 7200 - DNA, 20 bp, Artificial Sequence
  Synthetic oligonucleotide; TGG chr11 5212663 5212682 5212679 +
atcagatggttgtaggcatg

SEQ ID NO: 7201 - DNA, 20 bp, Artificial Sequence
  Synthetic oligonucleotide; TGG chr11 5212675 5212694 5212691 +
taggcatgtggtcttatttc

SEQ ID NO: 7202 - DNA, 20 bp, Artificial Sequence
  Synthetic oligonucleotide; GGG chr11 5212676 5212695 5212692 +
aggcatgtggtcttatttct

SEQ ID NO: 7203 - DNA, 20 bp, Artificial Sequence
  Synthetic oligonucleotide; CAG chr11 5212720 5212739 5212736 +
tctgtgtgtcttttctgtaa

SEQ ID NO: 7204 - DNA, 20 bp, Artificial Sequence
  Synthetic oligonucleotide; TGG chr11 5212736 5212755 5212752 +
gtaacagtaccacactgttt

SEQ ID NO: 7205 - DNA, 20 bp, Artificial Sequence
  Synthetic oligonucleotide; TAG chr11 5212745 5212764 5212761 +
ccacactgttttggttactg

SEQ ID NO: 7206 - DNA, 20 bp, Artificial Sequence
  Synthetic oligonucleotide; TGG chr11 5212753 5212772 5212769 +
ttttggttactgtagccctg

SEQ ID NO: 7207 - DNA, 20 bp, Artificial Sequence
  Synthetic oligonucleotide; TGG chr11 5212758 5212777 5212774 +
gttactgtagccctgtggta

SEQ ID NO: 7208 - DNA, 20 bp, Artificial Sequence
  Synthetic oligonucleotide; AAG chr11 5212765 5212784 5212781 +
tagccctgtggtatggtttg

SEQ ID NO: 7209 - DNA, 20 bp, Artificial Sequence
  Synthetic oligonucleotide; TAG chr11 5212769 5212788 5212785 +
cctgtggtatggtttgaagt

SEQ ID NO: 7210 - DNA, 20 bp, Artificial Sequence
  Synthetic oligonucleotide; AGG chr11 5212770 5212789 5212786 +
ctgtggtatggtttgaagtt

SEQ ID NO: 7211 - DNA, 20 bp, Artificial Sequence
  Synthetic oligonucleotide; CAG chr11 5212787 5212806 5212803 +
gttaggcaatgtattatctc

SEQ ID NO: 7212 - DNA, 20 bp, Artificial Sequence
  Synthetic oligonucleotide; AAG chr11 5212826 5212845 5212842 +
tttttttttttttgtactct

SEQ ID NO: 7213 - DNA, 20 bp, Artificial Sequence
  Synthetic oligonucleotide; CGG chr11 5212834 5212853 5212850 +
tttttgtactctaagttcta

SEQ ID NO: 7214 - DNA, 20 bp, Artificial Sequence
  Synthetic oligonucleotide; CAG chr11 5212845 5212864 5212861 +
taagttctacggtacctgtg

SEQ ID NO: 7215 - DNA, 20 bp, Artificial Sequence
  Synthetic oligonucleotide; TGG chr11 5212877 5212896 5212893 +
tatgtatacgtgtgccatat

SEQ ID NO: 7216 - DNA, 20 bp, Artificial Sequence
  Synthetic oligonucleotide; TAG chr11 5212911 5212930 5212927 +
cgttaactcgtcatttacat

SEQ ID NO: 7217 - DNA, 20 bp, Artificial Sequence
  Synthetic oligonucleotide; CAG chr11 5212959 5212978 5212975 +
tctctcctaccaccccacga

SEQ ID NO: 7218 - DNA, 20 bp, Artificial Sequence
  Synthetic oligonucleotide; AGG chr11 5212960 5212979 5212976 +
ctctcctaccaccccacgac

SEQ ID NO: 7219 - DNA, 20 bp, Artificial Sequence
  Synthetic oligonucleotide; CGG chr11 5212966 5212985 5212982 +
taccaccccacgacaggccc

SEQ ID NO: 7220 - DNA, 20 bp, Artificial Sequence
  Synthetic oligonucleotide; AAG chr11 5212995 5213014 5213011 +
atgttccccaccctgtgtcc

SEQ ID NO: 7221 - DNA, 20 bp, Artificial Sequence
  Synthetic oligonucleotide; GAG chr11 5213025 5213044 5213041 +
atttttcaattcccacctgt

SEQ ID NO: 7222 - DNA, 20 bp, Artificial Sequence
  Synthetic oligonucleotide; TAG chr11 5213031 5213050 5213047 +
caattcccacctgtgagtat

SEQ ID NO: 7223 - DNA, 20 bp, Artificial Sequence
  Synthetic oligonucleotide; AGG chr11 5213032 5213051 5213048 +
aattcccacctgtgagtatt

SEQ ID NO: 7224 - DNA, 20 bp, Artificial Sequence
  Synthetic oligonucleotide; TAG chr11 5213041 5213060 5213057 +
ctgtgagtattaggatttcc

SEQ ID NO: 7225 - DNA, 20 bp, Artificial Sequence
  Synthetic oligonucleotide; AGG chr11 5213042 5213061 5213058 +
tgtgagtattaggatttcct

SEQ ID NO: 7226 - DNA, 20 bp, Artificial Sequence
  Synthetic oligonucleotide; TGG chr11 5213050 5213069 5213066 +
ttaggatttcctaggctatt

SEQ ID NO: 7227 - DNA, 20 bp, Artificial Sequence
  Synthetic oligonucleotide; AAG chr11 5213085 5213104 5213101 +
gttgttccatatgaacttta

SEQ ID NO: 7228 - DNA, 20 bp, Artificial Sequence
  Synthetic oligonucleotide; TAG chr11 5213098 5213117 5213114 +
aactttaaagtgtatttttc

SEQ ID NO: 7229 - DNA, 20 bp, Artificial Sequence
  Synthetic oligonucleotide; AAG chr11 5213108 5213127 5213124 +
tgtatttttctagttctgtg

SEQ ID NO: 7230 - DNA, 20 bp, Artificial Sequence
  Synthetic oligonucleotide; TGG chr11 5213119 5213138 5213135 +
agttctgtgaagaatgtcat

SEQ ID NO: 7231 - DNA, 20 bp, Artificial Sequence
  Synthetic oligonucleotide; TAG chr11 5213122 5213141 5213138 +
tctgtgaagaatgtcattgg

SEQ ID NO: 7232 - DNA, 20 bp, Artificial Sequence
  Synthetic oligonucleotide; TAG chr11 5213130 5213149 5213146 +
gaatgtcattggtagtttga

SEQ ID NO: 7233 - DNA, 20 bp, Artificial Sequence
  Synthetic oligonucleotide; AGG chr11 5213131 5213150 5213147 +
aatgtcattggtagtttgat

SEQ ID NO: 7234 - DNA, 20 bp, Artificial Sequence
  Synthetic oligonucleotide; TAG chr11 5213136 5213155 5213152 +
cattggtagtttgataggaa

SEQ ID NO: 7235 - DNA, 20 bp, Artificial Sequence
  Synthetic oligonucleotide; TAG chr11 5213160 5213179 5213176 +
tttgaaactgtaaattgctc

SEQ ID NO: 7236 - DNA, 20 bp, Artificial Sequence
  Synthetic oligonucleotide; AGG chr11 5213161 5213180 5213177 +
ttgaaactgtaaattgctct

SEQ ID NO: 7237 - DNA, 20 bp, Artificial Sequence
  Synthetic oligonucleotide; CAG chr11 5213164 5213183 5213180 +
aaactgtaaattgctctagg

SEQ ID NO: 7238 - DNA, 20 bp, Artificial Sequence
  Synthetic oligonucleotide; TGG chr11 5213169 5213188 5213185 +
gtaaattgctctaggcagta

SEQ ID NO: 7239 - DNA, 20 bp, Artificial Sequence
  Synthetic oligonucleotide; GAG chr11 5213204 5213223 5213220 +
tattgattctttttatccat

SEQ ID NO: 7240 - DNA, 20 bp, Artificial Sequence
  Synthetic oligonucleotide; TGG chr11 5213209 5213228 5213225 +
attctttttatccatgagca

SEQ ID NO: 7241 - DNA, 20 bp, Artificial Sequence
  Synthetic oligonucleotide; AAG chr11 5213213 5213232 5213229 +
tttttatccatgagcatgga

SEQ ID NO: 7242 - DNA, 20 bp, Artificial Sequence
  Synthetic oligonucleotide; CAG chr11 5213235 5213254 5213251 +
gtttttccatttgtttctat

SEQ ID NO: 7243 - DNA, 20 bp, Artificial Sequence
  Synthetic oligonucleotide; GAG chr11 5213251 5213270 5213267 +
ctatcagctctgatttcttt

SEQ ID NO: 7244 - DNA, 20 bp, Artificial Sequence
  Synthetic oligonucleotide; CAG chr11 5213254 5213273 5213270 +
tcagctctgatttctttgag

SEQ ID NO: 7245 - DNA, 20 bp, Artificial Sequence
  Synthetic oligonucleotide; TAG chr11 5213276 5213295 5213292 +
gtgttttgtaaatctcattg

SEQ ID NO: 7246 - DNA, 20 bp, Artificial Sequence
  Synthetic oligonucleotide; GAG chr11 5213278 5213297 5213294 +
gttttgtaaatctcattgta

SEQ ID NO: 7247 - DNA, 20 bp, Artificial Sequence
  Synthetic oligonucleotide; TGG chr11 5213295 5213314 5213311 +
gtagagatctttcaactgct

SEQ ID NO: 7248 - DNA, 20 bp, Artificial Sequence
  Synthetic oligonucleotide; TAG chr11 5213299 5213318 5213315 +
agatctttcaactgcttggt

SEQ ID NO: 7249 - DNA, 20 bp, Artificial Sequence
  Synthetic oligonucleotide; TAG chr11 5213311 5213330 5213327 +
tgcttggttagatatatcct

SEQ ID NO: 7250 - DNA, 20 bp, Artificial Sequence
  Synthetic oligonucleotide; AGG chr11 5213312 5213331 5213328 +
gcttggttagatatatcctt

SEQ ID NO: 7251 - DNA, 20 bp, Artificial Sequence
  Synthetic oligonucleotide; TGG chr11 5213331 5213350 5213347 +
taggtattttattctttttg

SEQ ID NO: 7252 - DNA, 20 bp, Artificial Sequence
  Synthetic oligonucleotide; CGG chr11 5213337 5213356 5213353 +
ttttattctttttgtggcaa

SEQ ID NO: 7253 - DNA, 20 bp, Artificial Sequence
  Synthetic oligonucleotide; TGG chr11 5213344 5213363 5213360 +
ctttttgtggcaacggtaaa

SEQ ID NO: 7254 - DNA, 20 bp, Artificial Sequence
  Synthetic oligonucleotide; GGG chr11 5213345 5213364 5213361 +
tttttgtggcaacggtaaat

SEQ ID NO: 7255 - DNA, 20 bp, Artificial Sequence
  Synthetic oligonucleotide; TGG chr11 5213363 5213382 5213379 +
atgggattgacttcctgatt

SEQ ID NO: 7256 - DNA, 20 bp, Artificial Sequence
  Synthetic oligonucleotide; TAG chr11 5213369 5213388 5213385 +
ttgacttcctgatttggctc

SEQ ID NO: 7257 - DNA, 20 bp, Artificial Sequence
  Synthetic oligonucleotide; AGG chr11 5213370 5213389 5213386 +
tgacttcctgatttggctct

SEQ ID NO: 7258 - DNA, 20 bp, Artificial Sequence
  Synthetic oligonucleotide; TGG chr11 5213375 5213394 5213391 +
tcctgatttggctctaggct

SEQ ID NO: 7259 - DNA, 20 bp, Artificial Sequence
  Synthetic oligonucleotide; TGG chr11 5213392 5213411 5213408 +
gcttggctattgttgatgta

SEQ ID NO: 7260 - DNA, 20 bp, Artificial Sequence
  Synthetic oligonucleotide; GGG chr11 5213393 5213412 5213409 +
cttggctattgttgatgtat

SEQ ID NO: 7261 - DNA, 20 bp, Artificial Sequence
  Synthetic oligonucleotide; TAG chr11 5213401 5213420 5213417 +
ttgttgatgtatgggaatgc

SEQ ID NO: 7262 - DNA, 20 bp, Artificial Sequence
  Synthetic oligonucleotide; AAG chr11 5213444 5213463 5213460 +
tatatcctgaaactttgctg

SEQ ID NO: 7263 - DNA, 20 bp, Artificial Sequence
  Synthetic oligonucleotide; CAG chr11 5213451 5213470 5213467 +
tgaaactttgctgaagttat

SEQ ID NO: 7264 - DNA, 20 bp, Artificial Sequence
  Synthetic oligonucleotide; AAG chr11 5213457 5213476 5213473 +
tttgctgaagttatcagctg

SEQ ID NO: 7265 - DNA, 20 bp, Artificial Sequence
  Synthetic oligonucleotide; AGG chr11 5213458 5213477 5213474 +
ttgctgaagttatcagctga

SEQ ID NO: 7266 - DNA, 20 bp, Artificial Sequence
  Synthetic oligonucleotide; GAG chr11 5213460 5213479 5213476 +
gctgaagttatcagctgaag

SEQ ID NO: 7267 - DNA, 20 bp, Artificial Sequence
  Synthetic oligonucleotide; TGG chr11 5213467 5213486 5213483 +
ttatcagctgaaggagcttt

SEQ ID NO: 7268 - DNA, 20 bp, Artificial Sequence
  Synthetic oligonucleotide; GGG chr11 5213468 5213487 5213484 +
tatcagctgaaggagctttt

SEQ ID NO: 7269 - DNA, 20 bp, Artificial Sequence
  Synthetic oligonucleotide; TGG chr11 5213480 5213499 5213496 +
gagcttttgggccttgacta

SEQ ID NO: 7270 - DNA, 20 bp, Artificial Sequence
  Synthetic oligonucleotide; TAG chr11 5213490 5213509 5213506 +
gccttgactatggtgttttc

SEQ ID NO: 7271 - DNA, 20 bp, Artificial Sequence
  Synthetic oligonucleotide; CAG chr11 5213496 5213515 5213512 +
actatggtgttttctagata

SEQ ID NO: 7272 - DNA, 20 bp, Artificial Sequence
  Synthetic oligonucleotide; CAG chr11 5213503 5213522 5213519 +
tgttttctagatacagaaaa

SEQ ID NO: 7273 - DNA, 20 bp, Artificial Sequence
  Synthetic oligonucleotide; AGG chr11 5213504 5213523 5213520 +
gttttctagatacagaaaac

SEQ ID NO: 7274 - DNA, 20 bp, Artificial Sequence
  Synthetic oligonucleotide; GGG chr11 5213505 5213524 5213521 +
ttttctagatacagaaaaca

SEQ ID NO: 7275 - DNA, 20 bp, Artificial Sequence
  Synthetic oligonucleotide; TGG chr11 5213534 5213553 5213550 +
tgactttctctcttcctatt

SEQ ID NO: 7276 - DNA, 20 bp, Artificial Sequence
  Synthetic oligonucleotide; TGG chr11 5213571 5213590 5213587 +
cttctcttgcctgattgctc

SEQ ID NO: 7277 - DNA, 20 bp, Artificial Sequence
  Synthetic oligonucleotide; CAG chr11 5213575 5213594 5213591 +
tcttgcctgattgctctggc

SEQ ID NO: 7278 - DNA, 20 bp, Artificial Sequence
  Synthetic oligonucleotide; AGG chr11 5213576 5213595 5213592 +
cttgcctgattgctctggcc

SEQ ID NO: 7279 - DNA, 20 bp, Artificial Sequence
  Synthetic oligonucleotide; CAG chr11 5213584 5213603 5213600 +
attgctctggccaggactgc

SEQ ID NO: 7280 - DNA, 20 bp, Artificial Sequence
  Synthetic oligonucleotide; TAG chr11 5213599 5213618 5213615 +
actgccagtactatactgaa

SEQ ID NO: 7281 - DNA, 20 bp, Artificial Sequence
  Synthetic oligonucleotide; CAG chr11 5213602 5213621 5213618 +
gccagtactatactgaatag

SEQ ID NO: 7282 - DNA, 20 bp, Artificial Sequence
  Synthetic oligonucleotide; TGG chr11 5213605 5213624 5213621 +
agtactatactgaatagcag

SEQ ID NO: 7283 - DNA, 20 bp, Artificial Sequence
  Synthetic oligonucleotide; GAG chr11 5213609 5213628 5213625 +
ctatactgaatagcagtggt

SEQ ID NO: 7284 - DNA, 20 bp, Artificial Sequence
  Synthetic oligonucleotide; GAG chr11 5213611 5213630 5213627 +
atactgaatagcagtggtga

SEQ ID NO: 7285 - DNA, 20 bp, Artificial Sequence
  Synthetic oligonucleotide; GAG chr11 5213613 5213632 5213629 +
actgaatagcagtggtgaga

SEQ ID NO: 7286 - DNA, 20 bp, Artificial Sequence
  Synthetic oligonucleotide; AGG chr11 5213614 5213633 5213630 +
ctgaatagcagtggtgagag

SEQ ID NO: 7287 - DNA, 20 bp, Artificial Sequence
  Synthetic oligonucleotide; GGG chr11 5213615 5213634 5213631 +
tgaatagcagtggtgagaga

SEQ ID NO: 7288 - DNA, 20 bp, Artificial Sequence
  Synthetic oligonucleotide; CAG chr11 5213634 5213653 5213650 +
agggcatccttgtcttgtgc

SEQ ID NO: 7289 - DNA, 20 bp, Artificial Sequence
  Synthetic oligonucleotide; AAG chr11 5213642 5213661 5213658 +
cttgtcttgtgccagttttc

SEQ ID NO: 7290 - DNA, 20 bp, Artificial Sequence
  Synthetic oligonucleotide; AAG chr11 5213645 5213664 5213661 +
gtcttgtgccagttttcaag

SEQ ID NO: 7291 - DNA, 20 bp, Artificial Sequence
  Synthetic oligonucleotide; CAG chr11 5213656 5213675 5213672 +
gttttcaagaagaatgcttc

SEQ ID NO: 7292 - DNA, 20 bp, Artificial Sequence
  Synthetic oligonucleotide; AGG chr11 5213657 5213676 5213673 +
ttttcaagaagaatgcttcc

SEQ ID NO: 7293 - DNA, 20 bp, Artificial Sequence
  Synthetic oligonucleotide; TGG chr11 5213682 5213701 5213698 +
ttgcccattctgtatgatgt

SEQ ID NO: 7294 - DNA, 20 bp, Artificial Sequence
  Synthetic oligonucleotide; TGG chr11 5213688 5213707 5213704 +
attctgtatgatgttggctg

SEQ ID NO: 7295 - DNA, 20 bp, Artificial Sequence
  Synthetic oligonucleotide; GGG chr11 5213689 5213708 5213705 +
ttctgtatgatgttggctgt

SEQ ID NO: 7296 - DNA, 20 bp, Artificial Sequence
  Synthetic oligonucleotide; TAG chr11 5213699 5213718 5213715 +
tgttggctgtgggtttgtca

SEQ ID NO: 7297 - DNA, 20 bp, Artificial Sequence
  Synthetic oligonucleotide; TGG chr11 5213703 5213722 5213719 +
ggctgtgggtttgtcataga

SEQ ID NO: 7298 - DNA, 20 bp, Artificial Sequence
  Synthetic oligonucleotide; GAG chr11 5213719 5213738 5213735 +
tagatggctcatattatttt

SEQ ID NO: 7299 - DNA, 20 bp, Artificial Sequence
  Synthetic oligonucleotide; AGG chr11 5213720 5213739 5213736 +
agatggctcatattattttg

SEQ ID NO: 7300 - DNA, 20 bp, Artificial Sequence
  Synthetic oligonucleotide; TAG chr11 5213736 5213755 5213752 +
tttgaggtcatgtccttaaa

SEQ ID NO: 7301 - DNA, 20 bp, Artificial Sequence
  Synthetic oligonucleotide; TAG chr11 5213740 5213759 5213756 +
aggtcatgtccttaaatagc

SEQ ID NO: 7302 - DNA, 20 bp, Artificial Sequence
  Synthetic oligonucleotide; GAG chr11 5213749 5213768 5213765 +
ccttaaatagctagtttgtt

SEQ ID NO: 7303 - DNA, 20 bp, Artificial Sequence
  Synthetic oligonucleotide; GAG chr11 5213751 5213770 5213767 +
ttaaatagctagtttgttga

SEQ ID NO: 7304 - DNA, 20 bp, Artificial Sequence
  Synthetic oligonucleotide; AGG chr11 5213752 5213771 5213768 +
taaatagctagtttgttgag

SEQ ID NO: 7305 - DNA, 20 bp, Artificial Sequence
  Synthetic oligonucleotide; AAG chr11 5213765 5213784 5213781 +
tgttgagaggttttaacatg

SEQ ID NO: 7306 - DNA, 20 bp, Artificial Sequence
  Synthetic oligonucleotide; AAG chr11 5213770 5213789 5213786 +
agaggttttaacatgaagtg

SEQ ID NO: 7307 - DNA, 20 bp, Artificial Sequence
  Synthetic oligonucleotide; TGG chr11 5213819 5213838 5213835 +
cacatattgaaatgatcatg

SEQ ID NO: 7308 - DNA, 20 bp, Artificial Sequence
  Synthetic oligonucleotide; TAG chr11 5213832 5213851 5213848 +
gatcatgtggtttctgtttt

SEQ ID NO: 7309 - DNA, 20 bp, Artificial Sequence
  Synthetic oligonucleotide; CAG chr11 5213895 5213914 5213911 +
gctgaaccaatcttgcttct

SEQ ID NO: 7310 - DNA, 20 bp, Artificial Sequence
  Synthetic oligonucleotide; AGG chr11 5213896 5213915 5213912 +
ctgaaccaatcttgcttctc

SEQ ID NO: 7311 - DNA, 20 bp, Artificial Sequence
  Synthetic oligonucleotide; GGG chr11 5213897 5213916 5213913 +
tgaaccaatcttgcttctca

SEQ ID NO: 7312 - DNA, 20 bp, Artificial Sequence
  Synthetic oligonucleotide; AAG chr11 5213903 5213922 5213919 +
aatcttgcttctcagggata

SEQ ID NO: 7313 - DNA, 20 bp, Artificial Sequence
  Synthetic oligonucleotide; GAG chr11 5213917 5213936 5213933 +
gggataaagcctacttgatt

SEQ ID NO: 7314 - DNA, 20 bp, Artificial Sequence
  Synthetic oligonucleotide; AGG chr11 5213918 5213937 5213934 +
ggataaagcctacttgattg

SEQ ID NO: 7315 - DNA, 20 bp, Artificial Sequence
  Synthetic oligonucleotide; TGG chr11 5213921 5213940 5213937 +
taaagcctacttgattgagg

SEQ ID NO: 7316 - DNA, 20 bp, Artificial Sequence
  Synthetic oligonucleotide; TAG chr11 5213926 5213945 5213942 +
cctacttgattgaggtggat

SEQ ID NO: 7317 - DNA, 20 bp, Artificial Sequence
  Synthetic oligonucleotide; TGG chr11 5213945 5213964 5213961 +
ttagctttgtgatgtgttgc

SEQ ID NO: 7318 - DNA, 20 bp, Artificial Sequence
  Synthetic oligonucleotide; TGG chr11 5213951 5213970 5213967 +
ttgtgatgtgttgctggatt

SEQ ID NO: 7319 - DNA, 20 bp, Artificial Sequence
  Synthetic oligonucleotide; TAG chr11 5213959 5213978 5213975 +
tgttgctggatttggcttgc

SEQ ID NO: 7320 - DNA, 20 bp, Artificial Sequence
  Synthetic oligonucleotide; AAG chr11 5213981 5214000 5213997 +
gtatttttgcatcaatgttc

SEQ ID NO: 7321 - DNA, 20 bp, Artificial Sequence
  Synthetic oligonucleotide; AGG chr11 5213982 5214001 5213998 +
tatttttgcatcaatgttca

SEQ ID NO: 7322 - DNA, 20 bp, Artificial Sequence
  Synthetic oligonucleotide; TGG chr11 5213989 5214008 5214005 +
gcatcaatgttcaaggatat

SEQ ID NO: 7323 - DNA, 20 bp, Artificial Sequence
  Synthetic oligonucleotide; AAG chr11 5213996 5214015 5214012 +
tgttcaaggatattggcctg

SEQ ID NO: 7324 - DNA, 20 bp, Artificial Sequence
  Synthetic oligonucleotide; CAG chr11 5214027 5214046 5214043 +
ttttgttgttgtgtgtctat

SEQ ID NO: 7325 - DNA, 20 bp, Artificial Sequence
  Synthetic oligonucleotide; AGG chr11 5214028 5214047 5214044 +
tttgttgttgtgtgtctatc

SEQ ID NO: 7326 - DNA, 20 bp, Artificial Sequence
  Synthetic oligonucleotide; TGG chr11 5214034 5214053 5214050 +
gttgtgtgtctatcaggttt

SEQ ID NO: 7327 - DNA, 20 bp, Artificial Sequence
  Synthetic oligonucleotide; CAG chr11 5214040 5214059 5214056 +
tgtctatcaggttttggtat

SEQ ID NO: 7328 - DNA, 20 bp, Artificial Sequence
  Synthetic oligonucleotide; AGG chr11 5214041 5214060 5214057 +
gtctatcaggttttggtatc

SEQ ID NO: 7329 - DNA, 20 bp, Artificial Sequence
  Synthetic oligonucleotide; TGG chr11 5214051 5214070 5214067 +
ttttggtatcaggatgatgc

SEQ ID NO: 7330 - DNA, 20 bp, Artificial Sequence
  Synthetic oligonucleotide; GAG chr11 5214065 5214084 5214081 +
tgatgctggcctcataaaat

SEQ ID NO: 7331 - DNA, 20 bp, Artificial Sequence
  Synthetic oligonucleotide; GAG chr11 5214070 5214089 5214086 +
ctggcctcataaaatgagct

SEQ ID NO: 7332 - DNA, 20 bp, Artificial Sequence
  Synthetic oligonucleotide; AGG chr11 5214071 5214090 5214087 +
tggcctcataaaatgagctg

SEQ ID NO: 7333 - DNA, 20 bp, Artificial Sequence
  Synthetic oligonucleotide; TGG chr11 5214098 5214117 5214114 +
atccctccccctcaattttt

SEQ ID NO: 7334 - DNA, 20 bp, Artificial Sequence
  Synthetic oligonucleotide; GAG chr11 5214100 5214119 5214116 +
ccctccccctcaattttttg

SEQ ID NO: 7335 - DNA, 20 bp, Artificial Sequence
  Synthetic oligonucleotide; TAG chr11 5214103 5214122 5214119 +
tccccctcaattttttggag

SEQ ID NO: 7336 - DNA, 20 bp, Artificial Sequence
  Synthetic oligonucleotide; CAG chr11 5214109 5214128 5214125 +
tcaattttttggagtagctt

SEQ ID NO: 7337 - DNA, 20 bp, Artificial Sequence
  Synthetic oligonucleotide; TAG chr11 5214112 5214131 5214128 +
attttttggagtagcttcag

SEQ ID NO: 7338 - DNA, 20 bp, Artificial Sequence
  Synthetic oligonucleotide; AGG chr11 5214113 5214132 5214129 +
ttttttggagtagcttcagt

SEQ ID NO: 7339 - DNA, 20 bp, Artificial Sequence
  Synthetic oligonucleotide; TAG chr11 5214146 5214165 5214162 +
actcttctttgtgcatctga

SEQ ID NO: 7340 - DNA, 20 bp, Artificial Sequence
  Synthetic oligonucleotide; TGG chr11 5214153 5214172 5214169 +
tttgtgcatctgatagaatt

SEQ ID NO: 7341 - DNA, 20 bp, Artificial Sequence
  Synthetic oligonucleotide; CAG chr11 5214173 5214192 5214189 +
tggttgtgaatcatattgtc

SEQ ID NO: 7342 - DNA, 20 bp, Artificial Sequence
  Synthetic oligonucleotide; AGG chr11 5214174 5214193 5214190 +
ggttgtgaatcatattgtcc

SEQ ID NO: 7343 - DNA, 20 bp, Artificial Sequence
  Synthetic oligonucleotide; GGG chr11 5214175 5214194 5214191 +
gttgtgaatcatattgtcca

SEQ ID NO: 7344 - DNA, 20 bp, Artificial Sequence
  Synthetic oligonucleotide; TAG chr11 5214192 5214211 5214208 +
ccagggctttttttgtttga

SEQ ID NO: 7345 - DNA, 20 bp, Artificial Sequence
  Synthetic oligonucleotide; AGG chr11 5214193 5214212 5214209 +
cagggctttttttgtttgat

SEQ ID NO: 7346 - DNA, 20 bp, Artificial Sequence
  Synthetic oligonucleotide; CAG chr11 5214218 5214237 5214234 +
atttattactgaatcatttt

SEQ ID NO: 7347 - DNA, 20 bp, Artificial Sequence
  Synthetic oligonucleotide; GAG chr11 5214220 5214239 5214236 +
ttattactgaatcattttca

SEQ ID NO: 7348 - DNA, 20 bp, Artificial Sequence
  Synthetic oligonucleotide; TGG chr11 5214230 5214249 5214246 +
atcattttcagagctcatca

SEQ ID NO: 7349 - DNA, 20 bp, Artificial Sequence
  Synthetic oligonucleotide; CAG chr11 5214240 5214259 5214256 +
gagctcatcatggatctctt

SEQ ID NO: 7350 - DNA, 20 bp, Artificial Sequence
  Synthetic oligonucleotide; AGG chr11 5214241 5214260 5214257 +
agctcatcatggatctcttc

SEQ ID NO: 7351 - DNA, 20 bp, Artificial Sequence
  Synthetic oligonucleotide; TGG chr11 5214259 5214278 5214275 +
tcaggaaattgatttcttcc

SEQ ID NO: 7352 - DNA, 20 bp, Artificial Sequence
  Synthetic oligonucleotide; CAG chr11 5214264 5214283 5214280 +
aaattgatttcttcctggtt

SEQ ID NO: 7353 - DNA, 20 bp, Artificial Sequence
  Synthetic oligonucleotide; TGG chr11 5214270 5214289 5214286 +
atttcttcctggttcagcct

SEQ ID NO: 7354 - DNA, 20 bp, Artificial Sequence
  Synthetic oligonucleotide; GGG chr11 5214271 5214290 5214287 +
tttcttcctggttcagcctt

SEQ ID NO: 7355 - DNA, 20 bp, Artificial Sequence
  Synthetic oligonucleotide; GAG chr11 5214273 5214292 5214289 +
tcttcctggttcagccttgg

SEQ ID NO: 7356 - DNA, 20 bp, Artificial Sequence
  Synthetic oligonucleotide; AGG chr11 5214274 5214293 5214290 +
cttcctggttcagccttggg

SEQ ID NO: 7357 - DNA, 20 bp, Artificial Sequence
  Synthetic oligonucleotide; CAG chr11 5214292 5214311 5214308 +
ggaggacctaaaacaatcct

SEQ ID NO: 7358 - DNA, 20 bp, Artificial Sequence
  Synthetic oligonucleotide; CAG chr11 5214328 5214347 5214344 +
aaaatcatatcaatcactct

SEQ ID NO: 7359 - DNA, 20 bp, Artificial Sequence
  Synthetic oligonucleotide; CAG chr11 5214335 5214354 5214351 +
tatcaatcactctcagacca

SEQ ID NO: 7360 - DNA, 20 bp, Artificial Sequence
  Synthetic oligonucleotide; GAG chr11 5214337 5214356 5214353 +
tcaatcactctcagaccaca

SEQ ID NO: 7361 - DNA, 20 bp, Artificial Sequence
  Synthetic oligonucleotide; AGG chr11 5214338 5214357 5214354 +
caatcactctcagaccacag

SEQ ID NO: 7362 - DNA, 20 bp, Artificial Sequence
  Synthetic oligonucleotide; TAG chr11 5214349 5214368 5214365 +
agaccacagaggaataaaaa

SEQ ID NO: 7363 - DNA, 20 bp, Artificial Sequence
  Synthetic oligonucleotide; AAG chr11 5214357 5214376 5214373 +
gaggaataaaaatagatttc

SEQ ID NO: 7364 - DNA, 20 bp, Artificial Sequence
  Synthetic oligonucleotide; TAG chr11 5214369 5214388 5214385 +
tagatttcaagactaatgaa

SEQ ID NO: 7365 - DNA, 20 bp, Artificial Sequence
  Synthetic oligonucleotide; TGG chr11 5214392 5214411 5214408 +
ctgaaaactatgcaattaca

SEQ ID NO: 7366 - DNA, 20 bp, Artificial Sequence
  Synthetic oligonucleotide; TGG chr11 5214425 5214444 5214441 +
acctgctcctgaatgaattt

SEQ ID NO: 7367 - DNA, 20 bp, Artificial Sequence
  Synthetic oligonucleotide; GGG chr11 5214426 5214445 5214442 +
cctgctcctgaatgaatttt

SEQ ID NO: 7368 - DNA, 20 bp, Artificial Sequence
  Synthetic oligonucleotide; AAG chr11 5214444 5214463 5214460 +
ttgggtaaataatgaaaact

SEQ ID NO: 7369 - DNA, 20 bp, Artificial Sequence
  Synthetic oligonucleotide; AGG chr11 5214445 5214464 5214461 +
tgggtaaataatgaaaacta

SEQ ID NO: 7370 - DNA, 20 bp, Artificial Sequence
  Synthetic oligonucleotide; TAG chr11 5214459 5214478 5214475 +
aaactaaggcaaaaataaaa

SEQ ID NO: 7371 - DNA, 20 bp, Artificial Sequence
  Synthetic oligonucleotide; GAG chr11 5214477 5214496 5214493 +
aatagttctttgaaactaat

SEQ ID NO: 7372 - DNA, 20 bp, Artificial Sequence
  Synthetic oligonucleotide; AAG chr11 5214484 5214503 5214500 +
ctttgaaactaatgagaaca

SEQ ID NO: 7373 - DNA, 20 bp, Artificial Sequence
  Synthetic oligonucleotide; CGG chr11 5214498 5214517 5214514 +
agaacaaagatacaatatac

SEQ ID NO: 7374 - DNA, 20 bp, Artificial Sequence
  Synthetic oligonucleotide; TGG chr11 5214507 5214526 5214523 +
atacaatataccggaatctc

SEQ ID NO: 7375 - DNA, 20 bp, Artificial Sequence
  Synthetic oligonucleotide; GGG chr11 5214508 5214527 5214524 +
tacaatataccggaatctct

SEQ ID NO: 7376 - DNA, 20 bp, Artificial Sequence
  Synthetic oligonucleotide; CAG chr11 5214514 5214533 5214530 +
ataccggaatctctgggaca

SEQ ID NO: 7377 - DNA, 20 bp, Artificial Sequence
  Synthetic oligonucleotide; TAG chr11 5214519 5214538 5214535 +
ggaatctctgggacacagct

SEQ ID NO: 7378 - DNA, 20 bp, Artificial Sequence
  Synthetic oligonucleotide; CAG chr11 5214523 5214542 5214539 +
tctctgggacacagcttaga

SEQ ID NO: 7379 - DNA, 20 bp, Artificial Sequence
  Synthetic oligonucleotide; AAG chr11 5214530 5214549 5214546 +
gacacagcttagacagtgtt

SEQ ID NO: 7380 - DNA, 20 bp, Artificial Sequence
  Synthetic oligonucleotide; GAG chr11 5214532 5214551 5214548 +
cacagcttagacagtgttaa

SEQ ID NO: 7381 - DNA, 20 bp, Artificial Sequence
  Synthetic oligonucleotide; GAG chr11 5214534 5214553 5214550 +
cagcttagacagtgttaaga

SEQ ID NO: 7382 - DNA, 20 bp, Artificial Sequence
  Synthetic oligonucleotide; AAG chr11 5214566 5214585 5214582 +
cactaaatgcccacatcaaa

SEQ ID NO: 7383 - DNA, 20 bp, Artificial Sequence
  Synthetic oligonucleotide; AAG chr11 5214574 5214593 5214590 +
gcccacatcaaaaagtctta

SEQ ID NO: 7384 - DNA, 20 bp, Artificial Sequence
  Synthetic oligonucleotide; AAG chr11 5214609 5214628 5214625 +
caacctaatgtcacaactaa

SEQ ID NO: 7385 - DNA, 20 bp, Artificial Sequence
  Synthetic oligonucleotide; CAG chr11 5214615 5214634 5214631 +
aatgtcacaactaaaagaac

SEQ ID NO: 7386 - DNA, 20 bp, Artificial Sequence
  Synthetic oligonucleotide; GAG chr11 5214617 5214636 5214633 +
tgtcacaactaaaagaacca

SEQ ID NO: 7387 - DNA, 20 bp, Artificial Sequence
  Synthetic oligonucleotide; AAG chr11 5214624 5214643 5214640 +
actaaaagaaccagagaacc

SEQ ID NO: 7388 - DNA, 20 bp, Artificial Sequence
  Synthetic oligonucleotide; GAG chr11 5214626 5214645 5214642 +
taaaagaaccagagaaccaa

SEQ ID NO: 7389 - DNA, 20 bp, Artificial Sequence
  Synthetic oligonucleotide; TAG chr11 5214646 5214665 5214662 +
gagcaaaccaaccctaaatc

SEQ ID NO: 7390 - DNA, 20 bp, Artificial Sequence
  Synthetic oligonucleotide; CAG chr11 5214649 5214668 5214665 +
caaaccaaccctaaatctag

SEQ ID NO: 7391 - DNA, 20 bp, Artificial Sequence
  Synthetic oligonucleotide; AAG chr11 5214652 5214671 5214668 +
accaaccctaaatctagcag

SEQ ID NO: 7392 - DNA, 20 bp, Artificial Sequence
  Synthetic oligonucleotide; AAG chr11 5214657 5214676 5214673 +
ccctaaatctagcagaagac

SEQ ID NO: 7393 - DNA, 20 bp, Artificial Sequence
  Synthetic oligonucleotide; AAG chr11 5214668 5214687 5214684 +
gcagaagacaagaaataaac

SEQ ID NO: 7394 - DNA, 20 bp, Artificial Sequence
  Synthetic oligonucleotide; AAG chr11 5214675 5214694 5214691 +
acaagaaataaacaagatca

SEQ ID NO: 7395 - DNA, 20 bp, Artificial Sequence
  Synthetic oligonucleotide; AAG chr11 5214685 5214704 5214701 +
aacaagatcaaagctaactg

SEQ ID NO: 7396 - DNA, 20 bp, Artificial Sequence
  Synthetic oligonucleotide; AGG chr11 5214686 5214705 5214702 +
acaagatcaaagctaactga

SEQ ID NO: 7397 - DNA, 20 bp, Artificial Sequence
  Synthetic oligonucleotide; AAG chr11 5214715 5214734 5214731 +
aaacacaaaataccattcaa

SEQ ID NO: 7398 - DNA, 20 bp, Artificial Sequence
  Synthetic oligonucleotide; GAG chr11 5214724 5214743 5214740 +
ataccattcaaaagattaat

SEQ ID NO: 7399 - DNA, 20 bp, Artificial Sequence
  Synthetic oligonucleotide; AAG chr11 5214730 5214749 5214746 +
ttcaaaagattaatgagtcc

SEQ ID NO: 7400 - DNA, 20 bp, Artificial Sequence
  Synthetic oligonucleotide; GAG chr11 5214732 5214751 5214748 +
caaaagattaatgagtccaa

SEQ ID NO: 7401 - DNA, 20 bp, Artificial Sequence
  Synthetic oligonucleotide; TGG chr11 5214736 5214755 5214752 +
agattaatgagtccaagagc

SEQ ID NO: 7402 - DNA, 20 bp, Artificial Sequence
  Synthetic oligonucleotide; AAG chr11 5214757 5214776 5214773 +
ggttttgtgaaaaaattaat

SEQ ID NO: 7403 - DNA, 20 bp, Artificial Sequence
  Synthetic oligonucleotide; AGG chr11 5214758 5214777 5214774 +
gttttgtgaaaaaattaata

SEQ ID NO: 7404 - DNA, 20 bp, Artificial Sequence
  Synthetic oligonucleotide; TAG chr11 5214761 5214780 5214777 +
ttgtgaaaaaattaataagg

SEQ ID NO: 7405 - DNA, 20 bp, Artificial Sequence
  Synthetic oligonucleotide; TAG chr11 5214769 5214788 5214785 +
aaattaataaggtagatcac

SEQ ID NO: 7406 - DNA, 20 bp, Artificial Sequence
  Synthetic oligonucleotide; TAG chr11 5214773 5214792 5214789 +
taataaggtagatcactagc

SEQ ID NO: 7407 - DNA, 20 bp, Artificial Sequence
  Synthetic oligonucleotide; AAG chr11 5214783 5214802 5214799 +
gatcactagctagactaata

SEQ ID NO: 7408 - DNA, 20 bp, Artificial Sequence
  Synthetic oligonucleotide; AAG chr11 5214786 5214805 5214802 +
cactagctagactaataaag

SEQ ID NO: 7409 - DNA, 20 bp, Artificial Sequence
  Synthetic oligonucleotide; AAG chr11 5214791 5214810 5214807 +
gctagactaataaagaagac

SEQ ID NO: 7410 - DNA, 20 bp, Artificial Sequence
  Synthetic oligonucleotide; GAG chr11 5214793 5214812 5214809 +
tagactaataaagaagacaa

SEQ ID NO: 7411 - DNA, 20 bp, Artificial Sequence
  Synthetic oligonucleotide; GAG chr11 5214795 5214814 5214811 +
gactaataaagaagacaaga

SEQ ID NO: 7412 - DNA, 20 bp, Artificial Sequence
  Synthetic oligonucleotide; AAG chr11 5214798 5214817 5214814 +
taataaagaagacaagagag

SEQ ID NO: 7413 - DNA, 20 bp, Artificial Sequence
  Synthetic oligonucleotide; AAG chr11 5214809 5214828 5214825 +
acaagagagaagatccaaat

SEQ ID NO: 7414 - DNA, 20 bp, Artificial Sequence
  Synthetic oligonucleotide; CAG chr11 5214814 5214833 5214830 +
agagaagatccaaataagca

SEQ ID NO: 7415 - DNA, 20 bp, Artificial Sequence
  Synthetic oligonucleotide; TAG chr11 5214818 5214837 5214834 +
aagatccaaataagcacagt

SEQ ID NO: 7416 - DNA, 20 bp, Artificial Sequence
  Synthetic oligonucleotide; AAG chr11 5214829 5214848 5214845 +
aagcacagttagaaatgaaa

SEQ ID NO: 7417 - DNA, 20 bp, Artificial Sequence
  Synthetic oligonucleotide; AGG chr11 5214830 5214849 5214846 +
agcacagttagaaatgaaaa

SEQ ID NO: 7418 - DNA, 20 bp, Artificial Sequence
  Synthetic oligonucleotide; GGG chr11 5214831 5214850 5214847 +
gcacagttagaaatgaaaaa

SEQ ID NO: 7419 - DNA, 20 bp, Artificial Sequence
  Synthetic oligonucleotide; CAG chr11 5214853 5214872 5214869 +
gaatattatcactcacccca

SEQ ID NO: 7420 - DNA, 20 bp, Artificial Sequence
  Synthetic oligonucleotide; TAG chr11 5214907 5214926 5214923 +
acatctctatgtacataaac

SEQ ID NO: 7421 - DNA, 20 bp, Artificial Sequence
  Synthetic oligonucleotide; AAG chr11 5214919 5214938 5214935 +
acataaactagaaaatctaa

SEQ ID NO: 7422 - DNA, 20 bp, Artificial Sequence
  Synthetic oligonucleotide; TGG chr11 5214925 5214944 5214941 +
actagaaaatctaaaagaaa

SEQ ID NO: 7423 - DNA, 20 bp, Artificial Sequence
  Synthetic oligonucleotide; TGG chr11 5214937 5214956 5214953 +
aaaagaaatggataacttcc

SEQ ID NO: 7424 - DNA, 20 bp, Artificial Sequence
  Synthetic oligonucleotide; TAG chr11 5214954 5214973 5214970 +
tcctggactgctcattgtct

SEQ ID NO: 7425 - DNA, 20 bp, Artificial Sequence
  Synthetic oligonucleotide; AGG chr11 5214955 5214974 5214971 +
cctggactgctcattgtctt

SEQ ID NO: 7426 - DNA, 20 bp, Artificial Sequence
  Synthetic oligonucleotide; AAG chr11 5214960 5214979 5214976 +
actgctcattgtcttaggca

SEQ ID NO: 7427 - DNA, 20 bp, Artificial Sequence
  Synthetic oligonucleotide; AAG chr11 5214963 5214982 5214979 +
gctcattgtcttaggcaaag

SEQ ID NO: 7428 - DNA, 20 bp, Artificial Sequence
  Synthetic oligonucleotide; TAG chr11 5214968 5214987 5214984 +
ttgtcttaggcaaagaagac

SEQ ID NO: 7429 - DNA, 20 bp, Artificial Sequence
  Synthetic oligonucleotide; GAG chr11 5214984 5215003 5215000 +
agactagccgtactttattt

SEQ ID NO: 7430 - DNA, 20 bp, Artificial Sequence
  Synthetic oligonucleotide; AGG chr11 5214985 5215004 5215001 +
gactagccgtactttatttg

SEQ ID NO: 7431 - DNA, 20 bp, Artificial Sequence
  Synthetic oligonucleotide; GGG chr11 5214986 5215005 5215002 +
actagccgtactttatttga

SEQ ID NO: 7432 - DNA, 20 bp, Artificial Sequence
  Synthetic oligonucleotide; GAG chr11 5214995 5215014 5215011 +
actttatttgagggctcttt

SEQ ID NO: 7433 - DNA, 20 bp, Artificial Sequence
  Synthetic oligonucleotide; TAG chr11 5214998 5215017 5215014 +
ttatttgagggctctttgag

SEQ ID NO: 7434 - DNA, 20 bp, Artificial Sequence
  Synthetic oligonucleotide; GAG chr11 5215000 5215019 5215016 +
atttgagggctctttgagta

SEQ ID NO: 7435 - DNA, 20 bp, Artificial Sequence
  Synthetic oligonucleotide; CAG chr11 5215047 5215066 5215063 +
caactctatgtccccctccc

SEQ ID NO: 7436 - DNA, 20 bp, Artificial Sequence
  Synthetic oligonucleotide; AAG chr11 5215056 5215075 5215072 +
gtccccctccccagaataca

SEQ ID NO: 7437 - DNA, 20 bp, Artificial Sequence
  Synthetic oligonucleotide; TGG chr11 5215089 5215108 5215105 +
gatgcctcctttgcttcttt

SEQ ID NO: 7438 - DNA, 20 bp, Artificial Sequence
  Synthetic oligonucleotide; TGG chr11 5215118 5215137 5215134 +
ctgtgttatatctgaatata

SEQ ID NO: 7439 - DNA, 20 bp, Artificial Sequence
  Synthetic oligonucleotide; TAG chr11 5215124 5215143 5215140 +
tatatctgaatatatggctc

SEQ ID NO: 7440 - DNA, 20 bp, Artificial Sequence
  Synthetic oligonucleotide; GAG chr11 5215126 5215145 5215142 +
tatctgaatatatggctcta

SEQ ID NO: 7441 - DNA, 20 bp, Artificial Sequence
  Synthetic oligonucleotide; AAG chr11 5215135 5215154 5215151 +
atatggctctagagaatccc

SEQ ID NO: 7442 - DNA, 20 bp, Artificial Sequence
  Synthetic oligonucleotide; TAG chr11 5215141 5215160 5215157 +
ctctagagaatcccaagaaa

SEQ ID NO: 7443 - DNA, 20 bp, Artificial Sequence
  Synthetic oligonucleotide; AAG chr11 5215147 5215166 5215163 +
agaatcccaagaaatagaaa

SEQ ID NO: 7444 - DNA, 20 bp, Artificial Sequence
  Synthetic oligonucleotide; TAG chr11 5215151 5215170 5215167 +
tcccaagaaatagaaaaagc

SEQ ID NO: 7445 - DNA, 20 bp, Artificial Sequence
  Synthetic oligonucleotide; AAG chr11 5215164 5215183 5215180 +
aaaaagctagtccaaaatcc

SEQ ID NO: 7446 - DNA, 20 bp, Artificial Sequence
  Synthetic oligonucleotide; AAG chr11 5215175 5215194 5215191 +
ccaaaatccaagctctgaat

SEQ ID NO: 7447 - DNA, 20 bp, Artificial Sequence
  Synthetic oligonucleotide; CAG chr11 5215179 5215198 5215195 +
aatccaagctctgaataaga

SEQ ID NO: 7448 - DNA, 20 bp, Artificial Sequence
  Synthetic oligonucleotide; AGG chr11 5215180 5215199 5215196 +
atccaagctctgaataagac

SEQ ID NO: 7449 - DNA, 20 bp, Artificial Sequence
  Synthetic oligonucleotide; GAG chr11 5215184 5215203 5215200 +
aagctctgaataagacaggt

SEQ ID NO: 7450 - DNA, 20 bp, Artificial Sequence
  Synthetic oligonucleotide; TGG chr11 5215192 5215211 5215208 +
aataagacaggtgagacctt

SEQ ID NO: 7451 - DNA, 20 bp, Artificial Sequence
  Synthetic oligonucleotide; AAG chr11 5215212 5215231 5215228 +
tggatgaatatcttttcaca

SEQ ID NO: 7452 - DNA, 20 bp, Artificial Sequence
  Synthetic oligonucleotide; GAG chr11 5215217 5215236 5215233 +
gaatatcttttcacaaagtt

SEQ ID NO: 7453 - DNA, 20 bp, Artificial Sequence
  Synthetic oligonucleotide; AAG chr11 5215220 5215239 5215236 +
tatcttttcacaaagttgag

SEQ ID NO: 7454 - DNA, 20 bp, Artificial Sequence
  Synthetic oligonucleotide; AAG chr11 5215228 5215247 5215244 +
cacaaagttgagaagatgtg

SEQ ID NO: 7455 - DNA, 20 bp, Artificial Sequence
  Synthetic oligonucleotide; AAG chr11 5215236 5215255 5215252 +
tgagaagatgtgaagaaccc

SEQ ID NO: 7456 - DNA, 20 bp, Artificial Sequence
  Synthetic oligonucleotide; TGG chr11 5215246 5215265 5215262 +
tgaagaacccaagaatccac

SEQ ID NO: 7457 - DNA, 20 bp, Artificial Sequence
  Synthetic oligonucleotide; GAG chr11 5215248 5215267 5215264 +
aagaacccaagaatccactg

SEQ ID NO: 7458 - DNA, 20 bp, Artificial Sequence
  Synthetic oligonucleotide; CAG chr11 5215254 5215273 5215270 +
ccaagaatccactggagaaa

SEQ ID NO: 7459 - DNA, 20 bp, Artificial Sequence
  Synthetic oligonucleotide; GAG chr11 5215261 5215280 5215277 +
tccactggagaaacagcccc

SEQ ID NO: 7460 - DNA, 20 bp, Artificial Sequence
  Synthetic oligonucleotide; AGG chr11 5215262 5215281 5215278 +
ccactggagaaacagccccg

SEQ ID NO: 7461 - DNA, 20 bp, Artificial Sequence
  Synthetic oligonucleotide; AAG chr11 5215271 5215290 5215287 +
aaacagccccgaggcactgc

SEQ ID NO: 7462 - DNA, 20 bp, Artificial Sequence
  Synthetic oligonucleotide; AGG chr11 5215272 5215291 5215288 +
aacagccccgaggcactgca

SEQ ID NO: 7463 - DNA, 20 bp, Artificial Sequence
  Synthetic oligonucleotide; GGG chr11 5215273 5215292 5215289 +
acagccccgaggcactgcaa

SEQ ID NO: 7464 - DNA, 20 bp, Artificial Sequence
  Synthetic oligonucleotide; GGG chr11 5215274 5215293 5215290 +
cagccccgaggcactgcaag

SEQ ID NO: 7465 - DNA, 20 bp, Artificial Sequence
  Synthetic oligonucleotide; CAG chr11 5215279 5215298 5215295 +
ccgaggcactgcaaggggtt

SEQ ID NO: 7466 - DNA, 20 bp, Artificial Sequence
  Synthetic oligonucleotide; TGG chr11 5215290 5215309 5215306 +
caaggggttcagacctgtgt

SEQ ID NO: 7467 - DNA, 20 bp, Artificial Sequence
  Synthetic oligonucleotide; GAG chr11 5215292 5215311 5215308 +
aggggttcagacctgtgttg

SEQ ID NO: 7468 - DNA, 20 bp, Artificial Sequence
  Synthetic oligonucleotide; CAG chr11 5215380 5215399 5215396 +
cttgtttgtttgtttttcct

SEQ ID NO: 7469 - DNA, 20 bp, Artificial Sequence
  Synthetic oligonucleotide; GAG chr11 5215382 5215401 5215398 +
tgtttgtttgtttttcctca

SEQ ID NO: 7470 - DNA, 20 bp, Artificial Sequence
  Synthetic oligonucleotide; CAG chr11 5215386 5215405 5215402 +
tgtttgtttttcctcagaga

SEQ ID NO: 7471 - DNA, 20 bp, Artificial Sequence
  Synthetic oligonucleotide; AGG chr11 5215387 5215406 5215403 +
gtttgtttttcctcagagac

SEQ ID NO: 7472 - DNA, 20 bp, Artificial Sequence
  Synthetic oligonucleotide; CAG chr11 5215394 5215413 5215410 +
tttcctcagagacaggatct

SEQ ID NO: 7473 - DNA, 20 bp, Artificial Sequence
  Synthetic oligonucleotide; AAG chr11 5215402 5215421 5215418 +
gagacaggatctcagtcacc

SEQ ID NO: 7474 - DNA, 20 bp, Artificial Sequence
  Synthetic oligonucleotide; AGG chr11 5215403 5215422 5215419 +
agacaggatctcagtcacca

SEQ ID NO: 7475 - DNA, 20 bp, Artificial Sequence
  Synthetic oligonucleotide; TAG chr11 5215407 5215426 5215423 +
aggatctcagtcaccaaggc

SEQ ID NO: 7476 - DNA, 20 bp, Artificial Sequence
  Synthetic oligonucleotide; GAG chr11 5215409 5215428 5215425 +
gatctcagtcaccaaggcta

SEQ ID NO: 7477 - DNA, 20 bp, Artificial Sequence
  Synthetic oligonucleotide; GAG chr11 5215411 5215430 5215427 +
tctcagtcaccaaggctaga

SEQ ID NO: 7478 - DNA, 20 bp, Artificial Sequence
  Synthetic oligonucleotide; CAG chr11 5215414 5215433 5215430 +
cagtcaccaaggctagagag

SEQ ID NO: 7479 - DNA, 20 bp, Artificial Sequence
  Synthetic oligonucleotide; TGG chr11 5215417 5215436 5215433 +
tcaccaaggctagagagcag

SEQ ID NO: 7480 - DNA, 20 bp, Artificial Sequence
  Synthetic oligonucleotide; TGG chr11 5215452 5215471 5215468 +
tcactgcaaccctgaaatcc

SEQ ID NO: 7481 - DNA, 20 bp, Artificial Sequence
  Synthetic oligonucleotide; GGG chr11 5215453 5215472 5215469 +
cactgcaaccctgaaatcct

SEQ ID NO: 7482 - DNA, 20 bp, Artificial Sequence
  Synthetic oligonucleotide; AAG chr11 5215459 5215478 5215475 +
aaccctgaaatcctgggctc

SEQ ID NO: 7483 - DNA, 20 bp, Artificial Sequence
  Synthetic oligonucleotide; CAG chr11 5215476 5215495 5215492 +
ctcaagtgatcctatcactt

SEQ ID NO: 7484 - DNA, 20 bp, Artificial Sequence
  Synthetic oligonucleotide; TGG chr11 5215484 5215503 5215500 +
atcctatcacttcagcctcc

SEQ ID NO: 7485 - DNA, 20 bp, Artificial Sequence
  Synthetic oligonucleotide; GGG chr11 5215485 5215504 5215501 +
tcctatcacttcagcctcct

SEQ ID NO: 7486 - DNA, 20 bp, Artificial Sequence
  Synthetic oligonucleotide; TGG chr11 5215492 5215511 5215508 +
acttcagcctcctgggttac

SEQ ID NO: 7487 - DNA, 20 bp, Artificial Sequence
  Synthetic oligonucleotide; GGG chr11 5215493 5215512 5215509 +
cttcagcctcctgggttact

SEQ ID NO: 7488 - DNA, 20 bp, Artificial Sequence
  Synthetic oligonucleotide; CAG chr11 5215500 5215519 5215516 +
ctcctgggttactgggacta

SEQ ID NO: 7489 - DNA, 20 bp, Artificial Sequence
  Synthetic oligonucleotide; AAG chr11 5215507 5215526 5215523 +
gttactgggactacagatgc

SEQ ID NO: 7490 - DNA, 20 bp, Artificial Sequence
  Synthetic oligonucleotide; CAG chr11 5215520 5215539 5215536 +
cagatgcaagccactgtgcc

SEQ ID NO: 7491 - DNA, 20 bp, Artificial Sequence
  Synthetic oligonucleotide; TGG chr11 5215525 5215544 5215541 +
gcaagccactgtgcccagct

SEQ ID NO: 7492 - DNA, 20 bp, Artificial Sequence
  Synthetic oligonucleotide; TGG chr11 5215548 5215567 5215564 +
ctctttctttttattttaat

SEQ ID NO: 7493 - DNA, 20 bp, Artificial Sequence
  Synthetic oligonucleotide; CAG chr11 5215563 5215582 5215579 +
ttaattggtcactttgtttt

SEQ ID NO: 7494 - DNA, 20 bp, Artificial Sequence
  Synthetic oligonucleotide; CAG chr11 5215611 5215630 5215627 +
tcacctctgacttgacctcc

SEQ ID NO: 7495 - DNA, 20 bp, Artificial Sequence
  Synthetic oligonucleotide; TGG chr11 5215634 5215653 5215650 +
ttgtcaaatatttgacttaa

SEQ ID NO: 7496 - DNA, 20 bp, Artificial Sequence
  Synthetic oligonucleotide; GGG chr11 5215635 5215654 5215651 +
tgtcaaatatttgacttaat

SEQ ID NO: 7497 - DNA, 20 bp, Artificial Sequence
  Synthetic oligonucleotide; GAG chr11 5215637 5215656 5215653 +
tcaaatatttgacttaatgg

SEQ ID NO: 7498 - DNA, 20 bp, Artificial Sequence
  Synthetic oligonucleotide; TAG chr11 5215649 5215668 5215665 +
cttaatgggagactttcccc

SEQ ID NO: 7499 - DNA, 20 bp, Artificial Sequence
  Synthetic oligonucleotide; CAG chr11 5215663 5215682 5215679 +
ttcccctagcttgttgattc

SEQ ID NO: 7500 - DNA, 20 bp, Artificial Sequence
  Synthetic oligonucleotide; TAG chr11 5215682 5215701 5215698 +
ccagaaattcaactttattc

SEQ ID NO: 7501 - DNA, 20 bp, Artificial Sequence
  Synthetic oligonucleotide; AGG chr11 5215683 5215702 5215699 +
cagaaattcaactttattct

SEQ ID NO: 7502 - DNA, 20 bp, Artificial Sequence
  Synthetic oligonucleotide; TGG chr11 5215688 5215707 5215704 +
attcaactttattctaggct

SEQ ID NO: 7503 - DNA, 20 bp, Artificial Sequence
  Synthetic oligonucleotide; TAG chr11 5215699 5215718 5215715 +
ttctaggcttggctcctgtt

SEQ ID NO: 7504 - DNA, 20 bp, Artificial Sequence
  Synthetic oligonucleotide; GAG chr11 5215714 5215733 5215730 +
ctgtttagtattgctgcttt

SEQ ID NO: 7505 - DNA, 20 bp, Artificial Sequence
  Synthetic oligonucleotide; TGG chr11 5215724 5215743 5215740 +
ttgctgctttgagattgttc

SEQ ID NO: 7506 - DNA, 20 bp, Artificial Sequence
  Synthetic oligonucleotide; AAG chr11 5215739 5215758 5215755 +
tgttctggttcatgaaaaac

SEQ ID NO: 7507 - DNA, 20 bp, Artificial Sequence
  Synthetic oligonucleotide; AAG chr11 5215798 5215817 5215814 +
ctaaattcttataaacaaat

SEQ ID NO: 7508 - DNA, 20 bp, Artificial Sequence
  Synthetic oligonucleotide; AAG chr11 5215801 5215820 5215817 +
aattcttataaacaaataag

SEQ ID NO: 7509 - DNA, 20 bp, Artificial Sequence
  Synthetic oligonucleotide; AGG chr11 5215802 5215821 5215818 +
attcttataaacaaataaga

SEQ ID NO: 7510 - DNA, 20 bp, Artificial Sequence
  Synthetic oligonucleotide; AAG chr11 5215805 5215824 5215821 +
cttataaacaaataagaagg

SEQ ID NO: 7511 - DNA, 20 bp, Artificial Sequence
  Synthetic oligonucleotide; CAG chr11 5215813 5215832 5215829 +
caaataagaaggaagactct

SEQ ID NO: 7512 - DNA, 20 bp, Artificial Sequence
  Synthetic oligonucleotide; TGG chr11 5215823 5215842 5215839 +
ggaagactctcagaaatata

SEQ ID NO: 7513 - DNA, 20 bp, Artificial Sequence
  Synthetic oligonucleotide; GAG chr11 5215825 5215844 5215841 +
aagactctcagaaatatatg

SEQ ID NO: 7514 - DNA, 20 bp, Artificial Sequence
  Synthetic oligonucleotide; GAG chr11 5215827 5215846 5215843 +
gactctcagaaatatatgga

SEQ ID NO: 7515 - DNA, 20 bp, Artificial Sequence
  Synthetic oligonucleotide; GAG chr11 5215833 5215852 5215849 +
cagaaatatatggagagact

SEQ ID NO: 7516 - DNA, 20 bp, Artificial Sequence
  Synthetic oligonucleotide; AGG chr11 5215834 5215853 5215850 +
agaaatatatggagagactg

SEQ ID NO: 7517 - DNA, 20 bp, Artificial Sequence
  Synthetic oligonucleotide; TAG chr11 5215838 5215857 5215854 +
atatatggagagactgaggt

SEQ ID NO: 7518 - DNA, 20 bp, Artificial Sequence
  Synthetic oligonucleotide; GAG chr11 5215840 5215859 5215856 +
atatggagagactgaggtta

SEQ ID NO: 7519 - DNA, 20 bp, Artificial Sequence
  Synthetic oligonucleotide; GAG chr11 5215845 5215864 5215861 +
gagagactgaggttagagtt

SEQ ID NO: 7520 - DNA, 20 bp, Artificial Sequence
  Synthetic oligonucleotide; AAG chr11 5215849 5215868 5215865 +
gactgaggttagagttgagc

SEQ ID NO: 7521 - DNA, 20 bp, Artificial Sequence
  Synthetic oligonucleotide; AGG chr11 5215850 5215869 5215866 +
actgaggttagagttgagca

SEQ ID NO: 7522 - DNA, 20 bp, Artificial Sequence
  Synthetic oligonucleotide; TAG chr11 5215877 5215896 5215893 +
aaattttgtcacaactaatc

SEQ ID NO: 7523 - DNA, 20 bp, Artificial Sequence
  Synthetic oligonucleotide; AAG chr11 5215883 5215902 5215899 +
tgtcacaactaatctagttg

SEQ ID NO: 7524 - DNA, 20 bp, Artificial Sequence
  Synthetic oligonucleotide; AGG chr11 5215884 5215903 5215900 +
gtcacaactaatctagttga

SEQ ID NO: 7525 - DNA, 20 bp, Artificial Sequence
  Synthetic oligonucleotide; GAG chr11 5215901 5215920 5215917 +
tgaaggaatgttaactgact

SEQ ID NO: 7526 - DNA, 20 bp, Artificial Sequence
  Synthetic oligonucleotide; AAG chr11 5215930 5215949 5215946 +
ctaaatttctgtctatttca

SEQ ID NO: 7527 - DNA, 20 bp, Artificial Sequence
  Synthetic oligonucleotide; GAG chr11 5215932 5215951 5215948 +
aaatttctgtctatttcaaa

SEQ ID NO: 7528 - DNA, 20 bp, Artificial Sequence
  Synthetic oligonucleotide; AAG chr11 5215936 5215955 5215952 +
ttctgtctatttcaaagaga

SEQ ID NO: 7529 - DNA, 20 bp, Artificial Sequence
  Synthetic oligonucleotide; TGG chr11 5215948 5215967 5215964 +
caaagagaaagacttgataa

SEQ ID NO: 7530 - DNA, 20 bp, Artificial Sequence
  Synthetic oligonucleotide; CGG chr11 5215956 5215975 5215972 +
aagacttgataatggctcta

SEQ ID NO: 7531 - DNA, 20 bp, Artificial Sequence
  Synthetic oligonucleotide; GAG chr11 5215965 5215984 5215981 +
taatggctctacggatgtgt

SEQ ID NO: 7532 - DNA, 20 bp, Artificial Sequence
  Synthetic oligonucleotide; CAG chr11 5215970 5215989 5215986 +
gctctacggatgtgtgagat

SEQ ID NO: 7533 - DNA, 20 bp, Artificial Sequence
  Synthetic oligonucleotide; TAG chr11 5215979 5215998 5215995 +
atgtgtgagatcagttttaa

SEQ ID NO: 7534 - DNA, 20 bp, Artificial Sequence
  Synthetic oligonucleotide; AGG chr11 5215980 5215999 5215996 +
tgtgtgagatcagttttaat

SEQ ID NO: 7535 - DNA, 20 bp, Artificial Sequence
  Synthetic oligonucleotide; AAG chr11 5216009 5216028 5216025 +
tttttttattattatacttc

SEQ ID NO: 7536 - DNA, 20 bp, Artificial Sequence
  Synthetic oligonucleotide; TAG chr11 5216015 5216034 5216031 +
tattattatacttcaagttt

SEQ ID NO: 7537 - DNA, 20 bp, Artificial Sequence
  Synthetic oligonucleotide; AGG chr11 5216016 5216035 5216032 +
attattatacttcaagtttt

SEQ ID NO: 7538 - DNA, 20 bp, Artificial Sequence
  Synthetic oligonucleotide; GGG chr11 5216017 5216036 5216033 +
ttattatacttcaagtttta

SEQ ID NO: 7539 - DNA, 20 bp, Artificial Sequence
  Synthetic oligonucleotide; CAG chr11 5216037 5216056 5216053 +
gggtacatgtgcacaacatg

SEQ ID NO: 7540 - DNA, 20 bp, Artificial Sequence
  Synthetic oligonucleotide; AGG chr11 5216038 5216057 5216054 +
ggtacatgtgcacaacatgc

SEQ ID NO: 7541 - DNA, 20 bp, Artificial Sequence
  Synthetic oligonucleotide; TGG chr11 5216070 5216089 5216086 +
tatgtatacatgtgccatgt

SEQ ID NO: 7542 - DNA, 20 bp, Artificial Sequence
  Synthetic oligonucleotide; TAG chr11 5216099 5216118 5216115 +
gcacccattaactcgtcatt

SEQ ID NO: 7543 - DNA, 20 bp, Artificial Sequence
  Synthetic oligonucleotide; TAG chr11 5216105 5216124 5216121 +
attaactcgtcatttagcat

SEQ ID NO: 7544 - DNA, 20 bp, Artificial Sequence
  Synthetic oligonucleotide; AGG chr11 5216106 5216125 5216122 +
ttaactcgtcatttagcatt

SEQ ID NO: 7545 - DNA, 20 bp, Artificial Sequence
  Synthetic oligonucleotide; TAG chr11 5216118 5216137 5216134 +
ttagcattaggtatatctcc

SEQ ID NO: 7546 - DNA, 20 bp, Artificial Sequence
  Synthetic oligonucleotide; CAG chr11 5216153 5216172 5216169 +
ccctgccccccaccccataa

SEQ ID NO: 7547 - DNA, 20 bp, Artificial Sequence
  Synthetic oligonucleotide; CAG chr11 5216160 5216179 5216176 +
ccccaccccataacagtccc

SEQ ID NO: 7548 - DNA, 20 bp, Artificial Sequence
  Synthetic oligonucleotide; GAG chr11 5216162 5216181 5216178 +
ccaccccataacagtcccca

SEQ ID NO: 7549 - DNA, 20 bp, Artificial Sequence
  Synthetic oligonucleotide; GAG chr11 5216219 5216238 5216235 +
attgttcaattcccacctat

SEQ ID NO: 7550 - DNA, 20 bp, Artificial Sequence
  Synthetic oligonucleotide; GAG chr11 5216223 5216242 5216239 +
ttcaattcccacctatgagt

SEQ ID NO: 7551 - DNA, 20 bp, Artificial Sequence
  Synthetic oligonucleotide; CGG chr11 5216232 5216251 5216248 +
cacctatgagtgagaacatg

SEQ ID NO: 7552 - DNA, 20 bp, Artificial Sequence
  Synthetic oligonucleotide; TGG chr11 5216239 5216258 5216255 +
gagtgagaacatgcggtgtt

SEQ ID NO: 7553 - DNA, 20 bp, Artificial Sequence
  Synthetic oligonucleotide; TAG chr11 5216258 5216277 5216274 +
ttggtttattctccttgtga

SEQ ID NO: 7554 - DNA, 20 bp, Artificial Sequence
  Synthetic oligonucleotide; GAG chr11 5216267 5216286 5216283 +
tctccttgtgatagtttgct

SEQ ID NO: 7555 - DNA, 20 bp, Artificial Sequence
  Synthetic oligonucleotide; TAG chr11 5216275 5216294 5216291 +
tgatagtttgctgagaatga

SEQ ID NO: 7556 - DNA, 20 bp, Artificial Sequence
  Synthetic oligonucleotide; CAG chr11 5216282 5216301 5216298 +
ttgctgagaatgatagtttc

SEQ ID NO: 7557 - DNA, 20 bp, Artificial Sequence
  Synthetic oligonucleotide; AAG chr11 5216304 5216323 5216320 +
gcttcatccatgtccctaca

SEQ ID NO: 7558 - DNA, 20 bp, Artificial Sequence
  Synthetic oligonucleotide; AGG chr11 5216305 5216324 5216321 +
cttcatccatgtccctacaa

SEQ ID NO: 7559 - DNA, 20 bp, Artificial Sequence
  Synthetic oligonucleotide; TGG chr11 5216329 5216348 5216345 +
catgaactcatcatttttta

SEQ ID NO: 7560 - DNA, 20 bp, Artificial Sequence
  Synthetic oligonucleotide; TAG chr11 5216337 5216356 5216353 +
catcattttttatggctgca

SEQ ID NO: 7561 - DNA, 20 bp, Artificial Sequence
  Synthetic oligonucleotide; TGG chr11 5216347 5216366 5216363 +
tatggctgcatagtattcca

SEQ ID NO: 7562 - DNA, 20 bp, Artificial Sequence
  Synthetic oligonucleotide; CAG chr11 5216376 5216395 5216392 +
tgtgccacattttcttaatc

SEQ ID NO: 7563 - DNA, 20 bp, Artificial Sequence
  Synthetic oligonucleotide; TGG chr11 5216390 5216409 5216406 +
ttaatccagtctatcgttgt

SEQ ID NO: 7564 - DNA, 20 bp, Artificial Sequence
  Synthetic oligonucleotide; TGG chr11 5216398 5216417 5216414 +
gtctatcgttgttggacatt

SEQ ID NO: 7565 - DNA, 20 bp, Artificial Sequence
  Synthetic oligonucleotide; GGG chr11 5216399 5216418 5216415 +
tctatcgttgttggacattt

SEQ ID NO: 7566 - DNA, 20 bp, Artificial Sequence
  Synthetic oligonucleotide; TGG chr11 5216403 5216422 5216419 +
tcgttgttggacatttgggt

SEQ ID NO: 7567 - DNA, 20 bp, Artificial Sequence
  Synthetic oligonucleotide; AAG chr11 5216410 5216429 5216426 +
tggacatttgggttggttcc

SEQ ID NO: 7568 - DNA, 20 bp, Artificial Sequence
  Synthetic oligonucleotide; TAG chr11 5216429 5216448 5216445 +
caagtctttgctattgtgaa

SEQ ID NO: 7569 - DNA, 20 bp, Artificial Sequence
  Synthetic oligonucleotide; TAG chr11 5216466 5216485 5216482 +
tacgtgtgcatgtgtcttta

SEQ ID NO: 7570 - DNA, 20 bp, Artificial Sequence
  Synthetic oligonucleotide; CAG chr11 5216469 5216488 5216485 +
gtgtgcatgtgtctttatag

SEQ ID NO: 7571 - DNA, 20 bp, Artificial Sequence
  Synthetic oligonucleotide; TGG chr11 5216489 5216508 5216505 +
cagcatgatttataatcctt

SEQ ID NO: 7572 - DNA, 20 bp, Artificial Sequence
  Synthetic oligonucleotide; GGG chr11 5216490 5216509 5216506 +
agcatgatttataatccttt

SEQ ID NO: 7573 - DNA, 20 bp, Artificial Sequence
  Synthetic oligonucleotide; CAG chr11 5216501 5216520 5216517 +
taatcctttgggtatgtacc

SEQ ID NO: 7574 - DNA, 20 bp, Artificial Sequence
  Synthetic oligonucleotide; TGG chr11 5216507 5216526 5216523 +
tttgggtatgtacccagtaa

SEQ ID NO: 7575 - DNA, 20 bp, Artificial Sequence
  Synthetic oligonucleotide; GGG chr11 5216508 5216527 5216524 +
ttgggtatgtacccagtaat

SEQ ID NO: 7576 - DNA, 20 bp, Artificial Sequence
  Synthetic oligonucleotide; TGG chr11 5216512 5216531 5216528 +
gtatgtacccagtaatggga

SEQ ID NO: 7577 - DNA, 20 bp, Artificial Sequence
  Synthetic oligonucleotide; TGG chr11 5216516 5216535 5216532 +
gtacccagtaatgggatggc

SEQ ID NO: 7578 - DNA, 20 bp, Artificial Sequence
  Synthetic oligonucleotide; GGG chr11 5216517 5216536 5216533 +
tacccagtaatgggatggct

SEQ ID NO: 7579 - DNA, 20 bp, Artificial Sequence
  Synthetic oligonucleotide; TGG chr11 5216525 5216544 5216541 +
aatgggatggctgggtcaaa

SEQ ID NO: 7580 - DNA, 20 bp, Artificial Sequence
  Synthetic oligonucleotide; TAG chr11 5216534 5216553 5216550 +
gctgggtcaaatggtatttc

SEQ ID NO: 7581 - DNA, 20 bp, Artificial Sequence
  Synthetic oligonucleotide; TAG chr11 5216540 5216559 5216556 +
tcaaatggtatttctagttc

SEQ ID NO: 7582 - DNA, 20 bp, Artificial Sequence
  Synthetic oligonucleotide; GAG chr11 5216549 5216568 5216565 +
atttctagttctagattcct

SEQ ID NO: 7583 - DNA, 20 bp, Artificial Sequence
  Synthetic oligonucleotide; AGG chr11 5216550 5216569 5216566 +
tttctagttctagattcctg

SEQ ID NO: 7584 - DNA, 20 bp, Artificial Sequence
  Synthetic oligonucleotide; TGG chr11 5216576 5216595 5216592 +
tgccacactgacttccgcaa

SEQ ID NO: 7585 - DNA, 20 bp, Artificial Sequence
  Synthetic oligonucleotide; TAG chr11 5216585 5216604 5216601 +
gacttccgcaatggttgaac

SEQ ID NO: 7586 - DNA, 20 bp, Artificial Sequence
  Synthetic oligonucleotide; CAG chr11 5216592 5216611 5216608 +
gcaatggttgaactagttta

SEQ ID NO: 7587 - DNA, 20 bp, Artificial Sequence
  Synthetic oligonucleotide; CAG chr11 5216604 5216623 5216620 +
ctagtttacagtcccaccaa

SEQ ID NO: 7588 - DNA, 20 bp, Artificial Sequence
  Synthetic oligonucleotide; AAG chr11 5216612 5216631 5216628 +
cagtcccaccaacagtgtaa

SEQ ID NO: 7589 - DNA, 20 bp, Artificial Sequence
  Synthetic oligonucleotide; CAG chr11 5216641 5216660 5216657 +
ctgtttctccacatcctctc

SEQ ID NO: 7590 - DNA, 20 bp, Artificial Sequence
  Synthetic oligonucleotide; TGG chr11 5216685 5216704 5216701 +
ttaatgatcgccattctaac

SEQ ID NO: 7591 - DNA, 20 bp, Artificial Sequence
  Synthetic oligonucleotide; GAG chr11 5216691 5216710 5216707 +
atcgccattctaactggtgt

SEQ ID NO: 7592 - DNA, 20 bp, Artificial Sequence
  Synthetic oligonucleotide; TGG chr11 5216695 5216714 5216711 +
ccattctaactggtgtgaga

SEQ ID NO: 7593 - DNA, 20 bp, Artificial Sequence
  Synthetic oligonucleotide; TGG chr11 5216708 5216727 5216724 +
tgtgagatggtatctcattg

SEQ ID NO: 7594 - DNA, 20 bp, Artificial Sequence
  Synthetic oligonucleotide; TGG chr11 5216732 5216751 5216748 +
tttgatttgcatttctctga

SEQ ID NO: 7595 - DNA, 20 bp, Artificial Sequence
  Synthetic oligonucleotide; TAG chr11 5216736 5216755 5216752 +
atttgcatttctctgatggc

SEQ ID NO: 7596 - DNA, 20 bp, Artificial Sequence
  Synthetic oligonucleotide; GAG chr11 5216746 5216765 5216762 +
ctctgatggctagtgatgat

SEQ ID NO: 7597 - DNA, 20 bp, Artificial Sequence
  Synthetic oligonucleotide; AAG chr11 5216794 5216813 5216810 +
cataaatgtcttcttttgcg

SEQ ID NO: 7598 - DNA, 20 bp, Artificial Sequence
  Synthetic oligonucleotide; TGG chr11 5216828 5216847 5216844 +
atcctttgcccactttttga

SEQ ID NO: 7599 - DNA, 20 bp, Artificial Sequence
  Synthetic oligonucleotide; GGG chr11 5216829 5216848 5216845 +
tcctttgcccactttttgat

SEQ ID NO: 7600 - DNA, 20 bp, Artificial Sequence
  Synthetic oligonucleotide; GGG chr11 5216830 5216849 5216846 +
cctttgcccactttttgatg

SEQ ID NO: 7601 - DNA, 20 bp, Artificial Sequence
  Synthetic oligonucleotide; GAG chr11 5216861 5216880 5216877 +
tttttcttgtaaatttgttt

SEQ ID NO: 7602 - DNA, 20 bp, Artificial Sequence
  Synthetic oligonucleotide; TAG chr11 5216871 5216890 5216887 +
aaatttgtttgagttcattg

SEQ ID NO: 7603 - DNA, 20 bp, Artificial Sequence
  Synthetic oligonucleotide; TGG chr11 5216878 5216897 5216894 +
tttgagttcattgtagattc

SEQ ID NO: 7604 - DNA, 20 bp, Artificial Sequence
  Synthetic oligonucleotide; TAG chr11 5216885 5216904 5216901 +
tcattgtagattctggatat

SEQ ID NO: 7605 - DNA, 20 bp, Artificial Sequence
  Synthetic oligonucleotide; CAG chr11 5216896 5216915 5216912 +
tctggatattagccctttgt

SEQ ID NO: 7606 - DNA, 20 bp, Artificial Sequence
  Synthetic oligonucleotide; GAG chr11 5216901 5216920 5216917 +
atattagccctttgtcagat

SEQ ID NO: 7607 - DNA, 20 bp, Artificial Sequence
  Synthetic oligonucleotide; TAG chr11 5216904 5216923 5216920 +
ttagccctttgtcagatgag

SEQ ID NO: 7608 - DNA, 20 bp, Artificial Sequence
  Synthetic oligonucleotide; TAG chr11 5216932 5216951 5216948 +
aaaaattttctcccattttg

SEQ ID NO: 7609 - DNA, 20 bp, Artificial Sequence
  Synthetic oligonucleotide; AGG chr11 5216933 5216952 5216949 +
aaaattttctcccattttgt

SEQ ID NO: 7610 - DNA, 20 bp, Artificial Sequence
  Synthetic oligonucleotide; TGG chr11 5216953 5216972 5216969 +
aggttgcctgttcactctga

SEQ ID NO: 7611 - DNA, 20 bp, Artificial Sequence
  Synthetic oligonucleotide; TAG chr11 5216956 5216975 5216972 +
ttgcctgttcactctgatgg

SEQ ID NO: 7612 - DNA, 20 bp, Artificial Sequence
  Synthetic oligonucleotide; TAG chr11 5216965 5216984 5216981 +
cactctgatggtagtttctt

SEQ ID NO: 7613 - DNA, 20 bp, Artificial Sequence
  Synthetic oligonucleotide; CAG chr11 5216973 5216992 5216989 +
tggtagtttctttagctgtg

SEQ ID NO: 7614 - DNA, 20 bp, Artificial Sequence
  Synthetic oligonucleotide; AAG chr11 5216976 5216995 5216992 +
tagtttctttagctgtgcag

SEQ ID NO: 7615 - DNA, 20 bp, Artificial Sequence
  Synthetic oligonucleotide; TAG chr11 5216984 5217003 5217000 +
ttagctgtgcagaagctctt

SEQ ID NO: 7616 - DNA, 20 bp, Artificial Sequence
  Synthetic oligonucleotide; TAG chr11 5216993 5217012 5217009 +
cagaagctctttagtttaat

SEQ ID NO: 7617 - DNA, 20 bp, Artificial Sequence
  Synthetic oligonucleotide; TGG chr11 5217035 5217054 5217051 +
tcttttgttgccattgcttt

SEQ ID NO: 7618 - DNA, 20 bp, Artificial Sequence
  Synthetic oligonucleotide; TAG chr11 5217043 5217062 5217059 +
tgccattgcttttggtgttt

SEQ ID NO: 7619 - DNA, 20 bp, Artificial Sequence
  Synthetic oligonucleotide; AAG chr11 5217051 5217070 5217067 +
cttttggtgttttagacatg

SEQ ID NO: 7620 - DNA, 20 bp, Artificial Sequence
  Synthetic oligonucleotide; TGG chr11 5217079 5217098 5217095 +
gcccatgcctatgtcctgaa

SEQ ID NO: 7621 - DNA, 20 bp, Artificial Sequence
  Synthetic oligonucleotide; TAG chr11 5217089 5217108 5217105 +
atgtcctgaatggtattgcc

SEQ ID NO: 7622 - DNA, 20 bp, Artificial Sequence
  Synthetic oligonucleotide; AGG chr11 5217090 5217109 5217106 +
tgtcctgaatggtattgcct

SEQ ID NO: 7623 - DNA, 20 bp, Artificial Sequence
  Synthetic oligonucleotide; TAG chr11 5217101 5217120 5217117 +
gtattgcctaggtttttttc

SEQ ID NO: 7624 - DNA, 20 bp, Artificial Sequence
  Synthetic oligonucleotide; AGG chr11 5217102 5217121 5217118 +
tattgcctaggtttttttct

SEQ ID NO: 7625 - DNA, 20 bp, Artificial Sequence
  Synthetic oligonucleotide; GGG chr11 5217103 5217122 5217119 +
attgcctaggtttttttcta

SEQ ID NO: 7626 - DNA, 20 bp, Artificial Sequence
  Synthetic oligonucleotide; TGG chr11 5217112 5217131 5217128 +
gtttttttctagggttttta

SEQ ID NO: 7627 - DNA, 20 bp, Artificial Sequence
  Synthetic oligonucleotide; TAG chr11 5217118 5217137 5217134 +
ttctagggtttttatggttt

SEQ ID NO: 7628 - DNA, 20 bp, Artificial Sequence
  Synthetic oligonucleotide; AGG chr11 5217119 5217138 5217135 +
tctagggtttttatggtttt

SEQ ID NO: 7629 - DNA, 20 bp, Artificial Sequence
  Synthetic oligonucleotide; AAG chr11 5217132 5217151 5217148 +
tggttttaggtctaacatgt

SEQ ID NO: 7630 - DNA, 20 bp, Artificial Sequence
  Synthetic oligonucleotide; AAG chr11 5217166 5217185 5217182 +
tcttgaattaatttttgtat

SEQ ID NO: 7631 - DNA, 20 bp, Artificial Sequence
  Synthetic oligonucleotide; AGG chr11 5217167 5217186 5217183 +
cttgaattaatttttgtata

SEQ ID NO: 7632 - DNA, 20 bp, Artificial Sequence
  Synthetic oligonucleotide; AAG chr11 5217173 5217192 5217189 +
ttaatttttgtataaggtgt

SEQ ID NO: 7633 - DNA, 20 bp, Artificial Sequence
  Synthetic oligonucleotide; AGG chr11 5217174 5217193 5217190 +
taatttttgtataaggtgta

SEQ ID NO: 7634 - DNA, 20 bp, Artificial Sequence
  Synthetic oligonucleotide; AAG chr11 5217177 5217196 5217193 +
tttttgtataaggtgtaagg

SEQ ID NO: 7635 - DNA, 20 bp, Artificial Sequence
  Synthetic oligonucleotide; AGG chr11 5217178 5217197 5217194 +
ttttgtataaggtgtaagga

SEQ ID NO: 7636 - DNA, 20 bp, Artificial Sequence
  Synthetic oligonucleotide; GGG chr11 5217179 5217198 5217195 +
tttgtataaggtgtaaggaa

SEQ ID NO: 7637 - DNA, 20 bp, Artificial Sequence
  Synthetic oligonucleotide; CAG chr11 5217185 5217204 5217201 +
taaggtgtaaggaagggatc

SEQ ID NO: 7638 - DNA, 20 bp, Artificial Sequence
  Synthetic oligonucleotide; CAG chr11 5217191 5217210 5217207 +
gtaaggaagggatccagttt

SEQ ID NO: 7639 - DNA, 20 bp, Artificial Sequence
  Synthetic oligonucleotide; TGG chr11 5217205 5217224 5217221 +
cagtttcagctttctacata

SEQ ID NO: 7640 - DNA, 20 bp, Artificial Sequence
  Synthetic oligonucleotide; TAG chr11 5217209 5217228 5217225 +
ttcagctttctacatatggc

SEQ ID NO: 7641 - DNA, 20 bp, Artificial Sequence
  Synthetic oligonucleotide; CAG chr11 5217213 5217232 5217229 +
gctttctacatatggctagc

SEQ ID NO: 7642 - DNA, 20 bp, Artificial Sequence
  Synthetic oligonucleotide; CAG chr11 5217222 5217241 5217238 +
atatggctagccagttttcc

SEQ ID NO: 7643 - DNA, 20 bp, Artificial Sequence
  Synthetic oligonucleotide; TAG chr11 5217239 5217258 5217255 +
tcccagcaccatttattaaa

SEQ ID NO: 7644 - DNA, 20 bp, Artificial Sequence
  Synthetic oligonucleotide; AGG chr11 5217240 5217259 5217256 +
cccagcaccatttattaaat

SEQ ID NO: 7645 - DNA, 20 bp, Artificial Sequence
  Synthetic oligonucleotide; GGG chr11 5217241 5217260 5217257 +
ccagcaccatttattaaata

SEQ ID NO: 7646 - DNA, 20 bp, Artificial Sequence
  Synthetic oligonucleotide; CAG chr11 5217271 5217290 5217287 +
tccccattgcttgtttctct

SEQ ID NO: 7647 - DNA, 20 bp, Artificial Sequence
  Synthetic oligonucleotide; AGG chr11 5217272 5217291 5217288 +
ccccattgcttgtttctctc

SEQ ID NO: 7648 - DNA, 20 bp, Artificial Sequence
  Synthetic oligonucleotide; AAG chr11 5217282 5217301 5217298 +
tgtttctctcaggtttgtca

SEQ ID NO: 7649 - DNA, 20 bp, Artificial Sequence
  Synthetic oligonucleotide; CAG chr11 5217287 5217306 5217303 +
ctctcaggtttgtcaaagat

SEQ ID NO: 7650 - DNA, 20 bp, Artificial Sequence
  Synthetic oligonucleotide; TAG chr11 5217291 5217310 5217307 +
caggtttgtcaaagatcaga

SEQ ID NO: 7651 - DNA, 20 bp, Artificial Sequence
  Synthetic oligonucleotide; TAG chr11 5217297 5217316 5217313 +
tgtcaaagatcagatagttg

SEQ ID NO: 7652 - DNA, 20 bp, Artificial Sequence
  Synthetic oligonucleotide; CGG chr11 5217305 5217324 5217321 +
atcagatagttgtagatatg

SEQ ID NO: 7653 - DNA, 20 bp, Artificial Sequence
  Synthetic oligonucleotide; GAG chr11 5217318 5217337 5217334 +
agatatgcggcattatttct

SEQ ID NO: 7654 - DNA, 20 bp, Artificial Sequence
  Synthetic oligonucleotide; AGG chr11 5217319 5217338 5217335 +
gatatgcggcattatttctg

SEQ ID NO: 7655 - DNA, 20 bp, Artificial Sequence
  Synthetic oligonucleotide; GGG chr11 5217320 5217339 5217336 +
atatgcggcattatttctga

SEQ ID NO: 7656 - DNA, 20 bp, Artificial Sequence
  Synthetic oligonucleotide; TGG chr11 5217339 5217358 5217355 +
agggctctgttctgttccat

SEQ ID NO: 7657 - DNA, 20 bp, Artificial Sequence
  Synthetic oligonucleotide; TAG chr11 5217344 5217363 5217360 +
tctgttctgttccattggtc

SEQ ID NO: 7658 - DNA, 20 bp, Artificial Sequence
  Synthetic oligonucleotide; TGG chr11 5217357 5217376 5217373 +
attggtctagatctctgttt

SEQ ID NO: 7659 - DNA, 20 bp, Artificial Sequence
  Synthetic oligonucleotide; CAG chr11 5217363 5217382 5217379 +
ctagatctctgttttggtac

SEQ ID NO: 7660 - DNA, 20 bp, Artificial Sequence
  Synthetic oligonucleotide; TGG chr11 5217379 5217398 5217395 +
gtaccagtaccatgctgttt

SEQ ID NO: 7661 - DNA, 20 bp, Artificial Sequence
  Synthetic oligonucleotide; TAG chr11 5217388 5217407 5217404 +
ccatgctgttttggttaccg

SEQ ID NO: 7662 - DNA, 20 bp, Artificial Sequence
  Synthetic oligonucleotide; TAG chr11 5217396 5217415 5217412 +
ttttggttaccgtagcattg

SEQ ID NO: 7663 - DNA, 20 bp, Artificial Sequence
  Synthetic oligonucleotide; TAG chr11 5217401 5217420 5217417 +
gttaccgtagcattgtagta

SEQ ID NO: 7664 - DNA, 20 bp, Artificial Sequence
  Synthetic oligonucleotide; AAG chr11 5217408 5217427 5217424 +
tagcattgtagtatagtttg

SEQ ID NO: 7665 - DNA, 20 bp, Artificial Sequence
  Synthetic oligonucleotide; CAG chr11 5217412 5217431 5217428 +
attgtagtatagtttgaagt

SEQ ID NO: 7666 - DNA, 20 bp, Artificial Sequence
  Synthetic oligonucleotide; AGG chr11 5217413 5217432 5217429 +
ttgtagtatagtttgaagtc

SEQ ID NO: 7667 - DNA, 20 bp, Artificial Sequence
  Synthetic oligonucleotide; TAG chr11 5217416 5217435 5217432 +
tagtatagtttgaagtcagg

SEQ ID NO: 7668 - DNA, 20 bp, Artificial Sequence
  Synthetic oligonucleotide; CAG chr11 5217430 5217449 5217446 +
gtcaggtagcgtgatgcctc

SEQ ID NO: 7669 - DNA, 20 bp, Artificial Sequence
  Synthetic oligonucleotide; TGG chr11 5217444 5217463 5217460 +
tgcctccagctttgttcttt

SEQ ID NO: 7670 - DNA, 20 bp, Artificial Sequence
  Synthetic oligonucleotide; TAG chr11 5217449 5217468 5217465 +
ccagctttgttcttttggct

SEQ ID NO: 7671 - DNA, 20 bp, Artificial Sequence
  Synthetic oligonucleotide; AGG chr11 5217450 5217469 5217466 +
cagctttgttcttttggctt

SEQ ID NO: 7672 - DNA, 20 bp, Artificial Sequence
  Synthetic oligonucleotide; TGG chr11 5217460 5217479 5217476 +
cttttggcttaggattgcct

SEQ ID NO: 7673 - DNA, 20 bp, Artificial Sequence
  Synthetic oligonucleotide; TGG chr11 5217468 5217487 5217484 +
ttaggattgccttggtgatg

SEQ ID NO: 7674 - DNA, 20 bp, Artificial Sequence
  Synthetic oligonucleotide; GGG chr11 5217469 5217488 5217485 +
taggattgccttggtgatgt

SEQ ID NO: 7675 - DNA, 20 bp, Artificial Sequence
  Synthetic oligonucleotide; TGG chr11 5217480 5217499 5217496 +
tggtgatgtgggctcttttt

SEQ ID NO: 7676 - DNA, 20 bp, Artificial Sequence
  Synthetic oligonucleotide; AAG chr11 5217499 5217518 5217515 +
ttggttccatatgaacttta

SEQ ID NO: 7677 - DNA, 20 bp, Artificial Sequence
  Synthetic oligonucleotide; TAG chr11 5217502 5217521 5217518 +
gttccatatgaactttaaag

SEQ ID NO: 7678 - DNA, 20 bp, Artificial Sequence
  Synthetic oligonucleotide; CAG chr11 5217512 5217531 5217528 +
aactttaaagtagttttttc

SEQ ID NO: 7679 - DNA, 20 bp, Artificial Sequence
  Synthetic oligonucleotide; AAG chr11 5217522 5217541 5217538 +
tagttttttccagttctgtg

SEQ ID NO: 7680 - DNA, 20 bp, Artificial Sequence
  Synthetic oligonucleotide; AAG chr11 5217526 5217545 5217542 +
tttttccagttctgtgaaga

SEQ ID NO: 7681 - DNA, 20 bp, Artificial Sequence
  Synthetic oligonucleotide; TGG chr11 5217533 5217552 5217549 +
agttctgtgaagaaagtcat

SEQ ID NO: 7682 - DNA, 20 bp, Artificial Sequence
  Synthetic oligonucleotide; TAG chr11 5217536 5217555 5217552 +
tctgtgaagaaagtcattgg

SEQ ID NO: 7683 - DNA, 20 bp, Artificial Sequence
  Synthetic oligonucleotide; TGG chr11 5217544 5217563 5217560 +
gaaagtcattggtagcttga

SEQ ID NO: 7684 - DNA, 20 bp, Artificial Sequence
  Synthetic oligonucleotide; GGG chr11 5217545 5217564 5217561 +
aaagtcattggtagcttgat

SEQ ID NO: 7685 - DNA, 20 bp, Artificial Sequence
  Synthetic oligonucleotide; GGG chr11 5217546 5217565 5217562 +
aagtcattggtagcttgatg

SEQ ID NO: 7686 - DNA, 20 bp, Artificial Sequence
  Synthetic oligonucleotide; TGG chr11 5217550 5217569 5217566 +
cattggtagcttgatgggga

SEQ ID NO: 7687 - DNA, 20 bp, Artificial Sequence
  Synthetic oligonucleotide; TGG chr11 5217574 5217593 5217590 +
attgaatctataaattacct

SEQ ID NO: 7688 - DNA, 20 bp, Artificial Sequence
  Synthetic oligonucleotide; GGG chr11 5217575 5217594 5217591 +
ttgaatctataaattacctt

SEQ ID NO: 7689 - DNA, 20 bp, Artificial Sequence
  Synthetic oligonucleotide; CAG chr11 5217578 5217597 5217594 +
aatctataaattaccttggg

SEQ ID NO: 7690 - DNA, 20 bp, Artificial Sequence
  Synthetic oligonucleotide; GAG chr11 5217618 5217637 5217634 +
tattgattcttcctacccat

SEQ ID NO: 7691 - DNA, 20 bp, Artificial Sequence
  Synthetic oligonucleotide; TGG chr11 5217623 5217642 5217639 +
attcttcctacccatgagca

SEQ ID NO: 7692 - DNA, 20 bp, Artificial Sequence
  Synthetic oligonucleotide; GAG chr11 5217665 5217684 5217681 +
gtatcctcttttatttcatt

SEQ ID NO: 7693 - DNA, 20 bp, Artificial Sequence
  Synthetic oligonucleotide; CAG chr11 5217668 5217687 5217684 +
tcctcttttatttcattgag

SEQ ID NO: 7694 - DNA, 20 bp, Artificial Sequence
  Synthetic oligonucleotide; TGG chr11 5217671 5217690 5217687 +
tcttttatttcattgagcag

SEQ ID NO: 7695 - DNA, 20 bp, Artificial Sequence
  Synthetic oligonucleotide; TAG chr11 5217678 5217697 5217694 +
tttcattgagcagtggtttg

SEQ ID NO: 7696 - DNA, 20 bp, Artificial Sequence
  Synthetic oligonucleotide; AAG chr11 5217690 5217709 5217706 +
gtggtttgtagttctccttg

SEQ ID NO: 7697 - DNA, 20 bp, Artificial Sequence
  Synthetic oligonucleotide; GAG chr11 5217692 5217711 5217708 +
ggtttgtagttctccttgaa

SEQ ID NO: 7698 - DNA, 20 bp, Artificial Sequence
  Synthetic oligonucleotide; AGG chr11 5217693 5217712 5217709 +
gtttgtagttctccttgaag

SEQ ID NO: 7699 - DNA, 20 bp, Artificial Sequence
  Synthetic oligonucleotide; AAG chr11 5217713 5217732 5217729 +
aggtccttcacatcccttgt

SEQ ID NO: 7700 - DNA, 20 bp, Artificial Sequence
  Synthetic oligonucleotide; TGG chr11 5217717 5217736 5217733 +
ccttcacatcccttgtaagt

SEQ ID NO: 7701 - DNA, 20 bp, Artificial Sequence
  Synthetic oligonucleotide; TAG chr11 5217725 5217744 5217741 +
tcccttgtaagttggattcc

SEQ ID NO: 7702 - DNA, 20 bp, Artificial Sequence
  Synthetic oligonucleotide; AGG chr11 5217726 5217745 5217742 +
cccttgtaagttggattcct

SEQ ID NO: 7703 - DNA, 20 bp, Artificial Sequence
  Synthetic oligonucleotide; AAG chr11 5217745 5217764 5217761 +
taggtattttattctctttg

SEQ ID NO: 7704 - DNA, 20 bp, Artificial Sequence
  Synthetic oligonucleotide; TGG chr11 5217758 5217777 5217774 +
ctctttgaagcaattgtgaa

SEQ ID NO: 7705 - DNA, 20 bp, Artificial Sequence
  Synthetic oligonucleotide; GGG chr11 5217759 5217778 5217775 +
tctttgaagcaattgtgaat

SEQ ID NO: 7706 - DNA, 20 bp, Artificial Sequence
  Synthetic oligonucleotide; GAG chr11 5217761 5217780 5217777 +
tttgaagcaattgtgaatgg

SEQ ID NO: 7707 - DNA, 20 bp, Artificial Sequence
  Synthetic oligonucleotide; TGG chr11 5217777 5217796 5217793 +
atgggagttcactcatgatt

SEQ ID NO: 7708 - DNA, 20 bp, Artificial Sequence
  Synthetic oligonucleotide; TGG chr11 5217799 5217818 5217815 +
gctctctgtttgtctgttat

SEQ ID NO: 7709 - DNA, 20 bp, Artificial Sequence
  Synthetic oligonucleotide; TAG chr11 5217806 5217825 5217822 +
gtttgtctgttattggtgca

SEQ ID NO: 7710 - DNA, 20 bp, Artificial Sequence
  Synthetic oligonucleotide; AGG chr11 5217807 5217826 5217823 +
tttgtctgttattggtgcat

SEQ ID NO: 7711 - DNA, 20 bp, Artificial Sequence
  Synthetic oligonucleotide; GAG chr11 5217846 5217865 5217862 +
gcacactgattttatatcct

SEQ ID NO: 7712 - DNA, 20 bp, Artificial Sequence
  Synthetic oligonucleotide; AAG chr11 5217858 5217877 5217874 +
tatatcctgagactttgctg

SEQ ID NO: 7713 - DNA, 20 bp, Artificial Sequence
  Synthetic oligonucleotide; CAG chr11 5217869 5217888 5217885 +
actttgctgaagttgcttat

SEQ ID NO: 7714 - DNA, 20 bp, Artificial Sequence
  Synthetic oligonucleotide; AAG chr11 5217875 5217894 5217891 +
ctgaagttgcttatcagctt

SEQ ID NO: 7715 - DNA, 20 bp, Artificial Sequence
  Synthetic oligonucleotide; AGG chr11 5217876 5217895 5217892 +
tgaagttgcttatcagctta

SEQ ID NO: 7716 - DNA, 20 bp, Artificial Sequence
  Synthetic oligonucleotide; GAG chr11 5217878 5217897 5217894 +
aagttgcttatcagcttaag

SEQ ID NO: 7717 - DNA, 20 bp, Artificial Sequence
  Synthetic oligonucleotide; TGG chr11 5217885 5217904 5217901 +
ttatcagcttaaggagattt

SEQ ID NO: 7718 - DNA, 20 bp, Artificial Sequence
  Synthetic oligonucleotide; GGG chr11 5217886 5217905 5217902 +
tatcagcttaaggagatttt

SEQ ID NO: 7719 - DNA, 20 bp, Artificial Sequence
  Synthetic oligonucleotide; GAG chr11 5217891 5217910 5217907 +
gcttaaggagattttgggct

SEQ ID NO: 7720 - DNA, 20 bp, Artificial Sequence
  Synthetic oligonucleotide; TGG chr11 5217898 5217917 5217914 +
gagattttgggctgagacaa

SEQ ID NO: 7721 - DNA, 20 bp, Artificial Sequence
  Synthetic oligonucleotide; GGG chr11 5217899 5217918 5217915 +
agattttgggctgagacaat

SEQ ID NO: 7722 - DNA, 20 bp, Artificial Sequence
  Synthetic oligonucleotide; GGG chr11 5217900 5217919 5217916 +
gattttgggctgagacaatg

SEQ ID NO: 7723 - DNA, 20 bp, Artificial Sequence
  Synthetic oligonucleotide; TAG chr11 5217908 5217927 5217924 +
gctgagacaatggggttttc

SEQ ID NO: 7724 - DNA, 20 bp, Artificial Sequence
  Synthetic oligonucleotide; CAG chr11 5217935 5217954 5217951 +
acaatcatgtcatctgcaaa

SEQ ID NO: 7725 - DNA, 20 bp, Artificial Sequence
  Synthetic oligonucleotide; AGG chr11 5217936 5217955 5217952 +
caatcatgtcatctgcaaac

SEQ ID NO: 7726 - DNA, 20 bp, Artificial Sequence
  Synthetic oligonucleotide; GGG chr11 5217937 5217956 5217953 +
aatcatgtcatctgcaaaca

SEQ ID NO: 7727 - DNA, 20 bp, Artificial Sequence
  Synthetic oligonucleotide; TGG chr11 5218003 5218022 5218019 +
cttctcctgcctgattgccc

SEQ ID NO: 7728 - DNA, 20 bp, Artificial Sequence
  Synthetic oligonucleotide; CAG chr11 5218007 5218026 5218023 +
tcctgcctgattgccctggc

SEQ ID NO: 7729 - DNA, 20 bp, Artificial Sequence
  Synthetic oligonucleotide; TAG chr11 5218031 5218050 5218047 +
acttacaacactatgttgaa

SEQ ID NO: 7730 - DNA, 20 bp, Artificial Sequence
  Synthetic oligonucleotide; AGG chr11 5218032 5218051 5218048 +
cttacaacactatgttgaat

SEQ ID NO: 7731 - DNA, 20 bp, Artificial Sequence
  Synthetic oligonucleotide; GAG chr11 5218034 5218053 5218050 +
tacaacactatgttgaatag

SEQ ID NO: 7732 - DNA, 20 bp, Artificial Sequence
  Synthetic oligonucleotide; TGG chr11 5218037 5218056 5218053 +
aacactatgttgaataggag

SEQ ID NO: 7733 - DNA, 20 bp, Artificial Sequence
  Synthetic oligonucleotide; GAG chr11 5218041 5218060 5218057 +
ctatgttgaataggagtggt

SEQ ID NO: 7734 - DNA, 20 bp, Artificial Sequence
  Synthetic oligonucleotide; GAG chr11 5218043 5218062 5218059 +
atgttgaataggagtggtga

SEQ ID NO: 7735 - DNA, 20 bp, Artificial Sequence
  Synthetic oligonucleotide; GAG chr11 5218045 5218064 5218061 +
gttgaataggagtggtgaga

SEQ ID NO: 7736 - DNA, 20 bp, Artificial Sequence
  Synthetic oligonucleotide; AGG chr11 5218046 5218065 5218062 +
ttgaataggagtggtgagag

SEQ ID NO: 7737 - DNA, 20 bp, Artificial Sequence
  Synthetic oligonucleotide; GGG chr11 5218047 5218066 5218063 +
tgaataggagtggtgagaga

SEQ ID NO: 7738 - DNA, 20 bp, Artificial Sequence
  Synthetic oligonucleotide; CAG chr11 5218066 5218085 5218082 +
agggcatccctgccttgtgc

SEQ ID NO: 7739 - DNA, 20 bp, Artificial Sequence
  Synthetic oligonucleotide; AAG chr11 5218075 5218094 5218091 +
ctgccttgtgccagttttca

SEQ ID NO: 7740 - DNA, 20 bp, Artificial Sequence
  Synthetic oligonucleotide; AGG chr11 5218076 5218095 5218092 +
tgccttgtgccagttttcaa

SEQ ID NO: 7741 - DNA, 20 bp, Artificial Sequence
  Synthetic oligonucleotide; GGG chr11 5218077 5218096 5218093 +
gccttgtgccagttttcaaa

SEQ ID NO: 7742 - DNA, 20 bp, Artificial Sequence
  Synthetic oligonucleotide; CAG chr11 5218088 5218107 5218104 +
gttttcaaagggaatgcttc

SEQ ID NO: 7743 - DNA, 20 bp, Artificial Sequence
  Synthetic oligonucleotide; CAG chr11 5218103 5218122 5218119 +
gcttccagtttttgtccact

SEQ ID NO: 7744 - DNA, 20 bp, Artificial Sequence
  Synthetic oligonucleotide; TGG chr11 5218114 5218133 5218130 +
ttgtccactcagtatgatat

SEQ ID NO: 7745 - DNA, 20 bp, Artificial Sequence
  Synthetic oligonucleotide; TGG chr11 5218120 5218139 5218136 +
actcagtatgatattggctg

SEQ ID NO: 7746 - DNA, 20 bp, Artificial Sequence
  Synthetic oligonucleotide; GGG chr11 5218121 5218140 5218137 +
ctcagtatgatattggctgt

SEQ ID NO: 7747 - DNA, 20 bp, Artificial Sequence
  Synthetic oligonucleotide; TAG chr11 5218131 5218150 5218147 +
tattggctgtgggtttgtca

SEQ ID NO: 7748 - DNA, 20 bp, Artificial Sequence
  Synthetic oligonucleotide; TAG chr11 5218135 5218154 5218151 +
ggctgtgggtttgtcataga

SEQ ID NO: 7749 - DNA, 20 bp, Artificial Sequence
  Synthetic oligonucleotide; GAG chr11 5218151 5218170 5218167 +
tagatagctcttattatttt

SEQ ID NO: 7750 - DNA, 20 bp, Artificial Sequence
  Synthetic oligonucleotide; GAG chr11 5218181 5218200 5218197 +
ccatcaatacctaatttatt

SEQ ID NO: 7751 - DNA, 20 bp, Artificial Sequence
  Synthetic oligonucleotide; GAG chr11 5218183 5218202 5218199 +
atcaatacctaatttattga

SEQ ID NO: 7752 - DNA, 20 bp, Artificial Sequence
  Synthetic oligonucleotide; TAG chr11 5218190 5218209 5218206 +
cctaatttattgagagtttt

SEQ ID NO: 7753 - DNA, 20 bp, Artificial Sequence
  Synthetic oligonucleotide; AAG chr11 5218197 5218216 5218213 +
tattgagagtttttagcatg

SEQ ID NO: 7754 - DNA, 20 bp, Artificial Sequence
  Synthetic oligonucleotide; AAG chr11 5218218 5218237 5218234 +
agcgttgttgaattttgtca

SEQ ID NO: 7755 - DNA, 20 bp, Artificial Sequence
  Synthetic oligonucleotide; AGG chr11 5218219 5218238 5218235 +
gcgttgttgaattttgtcaa

SEQ ID NO: 7756 - DNA, 20 bp, Artificial Sequence
  Synthetic oligonucleotide; GAG chr11 5218239 5218258 5218255 +
aggccttttctgcatctatt

SEQ ID NO: 7757 - DNA, 20 bp, Artificial Sequence
  Synthetic oligonucleotide; TGG chr11 5218251 5218270 5218267 +
catctattgagataatcata

SEQ ID NO: 7758 - DNA, 20 bp, Artificial Sequence
  Synthetic oligonucleotide; TGG chr11 5218264 5218283 5218280 +
aatcatatggtttgtgtctt

SEQ ID NO: 7759 - DNA, 20 bp, Artificial Sequence
  Synthetic oligonucleotide; TGG chr11 5218281 5218300 5218297 +
ctttggttctgtttatatgc

SEQ ID NO: 7760 - DNA, 20 bp, Artificial Sequence
  Synthetic oligonucleotide; CAG chr11 5218314 5218333 5218330 +
ttgattttcgtatgttgaac

SEQ ID NO: 7761 - DNA, 20 bp, Artificial Sequence
  Synthetic oligonucleotide; TGG chr11 5218324 5218343 5218340 +
tatgttgaaccagccttgca

SEQ ID NO: 7762 - DNA, 20 bp, Artificial Sequence
  Synthetic oligonucleotide; CAG chr11 5218327 5218346 5218343 +
gttgaaccagccttgcatgg

SEQ ID NO: 7763 - DNA, 20 bp, Artificial Sequence
  Synthetic oligonucleotide; AGG chr11 5218328 5218347 5218344 +
ttgaaccagccttgcatggc

SEQ ID NO: 7764 - DNA, 20 bp, Artificial Sequence
  Synthetic oligonucleotide; GGG chr11 5218329 5218348 5218345 +
tgaaccagccttgcatggca

SEQ ID NO: 7765 - DNA, 20 bp, Artificial Sequence
  Synthetic oligonucleotide; AAG chr11 5218335 5218354 5218351 +
agccttgcatggcagggatg

SEQ ID NO: 7766 - DNA, 20 bp, Artificial Sequence
  Synthetic oligonucleotide; TGG chr11 5218350 5218369 5218366 +
ggatgaagcccacttgatca

SEQ ID NO: 7767 - DNA, 20 bp, Artificial Sequence
  Synthetic oligonucleotide; TGG chr11 5218353 5218372 5218369 +
tgaagcccacttgatcatgg

SEQ ID NO: 7768 - DNA, 20 bp, Artificial Sequence
  Synthetic oligonucleotide; CAG chr11 5218358 5218377 5218374 +
cccacttgatcatggtggat

SEQ ID NO: 7769 - DNA, 20 bp, Artificial Sequence
  Synthetic oligonucleotide; CAG chr11 5218366 5218385 5218382 +
atcatggtggatcagtttgc

SEQ ID NO: 7770 - DNA, 20 bp, Artificial Sequence
  Synthetic oligonucleotide; GAG chr11 5218378 5218397 5218394 +
cagtttgccagtattttatt

SEQ ID NO: 7771 - DNA, 20 bp, Artificial Sequence
  Synthetic oligonucleotide; AGG chr11 5218379 5218398 5218395 +
agtttgccagtattttattg

SEQ ID NO: 7772 - DNA, 20 bp, Artificial Sequence
  Synthetic oligonucleotide; AAG chr11 5218403 5218422 5218419 +
tttttgcatcaatgttcatc

SEQ ID NO: 7773 - DNA, 20 bp, Artificial Sequence
  Synthetic oligonucleotide; AGG chr11 5218404 5218423 5218420 +
ttttgcatcaatgttcatca

SEQ ID NO: 7774 - DNA, 20 bp, Artificial Sequence
  Synthetic oligonucleotide; TGG chr11 5218411 5218430 5218427 +
tcaatgttcatcaaggatat

SEQ ID NO: 7775 - DNA, 20 bp, Artificial Sequence
  Synthetic oligonucleotide; CAG chr11 5218446 5218465 5218462 +
tttttttgttgtgtctctgt

SEQ ID NO: 7776 - DNA, 20 bp, Artificial Sequence
  Synthetic oligonucleotide; AGG chr11 5218447 5218466 5218463 +
ttttttgttgtgtctctgtc

SEQ ID NO: 7777 - DNA, 20 bp, Artificial Sequence
  Synthetic oligonucleotide; TGG chr11 5218453 5218472 5218469 +
gttgtgtctctgtcaggctt

SEQ ID NO: 7778 - DNA, 20 bp, Artificial Sequence
  Synthetic oligonucleotide; CAG chr11 5218459 5218478 5218475 +
tctctgtcaggctttggtat

SEQ ID NO: 7779 - DNA, 20 bp, Artificial Sequence
  Synthetic oligonucleotide; AGG chr11 5218460 5218479 5218476 +
ctctgtcaggctttggtatc

SEQ ID NO: 7780 - DNA, 20 bp, Artificial Sequence
  Synthetic oligonucleotide; TGG chr11 5218470 5218489 5218486 +
ctttggtatcaggatgatgc

SEQ ID NO: 7781 - DNA, 20 bp, Artificial Sequence
  Synthetic oligonucleotide; GAG chr11 5218484 5218503 5218500 +
tgatgctggcctcataaaat

SEQ ID NO: 7782 - DNA, 20 bp, Artificial Sequence
  Synthetic oligonucleotide; TAG chr11 5218488 5218507 5218504 +
gctggcctcataaaatgagt

SEQ ID NO: 7783 - DNA, 20 bp, Artificial Sequence
  Synthetic oligonucleotide; AGG chr11 5218489 5218508 5218505 +
ctggcctcataaaatgagtt

SEQ ID NO: 7784 - DNA, 20 bp, Artificial Sequence
  Synthetic oligonucleotide; GGG chr11 5218490 5218509 5218506 +
tggcctcataaaatgagtta

SEQ ID NO: 7785 - DNA, 20 bp, Artificial Sequence
  Synthetic oligonucleotide; GAG chr11 5218492 5218511 5218508 +
gcctcataaaatgagttagg

SEQ ID NO: 7786 - DNA, 20 bp, Artificial Sequence
  Synthetic oligonucleotide; AGG chr11 5218493 5218512 5218509 +
cctcataaaatgagttaggg

SEQ ID NO: 7787 - DNA, 20 bp, Artificial Sequence
  Synthetic oligonucleotide; TGG chr11 5218517 5218536 5218533 +
ttccctctttttctattgat

SEQ ID NO: 7788 - DNA, 20 bp, Artificial Sequence
  Synthetic oligonucleotide; TAG chr11 5218522 5218541 5218538 +
tctttttctattgattggaa

SEQ ID NO: 7789 - DNA, 20 bp, Artificial Sequence
  Synthetic oligonucleotide; CAG chr11 5218528 5218547 5218544 +
tctattgattggaatagttt

SEQ ID NO: 7790 - DNA, 20 bp, Artificial Sequence
  Synthetic oligonucleotide; AAG chr11 5218531 5218550 5218547 +
attgattggaatagtttcag

SEQ ID NO: 7791 - DNA, 20 bp, Artificial Sequence
  Synthetic oligonucleotide; AGG chr11 5218532 5218551 5218548 +
ttgattggaatagtttcaga

SEQ ID NO: 7792 - DNA, 20 bp, Artificial Sequence
  Synthetic oligonucleotide; TGG chr11 5218537 5218556 5218553 +
tggaatagtttcagaaggaa

SEQ ID NO: 7793 - DNA, 20 bp, Artificial Sequence
  Synthetic oligonucleotide; CAG chr11 5218543 5218562 5218559 +
agtttcagaaggaatggtac

SEQ ID NO: 7794 - DNA, 20 bp, Artificial Sequence
  Synthetic oligonucleotide; TGG chr11 5218562 5218581 5218578 +
ccagctcctccttgtacctc

SEQ ID NO: 7795 - DNA, 20 bp, Artificial Sequence
  Synthetic oligonucleotide; TAG chr11 5218565 5218584 5218581 +
gctcctccttgtacctctgg

SEQ ID NO: 7796 - DNA, 20 bp, Artificial Sequence
  Synthetic oligonucleotide; CGG chr11 5218572 5218591 5218588 +
cttgtacctctggtagaatt

SEQ ID NO: 7797 - DNA, 20 bp, Artificial Sequence
  Synthetic oligonucleotide; TGG chr11 5218588 5218607 5218604 +
aattcggctatgaatcctac

SEQ ID NO: 7798 - DNA, 20 bp, Artificial Sequence
  Synthetic oligonucleotide; CGG chr11 5218594 5218613 5218610 +
gctatgaatcctactggtcc

SEQ ID NO: 7799 - DNA, 20 bp, Artificial Sequence
  Synthetic oligonucleotide; TGG chr11 5218605 5218624 5218621 +
tactggtcccggactttttt

SEQ ID NO: 7800 - DNA, 20 bp, Artificial Sequence
  Synthetic oligonucleotide; AAG chr11 5218613 5218632 5218629 +
ccggactttttttggttgat

SEQ ID NO: 7801 - DNA, 20 bp, Artificial Sequence
  Synthetic oligonucleotide; CAG chr11 5218638 5218657 5218654 +
attaattattgcctcaattt

SEQ ID NO: 7802 - DNA, 20 bp, Artificial Sequence
  Synthetic oligonucleotide; GAG chr11 5218640 5218659 5218656 +
taattattgcctcaatttca

SEQ ID NO: 7803 - DNA, 20 bp, Artificial Sequence
  Synthetic oligonucleotide; TGG chr11 5218651 5218670 5218667 +
tcaatttcagagcctgttat

SEQ ID NO: 7804 - DNA, 20 bp, Artificial Sequence
  Synthetic oligonucleotide; CAG chr11 5218660 5218679 5218676 +
gagcctgttattggtctatt

SEQ ID NO: 7805 - DNA, 20 bp, Artificial Sequence
  Synthetic oligonucleotide; GAG chr11 5218662 5218681 5218678 +
gcctgttattggtctattca

SEQ ID NO: 7806 - DNA, 20 bp, Artificial Sequence
  Synthetic oligonucleotide; TGG chr11 5218679 5218698 5218695 +
tcagagatacaacttcttcc

SEQ ID NO: 7807 - DNA, 20 bp, Artificial Sequence
  Synthetic oligonucleotide; TAG chr11 5218684 5218703 5218700 +
gatacaacttcttcctggtt

SEQ ID NO: 7808 - DNA, 20 bp, Artificial Sequence
  Synthetic oligonucleotide; TGG chr11 5218690 5218709 5218706 +
acttcttcctggtttagtct

SEQ ID NO: 7809 - DNA, 20 bp, Artificial Sequence
  Synthetic oligonucleotide; CAG chr11 5218693 5218712 5218709 +
tcttcctggtttagtcttgg

SEQ ID NO: 7810 - DNA, 20 bp, Artificial Sequence
  Synthetic oligonucleotide; GAG chr11 5218695 5218714 5218711 +
ttcctggtttagtcttggca

SEQ ID NO: 7811 - DNA, 20 bp, Artificial Sequence
  Synthetic oligonucleotide; GAG chr11 5218708 5218727 5218724 +
cttggcagagtgtatgtgtc

SEQ ID NO: 7812 - DNA, 20 bp, Artificial Sequence
  Synthetic oligonucleotide; AGG chr11 5218709 5218728 5218725 +
ttggcagagtgtatgtgtcg

SEQ ID NO: 7813 - DNA, 20 bp, Artificial Sequence
  Synthetic oligonucleotide; TAG chr11 5218729 5218748 5218745 +
aggaatttatccatttcttc

SEQ ID NO: 7814 - DNA, 20 bp, Artificial Sequence
  Synthetic oligonucleotide; TAG chr11 5218738 5218757 5218754 +
tccatttcttctagattttc

SEQ ID NO: 7815 - DNA, 20 bp, Artificial Sequence
  Synthetic oligonucleotide; TAG chr11 5218751 5218770 5218767 +
gattttctagtttatttgcg

SEQ ID NO: 7816 - DNA, 20 bp, Artificial Sequence
  Synthetic oligonucleotide; GAG chr11 5218753 5218772 5218769 +
ttttctagtttatttgcgta

SEQ ID NO: 7817 - DNA, 20 bp, Artificial Sequence
  Synthetic oligonucleotide; AGG chr11 5218754 5218773 5218770 +
tttctagtttatttgcgtag

SEQ ID NO: 7818 - DNA, 20 bp, Artificial Sequence
  Synthetic oligonucleotide; TAG chr11 5218763 5218782 5218779 +
tatttgcgtagaggtgttta

SEQ ID NO: 7819 - DNA, 20 bp, Artificial Sequence
  Synthetic oligonucleotide; CGG chr11 5218776 5218795 5218792 +
gtgtttatagtattctctga

SEQ ID NO: 7820 - DNA, 20 bp, Artificial Sequence
  Synthetic oligonucleotide; TAG chr11 5218779 5218798 5218795 +
tttatagtattctctgacgg

SEQ ID NO: 7821 - DNA, 20 bp, Artificial Sequence
  Synthetic oligonucleotide; TGG chr11 5218794 5218813 5218810 +
gacggtagtttgtatttctg

SEQ ID NO: 7822 - DNA, 20 bp, Artificial Sequence
  Synthetic oligonucleotide; GGG chr11 5218795 5218814 5218811 +
acggtagtttgtatttctgt

SEQ ID NO: 7823 - DNA, 20 bp, Artificial Sequence
  Synthetic oligonucleotide; CAG chr11 5218800 5218819 5218816 +
agtttgtatttctgtgggat

SEQ ID NO: 7824 - DNA, 20 bp, Artificial Sequence
  Synthetic oligonucleotide; TGG chr11 5218803 5218822 5218819 +
ttgtatttctgtgggatcag

SEQ ID NO: 7825 - DNA, 20 bp, Artificial Sequence
  Synthetic oligonucleotide; TAG chr11 5218865 5218884 5218881 +
ttctctcttttcttctttat

SEQ ID NO: 7826 - DNA, 20 bp, Artificial Sequence
  Synthetic oligonucleotide; TAG chr11 5218874 5218893 5218890 +
ttcttctttattagtcttgc

SEQ ID NO: 7827 - DNA, 20 bp, Artificial Sequence
  Synthetic oligonucleotide; CAG chr11 5218877 5218896 5218893 +
ttctttattagtcttgctag

SEQ ID NO: 7828 - DNA, 20 bp, Artificial Sequence
  Synthetic oligonucleotide; CAG chr11 5218911 5218930 5218927 +
tgttgatcttttcaaaaaaa

SEQ ID NO: 7829 - DNA, 20 bp, Artificial Sequence
  Synthetic oligonucleotide; TGG chr11 5218918 5218937 5218934 +
cttttcaaaaaaacagcttc

SEQ ID NO: 7830 - DNA, 20 bp, Artificial Sequence
  Synthetic oligonucleotide; AAG chr11 5218938 5218957 5218954 +
tggattcattgatttttttg

SEQ ID NO: 7831 - DNA, 20 bp, Artificial Sequence
  Synthetic oligonucleotide; AGG chr11 5218939 5218958 5218955 +
ggattcattgatttttttga

SEQ ID NO: 7832 - DNA, 20 bp, Artificial Sequence
  Synthetic oligonucleotide; GGG chr11 5218940 5218959 5218956 +
gattcattgatttttttgaa

SEQ ID NO: 7833 - DNA, 20 bp, Artificial Sequence
  Synthetic oligonucleotide; TAG chr11 5218983 5219002 5218999 +
cttcacttctgctctgatct

SEQ ID NO: 7834 - DNA, 20 bp, Artificial Sequence
  Synthetic oligonucleotide; TAG chr11 5219004 5219023 5219020 +
agttatttcttgtcttctgt

SEQ ID NO: 7835 - DNA, 20 bp, Artificial Sequence
  Synthetic oligonucleotide; TAG chr11 5219035 5219054 5219051 +
tgtgtttgctcctgcttctc

SEQ ID NO: 7836 - DNA, 20 bp, Artificial Sequence
  Synthetic oligonucleotide; TAG chr11 5219055 5219074 5219071 +
tagttttttaattgtgatgt

SEQ ID NO: 7837 - DNA, 20 bp, Artificial Sequence
  Synthetic oligonucleotide; AGG chr11 5219056 5219075 5219072 +
agttttttaattgtgatgtt

SEQ ID NO: 7838 - DNA, 20 bp, Artificial Sequence
  Synthetic oligonucleotide; GGG chr11 5219057 5219076 5219073 +
gttttttaattgtgatgtta

SEQ ID NO: 7839 - DNA, 20 bp, Artificial Sequence
  Synthetic oligonucleotide; TAG chr11 5219069 5219088 5219085 +
tgatgttagggtgtcaattt

SEQ ID NO: 7840 - DNA, 20 bp, Artificial Sequence
  Synthetic oligonucleotide; TGG chr11 5219092 5219111 5219108 +
atctttcctgctttcccttg

SEQ ID NO: 7841 - DNA, 20 bp, Artificial Sequence
  Synthetic oligonucleotide; GGG chr11 5219093 5219112 5219109 +
tctttcctgctttcccttgt

SEQ ID NO: 7842 - DNA, 20 bp, Artificial Sequence
  Synthetic oligonucleotide; TAG chr11 5219100 5219119 5219116 +
tgctttcccttgtgggcatt

SEQ ID NO: 7843 - DNA, 20 bp, Artificial Sequence
  Synthetic oligonucleotide; CAG chr11 5219143 5219162 5219159 +
acactgctttgaatgtgtct

SEQ ID NO: 7844 - DNA, 20 bp, Artificial Sequence
  Synthetic oligonucleotide; GAG chr11 5219145 5219164 5219161 +
actgctttgaatgtgtctca

SEQ ID NO: 7845 - DNA, 20 bp, Artificial Sequence
  Synthetic oligonucleotide; TGG chr11 5219152 5219171 5219168 +
tgaatgtgtctcagagattc

SEQ ID NO: 7846 - DNA, 20 bp, Artificial Sequence
  Synthetic oligonucleotide; TGG chr11 5219177 5219196 5219193 +
tgttgtgtctttgttctcgt

SEQ ID NO: 7847 - DNA, 20 bp, Artificial Sequence
  Synthetic oligonucleotide; AAG chr11 5219185 5219204 5219201 +
ctttgttctcgttggtttca

SEQ ID NO: 7848 - DNA, 20 bp, Artificial Sequence
  Synthetic oligonucleotide; CAG chr11 5219224 5219243 5219240 +
ccttcattttgttatgtacc

SEQ ID NO: 7849 - DNA, 20 bp, Artificial Sequence
  Synthetic oligonucleotide; TAG chr11 5219227 5219246 5219243 +
tcattttgttatgtacccag

SEQ ID NO: 7850 - DNA, 20 bp, Artificial Sequence
  Synthetic oligonucleotide; CAG chr11 5219235 5219254 5219251 +
ttatgtacccagtagtcatt

SEQ ID NO: 7851 - DNA, 20 bp, Artificial Sequence
  Synthetic oligonucleotide; AGG chr11 5219236 5219255 5219252 +
tatgtacccagtagtcattc

SEQ ID NO: 7852 - DNA, 20 bp, Artificial Sequence
  Synthetic oligonucleotide; GAG chr11 5219238 5219257 5219254 +
tgtacccagtagtcattcag

SEQ ID NO: 7853 - DNA, 20 bp, Artificial Sequence
  Synthetic oligonucleotide; CAG chr11 5219241 5219260 5219257 +
acccagtagtcattcaggag

SEQ ID NO: 7854 - DNA, 20 bp, Artificial Sequence
  Synthetic oligonucleotide; AGG chr11 5219242 5219261 5219258 +
cccagtagtcattcaggagc

SEQ ID NO: 7855 - DNA, 20 bp, Artificial Sequence
  Synthetic oligonucleotide; CAG chr11 5219250 5219269 5219266 +
tcattcaggagcaggctgtt

SEQ ID NO: 7856 - DNA, 20 bp, Artificial Sequence
  Synthetic oligonucleotide; TAG chr11 5219261 5219280 5219277 +
caggctgttcagtttccatg

SEQ ID NO: 7857 - DNA, 20 bp, Artificial Sequence
  Synthetic oligonucleotide; GAG chr11 5219266 5219285 5219282 +
tgttcagtttccatgtagct

SEQ ID NO: 7858 - DNA, 20 bp, Artificial Sequence
  Synthetic oligonucleotide; TGG chr11 5219269 5219288 5219285 +
tcagtttccatgtagctgag

SEQ ID NO: 7859 - DNA, 20 bp, Artificial Sequence
  Synthetic oligonucleotide; GAG chr11 5219276 5219295 5219292 +
ccatgtagctgagtggtttt

SEQ ID NO: 7860 - DNA, 20 bp, Artificial Sequence
  Synthetic oligonucleotide; GAG chr11 5219280 5219299 5219296 +
gtagctgagtggttttgagt

SEQ ID NO: 7861 - DNA, 20 bp, Artificial Sequence
  Synthetic oligonucleotide; GAG chr11 5219295 5219314 5219311 +
tgagtgagtttcttaatcct

SEQ ID NO: 7862 - DNA, 20 bp, Artificial Sequence
  Synthetic oligonucleotide; TAG chr11 5219301 5219320 5219317 +
agtttcttaatcctgagttc

SEQ ID NO: 7863 - DNA, 20 bp, Artificial Sequence
  Synthetic oligonucleotide; TGG chr11 5219317 5219336 5219333 +
gttctagtttgattgcactg

SEQ ID NO: 7864 - DNA, 20 bp, Artificial Sequence
  Synthetic oligonucleotide; GAG chr11 5219323 5219342 5219339 +
gtttgattgcactgtggtct

SEQ ID NO: 7865 - DNA, 20 bp, Artificial Sequence
  Synthetic oligonucleotide; GAG chr11 5219325 5219344 5219341 +
ttgattgcactgtggtctga

SEQ ID NO: 7866 - DNA, 20 bp, Artificial Sequence
  Synthetic oligonucleotide; CAG chr11 5219329 5219348 5219345 +
ttgcactgtggtctgagaga

SEQ ID NO: 7867 - DNA, 20 bp, Artificial Sequence
  Synthetic oligonucleotide; TAG chr11 5219339 5219358 5219355 +
gtctgagagacagtttgtta

SEQ ID NO: 7868 - DNA, 20 bp, Artificial Sequence
  Synthetic oligonucleotide; GAG chr11 5219364 5219383 5219380 +
tctgttcttttacatttgct

SEQ ID NO: 7869 - DNA, 20 bp, Artificial Sequence
  Synthetic oligonucleotide; AGG chr11 5219365 5219384 5219381 +
ctgttcttttacatttgctg

SEQ ID NO: 7870 - DNA, 20 bp, Artificial Sequence
  Synthetic oligonucleotide; GAG chr11 5219367 5219386 5219383 +
gttcttttacatttgctgag

SEQ ID NO: 7871 - DNA, 20 bp, Artificial Sequence
  Synthetic oligonucleotide; GAG chr11 5219369 5219388 5219385 +
tcttttacatttgctgagga

SEQ ID NO: 7872 - DNA, 20 bp, Artificial Sequence
  Synthetic oligonucleotide; TGG chr11 5219389 5219408 5219405 +
gagctttacttccaactatg

SEQ ID NO: 7873 - DNA, 20 bp, Artificial Sequence
  Synthetic oligonucleotide; CAG chr11 5219393 5219412 5219409 +
tttacttccaactatgtggt

SEQ ID NO: 7874 - DNA, 20 bp, Artificial Sequence
  Synthetic oligonucleotide; TGG chr11 5219399 5219418 5219415 +
tccaactatgtggtcagttt

SEQ ID NO: 7875 - DNA, 20 bp, Artificial Sequence
  Synthetic oligonucleotide; TAG chr11 5219404 5219423 5219420 +
ctatgtggtcagttttggaa

SEQ ID NO: 7876 - DNA, 20 bp, Artificial Sequence
  Synthetic oligonucleotide; AGG chr11 5219405 5219424 5219421 +
tatgtggtcagttttggaat

SEQ ID NO: 7877 - DNA, 20 bp, Artificial Sequence
  Synthetic oligonucleotide; TGG chr11 5219410 5219429 5219426 +
ggtcagttttggaataggtg

SEQ ID NO: 7878 - DNA, 20 bp, Artificial Sequence
  Synthetic oligonucleotide; TGG chr11 5219415 5219434 5219431 +
gttttggaataggtgtggtg

SEQ ID NO: 7879 - DNA, 20 bp, Artificial Sequence
  Synthetic oligonucleotide; AAG chr11 5219425 5219444 5219441 +
aggtgtggtgtggtgctgaa

SEQ ID NO: 7880 - DNA, 20 bp, Artificial Sequence
  Synthetic oligonucleotide; TGG chr11 5219447 5219466 5219463 +
gaatgtatattctgttgatt

SEQ ID NO: 7881 - DNA, 20 bp, Artificial Sequence
  Synthetic oligonucleotide; GGG chr11 5219448 5219467 5219464 +
aatgtatattctgttgattt

SEQ ID NO: 7882 - DNA, 20 bp, Artificial Sequence
  Synthetic oligonucleotide; GGG chr11 5219449 5219468 5219465 +
atgtatattctgttgatttg

SEQ ID NO: 7883 - DNA, 20 bp, Artificial Sequence
  Synthetic oligonucleotide; TGG chr11 5219452 5219471 5219468 +
tatattctgttgatttgggg

SEQ ID NO: 7884 - DNA, 20 bp, Artificial Sequence
  Synthetic oligonucleotide; GAG chr11 5219454 5219473 5219470 +
tattctgttgatttggggtg

SEQ ID NO: 7885 - DNA, 20 bp, Artificial Sequence
  Synthetic oligonucleotide; GAG chr11 5219456 5219475 5219472 +
ttctgttgatttggggtgga

SEQ ID NO: 7886 - DNA, 20 bp, Artificial Sequence
  Synthetic oligonucleotide; TAG chr11 5219464 5219483 5219480 +
atttggggtggagagttctg

SEQ ID NO: 7887 - DNA, 20 bp, Artificial Sequence
  Synthetic oligonucleotide; TAG chr11 5219475 5219494 5219491 +
agagttctgtagatgtctat

SEQ ID NO: 7888 - DNA, 20 bp, Artificial Sequence
  Synthetic oligonucleotide; AGG chr11 5219476 5219495 5219492 +
gagttctgtagatgtctatt

SEQ ID NO: 7889 - DNA, 20 bp, Artificial Sequence
  Synthetic oligonucleotide; TGG chr11 5219485 5219504 5219501 +
agatgtctattaggtctgct

SEQ ID NO: 7890 - DNA, 20 bp, Artificial Sequence
  Synthetic oligonucleotide; CAG chr11 5219490 5219509 5219506 +
tctattaggtctgcttggtg

SEQ ID NO: 7891 - DNA, 20 bp, Artificial Sequence
  Synthetic oligonucleotide; GAG chr11 5219492 5219511 5219508 +
tattaggtctgcttggtgca

SEQ ID NO: 7892 - DNA, 20 bp, Artificial Sequence
  Synthetic oligonucleotide; GAG chr11 5219497 5219516 5219513 +
ggtctgcttggtgcagagct

SEQ ID NO: 7893 - DNA, 20 bp, Artificial Sequence
  Synthetic oligonucleotide; TGG chr11 5219509 5219528 5219525 +
gcagagctgagtccaattcc

SEQ ID NO: 7894 - DNA, 20 bp, Artificial Sequence
  Synthetic oligonucleotide; CAG chr11 5219556 5219575 5219572 +
gttgatctgtctaatgttga

SEQ ID NO: 7895 - DNA, 20 bp, Artificial Sequence
  Synthetic oligonucleotide; TGG chr11 5219559 5219578 5219575 +
gatctgtctaatgttgacag

SEQ ID NO: 7896 - DNA, 20 bp, Artificial Sequence
  Synthetic oligonucleotide; GGG chr11 5219560 5219579 5219576 +
atctgtctaatgttgacagt

SEQ ID NO: 7897 - DNA, 20 bp, Artificial Sequence
  Synthetic oligonucleotide; GGG chr11 5219561 5219580 5219577 +
tctgtctaatgttgacagtg

SEQ ID NO: 7898 - DNA, 20 bp, Artificial Sequence
  Synthetic oligonucleotide; AAG chr11 5219569 5219588 5219585 +
atgttgacagtggggtgtta

SEQ ID NO: 7899 - DNA, 20 bp, Artificial Sequence
  Synthetic oligonucleotide; TGG chr11 5219590 5219609 5219606 +
agtctcccattattattgtg

SEQ ID NO: 7900 - DNA, 20 bp, Artificial Sequence
  Synthetic oligonucleotide; GGG chr11 5219591 5219610 5219607 +
gtctcccattattattgtgt

SEQ ID NO: 7901 - DNA, 20 bp, Artificial Sequence
  Synthetic oligonucleotide; AAG chr11 5219599 5219618 5219615 +
ttattattgtgtgggcatct

SEQ ID NO: 7902 - DNA, 20 bp, Artificial Sequence
  Synthetic oligonucleotide; TAG chr11 5219610 5219629 5219626 +
tgggcatctaagtctctttg

SEQ ID NO: 7903 - DNA, 20 bp, Artificial Sequence
  Synthetic oligonucleotide; AGG chr11 5219611 5219630 5219627 +
gggcatctaagtctctttgt

SEQ ID NO: 7904 - DNA, 20 bp, Artificial Sequence
  Synthetic oligonucleotide; CAG chr11 5219619 5219638 5219635 +
aagtctctttgtaggtcact

SEQ ID NO: 7905 - DNA, 20 bp, Artificial Sequence
  Synthetic oligonucleotide; AGG chr11 5219620 5219639 5219636 +
agtctctttgtaggtcactc

SEQ ID NO: 7906 - DNA, 20 bp, Artificial Sequence
  Synthetic oligonucleotide; TGG chr11 5219639 5219658 5219655 +
caggacttgttttatgaatc

SEQ ID NO: 7907 - DNA, 20 bp, Artificial Sequence
  Synthetic oligonucleotide; GGG chr11 5219640 5219659 5219656 +
aggacttgttttatgaatct

SEQ ID NO: 7908 - DNA, 20 bp, Artificial Sequence
  Synthetic oligonucleotide; TGG chr11 5219654 5219673 5219670 +
gaatctgggtgctcctgtat

SEQ ID NO: 7909 - DNA, 20 bp, Artificial Sequence
  Synthetic oligonucleotide; GGG chr11 5219655 5219674 5219671 +
aatctgggtgctcctgtatt

SEQ ID NO: 7910 - DNA, 20 bp, Artificial Sequence
  Synthetic oligonucleotide; TAG chr11 5219670 5219689 5219686 +
gtattgggtgcatatatatt

SEQ ID NO: 7911 - DNA, 20 bp, Artificial Sequence
  Synthetic oligonucleotide; TAG chr11 5219675 5219694 5219691 +
gggtgcatatatatttagta

SEQ ID NO: 7912 - DNA, 20 bp, Artificial Sequence
  Synthetic oligonucleotide; TAG chr11 5219679 5219698 5219695 +
gcatatatatttagtatagt

SEQ ID NO: 7913 - DNA, 20 bp, Artificial Sequence
  Synthetic oligonucleotide; TAG chr11 5219696 5219715 5219712 +
agttagttcttcttcttgaa

SEQ ID NO: 7914 - DNA, 20 bp, Artificial Sequence
  Synthetic oligonucleotide; TGG chr11 5219719 5219738 5219735 +
atccctttgccattatgtaa

SEQ ID NO: 7915 - DNA, 20 bp, Artificial Sequence
  Synthetic oligonucleotide; TGG chr11 5219748 5219767 5219764 +
ttgtctcttttgatctttgt

SEQ ID NO: 7916 - DNA, 20 bp, Artificial Sequence
  Synthetic oligonucleotide; CAG chr11 5219768 5219787 5219784 +
tggtttaaaatctgttttat

SEQ ID NO: 7917 - DNA, 20 bp, Artificial Sequence
  Synthetic oligonucleotide; GAG chr11 5219770 5219789 5219786 +
gtttaaaatctgttttatca

SEQ ID NO: 7918 - DNA, 20 bp, Artificial Sequence
  Synthetic oligonucleotide; TAG chr11 5219775 5219794 5219791 +
aaatctgttttatcagagac

SEQ ID NO: 7919 - DNA, 20 bp, Artificial Sequence
  Synthetic oligonucleotide; AGG chr11 5219776 5219795 5219792 +
aatctgttttatcagagact

SEQ ID NO: 7920 - DNA, 20 bp, Artificial Sequence
  Synthetic oligonucleotide; TGG chr11 5219815 5219834 5219831 +
ttttttgttttccatttgct

SEQ ID NO: 7921 - DNA, 20 bp, Artificial Sequence
  Synthetic oligonucleotide; TAG chr11 5219818 5219837 5219834 +
tttgttttccatttgcttgg

SEQ ID NO: 7922 - DNA, 20 bp, Artificial Sequence
  Synthetic oligonucleotide; GAG chr11 5219844 5219863 5219860 +
ttcctccatccttttatttc

SEQ ID NO: 7923 - DNA, 20 bp, Artificial Sequence
  Synthetic oligonucleotide; GAG chr11 5219868 5219887 5219884 +
ctatgtgtgtctctgcacgt

SEQ ID NO: 7924 - DNA, 20 bp, Artificial Sequence
  Synthetic oligonucleotide; TGG chr11 5219872 5219891 5219888 +
gtgtgtctctgcacgtgaga

SEQ ID NO: 7925 - DNA, 20 bp, Artificial Sequence
  Synthetic oligonucleotide; GGG chr11 5219873 5219892 5219889 +
tgtgtctctgcacgtgagat

SEQ ID NO: 7926 - DNA, 20 bp, Artificial Sequence
  Synthetic oligonucleotide; CAG chr11 5219887 5219906 5219903 +
tgagatgggtttcctgaata

SEQ ID NO: 7927 - DNA, 20 bp, Artificial Sequence
  Synthetic oligonucleotide; CAG chr11 5219894 5219913 5219910 +
ggtttcctgaatacagaaca

SEQ ID NO: 7928 - DNA, 20 bp, Artificial Sequence
  Synthetic oligonucleotide; TGG chr11 5219898 5219917 5219914 +
tcctgaatacagaacacaga

SEQ ID NO: 7929 - DNA, 20 bp, Artificial Sequence
  Synthetic oligonucleotide; GGG chr11 5219899 5219918 5219915 +
cctgaatacagaacacagat

SEQ ID NO: 7930 - DNA, 20 bp, Artificial Sequence
  Synthetic oligonucleotide; CAG chr11 5219925 5219944 5219941 +
tgactccttatccaatttgc

SEQ ID NO: 7931 - DNA, 20 bp, Artificial Sequence
  Synthetic oligonucleotide; TGG chr11 5219943 5219962 5219959 +
gccagtctgtgtcttttaat

SEQ ID NO: 7932 - DNA, 20 bp, Artificial Sequence
  Synthetic oligonucleotide; GAG chr11 5219945 5219964 5219961 +
cagtctgtgtcttttaattg

SEQ ID NO: 7933 - DNA, 20 bp, Artificial Sequence
  Synthetic oligonucleotide; TAG chr11 5219952 5219971 5219968 +
tgtcttttaattggagcatt

SEQ ID NO: 7934 - DNA, 20 bp, Artificial Sequence
  Synthetic oligonucleotide; AAG chr11 5219968 5219987 5219984 +
catttagcctatttacattt

SEQ ID NO: 7935 - DNA, 20 bp, Artificial Sequence
  Synthetic oligonucleotide; AGG chr11 5219969 5219988 5219985 +
atttagcctatttacattta

SEQ ID NO: 7936 - DNA, 20 bp, Artificial Sequence
  Synthetic oligonucleotide; GAG chr11 5219973 5219992 5219989 +
agcctatttacatttaaggt

SEQ ID NO: 7937 - DNA, 20 bp, Artificial Sequence
  Synthetic oligonucleotide; TAG chr11 5220014 5220033 5220030 +
tgatcctgtcattatgatgt

SEQ ID NO: 7938 - DNA, 20 bp, Artificial Sequence
  Synthetic oligonucleotide; TGG chr11 5220018 5220037 5220034 +
cctgtcattatgatgttagc

SEQ ID NO: 7939 - DNA, 20 bp, Artificial Sequence
  Synthetic oligonucleotide; CAG chr11 5220039 5220058 5220055 +
ggttattttgctcgttgatg

SEQ ID NO: 7940 - DNA, 20 bp, Artificial Sequence
  Synthetic oligonucleotide; TAG chr11 5220050 5220069 5220066 +
tcgttgatgcagtttcttcc

SEQ ID NO: 7941 - DNA, 20 bp, Artificial Sequence
  Synthetic oligonucleotide; TGG chr11 5220059 5220078 5220075 +
cagtttcttcctagccttga

SEQ ID NO: 7942 - DNA, 20 bp, Artificial Sequence
  Synthetic oligonucleotide; TGG chr11 5220073 5220092 5220089 +
ccttgatggtctttacaatt

SEQ ID NO: 7943 - DNA, 20 bp, Artificial Sequence
  Synthetic oligonucleotide; CAG chr11 5220086 5220105 5220102 +
tacaatttggcatgtttttg

SEQ ID NO: 7944 - DNA, 20 bp, Artificial Sequence
  Synthetic oligonucleotide; TGG chr11 5220089 5220108 5220105 +
aatttggcatgtttttgcag

SEQ ID NO: 7945 - DNA, 20 bp, Artificial Sequence
  Synthetic oligonucleotide; TAG chr11 5220099 5220118 5220115 +
gtttttgcagtggctgatac

SEQ ID NO: 7946 - DNA, 20 bp, Artificial Sequence
  Synthetic oligonucleotide; TAG chr11 5220119 5220138 5220135 +
tagttgttcctttccatgtt

SEQ ID NO: 7947 - DNA, 20 bp, Artificial Sequence
  Synthetic oligonucleotide; CAG chr11 5220131 5220150 5220147 +
tccatgtttagtgcttcctt

SEQ ID NO: 7948 - DNA, 20 bp, Artificial Sequence
  Synthetic oligonucleotide; AGG chr11 5220132 5220151 5220148 +
ccatgtttagtgcttccttc

SEQ ID NO: 7949 - DNA, 20 bp, Artificial Sequence
  Synthetic oligonucleotide; GAG chr11 5220134 5220153 5220150 +
atgtttagtgcttccttcag

SEQ ID NO: 7950 - DNA, 20 bp, Artificial Sequence
  Synthetic oligonucleotide; TAG chr11 5220143 5220162 5220159 +
gcttccttcaggagctcttg

SEQ ID NO: 7951 - DNA, 20 bp, Artificial Sequence
  Synthetic oligonucleotide; AGG chr11 5220144 5220163 5220160 +
cttccttcaggagctcttgt

SEQ ID NO: 7952 - DNA, 20 bp, Artificial Sequence
  Synthetic oligonucleotide; GGG chr11 5220145 5220164 5220161 +
ttccttcaggagctcttgta

SEQ ID NO: 7953 - DNA, 20 bp, Artificial Sequence
  Synthetic oligonucleotide; CAG chr11 5220148 5220167 5220164 +
cttcaggagctcttgtaggg

SEQ ID NO: 7954 - DNA, 20 bp, Artificial Sequence
  Synthetic oligonucleotide; AGG chr11 5220149 5220168 5220165 +
ttcaggagctcttgtagggc

SEQ ID NO: 7955 - DNA, 20 bp, Artificial Sequence
  Synthetic oligonucleotide; TGG chr11 5220154 5220173 5220170 +
gagctcttgtagggcaggcc

SEQ ID NO: 7956 - DNA, 20 bp, Artificial Sequence
  Synthetic oligonucleotide; TGG chr11 5220157 5220176 5220173 +
ctcttgtagggcaggcctgg

SEQ ID NO: 7957 - DNA, 20 bp, Artificial Sequence
  Synthetic oligonucleotide; CAG chr11 5220173 5220192 5220189 +
ctggtggtgacaaaatctct

SEQ ID NO: 7958 - DNA, 20 bp, Artificial Sequence
  Synthetic oligonucleotide; AAG chr11 5220192 5220211 5220208 +
tcagcatttgcttgtctgta

SEQ ID NO: 7959 - DNA, 20 bp, Artificial Sequence
  Synthetic oligonucleotide; AGG chr11 5220193 5220212 5220209 +
cagcatttgcttgtctgtaa

SEQ ID NO: 7960 - DNA, 20 bp, Artificial Sequence
  Synthetic oligonucleotide; AAG chr11 5220219 5220238 5220235 +
ttatttctccttcacttatg

SEQ ID NO: 7961 - DNA, 20 bp, Artificial Sequence
  Synthetic oligonucleotide; TAG chr11 5220224 5220243 5220240 +
tctccttcacttatgaagct

SEQ ID NO: 7962 - DNA, 20 bp, Artificial Sequence
  Synthetic oligonucleotide; TGG chr11 5220229 5220248 5220245 +
ttcacttatgaagcttagtt

SEQ ID NO: 7963 - DNA, 20 bp, Artificial Sequence
  Synthetic oligonucleotide; TGG chr11 5220233 5220252 5220249 +
cttatgaagcttagtttggc

SEQ ID NO: 7964 - DNA, 20 bp, Artificial Sequence
  Synthetic oligonucleotide; TGG chr11 5220247 5220266 5220263 +
tttggctggatatgaaattc

SEQ ID NO: 7965 - DNA, 20 bp, Artificial Sequence
  Synthetic oligonucleotide; GGG chr11 5220248 5220267 5220264 +
ttggctggatatgaaattct

SEQ ID NO: 7966 - DNA, 20 bp, Artificial Sequence
  Synthetic oligonucleotide; TGG chr11 5220284 5220303 5220300 +
tctttaacaatgttgaatat

SEQ ID NO: 7967 - DNA, 20 bp, Artificial Sequence
  Synthetic oligonucleotide; TGG chr11 5220301 5220320 5220317 +
tattggcccccactttcttc

SEQ ID NO: 7968 - DNA, 20 bp, Artificial Sequence
  Synthetic oligonucleotide; TAG chr11 5220308 5220327 5220324 +
ccccactttcttctggcttg

SEQ ID NO: 7969 - DNA, 20 bp, Artificial Sequence
  Synthetic oligonucleotide; GAG chr11 5220310 5220329 5220326 +
ccactttcttctggcttgta

SEQ ID NO: 7970 - DNA, 20 bp, Artificial Sequence
  Synthetic oligonucleotide; TAG chr11 5220323 5220342 5220339 +
gcttgtagagtttctgccga

SEQ ID NO: 7971 - DNA, 20 bp, Artificial Sequence
  Synthetic oligonucleotide; CAG chr11 5220328 5220347 5220344 +
tagagtttctgccgatagat

SEQ ID NO: 7972 - DNA, 20 bp, Artificial Sequence
  Synthetic oligonucleotide; TAG chr11 5220335 5220354 5220351 +
tctgccgatagatcagctgt

SEQ ID NO: 7973 - DNA, 20 bp, Artificial Sequence
  Synthetic oligonucleotide; TGG chr11 5220343 5220362 5220359 +
tagatcagctgttagtctga

SEQ ID NO: 7974 - DNA, 20 bp, Artificial Sequence
  Synthetic oligonucleotide; GGG chr11 5220344 5220363 5220360 +
agatcagctgttagtctgat

SEQ ID NO: 7975 - DNA, 20 bp, Artificial Sequence
  Synthetic oligonucleotide; TGG chr11 5220357 5220376 5220373 +
gtctgatgggcttccctttg

SEQ ID NO: 7976 - DNA, 20 bp, Artificial Sequence
  Synthetic oligonucleotide; GGG chr11 5220358 5220377 5220374 +
tctgatgggcttccctttgt

SEQ ID NO: 7977 - DNA, 20 bp, Artificial Sequence
  Synthetic oligonucleotide; TGG chr11 5220379 5220398 5220395 +
ggtaacccgacctttctctc

SEQ ID NO: 7978 - DNA, 20 bp, Artificial Sequence
  Synthetic oligonucleotide; TGG chr11 5220415 5220434 5220431 +
tttttccttcatttcaactt

SEQ ID NO: 7979 - DNA, 20 bp, Artificial Sequence
  Synthetic oligonucleotide; CAG chr11 5220427 5220446 5220443 +
ttcaactttggtgaatctga

SEQ ID NO: 7980 - DNA, 20 bp, Artificial Sequence
  Synthetic oligonucleotide; TGG chr11 5220440 5220459 5220456 +
aatctgacagttatgtgtct

SEQ ID NO: 7981 - DNA, 20 bp, Artificial Sequence
  Synthetic oligonucleotide; GAG chr11 5220442 5220461 5220458 +
tctgacagttatgtgtcttg

SEQ ID NO: 7982 - DNA, 20 bp, Artificial Sequence
  Synthetic oligonucleotide; TAG chr11 5220456 5220475 5220472 +
gtcttggagttgcttttctc

SEQ ID NO: 7983 - DNA, 20 bp, Artificial Sequence
  Synthetic oligonucleotide; AGG chr11 5220457 5220476 5220473 +
tcttggagttgcttttctct

SEQ ID NO: 7984 - DNA, 20 bp, Artificial Sequence
  Synthetic oligonucleotide; GAG chr11 5220459 5220478 5220475 +
ttggagttgcttttctctag

SEQ ID NO: 7985 - DNA, 20 bp, Artificial Sequence
  Synthetic oligonucleotide; TGG chr11 5220470 5220489 5220486 +
tttctctaggagtatctttg

SEQ ID NO: 7986 - DNA, 20 bp, Artificial Sequence
  Synthetic oligonucleotide; TGG chr11 5220501 5220520 5220517 +
gtatttcctgaatgtgaatt

SEQ ID NO: 7987 - DNA, 20 bp, Artificial Sequence
  Synthetic oligonucleotide; GGG chr11 5220502 5220521 5220518 +
tatttcctgaatgtgaattt

SEQ ID NO: 7988 - DNA, 20 bp, Artificial Sequence
  Synthetic oligonucleotide; TAG chr11 5220515 5220534 5220531 +
tgaatttgggcttgccttgc

SEQ ID NO: 7989 - DNA, 20 bp, Artificial Sequence
  Synthetic oligonucleotide; TGG chr11 5220520 5220539 5220536 +
ttgggcttgccttgctagat

SEQ ID NO: 7990 - DNA, 20 bp, Artificial Sequence
  Synthetic oligonucleotide; GGG chr11 5220521 5220540 5220537 +
tgggcttgccttgctagatt

SEQ ID NO: 7991 - DNA, 20 bp, Artificial Sequence
  Synthetic oligonucleotide; GGG chr11 5220522 5220541 5220538 +
gggcttgccttgctagattg

SEQ ID NO: 7992 - DNA, 20 bp, Artificial Sequence
  Synthetic oligonucleotide; AAG chr11 5220525 5220544 5220541 +
cttgccttgctagattgggg

SEQ ID NO: 7993 - DNA, 20 bp, Artificial Sequence
  Synthetic oligonucleotide; TGG chr11 5220534 5220553 5220550 +
ctagattggggaagttctcc

SEQ ID NO: 7994 - DNA, 20 bp, Artificial Sequence
  Synthetic oligonucleotide; CAG chr11 5220548 5220567 5220564 +
ttctcctggataatatcctg

SEQ ID NO: 7995 - DNA, 20 bp, Artificial Sequence
  Synthetic oligonucleotide; GAG chr11 5220550 5220569 5220566 +
ctcctggataatatcctgca

SEQ ID NO: 7996 - DNA, 20 bp, Artificial Sequence
  Synthetic oligonucleotide; TGG chr11 5220565 5220584 5220581 +
ctgcagagtgttttccaact

SEQ ID NO: 7997 - DNA, 20 bp, Artificial Sequence
  Synthetic oligonucleotide; CAG chr11 5220589 5220608 5220605 +
tccattctccccatcacttt

SEQ ID NO: 7998 - DNA, 20 bp, Artificial Sequence
  Synthetic oligonucleotide; TAG chr11 5220602 5220621 5220618 +
tcactttcagctacaccaat

SEQ ID NO: 7999 - DNA, 20 bp, Artificial Sequence
  Synthetic oligonucleotide; TAG chr11 5220608 5220627 5220624 +
tcagctacaccaattagatg

SEQ ID NO: 8000 - DNA, 20 bp, Artificial Sequence
  Synthetic oligonucleotide; TGG chr11 5220614 5220633 5220630 +
acaccaattagatgtagatt

SEQ ID NO: 8001 - DNA, 20 bp, Artificial Sequence
  Synthetic oligonucleotide; TAG chr11 5220627 5220646 5220643 +
gtagatttggtcttttcaca

SEQ ID NO: 8002 - DNA, 20 bp, Artificial Sequence
  Synthetic oligonucleotide; TGG chr11 5220642 5220661 5220658 +
tcacatagtcccatatttct

SEQ ID NO: 8003 - DNA, 20 bp, Artificial Sequence
  Synthetic oligonucleotide; GAG chr11 5220644 5220663 5220660 +
acatagtcccatatttcttg

SEQ ID NO: 8004 - DNA, 20 bp, Artificial Sequence
  Synthetic oligonucleotide; AGG chr11 5220645 5220664 5220661 +
catagtcccatatttcttgg

SEQ ID NO: 8005 - DNA, 20 bp, Artificial Sequence
  Synthetic oligonucleotide; CAG chr11 5220740 5220759 5220756 +
gtcattgataccctttcttc

SEQ ID NO: 8006 - DNA, 20 bp, Artificial Sequence
  Synthetic oligonucleotide; CGG chr11 5220753 5220772 5220769 +
tttcttccagttgatctcat

SEQ ID NO: 8007 - DNA, 20 bp, Artificial Sequence
  Synthetic oligonucleotide; GAG chr11 5220761 5220780 5220777 +
agttgatctcatcggttact

SEQ ID NO: 8008 - DNA, 20 bp, Artificial Sequence
  Synthetic oligonucleotide; AGG chr11 5220762 5220781 5220778 +
gttgatctcatcggttactg

SEQ ID NO: 8009 - DNA, 20 bp, Artificial Sequence
  Synthetic oligonucleotide; TAG chr11 5220782 5220801 5220798 +
aggcttgtgtatttgtcacg

SEQ ID NO: 8010 - DNA, 20 bp, Artificial Sequence
  Synthetic oligonucleotide; TGG chr11 5220796 5220815 5220812 +
gtcacgtagttctcctgcct

SEQ ID NO: 8011 - DNA, 20 bp, Artificial Sequence
  Synthetic oligonucleotide; CAG chr11 5220803 5220822 5220819 +
agttctcctgccttggtttt

SEQ ID NO: 8012 - DNA, 20 bp, Artificial Sequence
  Synthetic oligonucleotide; CAG chr11 5220812 5220831 5220828 +
gccttggttttcagctccat

SEQ ID NO: 8013 - DNA, 20 bp, Artificial Sequence
  Synthetic oligonucleotide; AGG chr11 5220813 5220832 5220829 +
ccttggttttcagctccatc

SEQ ID NO: 8014 - DNA, 20 bp, Artificial Sequence
  Synthetic oligonucleotide; AAG chr11 5220822 5220841 5220838 +
tcagctccatcaggtccttt

SEQ ID NO: 8015 - DNA, 20 bp, Artificial Sequence
  Synthetic oligonucleotide; AGG chr11 5220823 5220842 5220839 +
cagctccatcaggtccttta

SEQ ID NO: 8016 - DNA, 20 bp, Artificial Sequence
  Synthetic oligonucleotide; TGG chr11 5220838 5220857 5220854 +
ctttaaggacttctgtgcat

SEQ ID NO: 8017 - DNA, 20 bp, Artificial Sequence
  Synthetic oligonucleotide; TAG chr11 5220847 5220866 5220863 +
cttctgtgcattggttattc

SEQ ID NO: 8018 - DNA, 20 bp, Artificial Sequence
  Synthetic oligonucleotide; AAG chr11 5220876 5220895 5220892 +
attcatctaattttttttca

SEQ ID NO: 8019 - DNA, 20 bp, Artificial Sequence
  Synthetic oligonucleotide; TAG chr11 5220917 5220936 5220933 +
tttgttcgaacttcctcctt

SEQ ID NO: 8020 - DNA, 20 bp, Artificial Sequence
  Synthetic oligonucleotide; TGG chr11 5220922 5220941 5220938 +
tcgaacttcctcctttagct

SEQ ID NO: 8021 - DNA, 20 bp, Artificial Sequence
  Synthetic oligonucleotide; GAG chr11 5220924 5220943 5220940 +
gaacttcctcctttagcttg

SEQ ID NO: 8022 - DNA, 20 bp, Artificial Sequence
  Synthetic oligonucleotide; TAG chr11 5220927 5220946 5220943 +
cttcctcctttagcttggag

SEQ ID NO: 8023 - DNA, 20 bp, Artificial Sequence
  Synthetic oligonucleotide; AAG chr11 5220942 5220961 5220958 +
tggagtagtttgatcttctg

SEQ ID NO: 8024 - DNA, 20 bp, Artificial Sequence
  Synthetic oligonucleotide; AAG chr11 5220966 5220985 5220982 +
cttcctctctcaactcgtca

SEQ ID NO: 8025 - DNA, 20 bp, Artificial Sequence
  Synthetic oligonucleotide; CAG chr11 5220981 5221000 5220997 +
cgtcaaagtcattctctgcc

SEQ ID NO: 8026 - DNA, 20 bp, Artificial Sequence
  Synthetic oligonucleotide; TGG chr11 5220998 5221017 5221014 +
gcccagctttgttccattgc

SEQ ID NO: 8027 - DNA, 20 bp, Artificial Sequence
  Synthetic oligonucleotide; GAG chr11 5221002 5221021 5221018 +
agctttgttccattgctggt

SEQ ID NO: 8028 - DNA, 20 bp, Artificial Sequence
  Synthetic oligonucleotide; AGG chr11 5221003 5221022 5221019 +
gctttgttccattgctggtg

SEQ ID NO: 8029 - DNA, 20 bp, Artificial Sequence
  Synthetic oligonucleotide; GAG chr11 5221005 5221024 5221021 +
tttgttccattgctggtgag

SEQ ID NO: 8030 - DNA, 20 bp, Artificial Sequence
  Synthetic oligonucleotide; TGG chr11 5221019 5221038 5221035 +
ggtgaggagctgcgttactt

SEQ ID NO: 8031 - DNA, 20 bp, Artificial Sequence
  Synthetic oligonucleotide; GAG chr11 5221021 5221040 5221037 +
tgaggagctgcgttactttg

SEQ ID NO: 8032 - DNA, 20 bp, Artificial Sequence
  Synthetic oligonucleotide; AGG chr11 5221022 5221041 5221038 +
gaggagctgcgttactttgg

SEQ ID NO: 8033 - DNA, 20 bp, Artificial Sequence
  Synthetic oligonucleotide; GAG chr11 5221024 5221043 5221040 +
ggagctgcgttactttggag

SEQ ID NO: 8034 - DNA, 20 bp, Artificial Sequence
  Synthetic oligonucleotide; AGG chr11 5221025 5221044 5221041 +
gagctgcgttactttggagg

SEQ ID NO: 8035 - DNA, 20 bp, Artificial Sequence
  Synthetic oligonucleotide; GAG chr11 5221027 5221046 5221043 +
gctgcgttactttggaggag

SEQ ID NO: 8036 - DNA, 20 bp, Artificial Sequence
  Synthetic oligonucleotide; GAG chr11 5221029 5221048 5221045 +
tgcgttactttggaggagga

SEQ ID NO: 8037 - DNA, 20 bp, Artificial Sequence
  Synthetic oligonucleotide; AGG chr11 5221030 5221049 5221046 +
gcgttactttggaggaggag

SEQ ID NO: 8038 - DNA, 20 bp, Artificial Sequence
  Synthetic oligonucleotide; TAG chr11 5221045 5221064 5221061 +
aggagaggcactctcatttt

SEQ ID NO: 8039 - DNA, 20 bp, Artificial Sequence
  Synthetic oligonucleotide; GAG chr11 5221047 5221066 5221063 +
gagaggcactctcattttta

SEQ ID NO: 8040 - DNA, 20 bp, Artificial Sequence
  Synthetic oligonucleotide; CAG chr11 5221054 5221073 5221070 +
actctcatttttagagtgtc

SEQ ID NO: 8041 - DNA, 20 bp, Artificial Sequence
  Synthetic oligonucleotide; TGG chr11 5221087 5221106 5221103 +
ctgctttttccccatcttta

SEQ ID NO: 8042 - DNA, 20 bp, Artificial Sequence
  Synthetic oligonucleotide; TGG chr11 5221103 5221122 5221119 +
tttatggttttatctacctt

SEQ ID NO: 8043 - DNA, 20 bp, Artificial Sequence
  Synthetic oligonucleotide; TGG chr11 5221116 5221135 5221132 +
ctacctttggtctttgatga

SEQ ID NO: 8044 - DNA, 20 bp, Artificial Sequence
  Synthetic oligonucleotide; CAG chr11 5221126 5221145 5221142 +
tctttgatgatggcgatgta

SEQ ID NO: 8045 - DNA, 20 bp, Artificial Sequence
  Synthetic oligonucleotide; TGG chr11 5221130 5221149 5221146 +
tgatgatggcgatgtacaga

SEQ ID NO: 8046 - DNA, 20 bp, Artificial Sequence
  Synthetic oligonucleotide; GGG chr11 5221131 5221150 5221147 +
gatgatggcgatgtacagat

SEQ ID NO: 8047 - DNA, 20 bp, Artificial Sequence
  Synthetic oligonucleotide; TGG chr11 5221138 5221157 5221154 +
gcgatgtacagatgggtttt

SEQ ID NO: 8048 - DNA, 20 bp, Artificial Sequence
  Synthetic oligonucleotide; TGG chr11 5221143 5221162 5221159 +
gtacagatgggtttttggtg

SEQ ID NO: 8049 - DNA, 20 bp, Artificial Sequence
  Synthetic oligonucleotide; TAG chr11 5221163 5221182 5221179 +
tggatgtcctttctgtttgt

SEQ ID NO: 8050 - DNA, 20 bp, Artificial Sequence
  Synthetic oligonucleotide; CAG chr11 5221178 5221197 5221194 +
tttgttagttttccttctaa

SEQ ID NO: 8051 - DNA, 20 bp, Artificial Sequence
  Synthetic oligonucleotide; CAG chr11 5221182 5221201 5221198 +
ttagttttccttctaacagt

SEQ ID NO: 8052 - DNA, 20 bp, Artificial Sequence
  Synthetic oligonucleotide; AGG chr11 5221183 5221202 5221199 +
tagttttccttctaacagtc

SEQ ID NO: 8053 - DNA, 20 bp, Artificial Sequence
  Synthetic oligonucleotide; CAG chr11 5221191 5221210 5221207 +
cttctaacagtcaggaccct

SEQ ID NO: 8054 - DNA, 20 bp, Artificial Sequence
  Synthetic oligonucleotide; CAG chr11 5221197 5221216 5221213 +
acagtcaggaccctcagctg

SEQ ID NO: 8055 - DNA, 20 bp, Artificial Sequence
  Synthetic oligonucleotide; AGG chr11 5221198 5221217 5221214 +
cagtcaggaccctcagctgc

SEQ ID NO: 8056 - DNA, 20 bp, Artificial Sequence
  Synthetic oligonucleotide; TGG chr11 5221206 5221225 5221222 +
accctcagctgcaggtctgt

SEQ ID NO: 8057 - DNA, 20 bp, Artificial Sequence
  Synthetic oligonucleotide; GAG chr11 5221208 5221227 5221224 +
cctcagctgcaggtctgttg

SEQ ID NO: 8058 - DNA, 20 bp, Artificial Sequence
  Synthetic oligonucleotide; TGG chr11 5221216 5221235 5221232 +
gcaggtctgttggagtttac

SEQ ID NO: 8059 - DNA, 20 bp, Artificial Sequence
  Synthetic oligonucleotide; GAG chr11 5221218 5221237 5221234 +
aggtctgttggagtttactg

SEQ ID NO: 8060 - DNA, 20 bp, Artificial Sequence
  Synthetic oligonucleotide; AGG chr11 5221219 5221238 5221235 +
ggtctgttggagtttactgg

SEQ ID NO: 8061 - DNA, 20 bp, Artificial Sequence
  Synthetic oligonucleotide; CAG chr11 5221229 5221248 5221245 +
agtttactggaggtccactc

SEQ ID NO: 8062 - DNA, 20 bp, Artificial Sequence
  Synthetic oligonucleotide; AAG chr11 5221232 5221251 5221248 +
ttactggaggtccactccag

SEQ ID NO: 8063 - DNA, 20 bp, Artificial Sequence
  Synthetic oligonucleotide; TGG chr11 5221244 5221263 5221260 +
cactccagaagctgttttcc

SEQ ID NO: 8064 - DNA, 20 bp, Artificial Sequence
  Synthetic oligonucleotide; GGG chr11 5221245 5221264 5221261 +
actccagaagctgttttcct

SEQ ID NO: 8065 - DNA, 20 bp, Artificial Sequence
  Synthetic oligonucleotide; CAG chr11 5221254 5221273 5221270 +
gctgttttcctgggtatcaa

SEQ ID NO: 8066 - DNA, 20 bp, Artificial Sequence
  Synthetic oligonucleotide; CGG chr11 5221257 5221276 5221273 +
gttttcctgggtatcaacag

SEQ ID NO: 8067 - DNA, 20 bp, Artificial Sequence
  Synthetic oligonucleotide; TGG chr11 5221260 5221279 5221276 +
ttcctgggtatcaacagcgg

SEQ ID NO: 8068 - DNA, 20 bp, Artificial Sequence
  Synthetic oligonucleotide; CAG chr11 5221266 5221285 5221282 +
ggtatcaacagcggtggctg

SEQ ID NO: 8069 - DNA, 20 bp, Artificial Sequence
  Synthetic oligonucleotide; CAG chr11 5221271 5221290 5221287 +
caacagcggtggctgcagaa

SEQ ID NO: 8070 - DNA, 20 bp, Artificial Sequence
  Synthetic oligonucleotide; TGG chr11 5221274 5221293 5221290 +
cagcggtggctgcagaacag

SEQ ID NO: 8071 - DNA, 20 bp, Artificial Sequence
  Synthetic oligonucleotide; TGG chr11 5221281 5221300 5221297 +
ggctgcagaacagtggatat

SEQ ID NO: 8072 - DNA, 20 bp, Artificial Sequence
  Synthetic oligonucleotide; TGG chr11 5221317 5221336 5221333 +
ctgctgcctgatcattcctc

SEQ ID NO: 8073 - DNA, 20 bp, Artificial Sequence
  Synthetic oligonucleotide; AAG chr11 5221320 5221339 5221336 +
ctgcctgatcattcctctgg

SEQ ID NO: 8074 - DNA, 20 bp, Artificial Sequence
  Synthetic oligonucleotide; TAG chr11 5221331 5221350 5221347 +
ttcctctggaagttttgtct

SEQ ID NO: 8075 - DNA, 20 bp, Artificial Sequence
  Synthetic oligonucleotide; GAG chr11 5221333 5221352 5221349 +
cctctggaagttttgtctta

SEQ ID NO: 8076 - DNA, 20 bp, Artificial Sequence
  Synthetic oligonucleotide; AGG chr11 5221334 5221353 5221350 +
ctctggaagttttgtcttag

SEQ ID NO: 8077 - DNA, 20 bp, Artificial Sequence
  Synthetic oligonucleotide; GAG chr11 5221336 5221355 5221352 +
ctggaagttttgtcttagag

SEQ ID NO: 8078 - DNA, 20 bp, Artificial Sequence
  Synthetic oligonucleotide; CAG chr11 5221342 5221361 5221358 +
gttttgtcttagaggagtac

SEQ ID NO: 8079 - DNA, 20 bp, Artificial Sequence
  Synthetic oligonucleotide; GAG chr11 5221351 5221370 5221367 +
tagaggagtaccagccatgt

SEQ ID NO: 8080 - DNA, 20 bp, Artificial Sequence
  Synthetic oligonucleotide; AGG chr11 5221352 5221371 5221368 +
agaggagtaccagccatgtg

SEQ ID NO: 8081 - DNA, 20 bp, Artificial Sequence
  Synthetic oligonucleotide; CAG chr11 5221358 5221377 5221374 +
gtaccagccatgtgaggtgt

SEQ ID NO: 8082 - DNA, 20 bp, Artificial Sequence
  Synthetic oligonucleotide; TGG chr11 5221372 5221391 5221388 +
aggtgtcagtctgcccctac

SEQ ID NO: 8083 - DNA, 20 bp, Artificial Sequence
  Synthetic oligonucleotide; GGG chr11 5221373 5221392 5221389 +
ggtgtcagtctgcccctact

SEQ ID NO: 8084 - DNA, 20 bp, Artificial Sequence
  Synthetic oligonucleotide; GGG chr11 5221374 5221393 5221390 +
gtgtcagtctgcccctactg

SEQ ID NO: 8085 - DNA, 20 bp, Artificial Sequence
  Synthetic oligonucleotide; GGG chr11 5221375 5221394 5221391 +
tgtcagtctgcccctactgg

SEQ ID NO: 8086 - DNA, 20 bp, Artificial Sequence
  Synthetic oligonucleotide; CAG chr11 5221386 5221405 5221402 +
ccctactgggggatgcctcc

SEQ ID NO: 8087 - DNA, 20 bp, Artificial Sequence
  Synthetic oligonucleotide; TAG chr11 5221390 5221409 5221406 +
actgggggatgcctcccagt

SEQ ID NO: 8088 - DNA, 20 bp, Artificial Sequence
  Synthetic oligonucleotide; AGG chr11 5221391 5221410 5221407 +
ctgggggatgcctcccagtt

SEQ ID NO: 8089 - DNA, 20 bp, Artificial Sequence
  Synthetic oligonucleotide; CGG chr11 5221399 5221418 5221415 +
tgcctcccagttaggctact

SEQ ID NO: 8090 - DNA, 20 bp, Artificial Sequence
  Synthetic oligonucleotide; GGG chr11 5221400 5221419 5221416 +
gcctcccagttaggctactc

SEQ ID NO: 8091 - DNA, 20 bp, Artificial Sequence
  Synthetic oligonucleotide; GGG chr11 5221401 5221420 5221417 +
cctcccagttaggctactcg

SEQ ID NO: 8092 - DNA, 20 bp, Artificial Sequence
  Synthetic oligonucleotide; GGG chr11 5221402 5221421 5221418 +
ctcccagttaggctactcgg

SEQ ID NO: 8093 - DNA, 20 bp, Artificial Sequence
  Synthetic oligonucleotide; CAG chr11 5221406 5221425 5221422 +
cagttaggctactcgggggt

SEQ ID NO: 8094 - DNA, 20 bp, Artificial Sequence
  Synthetic oligonucleotide; AGG chr11 5221407 5221426 5221423 +
agttaggctactcgggggtc

SEQ ID NO: 8095 - DNA, 20 bp, Artificial Sequence
  Synthetic oligonucleotide; GGG chr11 5221408 5221427 5221424 +
gttaggctactcgggggtca

SEQ ID NO: 8096 - DNA, 20 bp, Artificial Sequence
  Synthetic oligonucleotide; GAG chr11 5221419 5221438 5221435 +
cgggggtcagggacccactt

SEQ ID NO: 8097 - DNA, 20 bp, Artificial Sequence
  Synthetic oligonucleotide; AGG chr11 5221420 5221439 5221436 +
gggggtcagggacccacttg

SEQ ID NO: 8098 - DNA, 20 bp, Artificial Sequence
  Synthetic oligonucleotide; GAG chr11 5221422 5221441 5221438 +
gggtcagggacccacttgag

SEQ ID NO: 8099 - DNA, 20 bp, Artificial Sequence
  Synthetic oligonucleotide; AGG chr11 5221423 5221442 5221439 +
ggtcagggacccacttgagg

SEQ ID NO: 8100 - DNA, 20 bp, Artificial Sequence
  Synthetic oligonucleotide; CAG chr11 5221426 5221445 5221442 +
cagggacccacttgaggagg

SEQ ID NO: 8101 - DNA, 20 bp, Artificial Sequence
  Synthetic oligonucleotide; CAG chr11 5221441 5221460 5221457 +
ggaggcagtctgcctgttct

SEQ ID NO: 8102 - DNA, 20 bp, Artificial Sequence
  Synthetic oligonucleotide; AAG chr11 5221449 5221468 5221465 +
tctgcctgttctcagatctg

SEQ ID NO: 8103 - DNA, 20 bp, Artificial Sequence
  Synthetic oligonucleotide; TGG chr11 5221460 5221479 5221476 +
tcagatctgaagctatgtgc

SEQ ID NO: 8104 - DNA, 20 bp, Artificial Sequence
  Synthetic oligonucleotide; GGG chr11 5221461 5221480 5221477 +
cagatctgaagctatgtgct

SEQ ID NO: 8105 - DNA, 20 bp, Artificial Sequence
  Synthetic oligonucleotide; GAG chr11 5221463 5221482 5221479 +
gatctgaagctatgtgctgg

SEQ ID NO: 8106 - DNA, 20 bp, Artificial Sequence
  Synthetic oligonucleotide; AAG chr11 5221483 5221502 5221499 +
gagaaccactactctcttca

SEQ ID NO: 8107 - DNA, 20 bp, Artificial Sequence
  Synthetic oligonucleotide; CAG chr11 5221490 5221509 5221506 +
actactctcttcaaagctgt

SEQ ID NO: 8108 - DNA, 20 bp, Artificial Sequence
  Synthetic oligonucleotide; CAG chr11 5221494 5221513 5221510 +
ctctcttcaaagctgtcaga

SEQ ID NO: 8109 - DNA, 20 bp, Artificial Sequence
  Synthetic oligonucleotide; AGG chr11 5221495 5221514 5221511 +
tctcttcaaagctgtcagac

SEQ ID NO: 8110 - DNA, 20 bp, Artificial Sequence
  Synthetic oligonucleotide; GGG chr11 5221496 5221515 5221512 +
ctcttcaaagctgtcagaca

SEQ ID NO: 8111 - DNA, 20 bp, Artificial Sequence
  Synthetic oligonucleotide; AAG chr11 5221505 5221524 5221521 +
gctgtcagacagggacattt

SEQ ID NO: 8112 - DNA, 20 bp, Artificial Sequence
  Synthetic oligonucleotide; CAG chr11 5221512 5221531 5221528 +
gacagggacatttaagtctg

SEQ ID NO: 8113 - DNA, 20 bp, Artificial Sequence
  Synthetic oligonucleotide; GAG chr11 5221514 5221533 5221530 +
cagggacatttaagtctgca

SEQ ID NO: 8114 - DNA, 20 bp, Artificial Sequence
  Synthetic oligonucleotide; AGG chr11 5221515 5221534 5221531 +
agggacatttaagtctgcag

SEQ ID NO: 8115 - DNA, 20 bp, Artificial Sequence
  Synthetic oligonucleotide; TAG chr11 5221553 5221572 5221569 +
gtttgtctgtgccctgcccc

SEQ ID NO: 8116 - DNA, 20 bp, Artificial Sequence
  Synthetic oligonucleotide; GAG chr11 5221555 5221574 5221571 +
ttgtctgtgccctgccccta

SEQ ID NO: 8117 - DNA, 20 bp, Artificial Sequence
  Synthetic oligonucleotide; AGG chr11 5221556 5221575 5221572 +
tgtctgtgccctgcccctag

SEQ ID NO: 8118 - DNA, 20 bp, Artificial Sequence
  Synthetic oligonucleotide; TGG chr11 5221559 5221578 5221575 +
ctgtgccctgcccctagagg

SEQ ID NO: 8119 - DNA, 20 bp, Artificial Sequence
  Synthetic oligonucleotide; GAG chr11 5221561 5221580 5221577 +
gtgccctgcccctagaggtg

SEQ ID NO: 8120 - DNA, 20 bp, Artificial Sequence
  Synthetic oligonucleotide; CAG chr11 5221568 5221587 5221584 +
gcccctagaggtggagccta

SEQ ID NO: 8121 - DNA, 20 bp, Artificial Sequence
  Synthetic oligonucleotide; GAG chr11 5221570 5221589 5221586 +
ccctagaggtggagcctaca

SEQ ID NO: 8122 - DNA, 20 bp, Artificial Sequence
  Synthetic oligonucleotide; AGG chr11 5221571 5221590 5221587 +
cctagaggtggagcctacag

SEQ ID NO: 8123 - DNA, 20 bp, Artificial Sequence
  Synthetic oligonucleotide; CAG chr11 5221574 5221593 5221590 +
agaggtggagcctacagagg

SEQ ID NO: 8124 - DNA, 20 bp, Artificial Sequence
  Synthetic oligonucleotide; AGG chr11 5221575 5221594 5221591 +
gaggtggagcctacagaggc

SEQ ID NO: 8125 - DNA, 20 bp, Artificial Sequence
  Synthetic oligonucleotide; CAG chr11 5221578 5221597 5221594 +
gtggagcctacagaggcagg

SEQ ID NO: 8126 - DNA, 20 bp, Artificial Sequence
  Synthetic oligonucleotide; AGG chr11 5221579 5221598 5221595 +
tggagcctacagaggcaggc

SEQ ID NO: 8127 - DNA, 20 bp, Artificial Sequence
  Synthetic oligonucleotide; GAG chr11 5221589 5221608 5221605 +
agaggcaggcaggcctcctt

SEQ ID NO: 8128 - DNA, 20 bp, Artificial Sequence
  Synthetic oligonucleotide; TGG chr11 5221595 5221614 5221611 +
aggcaggcctccttgagctg

SEQ ID NO: 8129 - DNA, 20 bp, Artificial Sequence
  Synthetic oligonucleotide; TGG chr11 5221598 5221617 5221614 +
caggcctccttgagctgtgg

SEQ ID NO: 8130 - DNA, 20 bp, Artificial Sequence
  Synthetic oligonucleotide; GGG chr11 5221599 5221618 5221615 +
aggcctccttgagctgtggt

SEQ ID NO: 8131 - DNA, 20 bp, Artificial Sequence
  Synthetic oligonucleotide; CAG chr11 5221609 5221628 5221625 +
gagctgtggtgggctccacc

SEQ ID NO: 8132 - DNA, 20 bp, Artificial Sequence
  Synthetic oligonucleotide; GAG chr11 5221615 5221634 5221631 +
tggtgggctccacccagttc

SEQ ID NO: 8133 - DNA, 20 bp, Artificial Sequence
  Synthetic oligonucleotide; CAG chr11 5221622 5221641 5221638 +
ctccacccagttcgagcttc

SEQ ID NO: 8134 - DNA, 20 bp, Artificial Sequence
  Synthetic oligonucleotide; AGG chr11 5221623 5221642 5221639 +
tccacccagttcgagcttcc

SEQ ID NO: 8135 - DNA, 20 bp, Artificial Sequence
  Synthetic oligonucleotide; CGG chr11 5221626 5221645 5221642 +
acccagttcgagcttccagg

SEQ ID NO: 8136 - DNA, 20 bp, Artificial Sequence
  Synthetic oligonucleotide; AAG chr11 5221645 5221664 5221661 +
gcggctttgtttacctgctc

SEQ ID NO: 8137 - DNA, 20 bp, Artificial Sequence
  Synthetic oligonucleotide; TGG chr11 5221650 5221669 5221666 +
tttgtttacctgctcaagcc

SEQ ID NO: 8138 - DNA, 20 bp, Artificial Sequence
  Synthetic oligonucleotide; TGG chr11 5221657 5221676 5221673 +
acctgctcaagcctggacaa

SEQ ID NO: 8139 - DNA, 20 bp, Artificial Sequence
  Synthetic oligonucleotide; TGG chr11 5221660 5221679 5221676 +
tgctcaagcctggacaatgg

SEQ ID NO: 8140 - DNA, 20 bp, Artificial Sequence
  Synthetic oligonucleotide; GGG chr11 5221661 5221680 5221677 +
gctcaagcctggacaatggt

SEQ ID NO: 8141 - DNA, 20 bp, Artificial Sequence
  Synthetic oligonucleotide; CAG chr11 5221675 5221694 5221691 +
aatggtgggcacccctcccc

SEQ ID NO: 8142 - DNA, 20 bp, Artificial Sequence
  Synthetic oligonucleotide; CAG chr11 5221694 5221713 5221710 +
ccagcctcactgccaccttg

SEQ ID NO: 8143 - DNA, 20 bp, Artificial Sequence
  Synthetic oligonucleotide; CAG chr11 5221705 5221724 5221721 +
gccaccttgcagtttgacct

SEQ ID NO: 8144 - DNA, 20 bp, Artificial Sequence
  Synthetic oligonucleotide; TAG chr11 5221718 5221737 5221734 +
ttgacctcagactgctgtgc

SEQ ID NO: 8145 - DNA, 20 bp, Artificial Sequence
  Synthetic oligonucleotide; GAG chr11 5221725 5221744 5221741 +
cagactgctgtgctagcaat

SEQ ID NO: 8146 - DNA, 20 bp, Artificial Sequence
  Synthetic oligonucleotide; GAG chr11 5221729 5221748 5221745 +
ctgctgtgctagcaatgagc

SEQ ID NO: 8147 - DNA, 20 bp, Artificial Sequence
  Synthetic oligonucleotide; AGG chr11 5221730 5221749 5221746 +
tgctgtgctagcaatgagcg

SEQ ID NO: 8148 - DNA, 20 bp, Artificial Sequence
  Synthetic oligonucleotide; TGG chr11 5221738 5221757 5221754 +
tagcaatgagcgaggctcca

SEQ ID NO: 8149 - DNA, 20 bp, Artificial Sequence
  Synthetic oligonucleotide; GGG chr11 5221739 5221758 5221755 +
agcaatgagcgaggctccat

SEQ ID NO: 8150 - DNA, 20 bp, Artificial Sequence
  Synthetic oligonucleotide; TAG chr11 5221744 5221763 5221760 +
tgagcgaggctccatgggcg

SEQ ID NO: 8151 - DNA, 20 bp, Artificial Sequence
  Synthetic oligonucleotide; AGG chr11 5221745 5221764 5221761 +
gagcgaggctccatgggcgt

SEQ ID NO: 8152 - DNA, 20 bp, Artificial Sequence
  Synthetic oligonucleotide; GAG chr11 5221755 5221774 5221771 +
ccatgggcgtaggaccctct

SEQ ID NO: 8153 - DNA, 20 bp, Artificial Sequence
  Synthetic oligonucleotide; CAG chr11 5221759 5221778 5221775 +
gggcgtaggaccctctgagc

SEQ ID NO: 8154 - DNA, 20 bp, Artificial Sequence
  Synthetic oligonucleotide; AGG chr11 5221760 5221779 5221776 +
ggcgtaggaccctctgagcc

SEQ ID NO: 8155 - DNA, 20 bp, Artificial Sequence
  Synthetic oligonucleotide; TGG chr11 5221765 5221784 5221781 +
aggaccctctgagccaggca

SEQ ID NO: 8156 - DNA, 20 bp, Artificial Sequence
  Synthetic oligonucleotide; GGG chr11 5221766 5221785 5221782 +
ggaccctctgagccaggcat

SEQ ID NO: 8157 - DNA, 20 bp, Artificial Sequence
  Synthetic oligonucleotide; TGG chr11 5221780 5221799 5221796 +
aggcatgggatataatctcc

SEQ ID NO: 8158 - DNA, 20 bp, Artificial Sequence
  Synthetic oligonucleotide; AAG chr11 5221796 5221815 5221812 +
ctcctggtgtgccatttgtt

SEQ ID NO: 8159 - DNA, 20 bp, Artificial Sequence
  Synthetic oligonucleotide; TGG chr11 5221804 5221823 5221820 +
gtgccatttgttaagcttgt

SEQ ID NO: 8160 - DNA, 20 bp, Artificial Sequence
  Synthetic oligonucleotide; AAG chr11 5221807 5221826 5221823 +
ccatttgttaagcttgttgg

SEQ ID NO: 8161 - DNA, 20 bp, Artificial Sequence
  Synthetic oligonucleotide; GAG chr11 5221809 5221828 5221825 +
atttgttaagcttgttggaa

SEQ ID NO: 8162 - DNA, 20 bp, Artificial Sequence
  Synthetic oligonucleotide; CAG chr11 5221814 5221833 5221830 +
ttaagcttgttggaagagcg

SEQ ID NO: 8163 - DNA, 20 bp, Artificial Sequence
  Synthetic oligonucleotide; TAG chr11 5221820 5221839 5221836 +
ttgttggaagagcgcagtat

SEQ ID NO: 8164 - DNA, 20 bp, Artificial Sequence
  Synthetic oligonucleotide; AGG chr11 5221821 5221840 5221837 +
tgttggaagagcgcagtatt

SEQ ID NO: 8165 - DNA, 20 bp, Artificial Sequence
  Synthetic oligonucleotide; GGG chr11 5221822 5221841 5221838 +
gttggaagagcgcagtatta

SEQ ID NO: 8166 - DNA, 20 bp, Artificial Sequence
  Synthetic oligonucleotide; CGG chr11 5221825 5221844 5221841 +
ggaagagcgcagtattaggg

SEQ ID NO: 8167 - DNA, 20 bp, Artificial Sequence
  Synthetic oligonucleotide; GGG chr11 5221826 5221845 5221842 +
gaagagcgcagtattagggc

SEQ ID NO: 8168 - DNA, 20 bp, Artificial Sequence
  Synthetic oligonucleotide; GAG chr11 5221828 5221847 5221844 +
agagcgcagtattagggcgg

SEQ ID NO: 8169 - DNA, 20 bp, Artificial Sequence
  Synthetic oligonucleotide; CAG chr11 5221844 5221863 5221860 +
gcgggagtgacccgattttc

SEQ ID NO: 8170 - DNA, 20 bp, Artificial Sequence
  Synthetic oligonucleotide; AGG chr11 5221845 5221864 5221861 +
cgggagtgacccgattttcc

SEQ ID NO: 8171 - DNA, 20 bp, Artificial Sequence
  Synthetic oligonucleotide; TAG chr11 5221874 5221893 5221890 +
ctgtcacccttttctttgac

SEQ ID NO: 8172 - DNA, 20 bp, Artificial Sequence
  Synthetic oligonucleotide; AGG chr11 5221875 5221894 5221891 +
tgtcacccttttctttgact

SEQ ID NO: 8173 - DNA, 20 bp, Artificial Sequence
  Synthetic oligonucleotide; AAG chr11 5221879 5221898 5221895 +
acccttttctttgactagga

SEQ ID NO: 8174 - DNA, 20 bp, Artificial Sequence
  Synthetic oligonucleotide; AGG chr11 5221880 5221899 5221896 +
cccttttctttgactaggaa

SEQ ID NO: 8175 - DNA, 20 bp, Artificial Sequence
  Synthetic oligonucleotide; GGG chr11 5221881 5221900 5221897 +
ccttttctttgactaggaaa

SEQ ID NO: 8176 - DNA, 20 bp, Artificial Sequence
  Synthetic oligonucleotide; CGG chr11 5221908 5221927 5221924 +
ccctgaccccttgtgcttcc

SEQ ID NO: 8177 - DNA, 20 bp, Artificial Sequence
  Synthetic oligonucleotide; GGG chr11 5221909 5221928 5221925 +
cctgaccccttgtgcttccc

SEQ ID NO: 8178 - DNA, 20 bp, Artificial Sequence
  Synthetic oligonucleotide; GAG chr11 5221913 5221932 5221929 +
accccttgtgcttcccgggt

SEQ ID NO: 8179 - DNA, 20 bp, Artificial Sequence
  Synthetic oligonucleotide; AGG chr11 5221914 5221933 5221930 +
ccccttgtgcttcccgggtg

SEQ ID NO: 8180 - DNA, 20 bp, Artificial Sequence
  Synthetic oligonucleotide; TGG chr11 5221935 5221954 5221951 +
ggtgatgcctcgccctgctt

SEQ ID NO: 8181 - DNA, 20 bp, Artificial Sequence
  Synthetic oligonucleotide; CAG chr11 5221946 5221965 5221962 +
gccctgctttggctcatgca

SEQ ID NO: 8182 - DNA, 20 bp, Artificial Sequence
  Synthetic oligonucleotide; TGG chr11 5221981 5222000 5221997 +
actgtcctgcacccactgcc

SEQ ID NO: 8183 - DNA, 20 bp, Artificial Sequence
  Synthetic oligonucleotide; GAG chr11 5221995 5222014 5222011 +
actgcctggcacttccctgt

SEQ ID NO: 8184 - DNA, 20 bp, Artificial Sequence
  Synthetic oligonucleotide; TGG chr11 5222005 5222024 5222021 +
acttccctgtgagatgaacc

SEQ ID NO: 8185 - DNA, 20 bp, Artificial Sequence
  Synthetic oligonucleotide; CAG chr11 5222013 5222032 5222029 +
gtgagatgaacctggtacct

SEQ ID NO: 8186 - DNA, 20 bp, Artificial Sequence
  Synthetic oligonucleotide; TGG chr11 5222017 5222036 5222033 +
gatgaacctggtacctcagt

SEQ ID NO: 8187 - DNA, 20 bp, Artificial Sequence
  Synthetic oligonucleotide; CAG chr11 5222025 5222044 5222041 +
tggtacctcagttggaaatg

SEQ ID NO: 8188 - DNA, 20 bp, Artificial Sequence
  Synthetic oligonucleotide; TGG chr11 5222057 5222076 5222073 +
gtcttctgcgtcactcacga

SEQ ID NO: 8189 - DNA, 20 bp, Artificial Sequence
  Synthetic oligonucleotide; GGG chr11 5222058 5222077 5222074 +
tcttctgcgtcactcacgat

SEQ ID NO: 8190 - DNA, 20 bp, Artificial Sequence
  Synthetic oligonucleotide; GAG chr11 5222060 5222079 5222076 +
ttctgcgtcactcacgatgg

SEQ ID NO: 8191 - DNA, 20 bp, Artificial Sequence
  Synthetic oligonucleotide; TAG chr11 5222066 5222085 5222082 +
gtcactcacgatgggagcta

SEQ ID NO: 8192 - DNA, 20 bp, Artificial Sequence
  Synthetic oligonucleotide; TGG chr11 5222071 5222090 5222087 +
tcacgatgggagctatagac

SEQ ID NO: 8193 - DNA, 20 bp, Artificial Sequence
  Synthetic oligonucleotide; GAG chr11 5222073 5222092 5222089 +
acgatgggagctatagactg

SEQ ID NO: 8194 - DNA, 20 bp, Artificial Sequence
  Synthetic oligonucleotide; CGG chr11 5222087 5222106 5222103 +
agactggagctgttcctatt

SEQ ID NO: 8195 - DNA, 20 bp, Artificial Sequence
  Synthetic oligonucleotide; TGG chr11 5222096 5222115 5222112 +
ctgttcctattcggtcatct

SEQ ID NO: 8196 - DNA, 20 bp, Artificial Sequence
  Synthetic oligonucleotide; CGG chr11 5222144 5222163 5222160 +
tttttcttttttttttgtga

SEQ ID NO: 8197 - DNA, 20 bp, Artificial Sequence
  Synthetic oligonucleotide; GAG chr11 5222146 5222165 5222162 +
tttcttttttttttgtgacg

SEQ ID NO: 8198 - DNA, 20 bp, Artificial Sequence
  Synthetic oligonucleotide; TGG chr11 5222164 5222183 5222180 +
cggagtctcatgctgtcacc

SEQ ID NO: 8199 - DNA, 20 bp, Artificial Sequence
  Synthetic oligonucleotide; GGG chr11 5222165 5222184 5222181 +
ggagtctcatgctgtcacct

SEQ ID NO: 8200 - DNA, 20 bp, Artificial Sequence
  Synthetic oligonucleotide; TGG chr11 5222169 5222188 5222185 +
tctcatgctgtcacctgggc

SEQ ID NO: 8201 - DNA, 20 bp, Artificial Sequence
  Synthetic oligonucleotide; CAG chr11 5222176 5222195 5222192 +
ctgtcacctgggctggaatg

SEQ ID NO: 8202 - DNA, 20 bp, Artificial Sequence
  Synthetic oligonucleotide; TGG chr11 5222179 5222198 5222195 +
tcacctgggctggaatgcag

SEQ ID NO: 8203 - DNA, 20 bp, Artificial Sequence
  Synthetic oligonucleotide; TGG chr11 5222190 5222209 5222206 +
ggaatgcagtggcacaatct

SEQ ID NO: 8204 - DNA, 20 bp, Artificial Sequence
  Synthetic oligonucleotide; CAG chr11 5222214 5222233 5222230 +
tcactgcaacctctgcctcc

SEQ ID NO: 8205 - DNA, 20 bp, Artificial Sequence
  Synthetic oligonucleotide; AGG chr11 5222215 5222234 5222231 +
cactgcaacctctgcctccc

SEQ ID NO: 8206 - DNA, 20 bp, Artificial Sequence
  Synthetic oligonucleotide; AAG chr11 5222221 5222240 5222237 +
aacctctgcctcccaggatc

SEQ ID NO: 8207 - DNA, 20 bp, Artificial Sequence
  Synthetic oligonucleotide; CAG chr11 5222238 5222257 5222254 +
atcaagcgattctcctgcct

SEQ ID NO: 8208 - DNA, 20 bp, Artificial Sequence
  Synthetic oligonucleotide; TGG chr11 5222254 5222273 5222270 +
gcctcagcctcccaaattgc

SEQ ID NO: 8209 - DNA, 20 bp, Artificial Sequence
  Synthetic oligonucleotide; GGG chr11 5222255 5222274 5222271 +
cctcagcctcccaaattgct

SEQ ID NO: 8210 - DNA, 20 bp, Artificial Sequence
  Synthetic oligonucleotide; CAG chr11 5222281 5222300 5222297 +
acacatgcctgccaccacgc

SEQ ID NO: 8211 - DNA, 20 bp, Artificial Sequence
  Synthetic oligonucleotide; AGG chr11 5222282 5222301 5222298 +
cacatgcctgccaccacgcc

SEQ ID NO: 8212 - DNA, 20 bp, Artificial Sequence
  Synthetic oligonucleotide; AAG chr11 5222287 5222306 5222303 +
gcctgccaccacgccaggct

SEQ ID NO: 8213 - DNA, 20 bp, Artificial Sequence
  Synthetic oligonucleotide; TAG chr11 5222302 5222321 5222318 +
aggctaagtttttatatttt

SEQ ID NO: 8214 - DNA, 20 bp, Artificial Sequence
  Synthetic oligonucleotide; TAG chr11 5222305 5222324 5222321 +
ctaagtttttatatttttag

SEQ ID NO: 8215 - DNA, 20 bp, Artificial Sequence
  Synthetic oligonucleotide; GAG chr11 5222312 5222331 5222328 +
tttatatttttagtagcgat

SEQ ID NO: 8216 - DNA, 20 bp, Artificial Sequence
  Synthetic oligonucleotide; AGG chr11 5222313 5222332 5222329 +
ttatatttttagtagcgatg

SEQ ID NO: 8217 - DNA, 20 bp, Artificial Sequence
  Synthetic oligonucleotide; TGG chr11 5222327 5222346 5222343 +
gcgatgaggtttcactatgt

SEQ ID NO: 8218 - DNA, 20 bp, Artificial Sequence
  Synthetic oligonucleotide; CAG chr11 5222331 5222350 5222347 +
tgaggtttcactatgttggc

SEQ ID NO: 8219 - DNA, 20 bp, Artificial Sequence
  Synthetic oligonucleotide; AGG chr11 5222332 5222351 5222348 +
gaggtttcactatgttggcc

SEQ ID NO: 8220 - DNA, 20 bp, Artificial Sequence
  Synthetic oligonucleotide; TAG chr11 5222371 5222390 5222387 +
gacgtcgtgatccgcctgtc

SEQ ID NO: 8221 - DNA, 20 bp, Artificial Sequence
  Synthetic oligonucleotide; AGG chr11 5222372 5222391 5222388 +
acgtcgtgatccgcctgtct

SEQ ID NO: 8222 - DNA, 20 bp, Artificial Sequence
  Synthetic oligonucleotide; AAG chr11 5222382 5222401 5222398 +
ccgcctgtctaggcctccca

SEQ ID NO: 8223 - DNA, 20 bp, Artificial Sequence
  Synthetic oligonucleotide; CAG chr11 5222396 5222415 5222412 +
ctcccaaagtgctgcaattg

SEQ ID NO: 8224 - DNA, 20 bp, Artificial Sequence
  Synthetic oligonucleotide; AGG chr11 5222397 5222416 5222413 +
tcccaaagtgctgcaattgc

SEQ ID NO: 8225 - DNA, 20 bp, Artificial Sequence
  Synthetic oligonucleotide; GAG chr11 5222403 5222422 5222419 +
agtgctgcaattgcaggtgt

SEQ ID NO: 8226 - DNA, 20 bp, Artificial Sequence
  Synthetic oligonucleotide; CAG chr11 5222416 5222435 5222432 +
caggtgtgagccaccgctcc

SEQ ID NO: 8227 - DNA, 20 bp, Artificial Sequence
  Synthetic oligonucleotide; TAG chr11 5222421 5222440 5222437 +
gtgagccaccgctcccagcc

SEQ ID NO: 8228 - DNA, 20 bp, Artificial Sequence
  Synthetic oligonucleotide; TAG chr11 5222474 5222493 5222490 +
tgaatttatttctcccttga

SEQ ID NO: 8229 - DNA, 20 bp, Artificial Sequence
  Synthetic oligonucleotide; TGG chr11 5222486 5222505 5222502 +
tcccttgatagtttctactt

SEQ ID NO: 8230 - DNA, 20 bp, Artificial Sequence
  Synthetic oligonucleotide; GGG chr11 5222487 5222506 5222503 +
cccttgatagtttctacttt

SEQ ID NO: 8231 - DNA, 20 bp, Artificial Sequence
  Synthetic oligonucleotide; CAG chr11 5222505 5222524 5222521 +
ttgggttgataattaaataa

SEQ ID NO: 8232 - DNA, 20 bp, Artificial Sequence
  Synthetic oligonucleotide; AAG chr11 5222518 5222537 5222534 +
taaataacagtgttatctct

SEQ ID NO: 8233 - DNA, 20 bp, Artificial Sequence
  Synthetic oligonucleotide; TAG chr11 5222552 5222571 5222568 +
gtcttcccatatttttattc

SEQ ID NO: 8234 - DNA, 20 bp, Artificial Sequence
  Synthetic oligonucleotide; TGG chr11 5222604 5222623 5222620 +
cctaattgtgtaatcgattg

SEQ ID NO: 8235 - DNA, 20 bp, Artificial Sequence
  Synthetic oligonucleotide; CAG chr11 5222613 5222632 5222629 +
gtaatcgattgtggtatatg

SEQ ID NO: 8236 - DNA, 20 bp, Artificial Sequence
  Synthetic oligonucleotide; AAG chr11 5222618 5222637 5222634 +
cgattgtggtatatgcagtt

SEQ ID NO: 8237 - DNA, 20 bp, Artificial Sequence
  Synthetic oligonucleotide; AAG chr11 5222644 5222663 5222660 +
ttcactttactcttttcaaa

SEQ ID NO: 8238 - DNA, 20 bp, Artificial Sequence
  Synthetic oligonucleotide; TAG chr11 5222649 5222668 5222665 +
tttactcttttcaaaaagta

SEQ ID NO: 8239 - DNA, 20 bp, Artificial Sequence
  Synthetic oligonucleotide; AAG chr11 5222682 5222701 5222698 +
actgtttgttttttatttcc

SEQ ID NO: 8240 - DNA, 20 bp, Artificial Sequence
  Synthetic oligonucleotide; AAG chr11 5222695 5222714 5222711 +
tatttccaagctaaatttaa

SEQ ID NO: 8241 - DNA, 20 bp, Artificial Sequence
  Synthetic oligonucleotide; TAG chr11 5222729 5222748 5222745 +
tatatcacattattatattt

SEQ ID NO: 8242 - DNA, 20 bp, Artificial Sequence
  Synthetic oligonucleotide; GAG chr11 5222733 5222752 5222749 +
tcacattattatattttagt

SEQ ID NO: 8243 - DNA, 20 bp, Artificial Sequence
  Synthetic oligonucleotide; TAG chr11 5222739 5222758 5222755 +
tattatattttagtgagatt

SEQ ID NO: 8244 - DNA, 20 bp, Artificial Sequence
  Synthetic oligonucleotide; TGG chr11 5222746 5222765 5222762 +
ttttagtgagatttagtttt

SEQ ID NO: 8245 - DNA, 20 bp, Artificial Sequence
  Synthetic oligonucleotide; GAG chr11 5222782 5222801 5222798 +
ccactatcttacttacacat

SEQ ID NO: 8246 - DNA, 20 bp, Artificial Sequence
  Synthetic oligonucleotide; TGG chr11 5222785 5222804 5222801 +
ctatcttacttacacatgag

SEQ ID NO: 8247 - DNA, 20 bp, Artificial Sequence
  Synthetic oligonucleotide; TAG chr11 5222807 5222826 5222823 +
gtattaatttaacatgattt

SEQ ID NO: 8248 - DNA, 20 bp, Artificial Sequence
  Synthetic oligonucleotide; AAG chr11 5222814 5222833 5222830 +
tttaacatgattttagaatg

SEQ ID NO: 8249 - DNA, 20 bp, Artificial Sequence
  Synthetic oligonucleotide; AAG chr11 5222823 5222842 5222839 +
attttagaatgaagaaaatg

SEQ ID NO: 8250 - DNA, 20 bp, Artificial Sequence
  Synthetic oligonucleotide; TAG chr11 5222833 5222852 5222849 +
gaagaaaatgaagccatttt

SEQ ID NO: 8251 - DNA, 20 bp, Artificial Sequence
  Synthetic oligonucleotide; AAG chr11 5222845 5222864 5222861 +
gccatttttagataaaccaa

SEQ ID NO: 8252 - DNA, 20 bp, Artificial Sequence
  Synthetic oligonucleotide; CAG chr11 5222862 5222881 5222878 +
caaaagtaacaatgtatttc

SEQ ID NO: 8253 - DNA, 20 bp, Artificial Sequence
  Synthetic oligonucleotide; CAG chr11 5222865 5222884 5222881 +
aagtaacaatgtatttccag

SEQ ID NO: 8254 - DNA, 20 bp, Artificial Sequence
  Synthetic oligonucleotide; AAG chr11 5222869 5222888 5222885 +
aacaatgtatttccagcaga

SEQ ID NO: 8255 - DNA, 20 bp, Artificial Sequence
  Synthetic oligonucleotide; GAG chr11 5222871 5222890 5222887 +
caatgtatttccagcagaaa

SEQ ID NO: 8256 - DNA, 20 bp, Artificial Sequence
  Synthetic oligonucleotide; AAG chr11 5222882 5222901 5222898 +
cagcagaaagagataatatt

SEQ ID NO: 8257 - DNA, 20 bp, Artificial Sequence
  Synthetic oligonucleotide; AGG chr11 5222883 5222902 5222899 +
agcagaaagagataatatta

SEQ ID NO: 8258 - DNA, 20 bp, Artificial Sequence
  Synthetic oligonucleotide; CAG chr11 5222891 5222910 5222907 +
gagataatattaaggataat

SEQ ID NO: 8259 - DNA, 20 bp, Artificial Sequence
  Synthetic oligonucleotide; TAG chr11 5222901 5222920 5222917 +
taaggataatcagaaaaaaa

SEQ ID NO: 8260 - DNA, 20 bp, Artificial Sequence
  Synthetic oligonucleotide; TAG chr11 5222912 5222931 5222928 +
agaaaaaaatagaataaact

SEQ ID NO: 8261 - DNA, 20 bp, Artificial Sequence
  Synthetic oligonucleotide; GAG chr11 5222914 5222933 5222930 +
aaaaaaatagaataaactta

SEQ ID NO: 8262 - DNA, 20 bp, Artificial Sequence
  Synthetic oligonucleotide; GAG chr11 5222916 5222935 5222932 +
aaaaatagaataaacttaga

SEQ ID NO: 8263 - DNA, 20 bp, Artificial Sequence
  Synthetic oligonucleotide; TAG chr11 5222924 5222943 5222940 +
aataaacttagagagaatgt

SEQ ID NO: 8264 - DNA, 20 bp, Artificial Sequence
  Synthetic oligonucleotide; AAG chr11 5222932 5222951 5222948 +
tagagagaatgttagaaatg

SEQ ID NO: 8265 - DNA, 20 bp, Artificial Sequence
  Synthetic oligonucleotide; AAG chr11 5222937 5222956 5222953 +
agaatgttagaaatgaagaa

SEQ ID NO: 8266 - DNA, 20 bp, Artificial Sequence
  Synthetic oligonucleotide; AAG chr11 5222961 5222980 5222977 +
atgcaaaacattttgtacat

SEQ ID NO: 8267 - DNA, 20 bp, Artificial Sequence
  Synthetic oligonucleotide; TAG chr11 5222997 5223016 5223013 +
tcactatttaataataacac

SEQ ID NO: 8268 - DNA, 20 bp, Artificial Sequence
  Synthetic oligonucleotide; TAG chr11 5223006 5223025 5223022 +
aataataacactagaaaatc

SEQ ID NO: 8269 - DNA, 20 bp, Artificial Sequence
  Synthetic oligonucleotide; AGG chr11 5223007 5223026 5223023 +
ataataacactagaaaatct

SEQ ID NO: 8270 - DNA, 20 bp, Artificial Sequence
  Synthetic oligonucleotide; GGG chr11 5223008 5223027 5223024 +
taataacactagaaaatcta

SEQ ID NO: 8271 - DNA, 20 bp, Artificial Sequence
  Synthetic oligonucleotide; GAG chr11 5223010 5223029 5223026 +
ataacactagaaaatctagg

SEQ ID NO: 8272 - DNA, 20 bp, Artificial Sequence
  Synthetic oligonucleotide; TAG chr11 5223055 5223074 5223071 +
aatatatatatatataatta

SEQ ID NO: 8273 - DNA, 20 bp, Artificial Sequence
  Synthetic oligonucleotide; TGG chr11 5223060 5223079 5223076 +
atatatatataattatagat

SEQ ID NO: 8274 - DNA, 20 bp, Artificial Sequence
  Synthetic oligonucleotide; GGG chr11 5223061 5223080 5223077 +
tatatatataattatagatt

SEQ ID NO: 8275 - DNA, 20 bp, Artificial Sequence
  Synthetic oligonucleotide; AAG chr11 5223064 5223083 5223080 +
atatataattatagattggg

SEQ ID NO: 8276 - DNA, 20 bp, Artificial Sequence
  Synthetic oligonucleotide; AGG chr11 5223065 5223084 5223081 +
tatataattatagattggga

SEQ ID NO: 8277 - DNA, 20 bp, Artificial Sequence
  Synthetic oligonucleotide; GGG chr11 5223066 5223085 5223082 +
atataattatagattgggaa

SEQ ID NO: 8278 - DNA, 20 bp, Artificial Sequence
  Synthetic oligonucleotide; GGG chr11 5223067 5223086 5223083 +
tataattatagattgggaag

SEQ ID NO: 8279 - DNA, 20 bp, Artificial Sequence
  Synthetic oligonucleotide; AAG chr11 5223076 5223095 5223092 +
agattgggaaggggaaaatg

SEQ ID NO: 8280 - DNA, 20 bp, Artificial Sequence
  Synthetic oligonucleotide; AAG chr11 5223082 5223101 5223098 +
ggaaggggaaaatgaagata

SEQ ID NO: 8281 - DNA, 20 bp, Artificial Sequence
  Synthetic oligonucleotide; TGG chr11 5223108 5223127 5223124 +
taaaatttattgtattgttt

SEQ ID NO: 8282 - DNA, 20 bp, Artificial Sequence
  Synthetic oligonucleotide; AAG chr11 5223113 5223132 5223129 +
tttattgtattgttttggaa

SEQ ID NO: 8283 - DNA, 20 bp, Artificial Sequence
  Synthetic oligonucleotide; GAG chr11 5223115 5223134 5223131 +
tattgtattgttttggaaaa

SEQ ID NO: 8284 - DNA, 20 bp, Artificial Sequence
  Synthetic oligonucleotide; CAG chr11 5223122 5223141 5223138 +
ttgttttggaaaagagtaaa

SEQ ID NO: 8285 - DNA, 20 bp, Artificial Sequence
  Synthetic oligonucleotide; TGG chr11 5223130 5223149 5223146 +
gaaaagagtaaacagtcaaa

SEQ ID NO: 8286 - DNA, 20 bp, Artificial Sequence
  Synthetic oligonucleotide; AAG chr11 5223153 5223172 5223169 +
atatttgtatctgaaaaatc

SEQ ID NO: 8287 - DNA, 20 bp, Artificial Sequence
  Synthetic oligonucleotide; AAG chr11 5223174 5223193 5223190 +
agaatgcaattctaatcatc

SEQ ID NO: 8288 - DNA, 20 bp, Artificial Sequence
  Synthetic oligonucleotide; TAG chr11 5223195 5223214 5223211 +
agatgcatttttttattttt

SEQ ID NO: 8289 - DNA, 20 bp, Artificial Sequence
  Synthetic oligonucleotide; GAG chr11 5223249 5223268 5223265 +
tattattcttcaactttatt

SEQ ID NO: 8290 - DNA, 20 bp, Artificial Sequence
  Synthetic oligonucleotide; AGG chr11 5223250 5223269 5223266 +
attattcttcaactttattg

SEQ ID NO: 8291 - DNA, 20 bp, Artificial Sequence
  Synthetic oligonucleotide; AAG chr11 5223284 5223303 5223300 +
aataaaaattgtatatattt

SEQ ID NO: 8292 - DNA, 20 bp, Artificial Sequence
  Synthetic oligonucleotide; AGG chr11 5223285 5223304 5223301 +
ataaaaattgtatatattta

SEQ ID NO: 8293 - DNA, 20 bp, Artificial Sequence
  Synthetic oligonucleotide; AAG chr11 5223342 5223361 5223358 +
gtgaaatgattaccacaatc

SEQ ID NO: 8294 - DNA, 20 bp, Artificial Sequence
  Synthetic oligonucleotide; TAG chr11 5223371 5223390 5223387 +
aacatacccattatctcaca

SEQ ID NO: 8295 - DNA, 20 bp, Artificial Sequence
  Synthetic oligonucleotide; TGG chr11 5223388 5223407 5223404 +
acatagttacctttttcttg

SEQ ID NO: 8296 - DNA, 20 bp, Artificial Sequence
  Synthetic oligonucleotide; AAG chr11 5223402 5223421 5223418 +
ttcttgtggtaaatgctttt

SEQ ID NO: 8297 - DNA, 20 bp, Artificial Sequence
  Synthetic oligonucleotide; CGG chr11 5223414 5223433 5223430 +
atgcttttaagatctactct

SEQ ID NO: 8298 - DNA, 20 bp, Artificial Sequence
  Synthetic oligonucleotide; CAG chr11 5223418 5223437 5223434 +
ttttaagatctactctcggc

SEQ ID NO: 8299 - DNA, 20 bp, Artificial Sequence
  Synthetic oligonucleotide; AGG chr11 5223419 5223438 5223435 +
tttaagatctactctcggcc

SEQ ID NO: 8300 - DNA, 20 bp, Artificial Sequence
  Synthetic oligonucleotide; CGG chr11 5223424 5223443 5223440 +
gatctactctcggccaggcc

SEQ ID NO: 8301 - DNA, 20 bp, Artificial Sequence
  Synthetic oligonucleotide; TGG chr11 5223427 5223446 5223443 +
ctactctcggccaggcccgg

SEQ ID NO: 8302 - DNA, 20 bp, Artificial Sequence
  Synthetic oligonucleotide; CAG chr11 5223446 5223465 5223462 +
gtggctcacgcctgtaatcc

SEQ ID NO: 8303 - DNA, 20 bp, Artificial Sequence
  Synthetic oligonucleotide; TGG chr11 5223454 5223473 5223470 +
cgcctgtaatcccagccctt

SEQ ID NO: 8304 - DNA, 20 bp, Artificial Sequence
  Synthetic oligonucleotide; GGG chr11 5223455 5223474 5223471 +
gcctgtaatcccagcccttt

SEQ ID NO: 8305 - DNA, 20 bp, Artificial Sequence
  Synthetic oligonucleotide; TGG chr11 5223458 5223477 5223474 +
tgtaatcccagccctttggg

SEQ ID NO: 8306 - DNA, 20 bp, Artificial Sequence
  Synthetic oligonucleotide; GAG chr11 5223463 5223482 5223479 +
tcccagccctttgggtggcc

SEQ ID NO: 8307 - DNA, 20 bp, Artificial Sequence
  Synthetic oligonucleotide; AGG chr11 5223464 5223483 5223480 +
cccagccctttgggtggccg

SEQ ID NO: 8308 - DNA, 20 bp, Artificial Sequence
  Synthetic oligonucleotide; CAG chr11 5223467 5223486 5223483 +
agccctttgggtggccgagg

SEQ ID NO: 8309 - DNA, 20 bp, Artificial Sequence
  Synthetic oligonucleotide; AGG chr11 5223468 5223487 5223484 +
gccctttgggtggccgaggc

SEQ ID NO: 8310 - DNA, 20 bp, Artificial Sequence
  Synthetic oligonucleotide; CGG chr11 5223471 5223490 5223487 +
ctttgggtggccgaggcagg

SEQ ID NO: 8311 - DNA, 20 bp, Artificial Sequence
  Synthetic oligonucleotide; CAG chr11 5223476 5223495 5223492 +
ggtggccgaggcaggcggat

SEQ ID NO: 8312 - DNA, 20 bp, Artificial Sequence
  Synthetic oligonucleotide; TGG chr11 5223490 5223509 5223506 +
gcggatcagcctgaccaaca

SEQ ID NO: 8313 - DNA, 20 bp, Artificial Sequence
  Synthetic oligonucleotide; GAG chr11 5223492 5223511 5223508 +
ggatcagcctgaccaacatg

SEQ ID NO: 8314 - DNA, 20 bp, Artificial Sequence
  Synthetic oligonucleotide; TAG chr11 5223524 5223543 5223540 +
ctctactaaaaatacaaaat

SEQ ID NO: 8315 - DNA, 20 bp, Artificial Sequence
  Synthetic oligonucleotide; TGG chr11 5223528 5223547 5223544 +
actaaaaatacaaaattagc

SEQ ID NO: 8316 - DNA, 20 bp, Artificial Sequence
  Synthetic oligonucleotide; GGG chr11 5223529 5223548 5223545 +
ctaaaaatacaaaattagct

SEQ ID NO: 8317 - DNA, 20 bp, Artificial Sequence
  Synthetic oligonucleotide; TGG chr11 5223534 5223553 5223550 +
aatacaaaattagctgggca

SEQ ID NO: 8318 - DNA, 20 bp, Artificial Sequence
  Synthetic oligonucleotide; CAG chr11 5223556 5223575 5223572 +
gtgtcgcatgcctgtaatcc

SEQ ID NO: 8319 - DNA, 20 bp, Artificial Sequence
  Synthetic oligonucleotide; CGG chr11 5223564 5223583 5223580 +
tgcctgtaatcccagctact

SEQ ID NO: 8320 - DNA, 20 bp, Artificial Sequence
  Synthetic oligonucleotide; GGG chr11 5223565 5223584 5223581 +
gcctgtaatcccagctactc

SEQ ID NO: 8321 - DNA, 20 bp, Artificial Sequence
  Synthetic oligonucleotide; GAG chr11 5223567 5223586 5223583 +
ctgtaatcccagctactcgg

SEQ ID NO: 8322 - DNA, 20 bp, Artificial Sequence
  Synthetic oligonucleotide; AGG chr11 5223568 5223587 5223584 +
tgtaatcccagctactcggg

SEQ ID NO: 8323 - DNA, 20 bp, Artificial Sequence
  Synthetic oligonucleotide; GAG chr11 5223573 5223592 5223589 +
tcccagctactcgggaggct

SEQ ID NO: 8324 - DNA, 20 bp, Artificial Sequence
  Synthetic oligonucleotide; AGG chr11 5223574 5223593 5223590 +
cccagctactcgggaggctg

SEQ ID NO: 8325 - DNA, 20 bp, Artificial Sequence
  Synthetic oligonucleotide; CAG chr11 5223577 5223596 5223593 +
agctactcgggaggctgagg

SEQ ID NO: 8326 - DNA, 20 bp, Artificial Sequence
  Synthetic oligonucleotide; AGG chr11 5223578 5223597 5223594 +
gctactcgggaggctgaggc

SEQ ID NO: 8327 - DNA, 20 bp, Artificial Sequence
  Synthetic oligonucleotide; GAG chr11 5223580 5223599 5223596 +
tactcgggaggctgaggcag

SEQ ID NO: 8328 - DNA, 20 bp, Artificial Sequence
  Synthetic oligonucleotide; CAG chr11 5223596 5223615 5223612 +
gcaggagatttgcttgaacc

SEQ ID NO: 8329 - DNA, 20 bp, Artificial Sequence
  Synthetic oligonucleotide; AGG chr11 5223597 5223616 5223613 +
caggagatttgcttgaaccc

SEQ ID NO: 8330 - DNA, 20 bp, Artificial Sequence
  Synthetic oligonucleotide; GAG chr11 5223599 5223618 5223615 +
ggagatttgcttgaacccag

SEQ ID NO: 8331 - DNA, 20 bp, Artificial Sequence
  Synthetic oligonucleotide; AGG chr11 5223600 5223619 5223616 +
gagatttgcttgaacccagg

SEQ ID NO: 8332 - DNA, 20 bp, Artificial Sequence
  Synthetic oligonucleotide; CGG chr11 5223603 5223622 5223619 +
atttgcttgaacccaggagg

SEQ ID NO: 8333 - DNA, 20 bp, Artificial Sequence
  Synthetic oligonucleotide; GAG chr11 5223605 5223624 5223621 +
ttgcttgaacccaggaggcg

SEQ ID NO: 8334 - DNA, 20 bp, Artificial Sequence
  Synthetic oligonucleotide; AGG chr11 5223606 5223625 5223622 +
tgcttgaacccaggaggcgg

SEQ ID NO: 8335 - DNA, 20 bp, Artificial Sequence
  Synthetic oligonucleotide; CAG chr11 5223612 5223631 5223628 +
aacccaggaggcggaggttg

SEQ ID NO: 8336 - DNA, 20 bp, Artificial Sequence
  Synthetic oligonucleotide; GAG chr11 5223616 5223635 5223632 +
caggaggcggaggttgcagt

SEQ ID NO: 8337 - DNA, 20 bp, Artificial Sequence
  Synthetic oligonucleotide; AAG chr11 5223621 5223640 5223637 +
ggcggaggttgcagtgagcc

SEQ ID NO: 8338 - DNA, 20 bp, Artificial Sequence
  Synthetic oligonucleotide; CAG chr11 5223641 5223660 5223657 +
aagatcttgccattgcactc

SEQ ID NO: 8339 - DNA, 20 bp, Artificial Sequence
  Synthetic oligonucleotide; TGG chr11 5223646 5223665 5223662 +
cttgccattgcactccagcc

SEQ ID NO: 8340 - DNA, 20 bp, Artificial Sequence
  Synthetic oligonucleotide; AAG chr11 5223654 5223673 5223670 +
tgcactccagcctggacaac

SEQ ID NO: 8341 - DNA, 20 bp, Artificial Sequence
  Synthetic oligonucleotide; GAG chr11 5223656 5223675 5223672 +
cactccagcctggacaacaa

SEQ ID NO: 8342 - DNA, 20 bp, Artificial Sequence
  Synthetic oligonucleotide; CAG chr11 5223719 5223738 5223735 +
gcaaattttaaatatactta

SEQ ID NO: 8343 - DNA, 20 bp, Artificial Sequence
  Synthetic oligonucleotide; CAG chr11 5223734 5223753 5223750 +
acttacagtacaattaacta

SEQ ID NO: 8344 - DNA, 20 bp, Artificial Sequence
  Synthetic oligonucleotide; TAG chr11 5223753 5223772 5223769 +
acagtcacgatgctgtacat

SEQ ID NO: 8345 - DNA, 20 bp, Artificial Sequence
  Synthetic oligonucleotide; TAG chr11 5223761 5223780 5223777 +
gatgctgtacattagatatc

SEQ ID NO: 8346 - DNA, 20 bp, Artificial Sequence
  Synthetic oligonucleotide; GAG chr11 5223803 5223822 5223819 +
actgaaattttatacccttt

SEQ ID NO: 8347 - DNA, 20 bp, Artificial Sequence
  Synthetic oligonucleotide; TAG chr11 5223809 5223828 5223825 +
attttataccctttgagtaa

SEQ ID NO: 8348 - DNA, 20 bp, Artificial Sequence
  Synthetic oligonucleotide; TGG chr11 5223839 5223858 5223855 +
attctcccacccccaacccc

SEQ ID NO: 8349 - DNA, 20 bp, Artificial Sequence
  Synthetic oligonucleotide; GAG chr11 5223870 5223889 5223886 +
cctctactgtctgtttccat

SEQ ID NO: 8350 - DNA, 20 bp, Artificial Sequence
  Synthetic oligonucleotide; GAG chr11 5223872 5223891 5223888 +
tctactgtctgtttccatga

SEQ ID NO: 8351 - DNA, 20 bp, Artificial Sequence
  Synthetic oligonucleotide; GAG chr11 5223898 5223917 5223914 +
cttttttatgtttcacatat

SEQ ID NO: 8352 - DNA, 20 bp, Artificial Sequence
  Synthetic oligonucleotide; AAG chr11 5223902 5223921 5223918 +
tttatgtttcacatatgagc

SEQ ID NO: 8353 - DNA, 20 bp, Artificial Sequence
  Synthetic oligonucleotide; AGG chr11 5223903 5223922 5223919 +
ttatgtttcacatatgagca

SEQ ID NO: 8354 - DNA, 20 bp, Artificial Sequence
  Synthetic oligonucleotide; TAG chr11 5223911 5223930 5223927 +
cacatatgagcaaggttgtg

SEQ ID NO: 8355 - DNA, 20 bp, Artificial Sequence
  Synthetic oligonucleotide; CAG chr11 5223931 5223950 5223947 +
tagtatttgtctttttgtgt

SEQ ID NO: 8356 - DNA, 20 bp, Artificial Sequence
  Synthetic oligonucleotide; AGG chr11 5223932 5223951 5223948 +
agtatttgtctttttgtgtc

SEQ ID NO: 8357 - DNA, 20 bp, Artificial Sequence
  Synthetic oligonucleotide; TAG chr11 5223946 5223965 5223962 +
tgtgtcaggcttatttttct

SEQ ID NO: 8358 - DNA, 20 bp, Artificial Sequence
  Synthetic oligonucleotide; CAG chr11 5223961 5223980 5223977 +
tttcttagttttacatcctc

SEQ ID NO: 8359 - DNA, 20 bp, Artificial Sequence
  Synthetic oligonucleotide; AGG chr11 5223962 5223981 5223978 +
ttcttagttttacatcctcc

SEQ ID NO: 8360 - DNA, 20 bp, Artificial Sequence
  Synthetic oligonucleotide; TGG chr11 5223985 5224004 5224001 +
ttcatcaattctgccataaa

SEQ ID NO: 8361 - DNA, 20 bp, Artificial Sequence
  Synthetic oligonucleotide; CAG chr11 5223988 5224007 5224004 +
atcaattctgccataaatgg

SEQ ID NO: 8362 - DNA, 20 bp, Artificial Sequence
  Synthetic oligonucleotide; AGG chr11 5223989 5224008 5224005 +
tcaattctgccataaatggc

SEQ ID NO: 8363 - DNA, 20 bp, Artificial Sequence
  Synthetic oligonucleotide; TGG chr11 5224073 5224092 5224089 +
tctgtgtttcttatatattt

SEQ ID NO: 8364 - DNA, 20 bp, Artificial Sequence
  Synthetic oligonucleotide; AAG chr11 5224094 5224113 5224110 +
ggatattaaccaaaatattt

SEQ ID NO: 8365 - DNA, 20 bp, Artificial Sequence
  Synthetic oligonucleotide; TGG chr11 5224104 5224123 5224120 +
caaaatatttaagaaatatt

SEQ ID NO: 8366 - DNA, 20 bp, Artificial Sequence
  Synthetic oligonucleotide; TGG chr11 5224127 5224146 5224143 +
tttgcaaatatgccatttca

SEQ ID NO: 8367 - DNA, 20 bp, Artificial Sequence
  Synthetic oligonucleotide; TGG chr11 5224166 5224185 5224182 +
tcattgttttgttttttgtg

SEQ ID NO: 8368 - DNA, 20 bp, Artificial Sequence
  Synthetic oligonucleotide; TAG chr11 5224177 5224196 5224193 +
ttttttgtgtggaaattttt

SEQ ID NO: 8369 - DNA, 20 bp, Artificial Sequence
  Synthetic oligonucleotide; TAG chr11 5224187 5224206 5224203 +
ggaaattttttagtttgatg

SEQ ID NO: 8370 - DNA, 20 bp, Artificial Sequence
  Synthetic oligonucleotide; CGG chr11 5224247 5224266 5224263 +
ctcatatcaaattcaaaaaa

SEQ ID NO: 8371 - DNA, 20 bp, Artificial Sequence
  Synthetic oligonucleotide; TAG chr11 5224265 5224284 5224281 +
aacggctgcaacgtgaatat

SEQ ID NO: 8372 - DNA, 20 bp, Artificial Sequence
  Synthetic oligonucleotide; TGG chr11 5224302 5224321 5224318 +
gatttctttaaaaattttta

SEQ ID NO: 8373 - DNA, 20 bp, Artificial Sequence
  Synthetic oligonucleotide; TAG chr11 5224308 5224327 5224324 +
tttaaaaatttttatggttt

SEQ ID NO: 8374 - DNA, 20 bp, Artificial Sequence
  Synthetic oligonucleotide; AGG chr11 5224309 5224328 5224325 +
ttaaaaatttttatggtttt

SEQ ID NO: 8375 - DNA, 20 bp, Artificial Sequence
  Synthetic oligonucleotide; TAG chr11 5224315 5224334 5224331 +
atttttatggttttaggtct

SEQ ID NO: 8376 - DNA, 20 bp, Artificial Sequence
  Synthetic oligonucleotide; TGG chr11 5224355 5224374 5224371 +
ttcaaatttatttttgttta

SEQ ID NO: 8377 - DNA, 20 bp, Artificial Sequence
  Synthetic oligonucleotide; AAG chr11 5224361 5224380 5224377 +
tttatttttgtttatggtgt

SEQ ID NO: 8378 - DNA, 20 bp, Artificial Sequence
  Synthetic oligonucleotide; AAG chr11 5224366 5224385 5224382 +
ttttgtttatggtgtaagac

SEQ ID NO: 8379 - DNA, 20 bp, Artificial Sequence
  Synthetic oligonucleotide; AGG chr11 5224367 5224386 5224383 +
tttgtttatggtgtaagaca

SEQ ID NO: 8380 - DNA, 20 bp, Artificial Sequence
  Synthetic oligonucleotide; GGG chr11 5224368 5224387 5224384 +
ttgtttatggtgtaagacaa

SEQ ID NO: 8381 - DNA, 20 bp, Artificial Sequence
  Synthetic oligonucleotide; GAG chr11 5224390 5224409 5224406 +
gtctgatttcatttcatttt

SEQ ID NO: 8382 - DNA, 20 bp, Artificial Sequence
  Synthetic oligonucleotide; AGG chr11 5224391 5224410 5224407 +
tctgatttcatttcattttg

SEQ ID NO: 8383 - DNA, 20 bp, Artificial Sequence
  Synthetic oligonucleotide; GGG chr11 5224392 5224411 5224408 +
ctgatttcatttcattttga

SEQ ID NO: 8384 - DNA, 20 bp, Artificial Sequence
  Synthetic oligonucleotide; CAG chr11 5224471 5224490 5224487 +
ctgattatatgccttgattt

SEQ ID NO: 8385 - DNA, 20 bp, Artificial Sequence
  Synthetic oligonucleotide; TAG chr11 5224486 5224505 5224502 +
gatttcagaatcttgccaac

SEQ ID NO: 8386 - DNA, 20 bp, Artificial Sequence
  Synthetic oligonucleotide; CAG chr11 5224492 5224511 5224508 +
agaatcttgccaactagatt

SEQ ID NO: 8387 - DNA, 20 bp, Artificial Sequence
  Synthetic oligonucleotide; TGG chr11 5224503 5224522 5224519 +
aactagattcagaatttgac

SEQ ID NO: 8388 - DNA, 20 bp, Artificial Sequence
  Synthetic oligonucleotide; GGG chr11 5224504 5224523 5224520 +
actagattcagaatttgact

SEQ ID NO: 8389 - DNA, 20 bp, Artificial Sequence
  Synthetic oligonucleotide; GAG chr11 5224506 5224525 5224522 +
tagattcagaatttgactgg

SEQ ID NO: 8390 - DNA, 20 bp, Artificial Sequence
  Synthetic oligonucleotide; GAG chr11 5224508 5224527 5224524 +
gattcagaatttgactggga

SEQ ID NO: 8391 - DNA, 20 bp, Artificial Sequence
  Synthetic oligonucleotide; GAG chr11 5224510 5224529 5224526 +
ttcagaatttgactgggaga

SEQ ID NO: 8392 - DNA, 20 bp, Artificial Sequence
  Synthetic oligonucleotide; AGG chr11 5224511 5224530 5224527 +
tcagaatttgactgggagag

SEQ ID NO: 8393 - DNA, 20 bp, Artificial Sequence
  Synthetic oligonucleotide; AAG chr11 5224516 5224535 5224532 +
atttgactgggagagaggac

SEQ ID NO: 8394 - DNA, 20 bp, Artificial Sequence
  Synthetic oligonucleotide; AGG chr11 5224517 5224536 5224533 +
tttgactgggagagaggaca

SEQ ID NO: 8395 - DNA, 20 bp, Artificial Sequence
  Synthetic oligonucleotide; GAG chr11 5224527 5224546 5224543 +
agagaggacaaggaccactt

SEQ ID NO: 8396 - DNA, 20 bp, Artificial Sequence
  Synthetic oligonucleotide; CAG chr11 5224546 5224565 5224562 +
tgagactcatattttatttc

SEQ ID NO: 8397 - DNA, 20 bp, Artificial Sequence
  Synthetic oligonucleotide; TAG chr11 5224553 5224572 5224569 +
catattttatttccagaatc

SEQ ID NO: 8398 - DNA, 20 bp, Artificial Sequence
  Synthetic oligonucleotide; TAG chr11 5224568 5224587 5224584 +
gaatctagcatctacctacc

SEQ ID NO: 8399 - DNA, 20 bp, Artificial Sequence
  Synthetic oligonucleotide; AGG chr11 5224569 5224588 5224585 +
aatctagcatctacctacct

SEQ ID NO: 8400 - DNA, 20 bp, Artificial Sequence
  Synthetic oligonucleotide; AAG chr11 5224580 5224599 5224596 +
tacctacctaggtattgaat

SEQ ID NO: 8401 - DNA, 20 bp, Artificial Sequence
  Synthetic oligonucleotide; AAG chr11 5224590 5224609 5224606 +
ggtattgaataagaaaaatg

SEQ ID NO: 8402 - DNA, 20 bp, Artificial Sequence
  Synthetic oligonucleotide; AAG chr11 5224595 5224614 5224611 +
tgaataagaaaaatgaagtt

SEQ ID NO: 8403 - DNA, 20 bp, Artificial Sequence
  Synthetic oligonucleotide; AGG chr11 5224596 5224615 5224612 +
gaataagaaaaatgaagtta

SEQ ID NO: 8404 - DNA, 20 bp, Artificial Sequence
  Synthetic oligonucleotide; TGG chr11 5224599 5224618 5224615 +
taagaaaaatgaagttaagg

SEQ ID NO: 8405 - DNA, 20 bp, Artificial Sequence
  Synthetic oligonucleotide; TGG chr11 5224606 5224625 5224622 +
aatgaagttaaggtggttga

SEQ ID NO: 8406 - DNA, 20 bp, Artificial Sequence
  Synthetic oligonucleotide; CAG chr11 5224629 5224648 5224645 +
taacactatgctaataactg

SEQ ID NO: 8407 - DNA, 20 bp, Artificial Sequence
  Synthetic oligonucleotide; GAG chr11 5224631 5224650 5224647 +
acactatgctaataactgca

SEQ ID NO: 8408 - DNA, 20 bp, Artificial Sequence
  Synthetic oligonucleotide; CAG chr11 5224635 5224654 5224651 +
tatgctaataactgcagagc

SEQ ID NO: 8409 - DNA, 20 bp, Artificial Sequence
  Synthetic oligonucleotide; AAG chr11 5224638 5224657 5224654 +
gctaataactgcagagccag

SEQ ID NO: 8410 - DNA, 20 bp, Artificial Sequence
  Synthetic oligonucleotide; AAG chr11 5224647 5224666 5224663 +
tgcagagccagaagcaccat

SEQ ID NO: 8411 - DNA, 20 bp, Artificial Sequence
  Synthetic oligonucleotide; AGG chr11 5224648 5224667 5224664 +
gcagagccagaagcaccata

SEQ ID NO: 8412 - DNA, 20 bp, Artificial Sequence
  Synthetic oligonucleotide; GGG chr11 5224649 5224668 5224665 +
cagagccagaagcaccataa

SEQ ID NO: 8413 - DNA, 20 bp, Artificial Sequence
  Synthetic oligonucleotide; AAG chr11 5224659 5224678 5224675 +
agcaccataagggacatgat

SEQ ID NO: 8414 - DNA, 20 bp, Artificial Sequence
  Synthetic oligonucleotide; AGG chr11 5224660 5224679 5224676 +
gcaccataagggacatgata

SEQ ID NO: 8415 - DNA, 20 bp, Artificial Sequence
  Synthetic oligonucleotide; GGG chr11 5224661 5224680 5224677 +
caccataagggacatgataa

SEQ ID NO: 8416 - DNA, 20 bp, Artificial Sequence
  Synthetic oligonucleotide; GAG chr11 5224663 5224682 5224679 +
ccataagggacatgataagg

SEQ ID NO: 8417 - DNA, 20 bp, Artificial Sequence
  Synthetic oligonucleotide; CAG chr11 5224667 5224686 5224683 +
aagggacatgataagggagc

SEQ ID NO: 8418 - DNA, 20 bp, Artificial Sequence
  Synthetic oligonucleotide; CAG chr11 5224670 5224689 5224686 +
ggacatgataagggagccag

SEQ ID NO: 8419 - DNA, 20 bp, Artificial Sequence
  Synthetic oligonucleotide; GAG chr11 5224712 5224731 5224728 +
atgctaatcttaaacatcct

SEQ ID NO: 8420 - DNA, 20 bp, Artificial Sequence
  Synthetic oligonucleotide; AGG chr11 5224713 5224732 5224729 +
tgctaatcttaaacatcctg

SEQ ID NO: 8421 - DNA, 20 bp, Artificial Sequence
  Synthetic oligonucleotide; AAG chr11 5224716 5224735 5224732 +
taatcttaaacatcctgagg

SEQ ID NO: 8422 - DNA, 20 bp, Artificial Sequence
  Synthetic oligonucleotide; TGG chr11 5224721 5224740 5224737 +
ttaaacatcctgaggaagaa

SEQ ID NO: 8423 - DNA, 20 bp, Artificial Sequence
  Synthetic oligonucleotide; GGG chr11 5224722 5224741 5224738 +
taaacatcctgaggaagaat

SEQ ID NO: 8424 - DNA, 20 bp, Artificial Sequence
  Synthetic oligonucleotide; TGG chr11 5224734 5224753 5224750 +
ggaagaatgggacttccatt

SEQ ID NO: 8425 - DNA, 20 bp, Artificial Sequence
  Synthetic oligonucleotide; GGG chr11 5224735 5224754 5224751 +
gaagaatgggacttccattt

SEQ ID NO: 8426 - DNA, 20 bp, Artificial Sequence
  Synthetic oligonucleotide; GGG chr11 5224736 5224755 5224752 +
aagaatgggacttccatttg

SEQ ID NO: 8427 - DNA, 20 bp, Artificial Sequence
  Synthetic oligonucleotide; TGG chr11 5224739 5224758 5224755 +
aatgggacttccatttgggg

SEQ ID NO: 8428 - DNA, 20 bp, Artificial Sequence
  Synthetic oligonucleotide; GGG chr11 5224740 5224759 5224756 +
atgggacttccatttggggt

SEQ ID NO: 8429 - DNA, 20 bp, Artificial Sequence
  Synthetic oligonucleotide; CAG chr11 5224750 5224769 5224766 +
catttggggtgggcctatga

SEQ ID NO: 8430 - DNA, 20 bp, Artificial Sequence
  Synthetic oligonucleotide; AGG chr11 5224751 5224770 5224767 +
atttggggtgggcctatgac

SEQ ID NO: 8431 - DNA, 20 bp, Artificial Sequence
  Synthetic oligonucleotide; GGG chr11 5224752 5224771 5224768 +
tttggggtgggcctatgaca

SEQ ID NO: 8432 - DNA, 20 bp, Artificial Sequence
  Synthetic oligonucleotide; AAG chr11 5224759 5224778 5224775 +
tgggcctatgacagggtaat

SEQ ID NO: 8433 - DNA, 20 bp, Artificial Sequence
  Synthetic oligonucleotide; CAG chr11 5224763 5224782 5224779 +
cctatgacagggtaataaga

SEQ ID NO: 8434 - DNA, 20 bp, Artificial Sequence
  Synthetic oligonucleotide; TAG chr11 5224766 5224785 5224782 +
atgacagggtaataagacag

SEQ ID NO: 8435 - DNA, 20 bp, Artificial Sequence
  Synthetic oligonucleotide; AAG chr11 5224777 5224796 5224793 +
ataagacagtagtgaatatc

SEQ ID NO: 8436 - DNA, 20 bp, Artificial Sequence
  Synthetic oligonucleotide; AAG chr11 5224787 5224806 5224803 +
agtgaatatcaagctacaaa

SEQ ID NO: 8437 - DNA, 20 bp, Artificial Sequence
  Synthetic oligonucleotide; CAG chr11 5224809 5224828 5224825 +
gccgcctttcaaattcttct

SEQ ID NO: 8438 - DNA, 20 bp, Artificial Sequence
  Synthetic oligonucleotide; AAG chr11 5224829 5224848 5224845 +
cagtcctaacttttcatact

SEQ ID NO: 8439 - DNA, 20 bp, Artificial Sequence
  Synthetic oligonucleotide; CAG chr11 5224834 5224853 5224850 +
ctaacttttcatactaagcc

SEQ ID NO: 8440 - DNA, 20 bp, Artificial Sequence
  Synthetic oligonucleotide; AAG chr11 5224845 5224864 5224861 +
tactaagcccagtccttcca

SEQ ID NO: 8441 - DNA, 20 bp, Artificial Sequence
  Synthetic oligonucleotide; CAG chr11 5224848 5224867 5224864 +
taagcccagtccttccaaag

SEQ ID NO: 8442 - DNA, 20 bp, Artificial Sequence
  Synthetic oligonucleotide; AAG chr11 5224858 5224877 5224874 +
ccttccaaagcagactgtga

SEQ ID NO: 8443 - DNA, 20 bp, Artificial Sequence
  Synthetic oligonucleotide; GAG chr11 5224860 5224879 5224876 +
ttccaaagcagactgtgaaa

SEQ ID NO: 8444 - DNA, 20 bp, Artificial Sequence
  Synthetic oligonucleotide; TAG chr11 5224866 5224885 5224882 +
agcagactgtgaaagagtga

SEQ ID NO: 8445 - DNA, 20 bp, Artificial Sequence
  Synthetic oligonucleotide; CGG chr11 5224872 5224891 5224888 +
ctgtgaaagagtgatagttc

SEQ ID NO: 8446 - DNA, 20 bp, Artificial Sequence
  Synthetic oligonucleotide; GGG chr11 5224873 5224892 5224889 +
tgtgaaagagtgatagttcc

SEQ ID NO: 8447 - DNA, 20 bp, Artificial Sequence
  Synthetic oligonucleotide; GAG chr11 5224875 5224894 5224891 +
tgaaagagtgatagttccgg

SEQ ID NO: 8448 - DNA, 20 bp, Artificial Sequence
  Synthetic oligonucleotide; TAG chr11 5224880 5224899 5224896 +
gagtgatagttccgggagac

SEQ ID NO: 8449 - DNA, 20 bp, Artificial Sequence
  Synthetic oligonucleotide; CAG chr11 5224888 5224907 5224904 +
gttccgggagactagcactg

SEQ ID NO: 8450 - DNA, 20 bp, Artificial Sequence
  Synthetic oligonucleotide; CGG chr11 5224895 5224914 5224911 +
gagactagcactgcagattc

SEQ ID NO: 8451 - DNA, 20 bp, Artificial Sequence
  Synthetic oligonucleotide; GGG chr11 5224896 5224915 5224912 +
agactagcactgcagattcc

SEQ ID NO: 8452 - DNA, 20 bp, Artificial Sequence
  Synthetic oligonucleotide; GAG chr11 5224906 5224925 5224922 +
tgcagattccgggtcactgt

SEQ ID NO: 8453 - DNA, 20 bp, Artificial Sequence
  Synthetic oligonucleotide; TGG chr11 5224909 5224928 5224925 +
agattccgggtcactgtgag

SEQ ID NO: 8454 - DNA, 20 bp, Artificial Sequence
  Synthetic oligonucleotide; GGG chr11 5224910 5224929 5224926 +
gattccgggtcactgtgagt

SEQ ID NO: 8455 - DNA, 20 bp, Artificial Sequence
  Synthetic oligonucleotide; GGG chr11 5224911 5224930 5224927 +
attccgggtcactgtgagtg

SEQ ID NO: 8456 - DNA, 20 bp, Artificial Sequence
  Synthetic oligonucleotide; GGG chr11 5224912 5224931 5224928 +
ttccgggtcactgtgagtgg

SEQ ID NO: 8457 - DNA, 20 bp, Artificial Sequence
  Synthetic oligonucleotide; GAG chr11 5224914 5224933 5224930 +
ccgggtcactgtgagtgggg

SEQ ID NO: 8458 - DNA, 20 bp, Artificial Sequence
  Synthetic oligonucleotide; AGG chr11 5224915 5224934 5224931 +
cgggtcactgtgagtggggg

SEQ ID NO: 8459 - DNA, 20 bp, Artificial Sequence
  Synthetic oligonucleotide; CAG chr11 5224918 5224937 5224934 +
gtcactgtgagtgggggagg

SEQ ID NO: 8460 - DNA, 20 bp, Artificial Sequence
  Synthetic oligonucleotide; AGG chr11 5224919 5224938 5224935 +
tcactgtgagtgggggaggc

SEQ ID NO: 8461 - DNA, 20 bp, Artificial Sequence
  Synthetic oligonucleotide; GGG chr11 5224920 5224939 5224936 +
cactgtgagtgggggaggca

SEQ ID NO: 8462 - DNA, 20 bp, Artificial Sequence
  Synthetic oligonucleotide; AAG chr11 5224923 5224942 5224939 +
tgtgagtgggggaggcaggg

SEQ ID NO: 8463 - DNA, 20 bp, Artificial Sequence
  Synthetic oligonucleotide; AAG chr11 5224926 5224945 5224942 +
gagtgggggaggcagggaag

SEQ ID NO: 8464 - DNA, 20 bp, Artificial Sequence
  Synthetic oligonucleotide; AGG chr11 5224927 5224946 5224943 +
agtgggggaggcagggaaga

SEQ ID NO: 8465 - DNA, 20 bp, Artificial Sequence
  Synthetic oligonucleotide; GGG chr11 5224928 5224947 5224944 +
gtgggggaggcagggaagaa

SEQ ID NO: 8466 - DNA, 20 bp, Artificial Sequence
  Synthetic oligonucleotide; CAG chr11 5224935 5224954 5224951 +
aggcagggaagaagggctca

SEQ ID NO: 8467 - DNA, 20 bp, Artificial Sequence
  Synthetic oligonucleotide; AGG chr11 5224936 5224955 5224952 +
ggcagggaagaagggctcac

SEQ ID NO: 8468 - DNA, 20 bp, Artificial Sequence
  Synthetic oligonucleotide; CAG chr11 5224940 5224959 5224956 +
gggaagaagggctcacagga

SEQ ID NO: 8469 - DNA, 20 bp, Artificial Sequence
  Synthetic oligonucleotide; AAG chr11 5224973 5224992 5224989 +
acccctgtttttccttcttc

SEQ ID NO: 8470 - DNA, 20 bp, Artificial Sequence
  Synthetic oligonucleotide; TAG chr11 5224976 5224995 5224992 +
cctgtttttccttcttcaag

SEQ ID NO: 8471 - DNA, 20 bp, Artificial Sequence
  Synthetic oligonucleotide; AAG chr11 5224987 5225006 5225003 +
ttcttcaagtagacctctat

SEQ ID NO: 8472 - DNA, 20 bp, Artificial Sequence
  Synthetic oligonucleotide; CAG chr11 5224994 5225013 5225010 +
agtagacctctataagacaa

SEQ ID NO: 8473 - DNA, 20 bp, Artificial Sequence
  Synthetic oligonucleotide; GAG chr11 5224996 5225015 5225012 +
tagacctctataagacaaca

SEQ ID NO: 8474 - DNA, 20 bp, Artificial Sequence
  Synthetic oligonucleotide; AAG chr11 5225005 5225024 5225021 +
ataagacaacagagacaact

SEQ ID NO: 8475 - DNA, 20 bp, Artificial Sequence
  Synthetic oligonucleotide; AGG chr11 5225006 5225025 5225022 +
taagacaacagagacaacta

SEQ ID NO: 8476 - DNA, 20 bp, Artificial Sequence
  Synthetic oligonucleotide; GAG chr11 5225011 5225030 5225027 +
caacagagacaactaaggct

SEQ ID NO: 8477 - DNA, 20 bp, Artificial Sequence
  Synthetic oligonucleotide; TGG chr11 5225014 5225033 5225030 +
cagagacaactaaggctgag

SEQ ID NO: 8478 - DNA, 20 bp, Artificial Sequence
  Synthetic oligonucleotide; CAG chr11 5225018 5225037 5225034 +
gacaactaaggctgagtggc

SEQ ID NO: 8479 - DNA, 20 bp, Artificial Sequence
  Synthetic oligonucleotide; AGG chr11 5225019 5225038 5225035 +
acaactaaggctgagtggcc

SEQ ID NO: 8480 - DNA, 20 bp, Artificial Sequence
  Synthetic oligonucleotide; GAG chr11 5225023 5225042 5225039 +
ctaaggctgagtggccaggc

SEQ ID NO: 8481 - DNA, 20 bp, Artificial Sequence
  Synthetic oligonucleotide; AGG chr11 5225024 5225043 5225040 +
taaggctgagtggccaggcg

SEQ ID NO: 8482 - DNA, 20 bp, Artificial Sequence
  Synthetic oligonucleotide; GAG chr11 5225026 5225045 5225042 +
aggctgagtggccaggcgag

SEQ ID NO: 8483 - DNA, 20 bp, Artificial Sequence
  Synthetic oligonucleotide; TGG chr11 5225050 5225069 5225066 +
aaccatctcgccgtaaaaca

SEQ ID NO: 8484 - DNA, 20 bp, Artificial Sequence
  Synthetic oligonucleotide; AAG chr11 5225053 5225072 5225069 +
catctcgccgtaaaacatgg

SEQ ID NO: 8485 - DNA, 20 bp, Artificial Sequence
  Synthetic oligonucleotide; AGG chr11 5225054 5225073 5225070 +
atctcgccgtaaaacatgga

SEQ ID NO: 8486 - DNA, 20 bp, Artificial Sequence
  Synthetic oligonucleotide; CAG chr11 5225064 5225083 5225080 +
aaaacatggaaggaacactt

SEQ ID NO: 8487 - DNA, 20 bp, Artificial Sequence
  Synthetic oligonucleotide; AGG chr11 5225065 5225084 5225081 +
aaacatggaaggaacacttc

SEQ ID NO: 8488 - DNA, 20 bp, Artificial Sequence
  Synthetic oligonucleotide; GGG chr11 5225066 5225085 5225082 +
aacatggaaggaacacttca

SEQ ID NO: 8489 - DNA, 20 bp, Artificial Sequence
  Synthetic oligonucleotide; GGG chr11 5225067 5225086 5225083 +
acatggaaggaacacttcag

SEQ ID NO: 8490 - DNA, 20 bp, Artificial Sequence
  Synthetic oligonucleotide; AAG chr11 5225071 5225090 5225087 +
ggaaggaacacttcagggga

SEQ ID NO: 8491 - DNA, 20 bp, Artificial Sequence
  Synthetic oligonucleotide; AGG chr11 5225072 5225091 5225088 +
gaaggaacacttcaggggaa

SEQ ID NO: 8492 - DNA, 20 bp, Artificial Sequence
  Synthetic oligonucleotide; TGG chr11 5225075 5225094 5225091 +
ggaacacttcaggggaaagg

SEQ ID NO: 8493 - DNA, 20 bp, Artificial Sequence
  Synthetic oligonucleotide; AAG chr11 5225085 5225104 5225101 +
aggggaaaggtggtatctct

SEQ ID NO: 8494 - DNA, 20 bp, Artificial Sequence
  Synthetic oligonucleotide; AAG chr11 5225089 5225108 5225105 +
gaaaggtggtatctctaagc

SEQ ID NO: 8495 - DNA, 20 bp, Artificial Sequence
  Synthetic oligonucleotide; GAG chr11 5225091 5225110 5225107 +
aaggtggtatctctaagcaa

SEQ ID NO: 8496 - DNA, 20 bp, Artificial Sequence
  Synthetic oligonucleotide; GAG chr11 5225098 5225117 5225114 +
tatctctaagcaagagaact

SEQ ID NO: 8497 - DNA, 20 bp, Artificial Sequence
  Synthetic oligonucleotide; TGG chr11 5225101 5225120 5225117 +
ctctaagcaagagaactgag

SEQ ID NO: 8498 - DNA, 20 bp, Artificial Sequence
  Synthetic oligonucleotide; GAG chr11 5225103 5225122 5225119 +
ctaagcaagagaactgagtg

SEQ ID NO: 8499 - DNA, 20 bp, Artificial Sequence
  Synthetic oligonucleotide; AAG chr11 5225108 5225127 5225124 +
caagagaactgagtggagtc

SEQ ID NO: 8500 - DNA, 20 bp, Artificial Sequence
  Synthetic oligonucleotide; AGG chr11 5225109 5225128 5225125 +
aagagaactgagtggagtca

SEQ ID NO: 8501 - DNA, 20 bp, Artificial Sequence
  Synthetic oligonucleotide; GAG chr11 5225114 5225133 5225130 +
aactgagtggagtcaaggct

SEQ ID NO: 8502 - DNA, 20 bp, Artificial Sequence
  Synthetic oligonucleotide; GAG chr11 5225116 5225135 5225132 +
ctgagtggagtcaaggctga

SEQ ID NO: 8503 - DNA, 20 bp, Artificial Sequence
  Synthetic oligonucleotide; CAG chr11 5225122 5225141 5225138 +
ggagtcaaggctgagagatg

SEQ ID NO: 8504 - DNA, 20 bp, Artificial Sequence
  Synthetic oligonucleotide; AGG chr11 5225123 5225142 5225139 +
gagtcaaggctgagagatgc

SEQ ID NO: 8505 - DNA, 20 bp, Artificial Sequence
  Synthetic oligonucleotide; AAG chr11 5225128 5225147 5225144 +
aaggctgagagatgcaggat

SEQ ID NO: 8506 - DNA, 20 bp, Artificial Sequence
  Synthetic oligonucleotide; TGG chr11 5225135 5225154 5225151 +
agagatgcaggataagcaaa

SEQ ID NO: 8507 - DNA, 20 bp, Artificial Sequence
  Synthetic oligonucleotide; GGG chr11 5225136 5225155 5225152 +
gagatgcaggataagcaaat

SEQ ID NO: 8508 - DNA, 20 bp, Artificial Sequence
  Synthetic oligonucleotide; TAG chr11 5225139 5225158 5225155 +
atgcaggataagcaaatggg

SEQ ID NO: 8509 - DNA, 20 bp, Artificial Sequence
  Synthetic oligonucleotide; AAG chr11 5225146 5225165 5225162 +
ataagcaaatgggtagtgaa

SEQ ID NO: 8510 - DNA, 20 bp, Artificial Sequence
  Synthetic oligonucleotide; GAG chr11 5225157 5225176 5225173 +
ggtagtgaaaagacattcat

SEQ ID NO: 8511 - DNA, 20 bp, Artificial Sequence
  Synthetic oligonucleotide; AGG chr11 5225158 5225177 5225174 +
gtagtgaaaagacattcatg

SEQ ID NO: 8512 - DNA, 20 bp, Artificial Sequence
  Synthetic oligonucleotide; CAG chr11 5225162 5225181 5225178 +
tgaaaagacattcatgagga

SEQ ID NO: 8513 - DNA, 20 bp, Artificial Sequence
  Synthetic oligonucleotide; AAG chr11 5225175 5225194 5225191 +
atgaggacagctaaaacaat

SEQ ID NO: 8514 - DNA, 20 bp, Artificial Sequence
  Synthetic oligonucleotide; CAG chr11 5225190 5225209 5225206 +
acaataagtaatgtaaaata

SEQ ID NO: 8515 - DNA, 20 bp, Artificial Sequence
  Synthetic oligonucleotide; TAG chr11 5225195 5225214 5225211 +
aagtaatgtaaaatacagca

SEQ ID NO: 8516 - DNA, 20 bp, Artificial Sequence
  Synthetic oligonucleotide; AAG chr11 5225219 5225238 5225235 +
aaaactttaacctccaaatc

SEQ ID NO: 8517 - DNA, 20 bp, Artificial Sequence
  Synthetic oligonucleotide; GAG chr11 5225243 5225262 5225259 +
ctctacttgaatccttttct

SEQ ID NO: 8518 - DNA, 20 bp, Artificial Sequence
  Synthetic oligonucleotide; AGG chr11 5225244 5225263 5225260 +
tctacttgaatccttttctg

SEQ ID NO: 8519 - DNA, 20 bp, Artificial Sequence
  Synthetic oligonucleotide; GGG chr11 5225245 5225264 5225261 +
ctacttgaatccttttctga

SEQ ID NO: 8520 - DNA, 20 bp, Artificial Sequence
  Synthetic oligonucleotide; AAG chr11 5225254 5225273 5225270 +
tccttttctgagggatgaat

SEQ ID NO: 8521 - DNA, 20 bp, Artificial Sequence
  Synthetic oligonucleotide; AGG chr11 5225255 5225274 5225271 +
ccttttctgagggatgaata

SEQ ID NO: 8522 - DNA, 20 bp, Artificial Sequence
  Synthetic oligonucleotide; CAG chr11 5225267 5225286 5225283 +
gatgaataaggcatatgcat

SEQ ID NO: 8523 - DNA, 20 bp, Artificial Sequence
  Synthetic oligonucleotide; AGG chr11 5225268 5225287 5225284 +
atgaataaggcatatgcatc

SEQ ID NO: 8524 - DNA, 20 bp, Artificial Sequence
  Synthetic oligonucleotide; GGG chr11 5225269 5225288 5225285 +
tgaataaggcatatgcatca

SEQ ID NO: 8525 - DNA, 20 bp, Artificial Sequence
  Synthetic oligonucleotide; GGG chr11 5225270 5225289 5225286 +
gaataaggcatatgcatcag

SEQ ID NO: 8526 - DNA, 20 bp, Artificial Sequence
  Synthetic oligonucleotide; TAG chr11 5225290 5225309 5225306 +
gggctgttgccaatgtgcat

SEQ ID NO: 8527 - DNA, 20 bp, Artificial Sequence
  Synthetic oligonucleotide; CAG chr11 5225300 5225319 5225316 +
caatgtgcattagctgtttg

SEQ ID NO: 8528 - DNA, 20 bp, Artificial Sequence
  Synthetic oligonucleotide; TGG chr11 5225318 5225337 5225334 +
tgcagcctcaccttctttca

SEQ ID NO: 8529 - DNA, 20 bp, Artificial Sequence
  Synthetic oligonucleotide; GAG chr11 5225320 5225339 5225336 +
cagcctcaccttctttcatg

SEQ ID NO: 8530 - DNA, 20 bp, Artificial Sequence
  Synthetic oligonucleotide; AAG chr11 5225326 5225345 5225342 +
caccttctttcatggagttt

SEQ ID NO: 8531 - DNA, 20 bp, Artificial Sequence
  Synthetic oligonucleotide; TAG chr11 5225332 5225351 5225348 +
ctttcatggagtttaagata

SEQ ID NO: 8532 - DNA, 20 bp, Artificial Sequence
  Synthetic oligonucleotide; AAG chr11 5225346 5225365 5225362 +
aagatatagtgtattttccc

SEQ ID NO: 8533 - DNA, 20 bp, Artificial Sequence
  Synthetic oligonucleotide; AGG chr11 5225347 5225366 5225363 +
agatatagtgtattttccca

SEQ ID NO: 8534 - DNA, 20 bp, Artificial Sequence
  Synthetic oligonucleotide; TAG chr11 5225357 5225376 5225373 +
tattttcccaaggtttgaac

SEQ ID NO: 8535 - DNA, 20 bp, Artificial Sequence
  Synthetic oligonucleotide; TAG chr11 5225410 5225429 5225426 +
gacctcccacattccctttt

SEQ ID NO: 8536 - DNA, 20 bp, Artificial Sequence
  Synthetic oligonucleotide; CAG chr11 5225422 5225441 5225438 +
tccctttttagtaaaatatt

SEQ ID NO: 8537 - DNA, 20 bp, Artificial Sequence
  Synthetic oligonucleotide; TAG chr11 5225470 5225489 5225486 +
tgaaaataaatgttttttat

SEQ ID NO: 8538 - DNA, 20 bp, Artificial Sequence
  Synthetic oligonucleotide; AGG chr11 5225471 5225490 5225487 +
gaaaataaatgttttttatt

SEQ ID NO: 8539 - DNA, 20 bp, Artificial Sequence
  Synthetic oligonucleotide; CAG chr11 5225474 5225493 5225490 +
aataaatgttttttattagg

SEQ ID NO: 8540 - DNA, 20 bp, Artificial Sequence
  Synthetic oligonucleotide; CAG chr11 5225481 5225500 5225497 +
gttttttattaggcagaatc

SEQ ID NO: 8541 - DNA, 20 bp, Artificial Sequence
  Synthetic oligonucleotide; AAG chr11 5225490 5225509 5225506 +
taggcagaatccagatgctc

SEQ ID NO: 8542 - DNA, 20 bp, Artificial Sequence
  Synthetic oligonucleotide; AGG chr11 5225491 5225510 5225507 +
aggcagaatccagatgctca

SEQ ID NO: 8543 - DNA, 20 bp, Artificial Sequence
  Synthetic oligonucleotide; CAG chr11 5225511 5225530 5225527 +
aggcccttcataatatcccc

SEQ ID NO: 8544 - DNA, 20 bp, Artificial Sequence
  Synthetic oligonucleotide; TAG chr11 5225516 5225535 5225532 +
cttcataatatcccccagtt

SEQ ID NO: 8545 - DNA, 20 bp, Artificial Sequence
  Synthetic oligonucleotide; TAG chr11 5225519 5225538 5225535 +
cataatatcccccagtttag

SEQ ID NO: 8546 - DNA, 20 bp, Artificial Sequence
  Synthetic oligonucleotide; TGG chr11 5225523 5225542 5225539 +
atatcccccagtttagtagt

SEQ ID NO: 8547 - DNA, 20 bp, Artificial Sequence
  Synthetic oligonucleotide; TAG chr11 5225529 5225548 5225545 +
cccagtttagtagttggact

SEQ ID NO: 8548 - DNA, 20 bp, Artificial Sequence
  Synthetic oligonucleotide; AGG chr11 5225530 5225549 5225546 +
ccagtttagtagttggactt

SEQ ID NO: 8549 - DNA, 20 bp, Artificial Sequence
  Synthetic oligonucleotide; GGG chr11 5225531 5225550 5225547 +
cagtttagtagttggactta

SEQ ID NO: 8550 - DNA, 20 bp, Artificial Sequence
  Synthetic oligonucleotide; AAG chr11 5225538 5225557 5225554 +
gtagttggacttagggaaca

SEQ ID NO: 8551 - DNA, 20 bp, Artificial Sequence
  Synthetic oligonucleotide; AGG chr11 5225539 5225558 5225555 +
tagttggacttagggaacaa

SEQ ID NO: 8552 - DNA, 20 bp, Artificial Sequence
  Synthetic oligonucleotide; TAG chr11 5225551 5225570 5225567 +
gggaacaaaggaacctttaa

SEQ ID NO: 8553 - DNA, 20 bp, Artificial Sequence
  Synthetic oligonucleotide; TGG chr11 5225558 5225577 5225574 +
aaggaacctttaatagaaat

SEQ ID NO: 8554 - DNA, 20 bp, Artificial Sequence
  Synthetic oligonucleotide; CAG chr11 5225562 5225581 5225578 +
aacctttaatagaaattgga

SEQ ID NO: 8555 - DNA, 20 bp, Artificial Sequence
  Synthetic oligonucleotide; AAG chr11 5225566 5225585 5225582 +
tttaatagaaattggacagc

SEQ ID NO: 8556 - DNA, 20 bp, Artificial Sequence
  Synthetic oligonucleotide; AAG chr11 5225570 5225589 5225586 +
atagaaattggacagcaaga

SEQ ID NO: 8557 - DNA, 20 bp, Artificial Sequence
  Synthetic oligonucleotide; GAG chr11 5225574 5225593 5225590 +
aaattggacagcaagaaagc

SEQ ID NO: 8558 - DNA, 20 bp, Artificial Sequence
  Synthetic oligonucleotide; TAG chr11 5225579 5225598 5225595 +
ggacagcaagaaagcgagct

SEQ ID NO: 8559 - DNA, 20 bp, Artificial Sequence
  Synthetic oligonucleotide; TGG chr11 5225591 5225610 5225607 +
agcgagcttagtgatacttg

SEQ ID NO: 8560 - DNA, 20 bp, Artificial Sequence
  Synthetic oligonucleotide; GGG chr11 5225592 5225611 5225608 +
gcgagcttagtgatacttgt

SEQ ID NO: 8561 - DNA, 20 bp, Artificial Sequence
  Synthetic oligonucleotide; CAG chr11 5225596 5225615 5225612 +
gcttagtgatacttgtgggc

SEQ ID NO: 8562 - DNA, 20 bp, Artificial Sequence
  Synthetic oligonucleotide; AGG chr11 5225597 5225616 5225613 +
cttagtgatacttgtgggcc

SEQ ID NO: 8563 - DNA, 20 bp, Artificial Sequence
  Synthetic oligonucleotide; GGG chr11 5225598 5225617 5225614 +
ttagtgatacttgtgggcca

SEQ ID NO: 8564 - DNA, 20 bp, Artificial Sequence
  Synthetic oligonucleotide; TAG chr11 5225604 5225623 5225620 +
atacttgtgggccagggcat

SEQ ID NO: 8565 - DNA, 20 bp, Artificial Sequence
  Synthetic oligonucleotide; CAG chr11 5225613 5225632 5225629 +
ggccagggcattagccacac

SEQ ID NO: 8566 - DNA, 20 bp, Artificial Sequence
  Synthetic oligonucleotide; TAG chr11 5225630 5225649 5225646 +
caccagccaccactttctga

SEQ ID NO: 8567 - DNA, 20 bp, Artificial Sequence
  Synthetic oligonucleotide; AGG chr11 5225631 5225650 5225647 +
accagccaccactttctgat

SEQ ID NO: 8568 - DNA, 20 bp, Artificial Sequence
  Synthetic oligonucleotide; CAG chr11 5225634 5225653 5225650 +
agccaccactttctgatagg

SEQ ID NO: 8569 - DNA, 20 bp, Artificial Sequence
  Synthetic oligonucleotide; TGG chr11 5225644 5225663 5225660 +
ttctgataggcagcctgcac

SEQ ID NO: 8570 - DNA, 20 bp, Artificial Sequence
  Synthetic oligonucleotide; TGG chr11 5225647 5225666 5225663 +
tgataggcagcctgcactgg

SEQ ID NO: 8571 - DNA, 20 bp, Artificial Sequence
  Synthetic oligonucleotide; GGG chr11 5225648 5225667 5225664 +
gataggcagcctgcactggt

SEQ ID NO: 8572 - DNA, 20 bp, Artificial Sequence
  Synthetic oligonucleotide; GGG chr11 5225649 5225668 5225665 +
ataggcagcctgcactggtg

SEQ ID NO: 8573 - DNA, 20 bp, Artificial Sequence
  Synthetic oligonucleotide; AAG chr11 5225666 5225685 5225682 +
gtggggtgaattctttgcca

SEQ ID NO: 8574 - DNA, 20 bp, Artificial Sequence
  Synthetic oligonucleotide; TGG chr11 5225672 5225691 5225688 +
tgaattctttgccaaagtga

SEQ ID NO: 8575 - DNA, 20 bp, Artificial Sequence
  Synthetic oligonucleotide; GGG chr11 5225673 5225692 5225689 +
gaattctttgccaaagtgat

SEQ ID NO: 8576 - DNA, 20 bp, Artificial Sequence
  Synthetic oligonucleotide; CAG chr11 5225677 5225696 5225693 +
tctttgccaaagtgatgggc

SEQ ID NO: 8577 - DNA, 20 bp, Artificial Sequence
  Synthetic oligonucleotide; CAG chr11 5225684 5225703 5225700 +
caaagtgatgggccagcaca

SEQ ID NO: 8578 - DNA, 20 bp, Artificial Sequence
  Synthetic oligonucleotide; CAG chr11 5225689 5225708 5225705 +
tgatgggccagcacacagac

SEQ ID NO: 8579 - DNA, 20 bp, Artificial Sequence
  Synthetic oligonucleotide; CAG chr11 5225701 5225720 5225717 +
acacagaccagcacgttgcc

SEQ ID NO: 8580 - DNA, 20 bp, Artificial Sequence
  Synthetic oligonucleotide; AGG chr11 5225702 5225721 5225718 +
cacagaccagcacgttgccc

SEQ ID NO: 8581 - DNA, 20 bp, Artificial Sequence
  Synthetic oligonucleotide; GAG chr11 5225704 5225723 5225720 +
cagaccagcacgttgcccag

SEQ ID NO: 8582 - DNA, 20 bp, Artificial Sequence
  Synthetic oligonucleotide; TGG chr11 5225710 5225729 5225726 +
agcacgttgcccaggagctg

SEQ ID NO: 8583 - DNA, 20 bp, Artificial Sequence
  Synthetic oligonucleotide; GGG chr11 5225711 5225730 5225727 +
gcacgttgcccaggagctgt

SEQ ID NO: 8584 - DNA, 20 bp, Artificial Sequence
  Synthetic oligonucleotide; GAG chr11 5225713 5225732 5225729 +
acgttgcccaggagctgtgg

SEQ ID NO: 8585 - DNA, 20 bp, Artificial Sequence
  Synthetic oligonucleotide; AGG chr11 5225714 5225733 5225730 +
cgttgcccaggagctgtggg

SEQ ID NO: 8586 - DNA, 20 bp, Artificial Sequence
  Synthetic oligonucleotide; AAG chr11 5225717 5225736 5225733 +
tgcccaggagctgtgggagg

SEQ ID NO: 8587 - DNA, 20 bp, Artificial Sequence
  Synthetic oligonucleotide; AAG chr11 5225722 5225741 5225738 +
aggagctgtgggaggaagat

SEQ ID NO: 8588 - DNA, 20 bp, Artificial Sequence
  Synthetic oligonucleotide; GAG chr11 5225724 5225743 5225740 +
gagctgtgggaggaagataa

SEQ ID NO: 8589 - DNA, 20 bp, Artificial Sequence
  Synthetic oligonucleotide; AGG chr11 5225725 5225744 5225741 +
agctgtgggaggaagataag

SEQ ID NO: 8590 - DNA, 20 bp, Artificial Sequence
  Synthetic oligonucleotide; TAG chr11 5225740 5225759 5225756 +
ataagaggtatgaacatgat

SEQ ID NO: 8591 - DNA, 20 bp, Artificial Sequence
  Synthetic oligonucleotide; AAG chr11 5225746 5225765 5225762 +
ggtatgaacatgattagcaa

SEQ ID NO: 8592 - DNA, 20 bp, Artificial Sequence
  Synthetic oligonucleotide; AGG chr11 5225747 5225766 5225763 +
gtatgaacatgattagcaaa

SEQ ID NO: 8593 - DNA, 20 bp, Artificial Sequence
  Synthetic oligonucleotide; GGG chr11 5225748 5225767 5225764 +
tatgaacatgattagcaaaa

SEQ ID NO: 8594 - DNA, 20 bp, Artificial Sequence
  Synthetic oligonucleotide; TAG chr11 5225753 5225772 5225769 +
acatgattagcaaaagggcc

SEQ ID NO: 8595 - DNA, 20 bp, Artificial Sequence
  Synthetic oligonucleotide; TGG chr11 5225758 5225777 5225774 +
attagcaaaagggcctagct

SEQ ID NO: 8596 - DNA, 20 bp, Artificial Sequence
  Synthetic oligonucleotide; CAG chr11 5225764 5225783 5225780 +
aaaagggcctagcttggact

SEQ ID NO: 8597 - DNA, 20 bp, Artificial Sequence
  Synthetic oligonucleotide; CAG chr11 5225774 5225793 5225790 +
agcttggactcagaataatc

SEQ ID NO: 8598 - DNA, 20 bp, Artificial Sequence
  Synthetic oligonucleotide; AAG chr11 5225799 5225818 5225815 +
ttatcccaaccataaaataa

SEQ ID NO: 8599 - DNA, 20 bp, Artificial Sequence
  Synthetic oligonucleotide; CAG chr11 5225802 5225821 5225818 +
tcccaaccataaaataaaag

SEQ ID NO: 8600 - DNA, 20 bp, Artificial Sequence
  Synthetic oligonucleotide; TGG chr11 5225807 5225826 5225823 +
accataaaataaaagcagaa

SEQ ID NO: 8601 - DNA, 20 bp, Artificial Sequence
  Synthetic oligonucleotide; TAG chr11 5225810 5225829 5225826 +
ataaaataaaagcagaatgg

SEQ ID NO: 8602 - DNA, 20 bp, Artificial Sequence
  Synthetic oligonucleotide; TGG chr11 5225814 5225833 5225830 +
aataaaagcagaatggtagc

SEQ ID NO: 8603 - DNA, 20 bp, Artificial Sequence
  Synthetic oligonucleotide; TAG chr11 5225821 5225840 5225837 +
gcagaatggtagctggattg

SEQ ID NO: 8604 - DNA, 20 bp, Artificial Sequence
  Synthetic oligonucleotide; TAG chr11 5225831 5225850 5225847 +
agctggattgtagctgctat

SEQ ID NO: 8605 - DNA, 20 bp, Artificial Sequence
  Synthetic oligonucleotide; CAG chr11 5225854 5225873 5225870 +
caatatgaaacctcttacat

SEQ ID NO: 8606 - DNA, 20 bp, Artificial Sequence
  Synthetic oligonucleotide; CAG chr11 5225871 5225890 5225887 +
catcagttacaatttatatg

SEQ ID NO: 8607 - DNA, 20 bp, Artificial Sequence
  Synthetic oligonucleotide; CAG chr11 5225887 5225906 5225903 +
tatgcagaaatatttatatg

SEQ ID NO: 8608 - DNA, 20 bp, Artificial Sequence
  Synthetic oligonucleotide; GAG chr11 5225889 5225908 5225905 +
tgcagaaatatttatatgca

SEQ ID NO: 8609 - DNA, 20 bp, Artificial Sequence
  Synthetic oligonucleotide; CAG chr11 5225912 5225931 5225928 +
atattgctattgccttaacc

SEQ ID NO: 8610 - DNA, 20 bp, Artificial Sequence
  Synthetic oligonucleotide; TAG chr11 5225935 5225954 5225951 +
aaattatcactgttattctt

SEQ ID NO: 8611 - DNA, 20 bp, Artificial Sequence
  Synthetic oligonucleotide; TGG chr11 5225940 5225959 5225956 +
atcactgttattctttagaa

SEQ ID NO: 8612 - DNA, 20 bp, Artificial Sequence
  Synthetic oligonucleotide; AAG chr11 5225947 5225966 5225963 +
ttattctttagaatggtgca

SEQ ID NO: 8613 - DNA, 20 bp, Artificial Sequence
  Synthetic oligonucleotide; GAG chr11 5225949 5225968 5225965 +
attctttagaatggtgcaaa

SEQ ID NO: 8614 - DNA, 20 bp, Artificial Sequence
  Synthetic oligonucleotide; AGG chr11 5225950 5225969 5225966 +
ttctttagaatggtgcaaag

SEQ ID NO: 8615 - DNA, 20 bp, Artificial Sequence
  Synthetic oligonucleotide; AAG chr11 5225982 5226001 5225998 +
ttgtatcattattgccctga

SEQ ID NO: 8616 - DNA, 20 bp, Artificial Sequence
  Synthetic oligonucleotide; AAG chr11 5225986 5226005 5226002 +
atcattattgccctgaaaga

SEQ ID NO: 8617 - DNA, 20 bp, Artificial Sequence
  Synthetic oligonucleotide; GAG chr11 5225988 5226007 5226004 +
cattattgccctgaaagaaa

SEQ ID NO: 8618 - DNA, 20 bp, Artificial Sequence
  Synthetic oligonucleotide; TAG chr11 5225993 5226012 5226009 +
ttgccctgaaagaaagagat

SEQ ID NO: 8619 - DNA, 20 bp, Artificial Sequence
  Synthetic oligonucleotide; AGG chr11 5225994 5226013 5226010 +
tgccctgaaagaaagagatt

SEQ ID NO: 8620 - DNA, 20 bp, Artificial Sequence
  Synthetic oligonucleotide; GGG chr11 5225995 5226014 5226011 +
gccctgaaagaaagagatta

SEQ ID NO: 8621 - DNA, 20 bp, Artificial Sequence
  Synthetic oligonucleotide; AAG chr11 5225999 5226018 5226015 +
tgaaagaaagagattaggga

SEQ ID NO: 8622 - DNA, 20 bp, Artificial Sequence
  Synthetic oligonucleotide; TAG chr11 5226005 5226024 5226021 +
aaagagattagggaaagtat

SEQ ID NO: 8623 - DNA, 20 bp, Artificial Sequence
  Synthetic oligonucleotide; AAG chr11 5226012 5226031 5226028 +
ttagggaaagtattagaaat

SEQ ID NO: 8624 - DNA, 20 bp, Artificial Sequence
  Synthetic oligonucleotide; AAG chr11 5226025 5226044 5226041 +
tagaaataagataaacaaaa

SEQ ID NO: 8625 - DNA, 20 bp, Artificial Sequence
  Synthetic oligonucleotide; AAG chr11 5226036 5226055 5226052 +
taaacaaaaaagtatattaa

SEQ ID NO: 8626 - DNA, 20 bp, Artificial Sequence
  Synthetic oligonucleotide; AAG chr11 5226039 5226058 5226055 +
acaaaaaagtatattaaaag

SEQ ID NO: 8627 - DNA, 20 bp, Artificial Sequence
  Synthetic oligonucleotide; AAG chr11 5226043 5226062 5226059 +
aaaagtatattaaaagaaga

SEQ ID NO: 8628 - DNA, 20 bp, Artificial Sequence
  Synthetic oligonucleotide; TGG chr11 5226083 5226102 5226099 +
aatgcaaaattaccctgatt

SEQ ID NO: 8629 - DNA, 20 bp, Artificial Sequence
  Synthetic oligonucleotide; AAG chr11 5226164 5226183 5226180 +
tatgtatcaattaaaaataa

SEQ ID NO: 8630 - DNA, 20 bp, Artificial Sequence
  Synthetic oligonucleotide; AAG chr11 5226173 5226192 5226189 +
attaaaaataaaagaaaata

SEQ ID NO: 8631 - DNA, 20 bp, Artificial Sequence
  Synthetic oligonucleotide; TAG chr11 5226176 5226195 5226192 +
aaaaataaaagaaaataaag

SEQ ID NO: 8632 - DNA, 20 bp, Artificial Sequence
  Synthetic oligonucleotide; AGG chr11 5226177 5226196 5226193 +
aaaataaaagaaaataaagt

SEQ ID NO: 8633 - DNA, 20 bp, Artificial Sequence
  Synthetic oligonucleotide; GGG chr11 5226178 5226197 5226194 +
aaataaaagaaaataaagta

SEQ ID NO: 8634 - DNA, 20 bp, Artificial Sequence
  Synthetic oligonucleotide; GAG chr11 5226180 5226199 5226196 +
ataaaagaaaataaagtagg

SEQ ID NO: 8635 - DNA, 20 bp, Artificial Sequence
  Synthetic oligonucleotide; AAG chr11 5226200 5226219 5226216 +
gagattatgaatatgcaaat

SEQ ID NO: 8636 - DNA, 20 bp, Artificial Sequence
  Synthetic oligonucleotide; TAG chr11 5226220 5226239 5226236 +
aagcacacatatattccaaa

SEQ ID NO: 8637 - DNA, 20 bp, Artificial Sequence
  Synthetic oligonucleotide; TAG chr11 5226231 5226250 5226247 +
tattccaaatagtaatgtac

SEQ ID NO: 8638 - DNA, 20 bp, Artificial Sequence
  Synthetic oligonucleotide; AGG chr11 5226232 5226251 5226248 +
attccaaatagtaatgtact

SEQ ID NO: 8639 - DNA, 20 bp, Artificial Sequence
  Synthetic oligonucleotide; CAG chr11 5226235 5226254 5226251 +
ccaaatagtaatgtactagg

SEQ ID NO: 8640 - DNA, 20 bp, Artificial Sequence
  Synthetic oligonucleotide; AAG chr11 5226246 5226265 5226262 +
tgtactaggcagactgtgta

SEQ ID NO: 8641 - DNA, 20 bp, Artificial Sequence
  Synthetic oligonucleotide; AAG chr11 5226258 5226277 5226274 +
actgtgtaaagttttttttt

SEQ ID NO: 8642 - DNA, 20 bp, Artificial Sequence
  Synthetic oligonucleotide; CAG chr11 5226276 5226295 5226292 +
ttaagttacttaatgtatct

SEQ ID NO: 8643 - DNA, 20 bp, Artificial Sequence
  Synthetic oligonucleotide; GAG chr11 5226278 5226297 5226294 +
aagttacttaatgtatctca

SEQ ID NO: 8644 - DNA, 20 bp, Artificial Sequence
  Synthetic oligonucleotide; AAG chr11 5226308 5226327 5226324 +
cttttgttatacacaatgtt

SEQ ID NO: 8645 - DNA, 20 bp, Artificial Sequence
  Synthetic oligonucleotide; AGG chr11 5226309 5226328 5226325 +
ttttgttatacacaatgtta

SEQ ID NO: 8646 - DNA, 20 bp, Artificial Sequence
  Synthetic oligonucleotide; AAG chr11 5226316 5226335 5226332 +
atacacaatgttaaggcatt

SEQ ID NO: 8647 - DNA, 20 bp, Artificial Sequence
  Synthetic oligonucleotide; TAG chr11 5226324 5226343 5226340 +
tgttaaggcattaagtataa

SEQ ID NO: 8648 - DNA, 20 bp, Artificial Sequence
  Synthetic oligonucleotide; CGG chr11 5226336 5226355 5226352 +
aagtataatagtaaaaattg

SEQ ID NO: 8649 - DNA, 20 bp, Artificial Sequence
  Synthetic oligonucleotide; GAG chr11 5226338 5226357 5226354 +
gtataatagtaaaaattgcg

SEQ ID NO: 8650 - DNA, 20 bp, Artificial Sequence
  Synthetic oligonucleotide; AAG chr11 5226341 5226360 5226357 +
taatagtaaaaattgcggag

SEQ ID NO: 8651 - DNA, 20 bp, Artificial Sequence
  Synthetic oligonucleotide; AAG chr11 5226351 5226370 5226367 +
aattgcggagaagaaaaaaa

SEQ ID NO: 8652 - DNA, 20 bp, Artificial Sequence
  Synthetic oligonucleotide; AAG chr11 5226355 5226374 5226371 +
gcggagaagaaaaaaaaaga

SEQ ID NO: 8653 - DNA, 20 bp, Artificial Sequence
  Synthetic oligonucleotide; AAG chr11 5226359 5226378 5226375 +
agaagaaaaaaaaagaaagc

SEQ ID NO: 8654 - DNA, 20 bp, Artificial Sequence
  Synthetic oligonucleotide; AAG chr11 5226372 5226391 5226388 +
agaaagcaagaattaaacaa

SEQ ID NO: 8655 - DNA, 20 bp, Artificial Sequence
  Synthetic oligonucleotide; CAG chr11 5226392 5226411 5226408 +
aagaaaacaattgttatgaa

SEQ ID NO: 8656 - DNA, 20 bp, Artificial Sequence
  Synthetic oligonucleotide; AAG chr11 5226402 5226421 5226418 +
ttgttatgaacagcaaataa

SEQ ID NO: 8657 - DNA, 20 bp, Artificial Sequence
  Synthetic oligonucleotide; GAG chr11 5226421 5226440 5226437 +
aaagaaactaaaacgatcct

SEQ ID NO: 8658 - DNA, 20 bp, Artificial Sequence
  Synthetic oligonucleotide; TAG chr11 5226512 5226531 5226528 +
ctatgacatgaacttaacca

SEQ ID NO: 8659 - DNA, 20 bp, Artificial Sequence
  Synthetic oligonucleotide; AAG chr11 5226517 5226536 5226533 +
acatgaacttaaccatagaa

SEQ ID NO: 8660 - DNA, 20 bp, Artificial Sequence
  Synthetic oligonucleotide; AAG chr11 5226520 5226539 5226536 +
tgaacttaaccatagaaaag

SEQ ID NO: 8661 - DNA, 20 bp, Artificial Sequence
  Synthetic oligonucleotide; AGG chr11 5226521 5226540 5226537 +
gaacttaaccatagaaaaga

SEQ ID NO: 8662 - DNA, 20 bp, Artificial Sequence
  Synthetic oligonucleotide; GGG chr11 5226522 5226541 5226538 +
aacttaaccatagaaaagaa

SEQ ID NO: 8663 - DNA, 20 bp, Artificial Sequence
  Synthetic oligonucleotide; GGG chr11 5226523 5226542 5226539 +
acttaaccatagaaaagaag

SEQ ID NO: 8664 - DNA, 20 bp, Artificial Sequence
  Synthetic oligonucleotide; AAG chr11 5226527 5226546 5226543 +
aaccatagaaaagaagggga

SEQ ID NO: 8665 - DNA, 20 bp, Artificial Sequence
  Synthetic oligonucleotide; AAG chr11 5226538 5226557 5226554 +
agaaggggaaagaaaacatc

SEQ ID NO: 8666 - DNA, 20 bp, Artificial Sequence
  Synthetic oligonucleotide; TAG chr11 5226548 5226567 5226564 +
agaaaacatcaagcgtccca

SEQ ID NO: 8667 - DNA, 20 bp, Artificial Sequence
  Synthetic oligonucleotide; AAG chr11 5226561 5226580 5226577 +
cgtcccatagactcaccctg

SEQ ID NO: 8668 - DNA, 20 bp, Artificial Sequence
  Synthetic oligonucleotide; CAG chr11 5226568 5226587 5226584 +
tagactcaccctgaagttct

SEQ ID NO: 8669 - DNA, 20 bp, Artificial Sequence
  Synthetic oligonucleotide; AGG chr11 5226569 5226588 5226585 +
agactcaccctgaagttctc

SEQ ID NO: 8670 - DNA, 20 bp, Artificial Sequence
  Synthetic oligonucleotide; CAG chr11 5226581 5226600 5226597 +
aagttctcaggatccacgtg

SEQ ID NO: 8671 - DNA, 20 bp, Artificial Sequence
  Synthetic oligonucleotide; CAG chr11 5226591 5226610 5226607 +
gatccacgtgcagcttgtca

SEQ ID NO: 8672 - DNA, 20 bp, Artificial Sequence
  Synthetic oligonucleotide; CAG chr11 5226596 5226615 5226612 +
acgtgcagcttgtcacagtg

SEQ ID NO: 8673 - DNA, 20 bp, Artificial Sequence
  Synthetic oligonucleotide; CAG chr11 5226605 5226624 5226621 +
ttgtcacagtgcagctcact

SEQ ID NO: 8674 - DNA, 20 bp, Artificial Sequence
  Synthetic oligonucleotide; TGG chr11 5226610 5226629 5226626 +
acagtgcagctcactcagtg

SEQ ID NO: 8675 - DNA, 20 bp, Artificial Sequence
  Synthetic oligonucleotide; AAG chr11 5226615 5226634 5226631 +
gcagctcactcagtgtggca

SEQ ID NO: 8676 - DNA, 20 bp, Artificial Sequence
  Synthetic oligonucleotide; AGG chr11 5226616 5226635 5226632 +
cagctcactcagtgtggcaa

SEQ ID NO: 8677 - DNA, 20 bp, Artificial Sequence
  Synthetic oligonucleotide; GAG chr11 5226626 5226645 5226642 +
agtgtggcaaaggtgccctt

SEQ ID NO: 8678 - DNA, 20 bp, Artificial Sequence
  Synthetic oligonucleotide; AGG chr11 5226627 5226646 5226643 +
gtgtggcaaaggtgcccttg

SEQ ID NO: 8679 - DNA, 20 bp, Artificial Sequence
  Synthetic oligonucleotide; CAG chr11 5226635 5226654 5226651 +
aaggtgcccttgaggttgtc

SEQ ID NO: 8680 - DNA, 20 bp, Artificial Sequence
  Synthetic oligonucleotide; AGG chr11 5226636 5226655 5226652 +
aggtgcccttgaggttgtcc

SEQ ID NO: 8681 - DNA, 20 bp, Artificial Sequence
  Synthetic oligonucleotide; GAG chr11 5226640 5226659 5226656 +
gcccttgaggttgtccaggt

SEQ ID NO: 8682 - DNA, 20 bp, Artificial Sequence
  Synthetic oligonucleotide; CAG chr11 5226644 5226663 5226660 +
ttgaggttgtccaggtgagc

SEQ ID NO: 8683 - DNA, 20 bp, Artificial Sequence
  Synthetic oligonucleotide; AGG chr11 5226645 5226664 5226661 +
tgaggttgtccaggtgagcc

SEQ ID NO: 8684 - DNA, 20 bp, Artificial Sequence
  Synthetic oligonucleotide; AAG chr11 5226657 5226676 5226673 +
ggtgagccaggccatcacta

SEQ ID NO: 8685 - DNA, 20 bp, Artificial Sequence
  Synthetic oligonucleotide; AGG chr11 5226658 5226677 5226674 +
gtgagccaggccatcactaa

SEQ ID NO: 8686 - DNA, 20 bp, Artificial Sequence
  Synthetic oligonucleotide; GAG chr11 5226665 5226684 5226681 +
aggccatcactaaaggcacc

SEQ ID NO: 8687 - DNA, 20 bp, Artificial Sequence
  Synthetic oligonucleotide; GAG chr11 5226682 5226701 5226698 +
accgagcactttcttgccat

SEQ ID NO: 8688 - DNA, 20 bp, Artificial Sequence
  Synthetic oligonucleotide; TAG chr11 5226694 5226713 5226710 +
cttgccatgagccttcacct

SEQ ID NO: 8689 - DNA, 20 bp, Artificial Sequence
  Synthetic oligonucleotide; AGG chr11 5226695 5226714 5226711 +
ttgccatgagccttcacctt

SEQ ID NO: 8690 - DNA, 20 bp, Artificial Sequence
  Synthetic oligonucleotide; GGG chr11 5226696 5226715 5226712 +
tgccatgagccttcacctta

SEQ ID NO: 8691 - DNA, 20 bp, Artificial Sequence
  Synthetic oligonucleotide; CAG chr11 5226709 5226728 5226725 +
caccttagggttgcccataa

SEQ ID NO: 8692 - DNA, 20 bp, Artificial Sequence
  Synthetic oligonucleotide; CAG chr11 5226715 5226734 5226731 +
agggttgcccataacagcat

SEQ ID NO: 8693 - DNA, 20 bp, Artificial Sequence
  Synthetic oligonucleotide; AGG chr11 5226716 5226735 5226732 +
gggttgcccataacagcatc

SEQ ID NO: 8694 - DNA, 20 bp, Artificial Sequence
  Synthetic oligonucleotide; GAG chr11 5226718 5226737 5226734 +
gttgcccataacagcatcag

SEQ ID NO: 8695 - DNA, 20 bp, Artificial Sequence
  Synthetic oligonucleotide; TGG chr11 5226721 5226740 5226737 +
gcccataacagcatcaggag

SEQ ID NO: 8696 - DNA, 20 bp, Artificial Sequence
  Synthetic oligonucleotide; CAG chr11 5226725 5226744 5226741 +
ataacagcatcaggagtgga

SEQ ID NO: 8697 - DNA, 20 bp, Artificial Sequence
  Synthetic oligonucleotide; AAG chr11 5226735 5226754 5226751 +
caggagtggacagatcccca

SEQ ID NO: 8698 - DNA, 20 bp, Artificial Sequence
  Synthetic oligonucleotide; AGG chr11 5226736 5226755 5226752 +
aggagtggacagatccccaa

SEQ ID NO: 8699 - DNA, 20 bp, Artificial Sequence
  Synthetic oligonucleotide; AAG chr11 5226744 5226763 5226760 +
acagatccccaaaggactca

SEQ ID NO: 8700 - DNA, 20 bp, Artificial Sequence
  Synthetic oligonucleotide; TGG chr11 5226753 5226772 5226769 +
caaaggactcaaagaacctc

SEQ ID NO: 8701 - DNA, 20 bp, Artificial Sequence
  Synthetic oligonucleotide; GGG chr11 5226754 5226773 5226770 +
aaaggactcaaagaacctct

SEQ ID NO: 8702 - DNA, 20 bp, Artificial Sequence
  Synthetic oligonucleotide; AAG chr11 5226760 5226779 5226776 +
ctcaaagaacctctgggtcc

SEQ ID NO: 8703 - DNA, 20 bp, Artificial Sequence
  Synthetic oligonucleotide; AGG chr11 5226761 5226780 5226777 +
tcaaagaacctctgggtcca

SEQ ID NO: 8704 - DNA, 20 bp, Artificial Sequence
  Synthetic oligonucleotide; GGG chr11 5226762 5226781 5226778 +
caaagaacctctgggtccaa

SEQ ID NO: 8705 - DNA, 20 bp, Artificial Sequence
  Synthetic oligonucleotide; TAG chr11 5226765 5226784 5226781 +
agaacctctgggtccaaggg

SEQ ID NO: 8706 - DNA, 20 bp, Artificial Sequence
  Synthetic oligonucleotide; CAG chr11 5226773 5226792 5226789 +
tgggtccaagggtagaccac

SEQ ID NO: 8707 - DNA, 20 bp, Artificial Sequence
  Synthetic oligonucleotide; CAG chr11 5226776 5226795 5226792 +
gtccaagggtagaccaccag

SEQ ID NO: 8708 - DNA, 20 bp, Artificial Sequence
  Synthetic oligonucleotide; AAG chr11 5226782 5226801 5226798 +
gggtagaccaccagcagcct

SEQ ID NO: 8709 - DNA, 20 bp, Artificial Sequence
  Synthetic oligonucleotide; AGG chr11 5226783 5226802 5226799 +
ggtagaccaccagcagccta

SEQ ID NO: 8710 - DNA, 20 bp, Artificial Sequence
  Synthetic oligonucleotide; GGG chr11 5226784 5226803 5226800 +
gtagaccaccagcagcctaa

SEQ ID NO: 8711 - DNA, 20 bp, Artificial Sequence
  Synthetic oligonucleotide; TGG chr11 5226787 5226806 5226803 +
gaccaccagcagcctaaggg

SEQ ID NO: 8712 - DNA, 20 bp, Artificial Sequence
  Synthetic oligonucleotide; GGG chr11 5226788 5226807 5226804 +
accaccagcagcctaagggt

SEQ ID NO: 8713 - DNA, 20 bp, Artificial Sequence
  Synthetic oligonucleotide; TAG chr11 5226795 5226814 5226811 +
gcagcctaagggtgggaaaa

SEQ ID NO: 8714 - DNA, 20 bp, Artificial Sequence
  Synthetic oligonucleotide; TAG chr11 5226803 5226822 5226819 +
agggtgggaaaatagaccaa

SEQ ID NO: 8715 - DNA, 20 bp, Artificial Sequence
  Synthetic oligonucleotide; AGG chr11 5226804 5226823 5226820 +
gggtgggaaaatagaccaat

SEQ ID NO: 8716 - DNA, 20 bp, Artificial Sequence
  Synthetic oligonucleotide; CAG chr11 5226807 5226826 5226823 +
tgggaaaatagaccaatagg

SEQ ID NO: 8717 - DNA, 20 bp, Artificial Sequence
  Synthetic oligonucleotide; GAG chr11 5226809 5226828 5226825 +
ggaaaatagaccaataggca

SEQ ID NO: 8718 - DNA, 20 bp, Artificial Sequence
  Synthetic oligonucleotide; GAG chr11 5226811 5226830 5226827 +
aaaatagaccaataggcaga

SEQ ID NO: 8719 - DNA, 20 bp, Artificial Sequence
  Synthetic oligonucleotide; GAG chr11 5226813 5226832 5226829 +
aatagaccaataggcagaga

SEQ ID NO: 8720 - DNA, 20 bp, Artificial Sequence
  Synthetic oligonucleotide; CAG chr11 5226817 5226836 5226833 +
gaccaataggcagagagagt

SEQ ID NO: 8721 - DNA, 20 bp, Artificial Sequence
  Synthetic oligonucleotide; CAG chr11 5226827 5226846 5226843 +
cagagagagtcagtgcctat

SEQ ID NO: 8722 - DNA, 20 bp, Artificial Sequence
  Synthetic oligonucleotide; AAG chr11 5226836 5226855 5226852 +
tcagtgcctatcagaaaccc

SEQ ID NO: 8723 - DNA, 20 bp, Artificial Sequence
  Synthetic oligonucleotide; GAG chr11 5226838 5226857 5226854 +
agtgcctatcagaaacccaa

SEQ ID NO: 8724 - DNA, 20 bp, Artificial Sequence
  Synthetic oligonucleotide; CAG chr11 5226862 5226881 5226878 +
cttctctgtctccacatgcc

SEQ ID NO: 8725 - DNA, 20 bp, Artificial Sequence
  Synthetic oligonucleotide; TGG chr11 5226872 5226891 5226888 +
tccacatgcccagtttctat

SEQ ID NO: 8726 - DNA, 20 bp, Artificial Sequence
  Synthetic oligonucleotide; CAG chr11 5226915 5226934 5226931 +
aaccttgataccaacctgcc

SEQ ID NO: 8727 - DNA, 20 bp, Artificial Sequence
  Synthetic oligonucleotide; AGG chr11 5226916 5226935 5226932 +
accttgataccaacctgccc

SEQ ID NO: 8728 - DNA, 20 bp, Artificial Sequence
  Synthetic oligonucleotide; GGG chr11 5226917 5226936 5226933 +
ccttgataccaacctgccca

SEQ ID NO: 8729 - DNA, 20 bp, Artificial Sequence
  Synthetic oligonucleotide; CAG chr11 5226957 5226976 5226973 +
tccacgttcaccttgcccca

SEQ ID NO: 8730 - DNA, 20 bp, Artificial Sequence
  Synthetic oligonucleotide; AGG chr11 5226958 5226977 5226974 +
ccacgttcaccttgccccac

SEQ ID NO: 8731 - DNA, 20 bp, Artificial Sequence
  Synthetic oligonucleotide; GGG chr11 5226959 5226978 5226975 +
cacgttcaccttgccccaca

SEQ ID NO: 8732 - DNA, 20 bp, Artificial Sequence
  Synthetic oligonucleotide; CAG chr11 5226962 5226981 5226978 +
gttcaccttgccccacaggg

SEQ ID NO: 8733 - DNA, 20 bp, Artificial Sequence
  Synthetic oligonucleotide; CGG chr11 5226968 5226987 5226984 +
cttgccccacagggcagtaa

SEQ ID NO: 8734 - DNA, 20 bp, Artificial Sequence
  Synthetic oligonucleotide; CAG chr11 5226971 5226990 5226987 +
gccccacagggcagtaacgg

SEQ ID NO: 8735 - DNA, 20 bp, Artificial Sequence
  Synthetic oligonucleotide; CAG chr11 5226983 5227002 5226999 +
agtaacggcagacttctcct

SEQ ID NO: 8736 - DNA, 20 bp, Artificial Sequence
  Synthetic oligonucleotide; AGG chr11 5226984 5227003 5227000 +
gtaacggcagacttctcctc

SEQ ID NO: 8737 - DNA, 20 bp, Artificial Sequence
  Synthetic oligonucleotide; GAG chr11 5226986 5227005 5227002 +
aacggcagacttctcctcag

SEQ ID NO: 8738 - DNA, 20 bp, Artificial Sequence
  Synthetic oligonucleotide; CAG chr11 5226990 5227009 5227006 +
gcagacttctcctcaggagt

SEQ ID NO: 8739 - DNA, 20 bp, Artificial Sequence
  Synthetic oligonucleotide; TGG chr11 5227001 5227020 5227017 +
ctcaggagtcagatgcacca

SEQ ID NO: 8740 - DNA, 20 bp, Artificial Sequence
  Synthetic oligonucleotide; GAG chr11 5227013 5227032 5227029 +
atgcaccatggtgtctgttt

SEQ ID NO: 8741 - DNA, 20 bp, Artificial Sequence
  Synthetic oligonucleotide; AGG chr11 5227014 5227033 5227030 +
tgcaccatggtgtctgtttg

SEQ ID NO: 8742 - DNA, 20 bp, Artificial Sequence
  Synthetic oligonucleotide; TAG chr11 5227021 5227040 5227037 +
tggtgtctgtttgaggttgc

SEQ ID NO: 8743 - DNA, 20 bp, Artificial Sequence
  Synthetic oligonucleotide; CAG chr11 5227030 5227049 5227046 +
tttgaggttgctagtgaaca

SEQ ID NO: 8744 - DNA, 20 bp, Artificial Sequence
  Synthetic oligonucleotide; CAG chr11 5227039 5227058 5227055 +
gctagtgaacacagttgtgt

SEQ ID NO: 8745 - DNA, 20 bp, Artificial Sequence
  Synthetic oligonucleotide; AAG chr11 5227042 5227061 5227058 +
agtgaacacagttgtgtcag

SEQ ID NO: 8746 - DNA, 20 bp, Artificial Sequence
  Synthetic oligonucleotide; AAG chr11 5227052 5227071 5227068 +
gttgtgtcagaagcaaatgt

SEQ ID NO: 8747 - DNA, 20 bp, Artificial Sequence
  Synthetic oligonucleotide; TAG chr11 5227058 5227077 5227074 +
tcagaagcaaatgtaagcaa

SEQ ID NO: 8748 - DNA, 20 bp, Artificial Sequence
  Synthetic oligonucleotide; TGG chr11 5227062 5227081 5227078 +
aagcaaatgtaagcaataga

SEQ ID NO: 8749 - DNA, 20 bp, Artificial Sequence
  Synthetic oligonucleotide; CAG chr11 5227086 5227105 5227102 +
tctgccctgacttttatgcc

SEQ ID NO: 8750 - DNA, 20 bp, Artificial Sequence
  Synthetic oligonucleotide; TGG chr11 5227092 5227111 5227108 +
ctgacttttatgcccagccc

SEQ ID NO: 8751 - DNA, 20 bp, Artificial Sequence
  Synthetic oligonucleotide; TGG chr11 5227114 5227133 5227130 +
gctcctgccctccctgctcc

SEQ ID NO: 8752 - DNA, 20 bp, Artificial Sequence
  Synthetic oligonucleotide; GGG chr11 5227115 5227134 5227131 +
ctcctgccctccctgctcct

SEQ ID NO: 8753 - DNA, 20 bp, Artificial Sequence
  Synthetic oligonucleotide; GAG chr11 5227117 5227136 5227133 +
cctgccctccctgctcctgg

SEQ ID NO: 8754 - DNA, 20 bp, Artificial Sequence
  Synthetic oligonucleotide; TAG chr11 5227120 5227139 5227136 +
gccctccctgctcctgggag

SEQ ID NO: 8755 - DNA, 20 bp, Artificial Sequence
  Synthetic oligonucleotide; TGG chr11 5227125 5227144 5227141 +
ccctgctcctgggagtagat

SEQ ID NO: 8756 - DNA, 20 bp, Artificial Sequence
  Synthetic oligonucleotide; TAG chr11 5227135 5227154 5227151 +
gggagtagattggccaaccc

SEQ ID NO: 8757 - DNA, 20 bp, Artificial Sequence
  Synthetic oligonucleotide; AGG chr11 5227136 5227155 5227152 +
ggagtagattggccaaccct

SEQ ID NO: 8758 - DNA, 20 bp, Artificial Sequence
  Synthetic oligonucleotide; GGG chr11 5227137 5227156 5227153 +
gagtagattggccaacccta

SEQ ID NO: 8759 - DNA, 20 bp, Artificial Sequence
  Synthetic oligonucleotide; TGG chr11 5227142 5227161 5227158 +
gattggccaaccctagggtg

SEQ ID NO: 8760 - DNA, 20 bp, Artificial Sequence
  Synthetic oligonucleotide; CAG chr11 5227150 5227169 5227166 +
aaccctagggtgtggctcca

SEQ ID NO: 8761 - DNA, 20 bp, Artificial Sequence
  Synthetic oligonucleotide; AGG chr11 5227151 5227170 5227167 +
accctagggtgtggctccac

SEQ ID NO: 8762 - DNA, 20 bp, Artificial Sequence
  Synthetic oligonucleotide; GGG chr11 5227152 5227171 5227168 +
ccctagggtgtggctccaca

SEQ ID NO: 8763 - DNA, 20 bp, Artificial Sequence
  Synthetic oligonucleotide; GAG chr11 5227156 5227175 5227172 +
agggtgtggctccacagggt

SEQ ID NO: 8764 - DNA, 20 bp, Artificial Sequence
  Synthetic oligonucleotide; AGG chr11 5227157 5227176 5227173 +
gggtgtggctccacagggtg

SEQ ID NO: 8765 - DNA, 20 bp, Artificial Sequence
  Synthetic oligonucleotide; AAG chr11 5227163 5227182 5227179 +
ggctccacagggtgaggtct

SEQ ID NO: 8766 - DNA, 20 bp, Artificial Sequence
  Synthetic oligonucleotide; CAG chr11 5227172 5227191 5227188 +
gggtgaggtctaagtgatga

SEQ ID NO: 8767 - DNA, 20 bp, Artificial Sequence
  Synthetic oligonucleotide; TGG chr11 5227188 5227207 5227204 +
atgacagccgtacctgtcct

SEQ ID NO: 8768 - DNA, 20 bp, Artificial Sequence
  Synthetic oligonucleotide; TGG chr11 5227197 5227216 5227213 +
gtacctgtccttggctcttc

SEQ ID NO: 8769 - DNA, 20 bp, Artificial Sequence
  Synthetic oligonucleotide; TGG chr11 5227203 5227222 5227219 +
gtccttggctcttctggcac

SEQ ID NO: 8770 - DNA, 20 bp, Artificial Sequence
  Synthetic oligonucleotide; TAG chr11 5227208 5227227 5227224 +
tggctcttctggcactggct

SEQ ID NO: 8771 - DNA, 20 bp, Artificial Sequence
  Synthetic oligonucleotide; AGG chr11 5227209 5227228 5227225 +
ggctcttctggcactggctt

SEQ ID NO: 8772 - DNA, 20 bp, Artificial Sequence
  Synthetic oligonucleotide; GAG chr11 5227211 5227230 5227227 +
ctcttctggcactggcttag

SEQ ID NO: 8773 - DNA, 20 bp, Artificial Sequence
  Synthetic oligonucleotide; TGG chr11 5227215 5227234 5227231 +
tctggcactggcttaggagt

SEQ ID NO: 8774 - DNA, 20 bp, Artificial Sequence
  Synthetic oligonucleotide; CAG chr11 5227230 5227249 5227246 +
ggagttggacttcaaaccct

SEQ ID NO: 8775 - DNA, 20 bp, Artificial Sequence
  Synthetic oligonucleotide; AAG chr11 5227243 5227262 5227259 +
aaaccctcagccctccctct

SEQ ID NO: 8776 - DNA, 20 bp, Artificial Sequence
  Synthetic oligonucleotide; TGG chr11 5227256 5227275 5227272 +
tccctctaagatatatctct

SEQ ID NO: 8777 - DNA, 20 bp, Artificial Sequence
  Synthetic oligonucleotide; CAG chr11 5227270 5227289 5227286 +
atctcttggccccataccat

SEQ ID NO: 8778 - DNA, 20 bp, Artificial Sequence
  Synthetic oligonucleotide; AAG chr11 5227305 5227324 5227321 +
ctaaaaacatcctcctttgc

SEQ ID NO: 8779 - DNA, 20 bp, Artificial Sequence
  Synthetic oligonucleotide; TGG chr11 5227325 5227344 5227341 +
aagtgtatttacgtaatatt

SEQ ID NO: 8780 - DNA, 20 bp, Artificial Sequence
  Synthetic oligonucleotide; CAG chr11 5227333 5227352 5227349 +
ttacgtaatatttggaatca

SEQ ID NO: 8781 - DNA, 20 bp, Artificial Sequence
  Synthetic oligonucleotide; TGG chr11 5227338 5227357 5227354 +
taatatttggaatcacagct

SEQ ID NO: 8782 - DNA, 20 bp, Artificial Sequence
  Synthetic oligonucleotide; AAG chr11 5227342 5227361 5227358 +
atttggaatcacagcttggt

SEQ ID NO: 8783 - DNA, 20 bp, Artificial Sequence
  Synthetic oligonucleotide; AAG chr11 5227352 5227371 5227368 +
acagcttggtaagcatattg

SEQ ID NO: 8784 - DNA, 20 bp, Artificial Sequence
  Synthetic oligonucleotide; AAG chr11 5227386 5227405 5227402 +
aattttcttattacacaaat

SEQ ID NO: 8785 - DNA, 20 bp, Artificial Sequence
  Synthetic oligonucleotide; AAG chr11 5227389 5227408 5227405 +
tttcttattacacaaataag

SEQ ID NO: 8786 - DNA, 20 bp, Artificial Sequence
  Synthetic oligonucleotide; AAG chr11 5227404 5227423 5227420 +
ataagaagttgatgcactaa

SEQ ID NO: 8787 - DNA, 20 bp, Artificial Sequence
  Synthetic oligonucleotide; TGG chr11 5227407 5227426 5227423 +
agaagttgatgcactaaaag

SEQ ID NO: 8788 - DNA, 20 bp, Artificial Sequence
  Synthetic oligonucleotide; AAG chr11 5227410 5227429 5227426 +
agttgatgcactaaaagtgg

SEQ ID NO: 8789 - DNA, 20 bp, Artificial Sequence
  Synthetic oligonucleotide; GAG chr11 5227412 5227431 5227428 +
ttgatgcactaaaagtggaa

SEQ ID NO: 8790 - DNA, 20 bp, Artificial Sequence
  Synthetic oligonucleotide; CAG chr11 5227432 5227451 5227448 +
gagttttgtctaccataatt

SEQ ID NO: 8791 - DNA, 20 bp, Artificial Sequence
  Synthetic oligonucleotide; TGG chr11 5227438 5227457 5227454 +
tgtctaccataattcagctt

SEQ ID NO: 8792 - DNA, 20 bp, Artificial Sequence
  Synthetic oligonucleotide; GGG chr11 5227439 5227458 5227455 +
gtctaccataattcagcttt

SEQ ID NO: 8793 - DNA, 20 bp, Artificial Sequence
  Synthetic oligonucleotide; TAG chr11 5227447 5227466 5227463 +
taattcagctttgggatatg

SEQ ID NO: 8794 - DNA, 20 bp, Artificial Sequence
  Synthetic oligonucleotide; TGG chr11 5227451 5227470 5227467 +
tcagctttgggatatgtaga

SEQ ID NO: 8795 - DNA, 20 bp, Artificial Sequence
  Synthetic oligonucleotide; CAG chr11 5227471 5227490 5227487 +
tggatctcttcctgcgtctc

SEQ ID NO: 8796 - DNA, 20 bp, Artificial Sequence
  Synthetic oligonucleotide; CAG chr11 5227491 5227510 5227507 +
cagaatatgcaaaatactta

SEQ ID NO: 8797 - DNA, 20 bp, Artificial Sequence
  Synthetic oligonucleotide; AGG chr11 5227492 5227511 5227508 +
agaatatgcaaaatacttac

SEQ ID NO: 8798 - DNA, 20 bp, Artificial Sequence
  Synthetic oligonucleotide; CAG chr11 5227496 5227515 5227512 +
tatgcaaaatacttacagga

SEQ ID NO: 8799 - DNA, 20 bp, Artificial Sequence
  Synthetic oligonucleotide; TGG chr11 5227501 5227520 5227517 +
aaaatacttacaggacagaa

SEQ ID NO: 8800 - DNA, 20 bp, Artificial Sequence
  Synthetic oligonucleotide; CGG chr11 5227519 5227538 5227535 +
aatggatgaaaactctacct

SEQ ID NO: 8801 - DNA, 20 bp, Artificial Sequence
  Synthetic oligonucleotide; AAG chr11 5227526 5227545 5227542 +
gaaaactctacctcggttct

SEQ ID NO: 8802 - DNA, 20 bp, Artificial Sequence
  Synthetic oligonucleotide; TGG chr11 5227546 5227565 5227562 +
aagcatatcttctccttatt

SEQ ID NO: 8803 - DNA, 20 bp, Artificial Sequence
  Synthetic oligonucleotide; TGG chr11 5227561 5227580 5227577 +
ttatttggattaaaaccttc

SEQ ID NO: 8804 - DNA, 20 bp, Artificial Sequence
  Synthetic oligonucleotide; AAG chr11 5227565 5227584 5227581 +
ttggattaaaaccttctggt

SEQ ID NO: 8805 - DNA, 20 bp, Artificial Sequence
  Synthetic oligonucleotide; AAG chr11 5227570 5227589 5227586 +
ttaaaaccttctggtaagaa

SEQ ID NO: 8806 - DNA, 20 bp, Artificial Sequence
  Synthetic oligonucleotide; TAG chr11 5227690 5227709 5227706 +
taataaattatgtctaaaaa

SEQ ID NO: 8807 - DNA, 20 bp, Artificial Sequence
  Synthetic oligonucleotide; TAG chr11 5227723 5227742 5227739 +
aatcaatgtgctctgtgcat

SEQ ID NO: 8808 - DNA, 20 bp, Artificial Sequence
  Synthetic oligonucleotide; TAG chr11 5227734 5227753 5227750 +
tctgtgcattagttacttat

SEQ ID NO: 8809 - DNA, 20 bp, Artificial Sequence
  Synthetic oligonucleotide; AGG chr11 5227735 5227754 5227751 +
ctgtgcattagttacttatt

SEQ ID NO: 8810 - DNA, 20 bp, Artificial Sequence
  Synthetic oligonucleotide; TGG chr11 5227741 5227760 5227757 +
attagttacttattaggttt

SEQ ID NO: 8811 - DNA, 20 bp, Artificial Sequence
  Synthetic oligonucleotide; GGG chr11 5227742 5227761 5227758 +
ttagttacttattaggtttt

SEQ ID NO: 8812 - DNA, 20 bp, Artificial Sequence
  Synthetic oligonucleotide; AAG chr11 5227749 5227768 5227765 +
cttattaggttttgggaaac

SEQ ID NO: 8813 - DNA, 20 bp, Artificial Sequence
  Synthetic oligonucleotide; GAG chr11 5227751 5227770 5227767 +
tattaggttttgggaaacaa

SEQ ID NO: 8814 - DNA, 20 bp, Artificial Sequence
  Synthetic oligonucleotide; TAG chr11 5227763 5227782 5227779 +
ggaaacaagagataaaaaac

SEQ ID NO: 8815 - DNA, 20 bp, Artificial Sequence
  Synthetic oligonucleotide; GAG chr11 5227765 5227784 5227781 +
aaacaagagataaaaaacta

SEQ ID NO: 8816 - DNA, 20 bp, Artificial Sequence
  Synthetic oligonucleotide; CAG chr11 5227779 5227798 5227795 +
aaactagagacctcttaatg

SEQ ID NO: 8817 - DNA, 20 bp, Artificial Sequence
  Synthetic oligonucleotide; AAG chr11 5227803 5227822 5227819 +
caaaaatacaaataaataaa

SEQ ID NO: 8818 - DNA, 20 bp, Artificial Sequence
  Synthetic oligonucleotide; AAG chr11 5227820 5227839 5227836 +
aaaaagtcacttacaaccca

SEQ ID NO: 8819 - DNA, 20 bp, Artificial Sequence
  Synthetic oligonucleotide; TGG chr11 5227835 5227854 5227851 +
acccaaagtgtgactatcaa

SEQ ID NO: 8820 - DNA, 20 bp, Artificial Sequence
  Synthetic oligonucleotide; GGG chr11 5227836 5227855 5227852 +
cccaaagtgtgactatcaat

SEQ ID NO: 8821 - DNA, 20 bp, Artificial Sequence
  Synthetic oligonucleotide; GGG chr11 5227837 5227856 5227853 +
ccaaagtgtgactatcaatg

SEQ ID NO: 8822 - DNA, 20 bp, Artificial Sequence
  Synthetic oligonucleotide; CAG chr11 5227844 5227863 5227860 +
gtgactatcaatggggtaat

SEQ ID NO: 8823 - DNA, 20 bp, Artificial Sequence
  Synthetic oligonucleotide; TGG chr11 5227847 5227866 5227863 +
actatcaatggggtaatcag

SEQ ID NO: 8824 - DNA, 20 bp, Artificial Sequence
  Synthetic oligonucleotide; TAG chr11 5227857 5227876 5227873 +
gggtaatcagtggtgtcaaa

SEQ ID NO: 8825 - DNA, 20 bp, Artificial Sequence
  Synthetic oligonucleotide; AGG chr11 5227858 5227877 5227874 +
ggtaatcagtggtgtcaaat

SEQ ID NO: 8826 - DNA, 20 bp, Artificial Sequence
  Synthetic oligonucleotide; GAG chr11 5227860 5227879 5227876 +
taatcagtggtgtcaaatag

SEQ ID NO: 8827 - DNA, 20 bp, Artificial Sequence
  Synthetic oligonucleotide; AGG chr11 5227861 5227880 5227877 +
aatcagtggtgtcaaatagg

SEQ ID NO: 8828 - DNA, 20 bp, Artificial Sequence
  Synthetic oligonucleotide; TGG chr11 5227869 5227888 5227885 +
gtgtcaaataggaggttaac

SEQ ID NO: 8829 - DNA, 20 bp, Artificial Sequence
  Synthetic oligonucleotide; GGG chr11 5227870 5227889 5227886 +
tgtcaaataggaggttaact

SEQ ID NO: 8830 - DNA, 20 bp, Artificial Sequence
  Synthetic oligonucleotide; GGG chr11 5227871 5227890 5227887 +
gtcaaataggaggttaactg

SEQ ID NO: 8831 - DNA, 20 bp, Artificial Sequence
  Synthetic oligonucleotide; TGG chr11 5227893 5227912 5227909 +
gacatctaactgtttctgcc

SEQ ID NO: 8832 - DNA, 20 bp, Artificial Sequence
  Synthetic oligonucleotide; AAG chr11 5227906 5227925 5227922 +
ttctgcctggactaatctgc

SEQ ID NO: 8833 - DNA, 20 bp, Artificial Sequence
  Synthetic oligonucleotide; GAG chr11 5227908 5227927 5227924 +
ctgcctggactaatctgcaa

SEQ ID NO: 8834 - DNA, 20 bp, Artificial Sequence
  Synthetic oligonucleotide; TGG chr11 5227915 5227934 5227931 +
gactaatctgcaagagtgtc

SEQ ID NO: 8835 - DNA, 20 bp, Artificial Sequence
  Synthetic oligonucleotide; GGG chr11 5227916 5227935 5227932 +
actaatctgcaagagtgtct

SEQ ID NO: 8836 - DNA, 20 bp, Artificial Sequence
  Synthetic oligonucleotide; GGG chr11 5227917 5227936 5227933 +
ctaatctgcaagagtgtctg

SEQ ID NO: 8837 - DNA, 20 bp, Artificial Sequence
  Synthetic oligonucleotide; GGG chr11 5227918 5227937 5227934 +
taatctgcaagagtgtctgg

SEQ ID NO: 8838 - DNA, 20 bp, Artificial Sequence
  Synthetic oligonucleotide; AAG chr11 5227927 5227946 5227943 +
agagtgtctgggggaacaaa

SEQ ID NO: 8839 - DNA, 20 bp, Artificial Sequence
  Synthetic oligonucleotide; TAG chr11 5227941 5227960 5227957 +
aacaaaaagcctctgtgact

SEQ ID NO: 8840 - DNA, 20 bp, Artificial Sequence
  Synthetic oligonucleotide; AAG chr11 5227945 5227964 5227961 +
aaaagcctctgtgacttaga

SEQ ID NO: 8841 - DNA, 20 bp, Artificial Sequence
  Synthetic oligonucleotide; TAG chr11 5227948 5227967 5227964 +
agcctctgtgacttagaaag

SEQ ID NO: 8842 - DNA, 20 bp, Artificial Sequence
  Synthetic oligonucleotide; AGG chr11 5227949 5227968 5227965 +
gcctctgtgacttagaaagt

SEQ ID NO: 8843 - DNA, 20 bp, Artificial Sequence
  Synthetic oligonucleotide; GGG chr11 5227950 5227969 5227966 +
cctctgtgacttagaaagta

SEQ ID NO: 8844 - DNA, 20 bp, Artificial Sequence
  Synthetic oligonucleotide; GGG chr11 5227951 5227970 5227967 +
ctctgtgacttagaaagtag

SEQ ID NO: 8845 - DNA, 20 bp, Artificial Sequence
  Synthetic oligonucleotide; TAG chr11 5227954 5227973 5227970 +
tgtgacttagaaagtagggg

SEQ ID NO: 8846 - DNA, 20 bp, Artificial Sequence
  Synthetic oligonucleotide; AGG chr11 5227955 5227974 5227971 +
gtgacttagaaagtaggggt

SEQ ID NO: 8847 - DNA, 20 bp, Artificial Sequence
  Synthetic oligonucleotide; GAG chr11 5227957 5227976 5227973 +
gacttagaaagtaggggtag

SEQ ID NO: 8848 - DNA, 20 bp, Artificial Sequence
  Synthetic oligonucleotide; AGG chr11 5227958 5227977 5227974 +
acttagaaagtaggggtagg

SEQ ID NO: 8849 - DNA, 20 bp, Artificial Sequence
  Synthetic oligonucleotide; GGG chr11 5227959 5227978 5227975 +
cttagaaagtaggggtagga

SEQ ID NO: 8850 - DNA, 20 bp, Artificial Sequence
  Synthetic oligonucleotide; GGG chr11 5227960 5227979 5227976 +
ttagaaagtaggggtaggag

SEQ ID NO: 8851 - DNA, 20 bp, Artificial Sequence
  Synthetic oligonucleotide; AAG chr11 5227965 5227984 5227981 +
aagtaggggtaggaggggaa

SEQ ID NO: 8852 - DNA, 20 bp, Artificial Sequence
  Synthetic oligonucleotide; AGG chr11 5227966 5227985 5227982 +
agtaggggtaggaggggaaa

SEQ ID NO: 8853 - DNA, 20 bp, Artificial Sequence
  Synthetic oligonucleotide; TGG chr11 5227978 5227997 5227994 +
aggggaaaaggtcttctact

SEQ ID NO: 8854 - DNA, 20 bp, Artificial Sequence
  Synthetic oligonucleotide; CAG chr11 5227983 5228002 5227999 +
aaaaggtcttctacttggct

SEQ ID NO: 8855 - DNA, 20 bp, Artificial Sequence
  Synthetic oligonucleotide; TAG chr11 5228001 5228020 5228017 +
ctcagattatttttttcctc

SEQ ID NO: 8856 - DNA, 20 bp, Artificial Sequence
  Synthetic oligonucleotide; AAG chr11 5228010 5228029 5228026 +
tttttttcctctagtccact

SEQ ID NO: 8857 - DNA, 20 bp, Artificial Sequence
  Synthetic oligonucleotide; AAG chr11 5228045 5228064 5228061 +
taaaatcatttccttgattc

SEQ ID NO: 8858 - DNA, 20 bp, Artificial Sequence
  Synthetic oligonucleotide; TAG chr11 5228114 5228133 5228130 +
aatttactcttctttctcta

SEQ ID NO: 8859 - DNA, 20 bp, Artificial Sequence
  Synthetic oligonucleotide; CAG chr11 5228183 5228202 5228199 +
cttgtactaaattaactcct

SEQ ID NO: 8860 - DNA, 20 bp, Artificial Sequence
  Synthetic oligonucleotide; AGG chr11 5228184 5228203 5228200 +
ttgtactaaattaactcctc

SEQ ID NO: 8861 - DNA, 20 bp, Artificial Sequence
  Synthetic oligonucleotide; GAG chr11 5228188 5228207 5228204 +
actaaattaactcctcaggt

SEQ ID NO: 8862 - DNA, 20 bp, Artificial Sequence
  Synthetic oligonucleotide; AGG chr11 5228189 5228208 5228205 +
ctaaattaactcctcaggtg

SEQ ID NO: 8863 - DNA, 20 bp, Artificial Sequence
  Synthetic oligonucleotide; AAG chr11 5228203 5228222 5228219 +
caggtgaggaaaaacttttg

SEQ ID NO: 8864 - DNA, 20 bp, Artificial Sequence
  Synthetic oligonucleotide; CAG chr11 5228208 5228227 5228224 +
gaggaaaaacttttgaagtg

SEQ ID NO: 8865 - DNA, 20 bp, Artificial Sequence
  Synthetic oligonucleotide; GAG chr11 5228210 5228229 5228226 +
ggaaaaacttttgaagtgca

SEQ ID NO: 8866 - DNA, 20 bp, Artificial Sequence
  Synthetic oligonucleotide; AAG chr11 5228232 5228251 5228248 +
gttctgcttcctgctattaa

SEQ ID NO: 8867 - DNA, 20 bp, Artificial Sequence
  Synthetic oligonucleotide; CAG chr11 5228247 5228266 5228263 +
attaaaagatgtaattaaaa

SEQ ID NO: 8868 - DNA, 20 bp, Artificial Sequence
  Synthetic oligonucleotide; AAG chr11 5228252 5228271 5228268 +
aagatgtaattaaaacagca

SEQ ID NO: 8869 - DNA, 20 bp, Artificial Sequence
  Synthetic oligonucleotide; AGG chr11 5228253 5228272 5228269 +
agatgtaattaaaacagcaa

SEQ ID NO: 8870 - DNA, 20 bp, Artificial Sequence
  Synthetic oligonucleotide; TAG chr11 5228256 5228275 5228272 +
tgtaattaaaacagcaaagg

SEQ ID NO: 8871 - DNA, 20 bp, Artificial Sequence
  Synthetic oligonucleotide; AAG chr11 5228260 5228279 5228276 +
attaaaacagcaaaggtagc

SEQ ID NO: 8872 - DNA, 20 bp, Artificial Sequence
  Synthetic oligonucleotide; GAG chr11 5228270 5228289 5228286 +
caaaggtagcaagcatttat

SEQ ID NO: 8873 - DNA, 20 bp, Artificial Sequence
  Synthetic oligonucleotide; AGG chr11 5228271 5228290 5228287 +
aaaggtagcaagcatttatg

SEQ ID NO: 8874 - DNA, 20 bp, Artificial Sequence
  Synthetic oligonucleotide; CAG chr11 5228275 5228294 5228291 +
gtagcaagcatttatgaggt

SEQ ID NO: 8875 - DNA, 20 bp, Artificial Sequence
  Synthetic oligonucleotide; TAG chr11 5228280 5228299 5228296 +
aagcatttatgaggtcagcg

SEQ ID NO: 8876 - DNA, 20 bp, Artificial Sequence
  Synthetic oligonucleotide; AGG chr11 5228281 5228300 5228297 +
agcatttatgaggtcagcgt

SEQ ID NO: 8877 - DNA, 20 bp, Artificial Sequence
  Synthetic oligonucleotide; GGG chr11 5228282 5228301 5228298 +
gcatttatgaggtcagcgta

SEQ ID NO: 8878 - DNA, 20 bp, Artificial Sequence
  Synthetic oligonucleotide; CAG chr11 5228288 5228307 5228304 +
atgaggtcagcgtagggtct

SEQ ID NO: 8879 - DNA, 20 bp, Artificial Sequence
  Synthetic oligonucleotide; AAG chr11 5228299 5228318 5228315 +
gtagggtctcagtgttccct

SEQ ID NO: 8880 - DNA, 20 bp, Artificial Sequence
  Synthetic oligonucleotide; AGG chr11 5228300 5228319 5228316 +
tagggtctcagtgttcccta

SEQ ID NO: 8881 - DNA, 20 bp, Artificial Sequence
  Synthetic oligonucleotide; GGG chr11 5228301 5228320 5228317 +
agggtctcagtgttccctaa

SEQ ID NO: 8882 - DNA, 20 bp, Artificial Sequence
  Synthetic oligonucleotide; CAG chr11 5228310 5228329 5228326 +
gtgttccctaagggccctgt

SEQ ID NO: 8883 - DNA, 20 bp, Artificial Sequence
  Synthetic oligonucleotide; TGG chr11 5228336 5228355 5228352 +
tcctgaatcctgcccctacc

SEQ ID NO: 8884 - DNA, 20 bp, Artificial Sequence
  Synthetic oligonucleotide; CGG chr11 5228349 5228368 5228365 +
ccctacctggaaacccatgt

SEQ ID NO: 8885 - DNA, 20 bp, Artificial Sequence
  Synthetic oligonucleotide; TAG chr11 5228354 5228373 5228370 +
cctggaaacccatgtcggtt

SEQ ID NO: 8886 - DNA, 20 bp, Artificial Sequence
  Synthetic oligonucleotide; AAG chr11 5228358 5228377 5228374 +
gaaacccatgtcggtttagt

SEQ ID NO: 8887 - DNA, 20 bp, Artificial Sequence
  Synthetic oligonucleotide; AGG chr11 5228359 5228378 5228375 +
aaacccatgtcggtttagta

SEQ ID NO: 8888 - DNA, 20 bp, Artificial Sequence
  Synthetic oligonucleotide; AAG chr11 5228363 5228382 5228379 +
ccatgtcggtttagtaagga

SEQ ID NO: 8889 - DNA, 20 bp, Artificial Sequence
  Synthetic oligonucleotide; CAG chr11 5228408 5228427 5228424 +
tttctcctacttcttccttt

SEQ ID NO: 8890 - DNA, 20 bp, Artificial Sequence
  Synthetic oligonucleotide; TAG chr11 5228488 5228507 5228504 +
caataaaatgaaataaaatt

SEQ ID NO: 8891 - DNA, 20 bp, Artificial Sequence
  Synthetic oligonucleotide; AGG chr11 5228489 5228508 5228505 +
aataaaatgaaataaaattt

SEQ ID NO: 8892 - DNA, 20 bp, Artificial Sequence
  Synthetic oligonucleotide; AAG chr11 5228500 5228519 5228516 +
ataaaatttaggttaaccaa

SEQ ID NO: 8893 - DNA, 20 bp, Artificial Sequence
  Synthetic oligonucleotide; TGG chr11 5228507 5228526 5228523 +
ttaggttaaccaaaagaaac

SEQ ID NO: 8894 - DNA, 20 bp, Artificial Sequence
  Synthetic oligonucleotide; TAG chr11 5228522 5228541 5228538 +
gaaactggatcctctatttc

SEQ ID NO: 8895 - DNA, 20 bp, Artificial Sequence
  Synthetic oligonucleotide; CAG chr11 5228529 5228548 5228545 +
gatcctctatttctagttat

SEQ ID NO: 8896 - DNA, 20 bp, Artificial Sequence
  Synthetic oligonucleotide; AAG chr11 5228532 5228551 5228548 +
cctctatttctagttatcag

SEQ ID NO: 8897 - DNA, 20 bp, Artificial Sequence
  Synthetic oligonucleotide; AGG chr11 5228533 5228552 5228549 +
ctctatttctagttatcaga

SEQ ID NO: 8898 - DNA, 20 bp, Artificial Sequence
  Synthetic oligonucleotide; TAG chr11 5228604 5228623 5228620 +
ctctattattgctaaataaa

SEQ ID NO: 8899 - DNA, 20 bp, Artificial Sequence
  Synthetic oligonucleotide; GAG chr11 5228606 5228625 5228622 +
ctattattgctaaataaata

SEQ ID NO: 8900 - DNA, 20 bp, Artificial Sequence
  Synthetic oligonucleotide; CAG chr11 5228643 5228662 5228659 +
ctacctgtctcaaccctcat

SEQ ID NO: 8901 - DNA, 20 bp, Artificial Sequence
  Synthetic oligonucleotide; AGG chr11 5228644 5228663 5228660 +
tacctgtctcaaccctcatc

SEQ ID NO: 8902 - DNA, 20 bp, Artificial Sequence
  Synthetic oligonucleotide; CAG chr11 5228687 5228706 5228703 +
tctgattattctcacacacg

SEQ ID NO: 8903 - DNA, 20 bp, Artificial Sequence
  Synthetic oligonucleotide; AAG chr11 5228691 5228710 5228707 +
attattctcacacacgcaga

SEQ ID NO: 8904 - DNA, 20 bp, Artificial Sequence
  Synthetic oligonucleotide; TGG chr11 5228698 5228717 5228714 +
tcacacacgcagaaagtgtt

SEQ ID NO: 8905 - DNA, 20 bp, Artificial Sequence
  Synthetic oligonucleotide; TGG chr11 5228709 5228728 5228725 +
gaaagtgtttggttcttcta

SEQ ID NO: 8906 - DNA, 20 bp, Artificial Sequence
  Synthetic oligonucleotide; TGG chr11 5228717 5228736 5228733 +
ttggttcttctatggctatc

SEQ ID NO: 8907 - DNA, 20 bp, Artificial Sequence
  Synthetic oligonucleotide; GAG chr11 5228719 5228738 5228735 +
ggttcttctatggctatctg

SEQ ID NO: 8908 - DNA, 20 bp, Artificial Sequence
  Synthetic oligonucleotide; TAG chr11 5228724 5228743 5228740 +
ttctatggctatctggagcc

SEQ ID NO: 8909 - DNA, 20 bp, Artificial Sequence
  Synthetic oligonucleotide; AGG chr11 5228725 5228744 5228741 +
tctatggctatctggagcct

SEQ ID NO: 8910 - DNA, 20 bp, Artificial Sequence
  Synthetic oligonucleotide; TAG chr11 5228755 5228774 5228771 +
attatgcctatgtatgatta

SEQ ID NO: 8911 - DNA, 20 bp, Artificial Sequence
  Synthetic oligonucleotide; GAG chr11 5228757 5228776 5228773 +
tatgcctatgtatgattata

SEQ ID NO: 8912 - DNA, 20 bp, Artificial Sequence
  Synthetic oligonucleotide; AGG chr11 5228758 5228777 5228774 +
atgcctatgtatgattatag

SEQ ID NO: 8913 - DNA, 20 bp, Artificial Sequence
  Synthetic oligonucleotide; AAG chr11 5228762 5228781 5228778 +
ctatgtatgattatagaggt

SEQ ID NO: 8914 - DNA, 20 bp, Artificial Sequence
  Synthetic oligonucleotide; GAG chr11 5228764 5228783 5228780 +
atgtatgattatagaggtaa

SEQ ID NO: 8915 - DNA, 20 bp, Artificial Sequence
  Synthetic oligonucleotide; AGG chr11 5228765 5228784 5228781 +
tgtatgattatagaggtaag

SEQ ID NO: 8916 - DNA, 20 bp, Artificial Sequence
  Synthetic oligonucleotide; GGG chr11 5228766 5228785 5228782 +
gtatgattatagaggtaaga

SEQ ID NO: 8917 - DNA, 20 bp, Artificial Sequence
  Synthetic oligonucleotide; AAG chr11 5228778 5228797 5228794 +
aggtaagagggataaaattt

SEQ ID NO: 8918 - DNA, 20 bp, Artificial Sequence
  Synthetic oligonucleotide; AAG chr11 5228818 5228837 5228834 +
cattcctctgtaaaaaacta

SEQ ID NO: 8919 - DNA, 20 bp, Artificial Sequence
  Synthetic oligonucleotide; GAG chr11 5228825 5228844 5228841 +
ctgtaaaaaactaaagcaat

SEQ ID NO: 8920 - DNA, 20 bp, Artificial Sequence
  Synthetic oligonucleotide; AGG chr11 5228826 5228845 5228842 +
tgtaaaaaactaaagcaatg

SEQ ID NO: 8921 - DNA, 20 bp, Artificial Sequence
  Synthetic oligonucleotide; TAG chr11 5228832 5228851 5228848 +
aaactaaagcaatgaggatc

SEQ ID NO: 8922 - DNA, 20 bp, Artificial Sequence
  Synthetic oligonucleotide; AGG chr11 5228833 5228852 5228849 +
aactaaagcaatgaggatct

SEQ ID NO: 8923 - DNA, 20 bp, Artificial Sequence
  Synthetic oligonucleotide; GAG chr11 5228851 5228870 5228867 +
ctaggcacacgtgtatccct

SEQ ID NO: 8924 - DNA, 20 bp, Artificial Sequence
  Synthetic oligonucleotide; AAG chr11 5228856 5228875 5228872 +
cacacgtgtatccctgagaa

SEQ ID NO: 8925 - DNA, 20 bp, Artificial Sequence
  Synthetic oligonucleotide; TGG chr11 5228877 5228896 5228893 +
agatttcacatgttgaatcc

SEQ ID NO: 8926 - DNA, 20 bp, Artificial Sequence
  Synthetic oligonucleotide; GGG chr11 5228878 5228897 5228894 +
gatttcacatgttgaatcct

SEQ ID NO: 8927 - DNA, 20 bp, Artificial Sequence
  Synthetic oligonucleotide; AAG chr11 5228883 5228902 5228899 +
cacatgttgaatcctgggaa

SEQ ID NO: 8928 - DNA, 20 bp, Artificial Sequence
  Synthetic oligonucleotide; CAG chr11 5228919 5228938 5228935 +
attttaaatgttaaaacatg

SEQ ID NO: 8929 - DNA, 20 bp, Artificial Sequence
  Synthetic oligonucleotide; TGG chr11 5228930 5228949 5228946 +
taaaacatgcagatttgact

SEQ ID NO: 8930 - DNA, 20 bp, Artificial Sequence
  Synthetic oligonucleotide; TAG chr11 5228937 5228956 5228953 +
tgcagatttgacttggctgt

SEQ ID NO: 8931 - DNA, 20 bp, Artificial Sequence
  Synthetic oligonucleotide; TGG chr11 5228944 5228963 5228960 +
ttgacttggctgttagattt

SEQ ID NO: 8932 - DNA, 20 bp, Artificial Sequence
  Synthetic oligonucleotide; TAG chr11 5228976 5228995 5228992 +
tattaaatttaaacctgcat

SEQ ID NO: 8933 - DNA, 20 bp, Artificial Sequence
  Synthetic oligonucleotide; TAG chr11 5228987 5229006 5229003 +
aacctgcattagcattgttt

SEQ ID NO: 8934 - DNA, 20 bp, Artificial Sequence
  Synthetic oligonucleotide; TAG chr11 5228993 5229012 5229009 +
cattagcattgttttagatt

SEQ ID NO: 8935 - DNA, 20 bp, Artificial Sequence
  Synthetic oligonucleotide; CAG chr11 5228997 5229016 5229013 +
agcattgttttagatttaga

SEQ ID NO: 8936 - DNA, 20 bp, Artificial Sequence
  Synthetic oligonucleotide; AAG chr11 5229005 5229024 5229021 +
tttagatttagacagttttc

SEQ ID NO: 8937 - DNA, 20 bp, Artificial Sequence
  Synthetic oligonucleotide; AAG chr11 5229031 5229050 5229047 +
ctgtttcacatccctgatat

SEQ ID NO: 8938 - DNA, 20 bp, Artificial Sequence
  Synthetic oligonucleotide; GAG chr11 5229033 5229052 5229049 +
gtttcacatccctgatataa

SEQ ID NO: 8939 - DNA, 20 bp, Artificial Sequence
  Synthetic oligonucleotide; AGG chr11 5229034 5229053 5229050 +
tttcacatccctgatataag

SEQ ID NO: 8940 - DNA, 20 bp, Artificial Sequence
  Synthetic oligonucleotide; AAG chr11 5229054 5229073 5229070 +
aggcatgtatatgtgaaata

SEQ ID NO: 8941 - DNA, 20 bp, Artificial Sequence
  Synthetic oligonucleotide; CGG chr11 5229064 5229083 5229080 +
atgtgaaataaagtgttctg

SEQ ID NO: 8942 - DNA, 20 bp, Artificial Sequence
  Synthetic oligonucleotide; AAG chr11 5229067 5229086 5229083 +
tgaaataaagtgttctgcgg

SEQ ID NO: 8943 - DNA, 20 bp, Artificial Sequence
  Synthetic oligonucleotide; TGG chr11 5229096 5229115 5229112 +
tatgtcttttgcaaatatcc

SEQ ID NO: 8944 - DNA, 20 bp, Artificial Sequence
  Synthetic oligonucleotide; GGG chr11 5229097 5229116 5229113 +
atgtcttttgcaaatatcct

SEQ ID NO: 8945 - DNA, 20 bp, Artificial Sequence
  Synthetic oligonucleotide; AAG chr11 5229103 5229122 5229119 +
tttgcaaatatcctgggtca

SEQ ID NO: 8946 - DNA, 20 bp, Artificial Sequence
  Synthetic oligonucleotide; CAG chr11 5229114 5229133 5229130 +
cctgggtcaaagaaaatgca

SEQ ID NO: 8947 - DNA, 20 bp, Artificial Sequence
  Synthetic oligonucleotide; TAG chr11 5229136 5229155 5229152 +
gactttatgaaattataata

SEQ ID NO: 8948 - DNA, 20 bp, Artificial Sequence
  Synthetic oligonucleotide; AGG chr11 5229137 5229156 5229153 +
actttatgaaattataatat

SEQ ID NO: 8949 - DNA, 20 bp, Artificial Sequence
  Synthetic oligonucleotide; TAG chr11 5229149 5229168 5229165 +
tataatataggttatattta

SEQ ID NO: 8950 - DNA, 20 bp, Artificial Sequence
  Synthetic oligonucleotide; AAG chr11 5229160 5229179 5229176 +
ttatatttatagtattctga

SEQ ID NO: 8951 - DNA, 20 bp, Artificial Sequence
  Synthetic oligonucleotide; AAG chr11 5229176 5229195 5229192 +
ctgaaagaccaaaattgtca

SEQ ID NO: 8952 - DNA, 20 bp, Artificial Sequence
  Synthetic oligonucleotide; AAG chr11 5229180 5229199 5229196 +
aagaccaaaattgtcaaagc

SEQ ID NO: 8953 - DNA, 20 bp, Artificial Sequence
  Synthetic oligonucleotide; GAG chr11 5229182 5229201 5229198 +
gaccaaaattgtcaaagcaa

SEQ ID NO: 8954 - DNA, 20 bp, Artificial Sequence
  Synthetic oligonucleotide; TGG chr11 5229200 5229219 5229216 +
aagagctttgaaatcctgat

SEQ ID NO: 8955 - DNA, 20 bp, Artificial Sequence
  Synthetic oligonucleotide; CAG chr11 5229203 5229222 5229219 +
agctttgaaatcctgattgg

SEQ ID NO: 8956 - DNA, 20 bp, Artificial Sequence
  Synthetic oligonucleotide; AAG chr11 5229223 5229242 5229239 +
cagaaattgtcaccttctta

SEQ ID NO: 8957 - DNA, 20 bp, Artificial Sequence
  Synthetic oligonucleotide; CAG chr11 5229250 5229269 5229266 +
accctacaacttcttatgct

SEQ ID NO: 8958 - DNA, 20 bp, Artificial Sequence
  Synthetic oligonucleotide; TAG chr11 5229256 5229275 5229272 +
caacttcttatgctcagaaa

SEQ ID NO: 8959 - DNA, 20 bp, Artificial Sequence
  Synthetic oligonucleotide; TGG chr11 5229302 5229321 5229318 +
cttttttaaatgatgaacta

SEQ ID NO: 8960 - DNA, 20 bp, Artificial Sequence
  Synthetic oligonucleotide; TGG chr11 5229320 5229339 5229336 +
tatggatccttctcttgtgt

SEQ ID NO: 8961 - DNA, 20 bp, Artificial Sequence
  Synthetic oligonucleotide; CAG chr11 5229332 5229351 5229348 +
tcttgtgttggcaactgctg

SEQ ID NO: 8962 - DNA, 20 bp, Artificial Sequence
  Synthetic oligonucleotide; TGG chr11 5229347 5229366 5229363 +
tgctgcagataccatcatcc

SEQ ID NO: 8963 - DNA, 20 bp, Artificial Sequence
  Synthetic oligonucleotide; AAG chr11 5229354 5229373 5229370 +
gataccatcatcctggcttc

SEQ ID NO: 8964 - DNA, 20 bp, Artificial Sequence
  Synthetic oligonucleotide; AGG chr11 5229355 5229374 5229371 +
ataccatcatcctggcttca

SEQ ID NO: 8965 - DNA, 20 bp, Artificial Sequence
  Synthetic oligonucleotide; CAG chr11 5229358 5229377 5229374 +
ccatcatcctggcttcaagg

SEQ ID NO: 8966 - DNA, 20 bp, Artificial Sequence
  Synthetic oligonucleotide; AGG chr11 5229359 5229378 5229375 +
catcatcctggcttcaaggc

SEQ ID NO: 8967 - DNA, 20 bp, Artificial Sequence
  Synthetic oligonucleotide; GGG chr11 5229360 5229379 5229376 +
atcatcctggcttcaaggca

SEQ ID NO: 8968 - DNA, 20 bp, Artificial Sequence
  Synthetic oligonucleotide; GGG chr11 5229361 5229380 5229377 +
tcatcctggcttcaaggcag

SEQ ID NO: 8969 - DNA, 20 bp, Artificial Sequence
  Synthetic oligonucleotide; TGG chr11 5229376 5229395 5229392 +
ggcaggggttgcttttccaa

SEQ ID NO: 8970 - DNA, 20 bp, Artificial Sequence
  Synthetic oligonucleotide; TAG chr11 5229379 5229398 5229395 +
aggggttgcttttccaatgg

SEQ ID NO: 8971 - DNA, 20 bp, Artificial Sequence
  Synthetic oligonucleotide; TAG chr11 5229387 5229406 5229403 +
cttttccaatggtagttact

SEQ ID NO: 8972 - DNA, 20 bp, Artificial Sequence
  Synthetic oligonucleotide; TAG chr11 5229396 5229415 5229412 +
tggtagttacttagtgtgac

SEQ ID NO: 8973 - DNA, 20 bp, Artificial Sequence
  Synthetic oligonucleotide; GAG chr11 5229398 5229417 5229414 +
gtagttacttagtgtgacta

SEQ ID NO: 8974 - DNA, 20 bp, Artificial Sequence
  Synthetic oligonucleotide; CAG chr11 5229408 5229427 5229424 +
agtgtgactagagtgtaacg

SEQ ID NO: 8975 - DNA, 20 bp, Artificial Sequence
  Synthetic oligonucleotide; CAG chr11 5229441 5229460 5229457 +
ctattacccataataccctg

SEQ ID NO: 8976 - DNA, 20 bp, Artificial Sequence
  Synthetic oligonucleotide; AGG chr11 5229442 5229461 5229458 +
tattacccataataccctgc

SEQ ID NO: 8977 - DNA, 20 bp, Artificial Sequence
  Synthetic oligonucleotide; GGG chr11 5229443 5229462 5229459 +
attacccataataccctgca

SEQ ID NO: 8978 - DNA, 20 bp, Artificial Sequence
  Synthetic oligonucleotide; AAG chr11 5229448 5229467 5229464 +
ccataataccctgcagggac

SEQ ID NO: 8979 - DNA, 20 bp, Artificial Sequence
  Synthetic oligonucleotide; AGG chr11 5229449 5229468 5229465 +
cataataccctgcagggaca

SEQ ID NO: 8980 - DNA, 20 bp, Artificial Sequence
  Synthetic oligonucleotide; AAG chr11 5229456 5229475 5229472 +
ccctgcagggacaaggctgc

SEQ ID NO: 8981 - DNA, 20 bp, Artificial Sequence
  Synthetic oligonucleotide; AAG chr11 5229466 5229485 5229482 +
acaaggctgcaagctatact

SEQ ID NO: 8982 - DNA, 20 bp, Artificial Sequence
  Synthetic oligonucleotide; AAG chr11 5229477 5229496 5229493 +
agctatactaagaccatcaa

SEQ ID NO: 8983 - DNA, 20 bp, Artificial Sequence
  Synthetic oligonucleotide; CAG chr11 5229482 5229501 5229498 +
tactaagaccatcaaaagcc

SEQ ID NO: 8984 - DNA, 20 bp, Artificial Sequence
  Synthetic oligonucleotide; AGG chr11 5229483 5229502 5229499 +
actaagaccatcaaaagccc

SEQ ID NO: 8985 - DNA, 20 bp, Artificial Sequence
  Synthetic oligonucleotide; CAG chr11 5229491 5229510 5229507 +
catcaaaagcccaggcatac

SEQ ID NO: 8986 - DNA, 20 bp, Artificial Sequence
  Synthetic oligonucleotide; AGG chr11 5229492 5229511 5229508 +
atcaaaagcccaggcatacc

SEQ ID NO: 8987 - DNA, 20 bp, Artificial Sequence
  Synthetic oligonucleotide; AAG chr11 5229500 5229519 5229516 +
cccaggcataccaggcaaat

SEQ ID NO: 8988 - DNA, 20 bp, Artificial Sequence
  Synthetic oligonucleotide; AAG chr11 5229507 5229526 5229523 +
ataccaggcaaataagtttc

SEQ ID NO: 8989 - DNA, 20 bp, Artificial Sequence
  Synthetic oligonucleotide; AAG chr11 5229510 5229529 5229526 +
ccaggcaaataagtttcaag

SEQ ID NO: 8990 - DNA, 20 bp, Artificial Sequence
  Synthetic oligonucleotide; TAG chr11 5229520 5229539 5229536 +
aagtttcaagaagcaataaa

SEQ ID NO: 8991 - DNA, 20 bp, Artificial Sequence
  Synthetic oligonucleotide; TGG chr11 5229531 5229550 5229547 +
agcaataaatagtgcaaatt

SEQ ID NO: 8992 - DNA, 20 bp, Artificial Sequence
  Synthetic oligonucleotide; TGG chr11 5229537 5229556 5229553 +
aaatagtgcaaatttggtta

SEQ ID NO: 8993 - DNA, 20 bp, Artificial Sequence
  Synthetic oligonucleotide; CAG chr11 5229541 5229560 5229557 +
agtgcaaatttggttatggt

SEQ ID NO: 8994 - DNA, 20 bp, Artificial Sequence
  Synthetic oligonucleotide; GAG chr11 5229543 5229562 5229559 +
tgcaaatttggttatggtca

SEQ ID NO: 8995 - DNA, 20 bp, Artificial Sequence
  Synthetic oligonucleotide; CAG chr11 5229549 5229568 5229565 +
tttggttatggtcagagcct

SEQ ID NO: 8996 - DNA, 20 bp, Artificial Sequence
  Synthetic oligonucleotide; CAG chr11 5229566 5229585 5229582 +
cctcagtttcaaatctaaat

SEQ ID NO: 8997 - DNA, 20 bp, Artificial Sequence
  Synthetic oligonucleotide; AAG chr11 5229575 5229594 5229591 +
caaatctaaatcagcattca

SEQ ID NO: 8998 - DNA, 20 bp, Artificial Sequence
  Synthetic oligonucleotide; AAG chr11 5229595 5229614 5229611 +
aagttcctgaaaaactattc

SEQ ID NO: 8999 - DNA, 20 bp, Artificial Sequence
  Synthetic oligonucleotide; GAG chr11 5229621 5229640 5229637 +
actgacatcttcactattgt

SEQ ID NO: 9000 - DNA, 20 bp, Artificial Sequence
  Synthetic oligonucleotide; TGG chr11 5229643 5229662 5229659 +
gcttgcttctactctgtgaa

SEQ ID NO: 9001 - DNA, 20 bp, Artificial Sequence
  Synthetic oligonucleotide; CAG chr11 5229652 5229671 5229668 +
tactctgtgaatggatgcca

SEQ ID NO: 9002 - DNA, 20 bp, Artificial Sequence
  Synthetic oligonucleotide; CAG chr11 5229655 5229674 5229671 +
tctgtgaatggatgccacag

SEQ ID NO: 9003 - DNA, 20 bp, Artificial Sequence
  Synthetic oligonucleotide; AGG chr11 5229656 5229675 5229672 +
ctgtgaatggatgccacagc

SEQ ID NO: 9004 - DNA, 20 bp, Artificial Sequence
  Synthetic oligonucleotide; CAG chr11 5229661 5229680 5229677 +
aatggatgccacagcaggtg

SEQ ID NO: 9005 - DNA, 20 bp, Artificial Sequence
  Synthetic oligonucleotide; AGG chr11 5229662 5229681 5229678 +
atggatgccacagcaggtgc

SEQ ID NO: 9006 - DNA, 20 bp, Artificial Sequence
  Synthetic oligonucleotide; CAG chr11 5229683 5229702 5229699 +
ggtctattctacttttattc

SEQ ID NO: 9007 - DNA, 20 bp, Artificial Sequence
  Synthetic oligonucleotide; AAG chr11 5229734 5229753 5229750 +
acacacacacacacacacac

SEQ ID NO: 9008 - DNA, 20 bp, Artificial Sequence
  Synthetic oligonucleotide; AAG chr11 5229746 5229765 5229762 +
acacacacaagtcctcaaaa

SEQ ID NO: 9009 - DNA, 20 bp, Artificial Sequence
  Synthetic oligonucleotide; GAG chr11 5229748 5229767 5229764 +
acacacaagtcctcaaaaaa

SEQ ID NO: 9010 - DNA, 20 bp, Artificial Sequence
  Synthetic oligonucleotide; CAG chr11 5229752 5229771 5229768 +
acaagtcctcaaaaaagaga

SEQ ID NO: 9011 - DNA, 20 bp, Artificial Sequence
  Synthetic oligonucleotide; GAG chr11 5229756 5229775 5229772 +
gtcctcaaaaaagagacagc

SEQ ID NO: 9012 - DNA, 20 bp, Artificial Sequence
  Synthetic oligonucleotide; GAG chr11 5229758 5229777 5229774 +
cctcaaaaaagagacagcga

SEQ ID NO: 9013 - DNA, 20 bp, Artificial Sequence
  Synthetic oligonucleotide; GAG chr11 5229760 5229779 5229776 +
tcaaaaaagagacagcgaga

SEQ ID NO: 9014 - DNA, 20 bp, Artificial Sequence
  Synthetic oligonucleotide; CAG chr11 5229764 5229783 5229780 +
aaaagagacagcgagagaga

SEQ ID NO: 9015 - DNA, 20 bp, Artificial Sequence
  Synthetic oligonucleotide; GAG chr11 5229766 5229785 5229782 +
aagagacagcgagagagaca

SEQ ID NO: 9016 - DNA, 20 bp, Artificial Sequence
  Synthetic oligonucleotide; AGG chr11 5229767 5229786 5229783 +
agagacagcgagagagacag

SEQ ID NO: 9017 - DNA, 20 bp, Artificial Sequence
  Synthetic oligonucleotide; CAG chr11 5229786 5229805 5229802 +
gaggtccatttcctttactc

SEQ ID NO: 9018 - DNA, 20 bp, Artificial Sequence
  Synthetic oligonucleotide; AAG chr11 5229805 5229824 5229821 +
ccagtctattaatctttctt

SEQ ID NO: 9019 - DNA, 20 bp, Artificial Sequence
  Synthetic oligonucleotide; CAG chr11 5229824 5229843 5229840 +
taagtcctaatgttttatat

SEQ ID NO: 9020 - DNA, 20 bp, Artificial Sequence
  Synthetic oligonucleotide; TGG chr11 5229829 5229848 5229845 +
cctaatgttttatatcagaa

SEQ ID NO: 9021 - DNA, 20 bp, Artificial Sequence
  Synthetic oligonucleotide; TAG chr11 5229835 5229854 5229851 +
gttttatatcagaatggccc

SEQ ID NO: 9022 - DNA, 20 bp, Artificial Sequence
  Synthetic oligonucleotide; TGG chr11 5229840 5229859 5229856 +
atatcagaatggccctagtc

SEQ ID NO: 9023 - DNA, 20 bp, Artificial Sequence
  Synthetic oligonucleotide; GGG chr11 5229841 5229860 5229857 +
tatcagaatggccctagtct

SEQ ID NO: 9024 - DNA, 20 bp, Artificial Sequence
  Synthetic oligonucleotide; TAG chr11 5229850 5229869 5229866 +
ggccctagtctgggtatact

SEQ ID NO: 9025 - DNA, 20 bp, Artificial Sequence
  Synthetic oligonucleotide; GAG chr11 5229852 5229871 5229868 +
ccctagtctgggtatactta

SEQ ID NO: 9026 - DNA, 20 bp, Artificial Sequence
  Synthetic oligonucleotide; AGG chr11 5229853 5229872 5229869 +
cctagtctgggtatacttag

SEQ ID NO: 9027 - DNA, 20 bp, Artificial Sequence
  Synthetic oligonucleotide; TGG chr11 5229898 5229917 5229914 +
aaaatcatgacactcatcta

SEQ ID NO: 9028 - DNA, 20 bp, Artificial Sequence
  Synthetic oligonucleotide; GGG chr11 5229899 5229918 5229915 +
aaatcatgacactcatctat

SEQ ID NO: 9029 - DNA, 20 bp, Artificial Sequence
  Synthetic oligonucleotide; GAG chr11 5229901 5229920 5229917 +
atcatgacactcatctatgg

SEQ ID NO: 9030 - DNA, 20 bp, Artificial Sequence
  Synthetic oligonucleotide; TGG chr11 5229906 5229925 5229922 +
gacactcatctatgggagtg

SEQ ID NO: 9031 - DNA, 20 bp, Artificial Sequence
  Synthetic oligonucleotide; AAG chr11 5229927 5229946 5229943 +
ggttttatcatttgtttcaa

SEQ ID NO: 9032 - DNA, 20 bp, Artificial Sequence
  Synthetic oligonucleotide; CAG chr11 5229930 5229949 5229946 +
tttatcatttgtttcaaaag

SEQ ID NO: 9033 - DNA, 20 bp, Artificial Sequence
  Synthetic oligonucleotide; TAG chr11 5229941 5229960 5229957 +
tttcaaaagcagcacttgac

SEQ ID NO: 9034 - DNA, 20 bp, Artificial Sequence
  Synthetic oligonucleotide; GAG chr11 5229943 5229962 5229959 +
tcaaaagcagcacttgacta

SEQ ID NO: 9035 - DNA, 20 bp, Artificial Sequence
  Synthetic oligonucleotide; TAG chr11 5229970 5229989 5229986 +
tttatacatgctctactgtt

SEQ ID NO: 9036 - DNA, 20 bp, Artificial Sequence
  Synthetic oligonucleotide; AAG chr11 5229986 5230005 5230002 +
tgtttagtctaaaattcccc

SEQ ID NO: 9037 - DNA, 20 bp, Artificial Sequence
  Synthetic oligonucleotide; GAG chr11 5229990 5230009 5230006 +
tagtctaaaattccccaagt

SEQ ID NO: 9038 - DNA, 20 bp, Artificial Sequence
  Synthetic oligonucleotide; TAG chr11 5229999 5230018 5230015 +
attccccaagtgagacattt

SEQ ID NO: 9039 - DNA, 20 bp, Artificial Sequence
  Synthetic oligonucleotide; TAG chr11 5230022 5230041 5230038 +
caatctactgtatatgttcc

SEQ ID NO: 9040 - DNA, 20 bp, Artificial Sequence
  Synthetic oligonucleotide; AGG chr11 5230023 5230042 5230039 +
aatctactgtatatgttcct

SEQ ID NO: 9041 - DNA, 20 bp, Artificial Sequence
  Synthetic oligonucleotide; AAG chr11 5230028 5230047 5230044 +
actgtatatgttcctaggtc

SEQ ID NO: 9042 - DNA, 20 bp, Artificial Sequence
  Synthetic oligonucleotide; CAG chr11 5230033 5230052 5230049 +
atatgttcctaggtcaagca

SEQ ID NO: 9043 - DNA, 20 bp, Artificial Sequence
  Synthetic oligonucleotide; TAG chr11 5230038 5230057 5230054 +
ttcctaggtcaagcacagtc

SEQ ID NO: 9044 - DNA, 20 bp, Artificial Sequence
  Synthetic oligonucleotide; CAG chr11 5230051 5230070 5230067 +
cacagtctagctacttgcta

SEQ ID NO: 9045 - DNA, 20 bp, Artificial Sequence
  Synthetic oligonucleotide; CAG chr11 5230064 5230083 5230080 +
cttgctacagacttctctcg

SEQ ID NO: 9046 - DNA, 20 bp, Artificial Sequence
  Synthetic oligonucleotide; CAG chr11 5230080 5230099 5230096 +
ctcgcagatacacaatctct

SEQ ID NO: 9047 - DNA, 20 bp, Artificial Sequence
  Synthetic oligonucleotide; CAG chr11 5230094 5230113 5230110 +
atctctcagtaaacacaact

SEQ ID NO: 9048 - DNA, 20 bp, Artificial Sequence
  Synthetic oligonucleotide; CAG chr11 5230097 5230116 5230113 +
tctcagtaaacacaactcag

SEQ ID NO: 9049 - DNA, 20 bp, Artificial Sequence
  Synthetic oligonucleotide; CAG chr11 5230104 5230123 5230120 +
aaacacaactcagcagctct

SEQ ID NO: 9050 - DNA, 20 bp, Artificial Sequence
  Synthetic oligonucleotide; AAG chr11 5230140 5230159 5230156 +
aaatgaaataaaaatgctcc

SEQ ID NO: 9051 - DNA, 20 bp, Artificial Sequence
  Synthetic oligonucleotide; CAG chr11 5230148 5230167 5230164 +
taaaaatgctccaagaaaac

SEQ ID NO: 9052 - DNA, 20 bp, Artificial Sequence
  Synthetic oligonucleotide; TAG chr11 5230157 5230176 5230173 +
tccaagaaaaccagaaccca

SEQ ID NO: 9053 - DNA, 20 bp, Artificial Sequence
  Synthetic oligonucleotide; TAG chr11 5230183 5230202 5230199 +
caaaccgcacacacacaaaa

SEQ ID NO: 9054 - DNA, 20 bp, Artificial Sequence
  Synthetic oligonucleotide; TGG chr11 5230188 5230207 5230204 +
cgcacacacacaaaatagtt

SEQ ID NO: 9055 - DNA, 20 bp, Artificial Sequence
  Synthetic oligonucleotide; TAG chr11 5230194 5230213 5230210 +
cacacaaaatagtttggaaa

SEQ ID NO: 9056 - DNA, 20 bp, Artificial Sequence
  Synthetic oligonucleotide; AGG chr11 5230195 5230214 5230211 +
acacaaaatagtttggaaat

SEQ ID NO: 9057 - DNA, 20 bp, Artificial Sequence
  Synthetic oligonucleotide; TAG chr11 5230199 5230218 5230215 +
aaaatagtttggaaatagga

SEQ ID NO: 9058 - DNA, 20 bp, Artificial Sequence
  Synthetic oligonucleotide; TAG chr11 5230204 5230223 5230220 +
agtttggaaataggatagtt

SEQ ID NO: 9059 - DNA, 20 bp, Artificial Sequence
  Synthetic oligonucleotide; AAG chr11 5230218 5230237 5230234 +
atagtttagttcactttaaa

SEQ ID NO: 9060 - DNA, 20 bp, Artificial Sequence
  Synthetic oligonucleotide; AAG chr11 5230238 5230257 5230254 +
aagttgtatttcttaccaaa

SEQ ID NO: 9061 - DNA, 20 bp, Artificial Sequence
  Synthetic oligonucleotide; AAG chr11 5230246 5230265 5230262 +
tttcttaccaaaaagcaata

SEQ ID NO: 9062 - DNA, 20 bp, Artificial Sequence
  Synthetic oligonucleotide; TAG chr11 5230255 5230274 5230271 +
aaaaagcaataaagtcaaca

SEQ ID NO: 9063 - DNA, 20 bp, Artificial Sequence
  Synthetic oligonucleotide; CAG chr11 5230259 5230278 5230275 +
agcaataaagtcaacataga

SEQ ID NO: 9064 - DNA, 20 bp, Artificial Sequence
  Synthetic oligonucleotide; AAG chr11 5230272 5230291 5230288 +
acatagacagaactttgcta

SEQ ID NO: 9065 - DNA, 20 bp, Artificial Sequence
  Synthetic oligonucleotide; CAG chr11 5230292 5230311 5230308 +
aagtatatgcataattatta

SEQ ID NO: 9066 - DNA, 20 bp, Artificial Sequence
  Synthetic oligonucleotide; CAG chr11 5230309 5230328 5230325 +
ttacagaaaaatttatattt

SEQ ID NO: 9067 - DNA, 20 bp, Artificial Sequence
  Synthetic oligonucleotide; TGG chr11 5230343 5230362 5230359 +
ttcattaatatttcctccac

SEQ ID NO: 9068 - DNA, 20 bp, Artificial Sequence
  Synthetic oligonucleotide; GGG chr11 5230344 5230363 5230360 +
tcattaatatttcctccact

SEQ ID NO: 9069 - DNA, 20 bp, Artificial Sequence
  Synthetic oligonucleotide; CAG chr11 5230349 5230368 5230365 +
aatatttcctccactgggct

SEQ ID NO: 9070 - DNA, 20 bp, Artificial Sequence
  Synthetic oligonucleotide; CAG chr11 5230361 5230380 5230377 +
actgggctcagattttcatt

SEQ ID NO: 9071 - DNA, 20 bp, Artificial Sequence
  Synthetic oligonucleotide; TAG chr11 5230367 5230386 5230383 +
ctcagattttcattcagaat

SEQ ID NO: 9072 - DNA, 20 bp, Artificial Sequence
  Synthetic oligonucleotide; AAG chr11 5230388 5230407 5230404 +
agcttttttttaacctcatt

SEQ ID NO: 9073 - DNA, 20 bp, Artificial Sequence
  Synthetic oligonucleotide; TGG chr11 5230391 5230410 5230407 +
ttttttttaacctcattaag

SEQ ID NO: 9074 - DNA, 20 bp, Artificial Sequence
  Synthetic oligonucleotide; GGG chr11 5230392 5230411 5230408 +
tttttttaacctcattaagt

SEQ ID NO: 9075 - DNA, 20 bp, Artificial Sequence
  Synthetic oligonucleotide; TGG chr11 5230398 5230417 5230414 +
taacctcattaagtgggcca

SEQ ID NO: 9076 - DNA, 20 bp, Artificial Sequence
  Synthetic oligonucleotide; TGG chr11 5230411 5230430 5230427 +
tgggccatggtgtcaattta

SEQ ID NO: 9077 - DNA, 20 bp, Artificial Sequence
  Synthetic oligonucleotide; GAG chr11 5230413 5230432 5230429 +
ggccatggtgtcaatttatg

SEQ ID NO: 9078 - DNA, 20 bp, Artificial Sequence
  Synthetic oligonucleotide; GAG chr11 5230415 5230434 5230431 +
ccatggtgtcaatttatgga

SEQ ID NO: 9079 - DNA, 20 bp, Artificial Sequence
  Synthetic oligonucleotide; CAG chr11 5230418 5230437 5230434 +
tggtgtcaatttatggagag

SEQ ID NO: 9080 - DNA, 20 bp, Artificial Sequence
  Synthetic oligonucleotide; GAG chr11 5230420 5230439 5230436 +
gtgtcaatttatggagagca

SEQ ID NO: 9081 - DNA, 20 bp, Artificial Sequence
  Synthetic oligonucleotide; AGG chr11 5230421 5230440 5230437 +
tgtcaatttatggagagcag

SEQ ID NO: 9082 - DNA, 20 bp, Artificial Sequence
  Synthetic oligonucleotide; CAG chr11 5230426 5230445 5230442 +
atttatggagagcagaggta

SEQ ID NO: 9083 - DNA, 20 bp, Artificial Sequence
  Synthetic oligonucleotide; CAG chr11 5230433 5230452 5230449 +
gagagcagaggtacagtctt

SEQ ID NO: 9084 - DNA, 20 bp, Artificial Sequence
  Synthetic oligonucleotide; GAG chr11 5230444 5230463 5230460 +
tacagtcttcagataaattt

SEQ ID NO: 9085 - DNA, 20 bp, Artificial Sequence
  Synthetic oligonucleotide; TAG chr11 5230459 5230478 5230475 +
aatttgagattgcatctctt

SEQ ID NO: 9086 - DNA, 20 bp, Artificial Sequence
  Synthetic oligonucleotide; GAG chr11 5230461 5230480 5230477 +
tttgagattgcatctcttta

SEQ ID NO: 9087 - DNA, 20 bp, Artificial Sequence
  Synthetic oligonucleotide; AGG chr11 5230462 5230481 5230478 +
ttgagattgcatctctttag

SEQ ID NO: 9088 - DNA, 20 bp, Artificial Sequence
  Synthetic oligonucleotide; TAG chr11 5230465 5230484 5230481 +
agattgcatctctttagagg

SEQ ID NO: 9089 - DNA, 20 bp, Artificial Sequence
  Synthetic oligonucleotide; TGG chr11 5230473 5230492 5230489 +
tctctttagaggtagaatct

SEQ ID NO: 9090 - DNA, 20 bp, Artificial Sequence
  Synthetic oligonucleotide; CAG chr11 5230479 5230498 5230495 +
tagaggtagaatcttggctt

SEQ ID NO: 9091 - DNA, 20 bp, Artificial Sequence
  Synthetic oligonucleotide; TAG chr11 5230505 5230524 5230521 +
gaacaccctttacaaacatg

SEQ ID NO: 9092 - DNA, 20 bp, Artificial Sequence
  Synthetic oligonucleotide; AGG chr11 5230506 5230525 5230522 +
aacaccctttacaaacatgt

SEQ ID NO: 9093 - DNA, 20 bp, Artificial Sequence
  Synthetic oligonucleotide; CAG chr11 5230517 5230536 5230533 +
caaacatgtaggcattaatt

SEQ ID NO: 9094 - DNA, 20 bp, Artificial Sequence
  Synthetic oligonucleotide; GAG chr11 5230519 5230538 5230535 +
aacatgtaggcattaattca

SEQ ID NO: 9095 - DNA, 20 bp, Artificial Sequence
  Synthetic oligonucleotide; AGG chr11 5230520 5230539 5230536 +
acatgtaggcattaattcag

SEQ ID NO: 9096 - DNA, 20 bp, Artificial Sequence
  Synthetic oligonucleotide; AAG chr11 5230532 5230551 5230548 +
taattcagaggactgctctg

SEQ ID NO: 9097 - DNA, 20 bp, Artificial Sequence
  Synthetic oligonucleotide; AAG chr11 5230538 5230557 5230554 +
agaggactgctctgaagctc

SEQ ID NO: 9098 - DNA, 20 bp, Artificial Sequence
  Synthetic oligonucleotide; GAG chr11 5230540 5230559 5230556 +
aggactgctctgaagctcaa

SEQ ID NO: 9099 - DNA, 20 bp, Artificial Sequence
  Synthetic oligonucleotide; TGG chr11 5230544 5230563 5230560 +
ctgctctgaagctcaagaga

SEQ ID NO: 9100 - DNA, 20 bp, Artificial Sequence
  Synthetic oligonucleotide; TAG chr11 5230553 5230572 5230569 +
agctcaagagatggatgatt

SEQ ID NO: 9101 - DNA, 20 bp, Artificial Sequence
  Synthetic oligonucleotide; AGG chr11 5230554 5230573 5230570 +
gctcaagagatggatgattt

SEQ ID NO: 9102 - DNA, 20 bp, Artificial Sequence
  Synthetic oligonucleotide; GAG chr11 5230556 5230575 5230572 +
tcaagagatggatgatttag

SEQ ID NO: 9103 - DNA, 20 bp, Artificial Sequence
  Synthetic oligonucleotide; TAG chr11 5230564 5230583 5230580 +
tggatgatttaggagactat

SEQ ID NO: 9104 - DNA, 20 bp, Artificial Sequence
  Synthetic oligonucleotide; AGG chr11 5230565 5230584 5230581 +
ggatgatttaggagactatt

SEQ ID NO: 9105 - DNA, 20 bp, Artificial Sequence
  Synthetic oligonucleotide; CAG chr11 5230690 5230709 5230706 +
cacacacacaccctttcatt

SEQ ID NO: 9106 - DNA, 20 bp, Artificial Sequence
  Synthetic oligonucleotide; TAG chr11 5230705 5230724 5230721 +
tcattcagacatactgaaca

SEQ ID NO: 9107 - DNA, 20 bp, Artificial Sequence
  Synthetic oligonucleotide; AAG chr11 5230714 5230733 5230730 +
catactgaacatagtttata

SEQ ID NO: 9108 - DNA, 20 bp, Artificial Sequence
  Synthetic oligonucleotide; TAG chr11 5230725 5230744 5230741 +
tagtttataaagcaacgcca

SEQ ID NO: 9109 - DNA, 20 bp, Artificial Sequence
  Synthetic oligonucleotide; GAG chr11 5230729 5230748 5230745 +
ttataaagcaacgccatagt

SEQ ID NO: 9110 - DNA, 20 bp, Artificial Sequence
  Synthetic oligonucleotide; AAG chr11 5230734 5230753 5230750 +
aagcaacgccatagtgagaa

SEQ ID NO: 9111 - DNA, 20 bp, Artificial Sequence
  Synthetic oligonucleotide; AAG chr11 5230773 5230792 5230789 +
taaattatcaaataaaatta

SEQ ID NO: 9112 - DNA, 20 bp, Artificial Sequence
  Synthetic oligonucleotide; GAG chr11 5230785 5230804 5230801 +
taaaattaaagccaaatctt

SEQ ID NO: 9113 - DNA, 20 bp, Artificial Sequence
  Synthetic oligonucleotide; AGG chr11 5230786 5230805 5230802 +
aaaattaaagccaaatcttg

SEQ ID NO: 9114 - DNA, 20 bp, Artificial Sequence
  Synthetic oligonucleotide; TGG chr11 5230834 5230853 5230850 +
tttaactttcattttaaatt

SEQ ID NO: 9115 - DNA, 20 bp, Artificial Sequence
  Synthetic oligonucleotide; GGG chr11 5230835 5230854 5230851 +
ttaactttcattttaaattt

SEQ ID NO: 9116 - DNA, 20 bp, Artificial Sequence
  Synthetic oligonucleotide; GGG chr11 5230836 5230855 5230852 +
taactttcattttaaatttg

SEQ ID NO: 9117 - DNA, 20 bp, Artificial Sequence
  Synthetic oligonucleotide; GGG chr11 5230837 5230856 5230853 +
aactttcattttaaatttgg

SEQ ID NO: 9118 - DNA, 20 bp, Artificial Sequence
  Synthetic oligonucleotide; AAG chr11 5230849 5230868 5230865 +
aaatttgggggtacatgtac

SEQ ID NO: 9119 - DNA, 20 bp, Artificial Sequence
  Synthetic oligonucleotide; TAG chr11 5230857 5230876 5230873 +
gggtacatgtacaagttata

SEQ ID NO: 9120 - DNA, 20 bp, Artificial Sequence
  Synthetic oligonucleotide; AGG chr11 5230858 5230877 5230874 +
ggtacatgtacaagttatat

SEQ ID NO: 9121 - DNA, 20 bp, Artificial Sequence
  Synthetic oligonucleotide; TGG chr11 5230876 5230895 5230892 +
ataggtaaattgcatatcac

SEQ ID NO: 9122 - DNA, 20 bp, Artificial Sequence
  Synthetic oligonucleotide; GGG chr11 5230877 5230896 5230893 +
taggtaaattgcatatcact

SEQ ID NO: 9123 - DNA, 20 bp, Artificial Sequence
  Synthetic oligonucleotide; CAG chr11 5230890 5230909 5230906 +
tatcactgggtcttgatgta

SEQ ID NO: 9124 - DNA, 20 bp, Artificial Sequence
  Synthetic oligonucleotide; CAG chr11 5230907 5230926 5230923 +
gtacagattatttcatcact

SEQ ID NO: 9125 - DNA, 20 bp, Artificial Sequence
  Synthetic oligonucleotide; TAG chr11 5230929 5230948 5230945 +
gtgatgaacttaatacccaa

SEQ ID NO: 9126 - DNA, 20 bp, Artificial Sequence
  Synthetic oligonucleotide; AGG chr11 5230930 5230949 5230946 +
tgatgaacttaatacccaat

SEQ ID NO: 9127 - DNA, 20 bp, Artificial Sequence
  Synthetic oligonucleotide; AAG chr11 5230972 5230991 5230988 +
tcttcccaccctcaaccctc

SEQ ID NO: 9128 - DNA, 20 bp, Artificial Sequence
  Synthetic oligonucleotide; TAG chr11 5230975 5230994 5230991 +
tcccaccctcaaccctcaag

SEQ ID NO: 9129 - DNA, 20 bp, Artificial Sequence
  Synthetic oligonucleotide; AGG chr11 5230976 5230995 5230992 +
cccaccctcaaccctcaagt

SEQ ID NO: 9130 - DNA, 20 bp, Artificial Sequence
  Synthetic oligonucleotide; TGG chr11 5230981 5231000 5230997 +
cctcaaccctcaagtaggcc

SEQ ID NO: 9131 - DNA, 20 bp, Artificial Sequence
  Synthetic oligonucleotide; GGG chr11 5230982 5231001 5230998 +
ctcaaccctcaagtaggcct

SEQ ID NO: 9132 - DNA, 20 bp, Artificial Sequence
  Synthetic oligonucleotide; TAG chr11 5231026 5231045 5231042 +
tgtccatgtgtatcatcatt

SEQ ID NO: 9133 - DNA, 20 bp, Artificial Sequence
  Synthetic oligonucleotide; TAG chr11 5231041 5231060 5231057 +
tcatttagctcccacactcc

SEQ ID NO: 9134 - DNA, 20 bp, Artificial Sequence
  Synthetic oligonucleotide; AAG chr11 5231054 5231073 5231070 +
acactcctagactcttacaa

SEQ ID NO: 9135 - DNA, 20 bp, Artificial Sequence
  Synthetic oligonucleotide; AAG chr11 5231090 5231109 5231106 +
aataattttaatataacaac

SEQ ID NO: 9136 - DNA, 20 bp, Artificial Sequence
  Synthetic oligonucleotide; AGG chr11 5231091 5231110 5231107 +
ataattttaatataacaaca

SEQ ID NO: 9137 - DNA, 20 bp, Artificial Sequence
  Synthetic oligonucleotide; AAG chr11 5231098 5231117 5231114 +
taatataacaacaaggtgcc

SEQ ID NO: 9138 - DNA, 20 bp, Artificial Sequence
  Synthetic oligonucleotide; AAG chr11 5231138 5231157 5231154 +
acctcctcatcttcaatatg

SEQ ID NO: 9139 - DNA, 20 bp, Artificial Sequence
  Synthetic oligonucleotide; TAG chr11 5231142 5231161 5231158 +
cctcatcttcaatatgaaga

SEQ ID NO: 9140 - DNA, 20 bp, Artificial Sequence
  Synthetic oligonucleotide; TAG chr11 5231152 5231171 5231168 +
aatatgaagatagcaatgcc

SEQ ID NO: 9141 - DNA, 20 bp, Artificial Sequence
  Synthetic oligonucleotide; TAG chr11 5231159 5231178 5231175 +
agatagcaatgcctagcata

SEQ ID NO: 9142 - DNA, 20 bp, Artificial Sequence
  Synthetic oligonucleotide; CGG chr11 5231176 5231195 5231192 +
atatagtaattgtgtgtgct

SEQ ID NO: 9143 - DNA, 20 bp, Artificial Sequence
  Synthetic oligonucleotide; CAG chr11 5231192 5231211 5231208 +
tgctcggcacatgtcccatc

SEQ ID NO: 9144 - DNA, 20 bp, Artificial Sequence
  Synthetic oligonucleotide; AGG chr11 5231193 5231212 5231209 +
gctcggcacatgtcccatcc

SEQ ID NO: 9145 - DNA, 20 bp, Artificial Sequence
  Synthetic oligonucleotide; TGG chr11 5231216 5231235 5231232 +
tgatgttctcatgaattctc

SEQ ID NO: 9146 - DNA, 20 bp, Artificial Sequence
  Synthetic oligonucleotide; TGG chr11 5231223 5231242 5231239 +
ctcatgaattctctggtatt

SEQ ID NO: 9147 - DNA, 20 bp, Artificial Sequence
  Synthetic oligonucleotide; TAG chr11 5231231 5231250 5231247 +
ttctctggtatttggatttt

SEQ ID NO: 9148 - DNA, 20 bp, Artificial Sequence
  Synthetic oligonucleotide; AGG chr11 5231232 5231251 5231248 +
tctctggtatttggattttt

SEQ ID NO: 9149 - DNA, 20 bp, Artificial Sequence
  Synthetic oligonucleotide; GGG chr11 5231233 5231252 5231249 +
ctctggtatttggattttta

SEQ ID NO: 9150 - DNA, 20 bp, Artificial Sequence
  Synthetic oligonucleotide; TAG chr11 5231249 5231268 5231265 +
tttagggccaacatcttgcc

SEQ ID NO: 9151 - DNA, 20 bp, Artificial Sequence
  Synthetic oligonucleotide; TGG chr11 5231271 5231290 5231287 +
gactcactgactacttctaa

SEQ ID NO: 9152 - DNA, 20 bp, Artificial Sequence
  Synthetic oligonucleotide; TAG chr11 5231276 5231295 5231292 +
actgactacttctaatggtg

SEQ ID NO: 9153 - DNA, 20 bp, Artificial Sequence
  Synthetic oligonucleotide; AGG chr11 5231277 5231296 5231293 +
ctgactacttctaatggtgt

SEQ ID NO: 9154 - DNA, 20 bp, Artificial Sequence
  Synthetic oligonucleotide; TAG chr11 5231282 5231301 5231298 +
tacttctaatggtgtaggaa

SEQ ID NO: 9155 - DNA, 20 bp, Artificial Sequence
  Synthetic oligonucleotide; AAG chr11 5231285 5231304 5231301 +
ttctaatggtgtaggaatag

SEQ ID NO: 9156 - DNA, 20 bp, Artificial Sequence
  Synthetic oligonucleotide; AGG chr11 5231286 5231305 5231302 +
tctaatggtgtaggaataga

SEQ ID NO: 9157 - DNA, 20 bp, Artificial Sequence
  Synthetic oligonucleotide; TAG chr11 5231291 5231310 5231307 +
tggtgtaggaatagaaggta

SEQ ID NO: 9158 - DNA, 20 bp, Artificial Sequence
  Synthetic oligonucleotide; AAG chr11 5231295 5231314 5231311 +
gtaggaatagaaggtatagt

SEQ ID NO: 9159 - DNA, 20 bp, Artificial Sequence
  Synthetic oligonucleotide; TGG chr11 5231325 5231344 5231341 +
tgctctttttttttgacttt

SEQ ID NO: 9160 - DNA, 20 bp, Artificial Sequence
  Synthetic oligonucleotide; GAG chr11 5231327 5231346 5231343 +
ctctttttttttgacttttg

SEQ ID NO: 9161 - DNA, 20 bp, Artificial Sequence
  Synthetic oligonucleotide; AAG chr11 5231331 5231350 5231347 +
ttttttttgacttttggaga

SEQ ID NO: 9162 - DNA, 20 bp, Artificial Sequence
  Synthetic oligonucleotide; AGG chr11 5231332 5231351 5231348 +
tttttttgacttttggagaa

SEQ ID NO: 9163 - DNA, 20 bp, Artificial Sequence
  Synthetic oligonucleotide; TAG chr11 5231339 5231358 5231355 +
gacttttggagaaaggaatg

SEQ ID NO: 9164 - DNA, 20 bp, Artificial Sequence
  Synthetic oligonucleotide; AAG chr11 5231357 5231376 5231373 +
tgtagtttgttttccctatc

SEQ ID NO: 9165 - DNA, 20 bp, Artificial Sequence
  Synthetic oligonucleotide; AAG chr11 5231365 5231384 5231381 +
gttttccctatcaagatcat

SEQ ID NO: 9166 - DNA, 20 bp, Artificial Sequence
  Synthetic oligonucleotide; AGG chr11 5231366 5231385 5231382 +
ttttccctatcaagatcata

SEQ ID NO: 9167 - DNA, 20 bp, Artificial Sequence
  Synthetic oligonucleotide; AAG chr11 5231405 5231424 5231421 +
ctgtctttcgaataccacac

SEQ ID NO: 9168 - DNA, 20 bp, Artificial Sequence
  Synthetic oligonucleotide; GAG chr11 5231435 5231454 5231451 +
ttttaatatcttactcttat

SEQ ID NO: 9169 - DNA, 20 bp, Artificial Sequence
  Synthetic oligonucleotide; CAG chr11 5231452 5231471 5231468 +
tatgagaacttccctatgct

SEQ ID NO: 9170 - DNA, 20 bp, Artificial Sequence
  Synthetic oligonucleotide; AGG chr11 5231453 5231472 5231469 +
atgagaacttccctatgctc

SEQ ID NO: 9171 - DNA, 20 bp, Artificial Sequence
  Synthetic oligonucleotide; AAG chr11 5231463 5231482 5231479 +
ccctatgctcaggaatgtga

SEQ ID NO: 9172 - DNA, 20 bp, Artificial Sequence
  Synthetic oligonucleotide; GAG chr11 5231487 5231506 5231503 +
gatcttccccaaaatgccct

SEQ ID NO: 9173 - DNA, 20 bp, Artificial Sequence
  Synthetic oligonucleotide; TAG chr11 5231490 5231509 5231506 +
cttccccaaaatgccctgag

SEQ ID NO: 9174 - DNA, 20 bp, Artificial Sequence
  Synthetic oligonucleotide; CAG chr11 5231514 5231533 5231530 +
tctgcttctgatatgtaaac

SEQ ID NO: 9175 - DNA, 20 bp, Artificial Sequence
  Synthetic oligonucleotide; TGG chr11 5231517 5231536 5231533 +
gcttctgatatgtaaaccag

SEQ ID NO: 9176 - DNA, 20 bp, Artificial Sequence
  Synthetic oligonucleotide; CAG chr11 5231537 5231556 5231553 +
tggttcctaaatatcttatt

SEQ ID NO: 9177 - DNA, 20 bp, Artificial Sequence
  Synthetic oligonucleotide; AAG chr11 5231545 5231564 5231561 +
aaatatcttattcagatata

SEQ ID NO: 9178 - DNA, 20 bp, Artificial Sequence
  Synthetic oligonucleotide; GAG chr11 5231547 5231566 5231563 +
atatcttattcagatataaa

SEQ ID NO: 9179 - DNA, 20 bp, Artificial Sequence
  Synthetic oligonucleotide; CAG chr11 5231554 5231573 5231570 +
attcagatataaagagttct

SEQ ID NO: 9180 - DNA, 20 bp, Artificial Sequence
  Synthetic oligonucleotide; AAG chr11 5231579 5231598 5231595 +
cctactatgtataatgactt

SEQ ID NO: 9181 - DNA, 20 bp, Artificial Sequence
  Synthetic oligonucleotide; AGG chr11 5231580 5231599 5231596 +
ctactatgtataatgactta

SEQ ID NO: 9182 - DNA, 20 bp, Artificial Sequence
  Synthetic oligonucleotide; TGG chr11 5231591 5231610 5231607 +
aatgacttaaggaaaacaca

SEQ ID NO: 9183 - DNA, 20 bp, Artificial Sequence
  Synthetic oligonucleotide; AAG chr11 5231600 5231619 5231616 +
aggaaaacacatggatataa

SEQ ID NO: 9184 - DNA, 20 bp, Artificial Sequence
  Synthetic oligonucleotide; GAG chr11 5231602 5231621 5231618 +
gaaaacacatggatataaaa

SEQ ID NO: 9185 - DNA, 20 bp, Artificial Sequence
  Synthetic oligonucleotide; CAG chr11 5231615 5231634 5231631 +
tataaaagagcttctgctgc

SEQ ID NO: 9186 - DNA, 20 bp, Artificial Sequence
  Synthetic oligonucleotide; CAG chr11 5231643 5231662 5231659 +
tcaaaatgttgtgatcaaaa

SEQ ID NO: 9187 - DNA, 20 bp, Artificial Sequence
  Synthetic oligonucleotide; CAG chr11 5231664 5231683 5231680 +
agttaactataacacattgt

SEQ ID NO: 9188 - DNA, 20 bp, Artificial Sequence
  Synthetic oligonucleotide; TGG chr11 5231674 5231693 5231690 +
aacacattgtcagtatattc

SEQ ID NO: 9189 - DNA, 20 bp, Artificial Sequence
  Synthetic oligonucleotide; CAG chr11 5231677 5231696 5231693 +
acattgtcagtatattctgg

SEQ ID NO: 9190 - DNA, 20 bp, Artificial Sequence
  Synthetic oligonucleotide; CAG chr11 5231682 5231701 5231698 +
gtcagtatattctggcagta

SEQ ID NO: 9191 - DNA, 20 bp, Artificial Sequence
  Synthetic oligonucleotide; CAG chr11 5231686 5231705 5231702 +
gtatattctggcagtacaga

SEQ ID NO: 9192 - DNA, 20 bp, Artificial Sequence
  Synthetic oligonucleotide; GAG chr11 5231688 5231707 5231704 +
atattctggcagtacagaca

SEQ ID NO: 9193 - DNA, 20 bp, Artificial Sequence
  Synthetic oligonucleotide; AAG chr11 5231700 5231719 5231716 +
tacagacagagttactgtga

SEQ ID NO: 9194 - DNA, 20 bp, Artificial Sequence
  Synthetic oligonucleotide; AAG chr11 5231716 5231735 5231732 +
gtgaaagcactttcaaacac

SEQ ID NO: 9195 - DNA, 20 bp, Artificial Sequence
  Synthetic oligonucleotide; AGG chr11 5231717 5231736 5231733 +
tgaaagcactttcaaacaca

SEQ ID NO: 9196 - DNA, 20 bp, Artificial Sequence
  Synthetic oligonucleotide; CAG chr11 5231726 5231745 5231742 +
tttcaaacacaaggaaacaa

SEQ ID NO: 9197 - DNA, 20 bp, Artificial Sequence
  Synthetic oligonucleotide; TAG chr11 5231737 5231756 5231753 +
aggaaacaacagattctgtt

SEQ ID NO: 9198 - DNA, 20 bp, Artificial Sequence
  Synthetic oligonucleotide; AGG chr11 5231738 5231757 5231754 +
ggaaacaacagattctgttt

SEQ ID NO: 9199 - DNA, 20 bp, Artificial Sequence
  Synthetic oligonucleotide; AAG chr11 5231746 5231765 5231762 +
cagattctgtttaggtattc

SEQ ID NO: 9200 - DNA, 20 bp, Artificial Sequence
  Synthetic oligonucleotide; AAG chr11 5231750 5231769 5231766 +
ttctgtttaggtattcaagt

SEQ ID NO: 9201 - DNA, 20 bp, Artificial Sequence
  Synthetic oligonucleotide; CAG chr11 5231781 5231800 5231797 +
taatcaacatgcatataata

SEQ ID NO: 9202 - DNA, 20 bp, Artificial Sequence
  Synthetic oligonucleotide; GAG chr11 5231806 5231825 5231822 +
ttttaaaaatgtatacaact

SEQ ID NO: 9203 - DNA, 20 bp, Artificial Sequence
  Synthetic oligonucleotide; AAG chr11 5231810 5231829 5231826 +
aaaaatgtatacaactgaga

SEQ ID NO: 9204 - DNA, 20 bp, Artificial Sequence
  Synthetic oligonucleotide; TGG chr11 5231840 5231859 5231856 +
aatccttctaattttaccta

SEQ ID NO: 9205 - DNA, 20 bp, Artificial Sequence
  Synthetic oligonucleotide; TGG chr11 5231849 5231868 5231865 +
aattttacctatggcaaaaa

SEQ ID NO: 9206 - DNA, 20 bp, Artificial Sequence
  Synthetic oligonucleotide; AAG chr11 5231857 5231876 5231873 +
ctatggcaaaaatggtgctc

SEQ ID NO: 9207 - DNA, 20 bp, Artificial Sequence
  Synthetic oligonucleotide; AGG chr11 5231858 5231877 5231874 +
tatggcaaaaatggtgctca

SEQ ID NO: 9208 - DNA, 20 bp, Artificial Sequence
  Synthetic oligonucleotide; CAG chr11 5231883 5231902 5231899 +
aaaaatattactcctatgat

SEQ ID NO: 9209 - DNA, 20 bp, Artificial Sequence
  Synthetic oligonucleotide; AAG chr11 5231887 5231906 5231903 +
atattactcctatgatcaga

SEQ ID NO: 9210 - DNA, 20 bp, Artificial Sequence
  Synthetic oligonucleotide; AGG chr11 5231888 5231907 5231904 +
tattactcctatgatcagaa

SEQ ID NO: 9211 - DNA, 20 bp, Artificial Sequence
  Synthetic oligonucleotide; CGG chr11 5231902 5231921 5231918 +
tcagaaaggaaataactgtt

SEQ ID NO: 9212 - DNA, 20 bp, Artificial Sequence
  Synthetic oligonucleotide; TAG chr11 5231937 5231956 5231953 +
tgcttcctctttgtatgttg

SEQ ID NO: 9213 - DNA, 20 bp, Artificial Sequence
  Synthetic oligonucleotide; AAG chr11 5231951 5231970 5231967 +
atgttgtagcattaacaaca

SEQ ID NO: 9214 - DNA, 20 bp, Artificial Sequence
  Synthetic oligonucleotide; TGG chr11 5231967 5231986 5231983 +
aacaaagaaacactgtgcga

SEQ ID NO: 9215 - DNA, 20 bp, Artificial Sequence
  Synthetic oligonucleotide; CAG chr11 5231995 5232014 5232011 +
ttaatattgtcctctaattc

SEQ ID NO: 9216 - DNA, 20 bp, Artificial Sequence
  Synthetic oligonucleotide; AAG chr11 5231998 5232017 5232014 +
atattgtcctctaattccag

SEQ ID NO: 9217 - DNA, 20 bp, Artificial Sequence
  Synthetic oligonucleotide; AAG chr11 5232006 5232025 5232022 +
ctctaattccagaagttcta

SEQ ID NO: 9218 - DNA, 20 bp, Artificial Sequence
  Synthetic oligonucleotide; AAG chr11 5232010 5232029 5232026 +
aattccagaagttctaaagc

SEQ ID NO: 9219 - DNA, 20 bp, Artificial Sequence
  Synthetic oligonucleotide; AGG chr11 5232011 5232030 5232027 +
attccagaagttctaaagca

SEQ ID NO: 9220 - DNA, 20 bp, Artificial Sequence
  Synthetic oligonucleotide; GAG chr11 5232112 5232131 5232128 +
cccattgatgaatttaatat

SEQ ID NO: 9221 - DNA, 20 bp, Artificial Sequence
  Synthetic oligonucleotide; AGG chr11 5232113 5232132 5232129 +
ccattgatgaatttaatatg

SEQ ID NO: 9222 - DNA, 20 bp, Artificial Sequence
  Synthetic oligonucleotide; CAG chr11 5232118 5232137 5232134 +
gatgaatttaatatgaggca

SEQ ID NO: 9223 - DNA, 20 bp, Artificial Sequence
  Synthetic oligonucleotide; TAG chr11 5232121 5232140 5232137 +
gaatttaatatgaggcacag

SEQ ID NO: 9224 - DNA, 20 bp, Artificial Sequence
  Synthetic oligonucleotide; AGG chr11 5232122 5232141 5232138 +
aatttaatatgaggcacagt

SEQ ID NO: 9225 - DNA, 20 bp, Artificial Sequence
  Synthetic oligonucleotide; AAG chr11 5232130 5232149 5232146 +
atgaggcacagtaggcatgt

SEQ ID NO: 9226 - DNA, 20 bp, Artificial Sequence
  Synthetic oligonucleotide; AAG chr11 5232133 5232152 5232149 +
aggcacagtaggcatgtaag

SEQ ID NO: 9227 - DNA, 20 bp, Artificial Sequence
  Synthetic oligonucleotide; AGG chr11 5232134 5232153 5232150 +
ggcacagtaggcatgtaaga

SEQ ID NO: 9228 - DNA, 20 bp, Artificial Sequence
  Synthetic oligonucleotide; TAG chr11 5232137 5232156 5232153 +
acagtaggcatgtaagaagg

SEQ ID NO: 9229 - DNA, 20 bp, Artificial Sequence
  Synthetic oligonucleotide; GAG chr11 5232139 5232158 5232155 +
agtaggcatgtaagaaggta

SEQ ID NO: 9230 - DNA, 20 bp, Artificial Sequence
  Synthetic oligonucleotide; TAG chr11 5232144 5232163 5232160 +
gcatgtaagaaggtagagaa

SEQ ID NO: 9231 - DNA, 20 bp, Artificial Sequence
  Synthetic oligonucleotide; AGG chr11 5232145 5232164 5232161 +
catgtaagaaggtagagaat

SEQ ID NO: 9232 - DNA, 20 bp, Artificial Sequence
  Synthetic oligonucleotide; CAG chr11 5232148 5232167 5232164 +
gtaagaaggtagagaatagg

SEQ ID NO: 9233 - DNA, 20 bp, Artificial Sequence
  Synthetic oligonucleotide; AAG chr11 5232162 5232181 5232178 +
aataggcagaattgcttata

SEQ ID NO: 9234 - DNA, 20 bp, Artificial Sequence
  Synthetic oligonucleotide; CGG chr11 5232167 5232186 5232183 +
gcagaattgcttataaagca

SEQ ID NO: 9235 - DNA, 20 bp, Artificial Sequence
  Synthetic oligonucleotide; GAG chr11 5232169 5232188 5232185 +
agaattgcttataaagcacg

SEQ ID NO: 9236 - DNA, 20 bp, Artificial Sequence
  Synthetic oligonucleotide; AAG chr11 5232196 5232215 5232212 +
tgtgtgtgcatgaaataaat

SEQ ID NO: 9237 - DNA, 20 bp, Artificial Sequence
  Synthetic oligonucleotide; TGG chr11 5232221 5232240 5232237 +
aaatataaaaatataaaaaa

SEQ ID NO: 9238 - DNA, 20 bp, Artificial Sequence
  Synthetic oligonucleotide; TGG chr11 5232226 5232245 5232242 +
taaaaatataaaaaatggtg

SEQ ID NO: 9239 - DNA, 20 bp, Artificial Sequence
  Synthetic oligonucleotide; GGG chr11 5232227 5232246 5232243 +
aaaaatataaaaaatggtgt

SEQ ID NO: 9240 - DNA, 20 bp, Artificial Sequence
  Synthetic oligonucleotide; GGG chr11 5232228 5232247 5232244 +
aaaatataaaaaatggtgtg

SEQ ID NO: 9241 - DNA, 20 bp, Artificial Sequence
  Synthetic oligonucleotide; GGG chr11 5232229 5232248 5232245 +
aaatataaaaaatggtgtgg

SEQ ID NO: 9242 - DNA, 20 bp, Artificial Sequence
  Synthetic oligonucleotide; GAG chr11 5232231 5232250 5232247 +
atataaaaaatggtgtgggg

SEQ ID NO: 9243 - DNA, 20 bp, Artificial Sequence
  Synthetic oligonucleotide; AGG chr11 5232232 5232251 5232248 +
tataaaaaatggtgtggggg

SEQ ID NO: 9244 - DNA, 20 bp, Artificial Sequence
  Synthetic oligonucleotide; GGG chr11 5232233 5232252 5232249 +
ataaaaaatggtgtggggga

SEQ ID NO: 9245 - DNA, 20 bp, Artificial Sequence
  Synthetic oligonucleotide; TGG chr11 5232238 5232257 5232254 +
aaatggtgtgggggagggtt

SEQ ID NO: 9246 - DNA, 20 bp, Artificial Sequence
  Synthetic oligonucleotide; AAG chr11 5232242 5232261 5232258 +
ggtgtgggggagggtttgga

SEQ ID NO: 9247 - DNA, 20 bp, Artificial Sequence
  Synthetic oligonucleotide; TGG chr11 5232251 5232270 5232267 +
gagggtttggaaagattttt

SEQ ID NO: 9248 - DNA, 20 bp, Artificial Sequence
  Synthetic oligonucleotide; GGG chr11 5232252 5232271 5232268 +
agggtttggaaagatttttt

SEQ ID NO: 9249 - DNA, 20 bp, Artificial Sequence
  Synthetic oligonucleotide; TAG chr11 5232255 5232274 5232271 +
gtttggaaagattttttggg

SEQ ID NO: 9250 - DNA, 20 bp, Artificial Sequence
  Synthetic oligonucleotide; TAG chr11 5232260 5232279 5232276 +
gaaagattttttgggtagta

SEQ ID NO: 9251 - DNA, 20 bp, Artificial Sequence
  Synthetic oligonucleotide; GAG chr11 5232262 5232281 5232278 +
aagattttttgggtagtata

SEQ ID NO: 9252 - DNA, 20 bp, Artificial Sequence
  Synthetic oligonucleotide; AAG chr11 5232265 5232284 5232281 +
attttttgggtagtatagag

SEQ ID NO: 9253 - DNA, 20 bp, Artificial Sequence
  Synthetic oligonucleotide; TGG chr11 5232275 5232294 5232291 +
tagtatagagaagtttattg

SEQ ID NO: 9254 - DNA, 20 bp, Artificial Sequence
  Synthetic oligonucleotide; TGG chr11 5232279 5232298 5232295 +
atagagaagtttattgtggc

SEQ ID NO: 9255 - DNA, 20 bp, Artificial Sequence
  Synthetic oligonucleotide; GGG chr11 5232280 5232299 5232296 +
tagagaagtttattgtggct

SEQ ID NO: 9256 - DNA, 20 bp, Artificial Sequence
  Synthetic oligonucleotide; GGG chr11 5232281 5232300 5232297 +
agagaagtttattgtggctg

SEQ ID NO: 9257 - DNA, 20 bp, Artificial Sequence
  Synthetic oligonucleotide; AAG chr11 5232286 5232305 5232302 +
agtttattgtggctggggtc

SEQ ID NO: 9258 - DNA, 20 bp, Artificial Sequence
  Synthetic oligonucleotide; GAG chr11 5232288 5232307 5232304 +
tttattgtggctggggtcaa

SEQ ID NO: 9259 - DNA, 20 bp, Artificial Sequence
  Synthetic oligonucleotide; GAG chr11 5232290 5232309 5232306 +
tattgtggctggggtcaaga

SEQ ID NO: 9260 - DNA, 20 bp, Artificial Sequence
  Synthetic oligonucleotide; AGG chr11 5232291 5232310 5232307 +
attgtggctggggtcaagag

SEQ ID NO: 9261 - DNA, 20 bp, Artificial Sequence
  Synthetic oligonucleotide; AAG chr11 5232298 5232317 5232314 +
ctggggtcaagagaggtcac

SEQ ID NO: 9262 - DNA, 20 bp, Artificial Sequence
  Synthetic oligonucleotide; GAG chr11 5232309 5232328 5232325 +
agaggtcacaagtaatacgt

SEQ ID NO: 9263 - DNA, 20 bp, Artificial Sequence
  Synthetic oligonucleotide; TGG chr11 5232333 5232352 5232349 +
aatgaatcttgactgaaata

SEQ ID NO: 9264 - DNA, 20 bp, Artificial Sequence
  Synthetic oligonucleotide; GGG chr11 5232334 5232353 5232350 +
atgaatcttgactgaaatat

SEQ ID NO: 9265 - DNA, 20 bp, Artificial Sequence
  Synthetic oligonucleotide; AAG chr11 5232337 5232356 5232353 +
aatcttgactgaaatatggg

SEQ ID NO: 9266 - DNA, 20 bp, Artificial Sequence
  Synthetic oligonucleotide; AAG chr11 5232342 5232361 5232358 +
tgactgaaatatgggaagat

SEQ ID NO: 9267 - DNA, 20 bp, Artificial Sequence
  Synthetic oligonucleotide; GAG chr11 5232344 5232363 5232360 +
actgaaatatgggaagataa

SEQ ID NO: 9268 - DNA, 20 bp, Artificial Sequence
  Synthetic oligonucleotide; AGG chr11 5232345 5232364 5232361 +
ctgaaatatgggaagataag

SEQ ID NO: 9269 - DNA, 20 bp, Artificial Sequence
  Synthetic oligonucleotide; CAG chr11 5232358 5232377 5232374 +
agataagaggaaattcttta

SEQ ID NO: 9270 - DNA, 20 bp, Artificial Sequence
  Synthetic oligonucleotide; GAG chr11 5232360 5232379 5232376 +
ataagaggaaattctttaca

SEQ ID NO: 9271 - DNA, 20 bp, Artificial Sequence
  Synthetic oligonucleotide; TGG chr11 5232369 5232388 5232385 +
aattctttacagagatgttc

SEQ ID NO: 9272 - DNA, 20 bp, Artificial Sequence
  Synthetic oligonucleotide; GGG chr11 5232370 5232389 5232386 +
attctttacagagatgttct

SEQ ID NO: 9273 - DNA, 20 bp, Artificial Sequence
  Synthetic oligonucleotide; GGG chr11 5232371 5232390 5232387 +
ttctttacagagatgttctg

SEQ ID NO: 9274 - DNA, 20 bp, Artificial Sequence
  Synthetic oligonucleotide; AAG chr11 5232375 5232394 5232391 +
ttacagagatgttctggggc

SEQ ID NO: 9275 - DNA, 20 bp, Artificial Sequence
  Synthetic oligonucleotide; AAG chr11 5232379 5232398 5232395 +
agagatgttctggggcaagt

SEQ ID NO: 9276 - DNA, 20 bp, Artificial Sequence
  Synthetic oligonucleotide; GAG chr11 5232381 5232400 5232397 +
agatgttctggggcaagtaa

SEQ ID NO: 9277 - DNA, 20 bp, Artificial Sequence
  Synthetic oligonucleotide; AGG chr11 5232382 5232401 5232398 +
gatgttctggggcaagtaag

SEQ ID NO: 9278 - DNA, 20 bp, Artificial Sequence
  Synthetic oligonucleotide; GAG chr11 5232384 5232403 5232400 +
tgttctggggcaagtaagag

SEQ ID NO: 9279 - DNA, 20 bp, Artificial Sequence
  Synthetic oligonucleotide; AGG chr11 5232385 5232404 5232401 +
gttctggggcaagtaagagg

SEQ ID NO: 9280 - DNA, 20 bp, Artificial Sequence
  Synthetic oligonucleotide; AAG chr11 5232388 5232407 5232404 +
ctggggcaagtaagaggagg

SEQ ID NO: 9281 - DNA, 20 bp, Artificial Sequence
  Synthetic oligonucleotide; TGG chr11 5232399 5232418 5232415 +
aagaggaggaagctatttct

SEQ ID NO: 9282 - DNA, 20 bp, Artificial Sequence
  Synthetic oligonucleotide; GAG chr11 5232401 5232420 5232417 +
gaggaggaagctatttcttg

SEQ ID NO: 9283 - DNA, 20 bp, Artificial Sequence
  Synthetic oligonucleotide; CAG chr11 5232404 5232423 5232420 +
gaggaagctatttcttggag

SEQ ID NO: 9284 - DNA, 20 bp, Artificial Sequence
  Synthetic oligonucleotide; AGG chr11 5232405 5232424 5232421 +
aggaagctatttcttggagc

SEQ ID NO: 9285 - DNA, 20 bp, Artificial Sequence
  Synthetic oligonucleotide; TGG chr11 5232417 5232436 5232433 +
cttggagcaggaacacttga

SEQ ID NO: 9286 - DNA, 20 bp, Artificial Sequence
  Synthetic oligonucleotide; GGG chr11 5232418 5232437 5232434 +
ttggagcaggaacacttgat

SEQ ID NO: 9287 - DNA, 20 bp, Artificial Sequence
  Synthetic oligonucleotide; GGG chr11 5232419 5232438 5232435 +
tggagcaggaacacttgatg

SEQ ID NO: 9288 - DNA, 20 bp, Artificial Sequence
  Synthetic oligonucleotide; TAG chr11 5232424 5232443 5232440 +
caggaacacttgatggggta

SEQ ID NO: 9289 - DNA, 20 bp, Artificial Sequence
  Synthetic oligonucleotide; TGG chr11 5232432 5232451 5232448 +
cttgatggggtatagtatta

SEQ ID NO: 9290 - DNA, 20 bp, Artificial Sequence
  Synthetic oligonucleotide; GGG chr11 5232433 5232452 5232449 +
ttgatggggtatagtattat

SEQ ID NO: 9291 - DNA, 20 bp, Artificial Sequence
  Synthetic oligonucleotide; CAG chr11 5232446 5232465 5232462 +
gtattatgggctacaatgtg

SEQ ID NO: 9292 - DNA, 20 bp, Artificial Sequence
  Synthetic oligonucleotide; AGG chr11 5232447 5232466 5232463 +
tattatgggctacaatgtgc

SEQ ID NO: 9293 - DNA, 20 bp, Artificial Sequence
  Synthetic oligonucleotide; AAG chr11 5232452 5232471 5232468 +
tgggctacaatgtgcaggca

SEQ ID NO: 9294 - DNA, 20 bp, Artificial Sequence
  Synthetic oligonucleotide; AGG chr11 5232453 5232472 5232469 +
gggctacaatgtgcaggcaa

SEQ ID NO: 9295 - DNA, 20 bp, Artificial Sequence
  Synthetic oligonucleotide; AAG chr11 5232456 5232475 5232472 +
ctacaatgtgcaggcaaagg

SEQ ID NO: 9296 - DNA, 20 bp, Artificial Sequence
  Synthetic oligonucleotide; AGG chr11 5232457 5232476 5232473 +
tacaatgtgcaggcaaagga

SEQ ID NO: 9297 - DNA, 20 bp, Artificial Sequence
  Synthetic oligonucleotide; GAG chr11 5232459 5232478 5232475 +
caatgtgcaggcaaaggaag

SEQ ID NO: 9298 - DNA, 20 bp, Artificial Sequence
  Synthetic oligonucleotide; AGG chr11 5232460 5232479 5232476 +
aatgtgcaggcaaaggaagg

SEQ ID NO: 9299 - DNA, 20 bp, Artificial Sequence
  Synthetic oligonucleotide; AAG chr11 5232463 5232482 5232479 +
gtgcaggcaaaggaaggagg

SEQ ID NO: 9300 - DNA, 20 bp, Artificial Sequence
  Synthetic oligonucleotide; AAG chr11 5232467 5232486 5232483 +
aggcaaaggaaggaggaaga

SEQ ID NO: 9301 - DNA, 20 bp, Artificial Sequence
  Synthetic oligonucleotide; GAG chr11 5232488 5232507 5232504 +
agacaacataacattgtctt

SEQ ID NO: 9302 - DNA, 20 bp, Artificial Sequence
  Synthetic oligonucleotide; GAG chr11 5232511 5232530 5232527 +
taatcattatgcctttaatt

SEQ ID NO: 9303 - DNA, 20 bp, Artificial Sequence
  Synthetic oligonucleotide; CAG chr11 5232527 5232546 5232543 +
aattgagcacattattttct

SEQ ID NO: 9304 - DNA, 20 bp, Artificial Sequence
  Synthetic oligonucleotide; TGG chr11 5232537 5232556 5232553 +
attattttctcagtaattgt

SEQ ID NO: 9305 - DNA, 20 bp, Artificial Sequence
  Synthetic oligonucleotide; GAG chr11 5232539 5232558 5232555 +
tattttctcagtaattgttg

SEQ ID NO: 9306 - DNA, 20 bp, Artificial Sequence
  Synthetic oligonucleotide; TAG chr11 5232550 5232569 5232566 +
taattgttggagtttaatcg

SEQ ID NO: 9307 - DNA, 20 bp, Artificial Sequence
  Synthetic oligonucleotide; GAG chr11 5232563 5232582 5232579 +
ttaatcgtagcattaccctt

SEQ ID NO: 9308 - DNA, 20 bp, Artificial Sequence
  Synthetic oligonucleotide; AGG chr11 5232564 5232583 5232580 +
taatcgtagcattacccttg

SEQ ID NO: 9309 - DNA, 20 bp, Artificial Sequence
  Synthetic oligonucleotide; TAG chr11 5232575 5232594 5232591 +
ttacccttgaggctatgtct

SEQ ID NO: 9310 - DNA, 20 bp, Artificial Sequence
  Synthetic oligonucleotide; AGG chr11 5232576 5232595 5232592 +
tacccttgaggctatgtctt

SEQ ID NO: 9311 - DNA, 20 bp, Artificial Sequence
  Synthetic oligonucleotide; GGG chr11 5232577 5232596 5232593 +
acccttgaggctatgtctta

SEQ ID NO: 9312 - DNA, 20 bp, Artificial Sequence
  Synthetic oligonucleotide; GAG chr11 5232582 5232601 5232598 +
tgaggctatgtcttagggtt

SEQ ID NO: 9313 - DNA, 20 bp, Artificial Sequence
  Synthetic oligonucleotide; AGG chr11 5232583 5232602 5232599 +
gaggctatgtcttagggttg

SEQ ID NO: 9314 - DNA, 20 bp, Artificial Sequence
  Synthetic oligonucleotide; TAG chr11 5232593 5232612 5232609 +
cttagggttgaggtcttccc

SEQ ID NO: 9315 - DNA, 20 bp, Artificial Sequence
  Synthetic oligonucleotide; CAG chr11 5232604 5232623 5232620 +
ggtcttccctagaacctctg

SEQ ID NO: 9316 - DNA, 20 bp, Artificial Sequence
  Synthetic oligonucleotide; CAG chr11 5232610 5232629 5232626 +
ccctagaacctctgcagtgc

SEQ ID NO: 9317 - DNA, 20 bp, Artificial Sequence
  Synthetic oligonucleotide; AAG chr11 5232628 5232647 5232644 +
gccagtattatctttgtatc

SEQ ID NO: 9318 - DNA, 20 bp, Artificial Sequence
  Synthetic oligonucleotide; GAG chr11 5232630 5232649 5232646 +
cagtattatctttgtatcaa

SEQ ID NO: 9319 - DNA, 20 bp, Artificial Sequence
  Synthetic oligonucleotide; TGG chr11 5232654 5232673 5232670 +
tcttgataatttctgctctt

SEQ ID NO: 9320 - DNA, 20 bp, Artificial Sequence
  Synthetic oligonucleotide; GAG chr11 5232656 5232675 5232672 +
ttgataatttctgctctttg

SEQ ID NO: 9321 - DNA, 20 bp, Artificial Sequence
  Synthetic oligonucleotide; AGG chr11 5232657 5232676 5232673 +
tgataatttctgctctttgg

SEQ ID NO: 9322 - DNA, 20 bp, Artificial Sequence
  Synthetic oligonucleotide; TAG chr11 5232660 5232679 5232676 +
taatttctgctctttggagg

SEQ ID NO: 9323 - DNA, 20 bp, Artificial Sequence
  Synthetic oligonucleotide; AAG chr11 5232663 5232682 5232679 +
tttctgctctttggaggtag

SEQ ID NO: 9324 - DNA, 20 bp, Artificial Sequence
  Synthetic oligonucleotide; CGG chr11 5232688 5232707 5232704 +
tcacccattaatgccttgta

SEQ ID NO: 9325 - DNA, 20 bp, Artificial Sequence
  Synthetic oligonucleotide; AAG chr11 5232736 5232755 5232752 +
gtactctttgtaaaataaac

SEQ ID NO: 9326 - DNA, 20 bp, Artificial Sequence
  Synthetic oligonucleotide; TAG chr11 5232752 5232771 5232768 +
aaacaagtgctccctatctg

SEQ ID NO: 9327 - DNA, 20 bp, Artificial Sequence
  Synthetic oligonucleotide; GAG chr11 5232754 5232773 5232770 +
acaagtgctccctatctgta

SEQ ID NO: 9328 - DNA, 20 bp, Artificial Sequence
  Synthetic oligonucleotide; CAG chr11 5232760 5232779 5232776 +
gctccctatctgtagagcct

SEQ ID NO: 9329 - DNA, 20 bp, Artificial Sequence
  Synthetic oligonucleotide; AGG chr11 5232761 5232780 5232777 +
ctccctatctgtagagcctc

SEQ ID NO: 9330 - DNA, 20 bp, Artificial Sequence
  Synthetic oligonucleotide; TGG chr11 5232780 5232799 5232796 +
caggaaccttcttacacacc

SEQ ID NO: 9331 - DNA, 20 bp, Artificial Sequence
  Synthetic oligonucleotide; AAG chr11 5232798 5232817 5232814 +
cctggacaaaaaaatgaaat

SEQ ID NO: 9332 - DNA, 20 bp, Artificial Sequence
  Synthetic oligonucleotide; CAG chr11 5232811 5232830 5232827 +
atgaaataagtgaaattaat

SEQ ID NO: 9333 - DNA, 20 bp, Artificial Sequence
  Synthetic oligonucleotide; AGG chr11 5232812 5232831 5232828 +
tgaaataagtgaaattaatc

SEQ ID NO: 9334 - DNA, 20 bp, Artificial Sequence
  Synthetic oligonucleotide; AAG chr11 5232815 5232834 5232831 +
aataagtgaaattaatcagg

SEQ ID NO: 9335 - DNA, 20 bp, Artificial Sequence
  Synthetic oligonucleotide; GAG chr11 5232820 5232839 5232836 +
gtgaaattaatcaggaagtt

SEQ ID NO: 9336 - DNA, 20 bp, Artificial Sequence
  Synthetic oligonucleotide; TAG chr11 5232838 5232857 5232854 +
ttgagctgaacattctttat

SEQ ID NO: 9337 - DNA, 20 bp, Artificial Sequence
  Synthetic oligonucleotide; AGG chr11 5232839 5232858 5232855 +
tgagctgaacattctttatt

SEQ ID NO: 9338 - DNA, 20 bp, Artificial Sequence
  Synthetic oligonucleotide; CAG chr11 5232842 5232861 5232858 +
gctgaacattctttattagg

SEQ ID NO: 9339 - DNA, 20 bp, Artificial Sequence
  Synthetic oligonucleotide; AAG chr11 5232845 5232864 5232861 +
gaacattctttattaggcag

SEQ ID NO: 9340 - DNA, 20 bp, Artificial Sequence
  Synthetic oligonucleotide; AAG chr11 5232859 5232878 5232875 +
aggcagaagccatacccttg

SEQ ID NO: 9341 - DNA, 20 bp, Artificial Sequence
  Synthetic oligonucleotide; TAG chr11 5232862 5232881 5232878 +
cagaagccatacccttgaag

SEQ ID NO: 9342 - DNA, 20 bp, Artificial Sequence
  Synthetic oligonucleotide; AGG chr11 5232863 5232882 5232879 +
agaagccatacccttgaagt

SEQ ID NO: 9343 - DNA, 20 bp, Artificial Sequence
  Synthetic oligonucleotide; AAG chr11 5232878 5232897 5232894 +
gaagtaggcattgtgttccc

SEQ ID NO: 9344 - DNA, 20 bp, Artificial Sequence
  Synthetic oligonucleotide; CAG chr11 5232883 5232902 5232899 +
aggcattgtgttcccaagtt

SEQ ID NO: 9345 - DNA, 20 bp, Artificial Sequence
  Synthetic oligonucleotide; TAG chr11 5232890 5232909 5232906 +
gtgttcccaagttcagaaaa

SEQ ID NO: 9346 - DNA, 20 bp, Artificial Sequence
  Synthetic oligonucleotide; TAG chr11 5232897 5232916 5232913 +
caagttcagaaaatagaatc

SEQ ID NO: 9347 - DNA, 20 bp, Artificial Sequence
  Synthetic oligonucleotide; AGG chr11 5232898 5232917 5232914 +
aagttcagaaaatagaatct

SEQ ID NO: 9348 - DNA, 20 bp, Artificial Sequence
  Synthetic oligonucleotide; GGG chr11 5232899 5232918 5232915 +
agttcagaaaatagaatcta

SEQ ID NO: 9349 - DNA, 20 bp, Artificial Sequence
  Synthetic oligonucleotide; TAG chr11 5232905 5232924 5232921 +
gaaaatagaatctagggaaa

SEQ ID NO: 9350 - DNA, 20 bp, Artificial Sequence
  Synthetic oligonucleotide; AGG chr11 5232906 5232925 5232922 +
aaaatagaatctagggaaat

SEQ ID NO: 9351 - DNA, 20 bp, Artificial Sequence
  Synthetic oligonucleotide; GGG chr11 5232907 5232926 5232923 +
aaatagaatctagggaaata

SEQ ID NO: 9352 - DNA, 20 bp, Artificial Sequence
  Synthetic oligonucleotide; TGG chr11 5232918 5232937 5232934 +
agggaaatagggtcttctta

SEQ ID NO: 9353 - DNA, 20 bp, Artificial Sequence
  Synthetic oligonucleotide; CAG chr11 5232925 5232944 5232941 +
tagggtcttcttatggttat

SEQ ID NO: 9354 - DNA, 20 bp, Artificial Sequence
  Synthetic oligonucleotide; AGG chr11 5232926 5232945 5232942 +
agggtcttcttatggttatc

SEQ ID NO: 9355 - DNA, 20 bp, Artificial Sequence
  Synthetic oligonucleotide; CAG chr11 5232932 5232951 5232948 +
ttcttatggttatcaggaaa

SEQ ID NO: 9356 - DNA, 20 bp, Artificial Sequence
  Synthetic oligonucleotide; CAG chr11 5232937 5232956 5232953 +
atggttatcaggaaacagtc

SEQ ID NO: 9357 - DNA, 20 bp, Artificial Sequence
  Synthetic oligonucleotide; AGG chr11 5232938 5232957 5232954 +
tggttatcaggaaacagtcc

SEQ ID NO: 9358 - DNA, 20 bp, Artificial Sequence
  Synthetic oligonucleotide; TGG chr11 5232948 5232967 5232964 +
gaaacagtccaggatctcaa

SEQ ID NO: 9359 - DNA, 20 bp, Artificial Sequence
  Synthetic oligonucleotide; GAG chr11 5232958 5232977 5232974 +
aggatctcaatggtacttgt

SEQ ID NO: 9360 - DNA, 20 bp, Artificial Sequence
  Synthetic oligonucleotide; CAG chr11 5232962 5232981 5232978 +
tctcaatggtacttgtgagc

SEQ ID NO: 9361 - DNA, 20 bp, Artificial Sequence
  Synthetic oligonucleotide; AGG chr11 5232963 5232982 5232979 +
ctcaatggtacttgtgagcc

SEQ ID NO: 9362 - DNA, 20 bp, Artificial Sequence
  Synthetic oligonucleotide; GGG chr11 5232964 5232983 5232980 +
tcaatggtacttgtgagcca

SEQ ID NO: 9363 - DNA, 20 bp, Artificial Sequence
  Synthetic oligonucleotide; TAG chr11 5232970 5232989 5232986 +
gtacttgtgagccagggcat

SEQ ID NO: 9364 - DNA, 20 bp, Artificial Sequence
  Synthetic oligonucleotide; CAG chr11 5232979 5232998 5232995 +
agccagggcattagccacac

SEQ ID NO: 9365 - DNA, 20 bp, Artificial Sequence
  Synthetic oligonucleotide; TAG chr11 5232996 5233015 5233012 +
caccagccaccaccttctga

SEQ ID NO: 9366 - DNA, 20 bp, Artificial Sequence
  Synthetic oligonucleotide; AGG chr11 5232997 5233016 5233013 +
accagccaccaccttctgat

SEQ ID NO: 9367 - DNA, 20 bp, Artificial Sequence
  Synthetic oligonucleotide; CAG chr11 5233000 5233019 5233016 +
agccaccaccttctgatagg

SEQ ID NO: 9368 - DNA, 20 bp, Artificial Sequence
  Synthetic oligonucleotide; TGG chr11 5233013 5233032 5233029 +
tgataggcagcctgcatttg

SEQ ID NO: 9369 - DNA, 20 bp, Artificial Sequence
  Synthetic oligonucleotide; GGG chr11 5233014 5233033 5233030 +
gataggcagcctgcatttgt

SEQ ID NO: 9370 - DNA, 20 bp, Artificial Sequence
  Synthetic oligonucleotide; GGG chr11 5233015 5233034 5233031 +
ataggcagcctgcatttgtg

SEQ ID NO: 9371 - DNA, 20 bp, Artificial Sequence
  Synthetic oligonucleotide; AAG chr11 5233032 5233051 5233048 +
gtggggtgaattccttgcca

SEQ ID NO: 9372 - DNA, 20 bp, Artificial Sequence
  Synthetic oligonucleotide; CGG chr11 5233038 5233057 5233054 +
tgaattccttgccaaagttg

SEQ ID NO: 9373 - DNA, 20 bp, Artificial Sequence
  Synthetic oligonucleotide; GGG chr11 5233039 5233058 5233055 +
gaattccttgccaaagttgc

SEQ ID NO: 9374 - DNA, 20 bp, Artificial Sequence
  Synthetic oligonucleotide; CAG chr11 5233043 5233062 5233059 +
tccttgccaaagttgcgggc

SEQ ID NO: 9375 - DNA, 20 bp, Artificial Sequence
  Synthetic oligonucleotide; CAG chr11 5233055 5233074 5233071 +
ttgcgggccagcacacacac

SEQ ID NO: 9376 - DNA, 20 bp, Artificial Sequence
  Synthetic oligonucleotide; AAG chr11 5233068 5233087 5233084 +
cacacaccagcacattgccc

SEQ ID NO: 9377 - DNA, 20 bp, Artificial Sequence
  Synthetic oligonucleotide; GAG chr11 5233070 5233089 5233086 +
cacaccagcacattgcccaa

SEQ ID NO: 9378 - DNA, 20 bp, Artificial Sequence
  Synthetic oligonucleotide; CGG chr11 5233076 5233095 5233092 +
agcacattgcccaagagctg

SEQ ID NO: 9379 - DNA, 20 bp, Artificial Sequence
  Synthetic oligonucleotide; GAG chr11 5233078 5233097 5233094 +
cacattgcccaagagctgcg

SEQ ID NO: 9380 - DNA, 20 bp, Artificial Sequence
  Synthetic oligonucleotide; AAG chr11 5233081 5233100 5233097 +
attgcccaagagctgcggag

SEQ ID NO: 9381 - DNA, 20 bp, Artificial Sequence
  Synthetic oligonucleotide; GAG chr11 5233083 5233102 5233099 +
tgcccaagagctgcggagaa

SEQ ID NO: 9382 - DNA, 20 bp, Artificial Sequence
  Synthetic oligonucleotide; AGG chr11 5233084 5233103 5233100 +
gcccaagagctgcggagaag

SEQ ID NO: 9383 - DNA, 20 bp, Artificial Sequence
  Synthetic oligonucleotide; TAG chr11 5233087 5233106 5233103 +
caagagctgcggagaagagg

SEQ ID NO: 9384 - DNA, 20 bp, Artificial Sequence
  Synthetic oligonucleotide; AGG chr11 5233088 5233107 5233104 +
aagagctgcggagaagaggt

SEQ ID NO: 9385 - DNA, 20 bp, Artificial Sequence
  Synthetic oligonucleotide; CAG chr11 5233091 5233110 5233107 +
agctgcggagaagaggtagg

SEQ ID NO: 9386 - DNA, 20 bp, Artificial Sequence
  Synthetic oligonucleotide; TGG chr11 5233105 5233124 5233121 +
ggtaggcagatacatgcata

SEQ ID NO: 9387 - DNA, 20 bp, Artificial Sequence
  Synthetic oligonucleotide; CAG chr11 5233112 5233131 5233128 +
agatacatgcatatggttaa

SEQ ID NO: 9388 - DNA, 20 bp, Artificial Sequence
  Synthetic oligonucleotide; GAG chr11 5233114 5233133 5233130 +
atacatgcatatggttaaca

SEQ ID NO: 9389 - DNA, 20 bp, Artificial Sequence
  Synthetic oligonucleotide; AAG chr11 5233122 5233141 5233138 +
atatggttaacagagaaata

SEQ ID NO: 9390 - DNA, 20 bp, Artificial Sequence
  Synthetic oligonucleotide; TGG chr11 5233127 5233146 5233143 +
gttaacagagaaataaagac

SEQ ID NO: 9391 - DNA, 20 bp, Artificial Sequence
  Synthetic oligonucleotide; GAG chr11 5233135 5233154 5233151 +
agaaataaagactggcttct

SEQ ID NO: 9392 - DNA, 20 bp, Artificial Sequence
  Synthetic oligonucleotide; GAG chr11 5233143 5233162 5233159 +
agactggcttctgagaaact

SEQ ID NO: 9393 - DNA, 20 bp, Artificial Sequence
  Synthetic oligonucleotide; TAG chr11 5233175 5233194 5233191 +
atttttttctgcccaaatct

SEQ ID NO: 9394 - DNA, 20 bp, Artificial Sequence
  Synthetic oligonucleotide; CAG chr11 5233192 5233211 5233208 +
tcttagacaaaactgatccc

SEQ ID NO: 9395 - DNA, 20 bp, Artificial Sequence
  Synthetic oligonucleotide; AGG chr11 5233193 5233212 5233209 +
cttagacaaaactgatcccc

SEQ ID NO: 9396 - DNA, 20 bp, Artificial Sequence
  Synthetic oligonucleotide; CAG chr11 5233206 5233225 5233222 +
gatccccaggttattcccat

SEQ ID NO: 9397 - DNA, 20 bp, Artificial Sequence
  Synthetic oligonucleotide; AAG chr11 5233216 5233235 5233232 +
ttattcccatcagcataaat

SEQ ID NO: 9398 - DNA, 20 bp, Artificial Sequence
  Synthetic oligonucleotide; TAG chr11 5233281 5233300 5233297 +
acatcctctatgtacttaac

SEQ ID NO: 9399 - DNA, 20 bp, Artificial Sequence
  Synthetic oligonucleotide; TAG chr11 5233288 5233307 5233304 +
ctatgtacttaactagcatg

SEQ ID NO: 9400 - DNA, 20 bp, Artificial Sequence
  Synthetic oligonucleotide; TAG chr11 5233353 5233372 5233369 +
tatacaaattaattccaaat

SEQ ID NO: 9401 - DNA, 20 bp, Artificial Sequence
  Synthetic oligonucleotide; TAG chr11 5233377 5233396 5233393 +
tttaattttgtatgtgtata

SEQ ID NO: 9402 - DNA, 20 bp, Artificial Sequence
  Synthetic oligonucleotide; CAG chr11 5233404 5233423 5233420 +
tacaaattaattactataaa

SEQ ID NO: 9403 - DNA, 20 bp, Artificial Sequence
  Synthetic oligonucleotide; TAG chr11 5233412 5233431 5233428 +
aattactataaacagattaa

SEQ ID NO: 9404 - DNA, 20 bp, Artificial Sequence
  Synthetic oligonucleotide; CAG chr11 5233435 5233454 5233451 +
atacaaattaattgattaat

SEQ ID NO: 9405 - DNA, 20 bp, Artificial Sequence
  Synthetic oligonucleotide; TGG chr11 5233446 5233465 5233462 +
ttgattaatcagtgtgatga

SEQ ID NO: 9406 - DNA, 20 bp, Artificial Sequence
  Synthetic oligonucleotide; GGG chr11 5233447 5233466 5233463 +
tgattaatcagtgtgatgat

SEQ ID NO: 9407 - DNA, 20 bp, Artificial Sequence
  Synthetic oligonucleotide; TAG chr11 5233458 5233477 5233474 +
tgtgatgatgggctgtctcc

SEQ ID NO: 9408 - DNA, 20 bp, Artificial Sequence
  Synthetic oligonucleotide; CAG chr11 5233482 5233501 5233498 +
aacgacttctgccccacctc

SEQ ID NO: 9409 - DNA, 20 bp, Artificial Sequence
  Synthetic oligonucleotide; TAG chr11 5233495 5233514 5233511 +
ccacctccagtgtaactgcc

SEQ ID NO: 9410 - DNA, 20 bp, Artificial Sequence
  Synthetic oligonucleotide; CAG chr11 5233543 5233562 5233559 +
cctttccattccatttacta

SEQ ID NO: 9411 - DNA, 20 bp, Artificial Sequence
  Synthetic oligonucleotide; TAG chr11 5233588 5233607 5233604 +
ccttattgtaaaatgattta

SEQ ID NO: 9412 - DNA, 20 bp, Artificial Sequence
  Synthetic oligonucleotide; CAG chr11 5233600 5233619 5233616 +
atgatttatagcctctaaaa

SEQ ID NO: 9413 - DNA, 20 bp, Artificial Sequence
  Synthetic oligonucleotide; GAG chr11 5233624 5233643 5233640 +
attctatgcctctcatcttt

SEQ ID NO: 9414 - DNA, 20 bp, Artificial Sequence
  Synthetic oligonucleotide; TGG chr11 5233628 5233647 5233644 +
tatgcctctcatctttgagt

SEQ ID NO: 9415 - DNA, 20 bp, Artificial Sequence
  Synthetic oligonucleotide; GAG chr11 5233630 5233649 5233646 +
tgcctctcatctttgagttg

SEQ ID NO: 9416 - DNA, 20 bp, Artificial Sequence
  Synthetic oligonucleotide; TGG chr11 5233650 5233669 5233666 +
gagcctctcccatacccatg

SEQ ID NO: 9417 - DNA, 20 bp, Artificial Sequence
  Synthetic oligonucleotide; GAG chr11 5233652 5233671 5233668 +
gcctctcccatacccatgtg

SEQ ID NO: 9418 - DNA, 20 bp, Artificial Sequence
  Synthetic oligonucleotide; GAG chr11 5233654 5233673 5233670 +
ctctcccatacccatgtgga

SEQ ID NO: 9419 - DNA, 20 bp, Artificial Sequence
  Synthetic oligonucleotide; AAG chr11 5233661 5233680 5233677 +
atacccatgtggagagacaa

SEQ ID NO: 9420 - DNA, 20 bp, Artificial Sequence
  Synthetic oligonucleotide; AGG chr11 5233662 5233681 5233678 +
tacccatgtggagagacaaa

SEQ ID NO: 9421 - DNA, 20 bp, Artificial Sequence
  Synthetic oligonucleotide; AAG chr11 5233673 5233692 5233689 +
agagacaaaaggattattct

SEQ ID NO: 9422 - DNA, 20 bp, Artificial Sequence
  Synthetic oligonucleotide; CAG chr11 5233678 5233697 5233694 +
caaaaggattattctaagtg

SEQ ID NO: 9423 - DNA, 20 bp, Artificial Sequence
  Synthetic oligonucleotide; TAG chr11 5233684 5233703 5233700 +
gattattctaagtgcagaat

SEQ ID NO: 9424 - DNA, 20 bp, Artificial Sequence
  Synthetic oligonucleotide; CAG chr11 5233687 5233706 5233703 +
tattctaagtgcagaattag

SEQ ID NO: 9425 - DNA, 20 bp, Artificial Sequence
  Synthetic oligonucleotide; AGG chr11 5233688 5233707 5233704 +
attctaagtgcagaattagc

SEQ ID NO: 9426 - DNA, 20 bp, Artificial Sequence
  Synthetic oligonucleotide; GAG chr11 5233692 5233711 5233708 +
taagtgcagaattagcaggt

SEQ ID NO: 9427 - DNA, 20 bp, Artificial Sequence
  Synthetic oligonucleotide; GAG chr11 5233694 5233713 5233710 +
agtgcagaattagcaggtga

SEQ ID NO: 9428 - DNA, 20 bp, Artificial Sequence
  Synthetic oligonucleotide; TGG chr11 5233698 5233717 5233714 +
cagaattagcaggtgagagc

SEQ ID NO: 9429 - DNA, 20 bp, Artificial Sequence
  Synthetic oligonucleotide; GAG chr11 5233713 5233732 5233729 +
agagctggtatgcataattt

SEQ ID NO: 9430 - DNA, 20 bp, Artificial Sequence
  Synthetic oligonucleotide; TAG chr11 5233723 5233742 5233739 +
tgcataatttgagttgttgt

SEQ ID NO: 9431 - DNA, 20 bp, Artificial Sequence
  Synthetic oligonucleotide; GAG chr11 5233725 5233744 5233741 +
cataatttgagttgttgtta

SEQ ID NO: 9432 - DNA, 20 bp, Artificial Sequence
  Synthetic oligonucleotide; AAG chr11 5233728 5233747 5233744 +
aatttgagttgttgttagag

SEQ ID NO: 9433 - DNA, 20 bp, Artificial Sequence
  Synthetic oligonucleotide; AGG chr11 5233729 5233748 5233745 +
atttgagttgttgttagaga

SEQ ID NO: 9434 - DNA, 20 bp, Artificial Sequence
  Synthetic oligonucleotide; AAG chr11 5233739 5233758 5233755 +
ttgttagagaaggaaaaatg

SEQ ID NO: 9435 - DNA, 20 bp, Artificial Sequence
  Synthetic oligonucleotide; AGG chr11 5233740 5233759 5233756 +
tgttagagaaggaaaaatga

SEQ ID NO: 9436 - DNA, 20 bp, Artificial Sequence
  Synthetic oligonucleotide; GGG chr11 5233741 5233760 5233757 +
gttagagaaggaaaaatgaa

SEQ ID NO: 9437 - DNA, 20 bp, Artificial Sequence
  Synthetic oligonucleotide; GAG chr11 5233743 5233762 5233759 +
tagagaaggaaaaatgaagg

SEQ ID NO: 9438 - DNA, 20 bp, Artificial Sequence
  Synthetic oligonucleotide; AGG chr11 5233744 5233763 5233760 +
agagaaggaaaaatgaaggg

SEQ ID NO: 9439 - DNA, 20 bp, Artificial Sequence
  Synthetic oligonucleotide; GGG chr11 5233745 5233764 5233761 +
gagaaggaaaaatgaaggga

SEQ ID NO: 9440 - DNA, 20 bp, Artificial Sequence
  Synthetic oligonucleotide; GGG chr11 5233746 5233765 5233762 +
agaaggaaaaatgaagggag

SEQ ID NO: 9441 - DNA, 20 bp, Artificial Sequence
  Synthetic oligonucleotide; GGG chr11 5233747 5233766 5233763 +
gaaggaaaaatgaagggagg

SEQ ID NO: 9442 - DNA, 20 bp, Artificial Sequence
  Synthetic oligonucleotide; TGG chr11 5233751 5233770 5233767 +
gaaaaatgaagggagggggt

SEQ ID NO: 9443 - DNA, 20 bp, Artificial Sequence
  Synthetic oligonucleotide; GGG chr11 5233752 5233771 5233768 +
aaaaatgaagggagggggtt

SEQ ID NO: 9444 - DNA, 20 bp, Artificial Sequence
  Synthetic oligonucleotide; GAG chr11 5233754 5233773 5233770 +
aaatgaagggagggggttgg

SEQ ID NO: 9445 - DNA, 20 bp, Artificial Sequence
  Synthetic oligonucleotide; GAG chr11 5233756 5233775 5233772 +
atgaagggagggggttggga

SEQ ID NO: 9446 - DNA, 20 bp, Artificial Sequence
  Synthetic oligonucleotide; AAG chr11 5233760 5233779 5233776 +
agggagggggttgggagaga

SEQ ID NO: 9447 - DNA, 20 bp, Artificial Sequence
  Synthetic oligonucleotide; CAG chr11 5233764 5233783 5233780 +
agggggttgggagagaaaga

SEQ ID NO: 9448 - DNA, 20 bp, Artificial Sequence
  Synthetic oligonucleotide; AGG chr11 5233765 5233784 5233781 +
gggggttgggagagaaagac

SEQ ID NO: 9449 - DNA, 20 bp, Artificial Sequence
  Synthetic oligonucleotide; TAG chr11 5233786 5233805 5233802 +
ggatattaaataatttaaaa

SEQ ID NO: 9450 - DNA, 20 bp, Artificial Sequence
  Synthetic oligonucleotide; AAG chr11 5233790 5233809 5233806 +
attaaataatttaaaatagc

SEQ ID NO: 9451 - DNA, 20 bp, Artificial Sequence
  Synthetic oligonucleotide; GAG chr11 5233798 5233817 5233814 +
atttaaaatagcaagattgt

SEQ ID NO: 9452 - DNA, 20 bp, Artificial Sequence
  Synthetic oligonucleotide; AGG chr11 5233799 5233818 5233815 +
tttaaaatagcaagattgtg

SEQ ID NO: 9453 - DNA, 20 bp, Artificial Sequence
  Synthetic oligonucleotide; AAG chr11 5233802 5233821 5233818 +
aaaatagcaagattgtgagg

SEQ ID NO: 9454 - DNA, 20 bp, Artificial Sequence
  Synthetic oligonucleotide; AGG chr11 5233803 5233822 5233819 +
aaatagcaagattgtgagga

SEQ ID NO: 9455 - DNA, 20 bp, Artificial Sequence
  Synthetic oligonucleotide; CAG chr11 5233814 5233833 5233830 +
ttgtgaggaaggaaaaaatg

SEQ ID NO: 9456 - DNA, 20 bp, Artificial Sequence
  Synthetic oligonucleotide; TAG chr11 5233846 5233865 5233862 +
ataaaaaattaacaaaattt

SEQ ID NO: 9457 - DNA, 20 bp, Artificial Sequence
  Synthetic oligonucleotide; AAG chr11 5233849 5233868 5233865 +
aaaaattaacaaaattttag

SEQ ID NO: 9458 - DNA, 20 bp, Artificial Sequence
  Synthetic oligonucleotide; TAG chr11 5233869 5233888 5233885 +
aagcattaaatgataaaata

SEQ ID NO: 9459 - DNA, 20 bp, Artificial Sequence
  Synthetic oligonucleotide; TGG chr11 5233888 5233907 5233904 +
atagtaaaatgacaaaaatg

SEQ ID NO: 9460 - DNA, 20 bp, Artificial Sequence
  Synthetic oligonucleotide; GGG chr11 5233889 5233908 5233905 +
tagtaaaatgacaaaaatgt

SEQ ID NO: 9461 - DNA, 20 bp, Artificial Sequence
  Synthetic oligonucleotide; GAG chr11 5233891 5233910 5233907 +
gtaaaatgacaaaaatgtgg

SEQ ID NO: 9462 - DNA, 20 bp, Artificial Sequence
  Synthetic oligonucleotide; AAG chr11 5233894 5233913 5233910 +
aaatgacaaaaatgtgggag

SEQ ID NO: 9463 - DNA, 20 bp, Artificial Sequence
  Synthetic oligonucleotide; GAG chr11 5233896 5233915 5233912 +
atgacaaaaatgtgggagaa

SEQ ID NO: 9464 - DNA, 20 bp, Artificial Sequence
  Synthetic oligonucleotide; CAG chr11 5233899 5233918 5233915 +
acaaaaatgtgggagaagag

SEQ ID NO: 9465 - DNA, 20 bp, Artificial Sequence
  Synthetic oligonucleotide; AGG chr11 5233900 5233919 5233916 +
caaaaatgtgggagaagagc

SEQ ID NO: 9466 - DNA, 20 bp, Artificial Sequence
  Synthetic oligonucleotide; TAG chr11 5233903 5233922 5233919 +
aaatgtgggagaagagcagg

SEQ ID NO: 9467 - DNA, 20 bp, Artificial Sequence
  Synthetic oligonucleotide; AGG chr11 5233904 5233923 5233920 +
aatgtgggagaagagcaggt

SEQ ID NO: 9468 - DNA, 20 bp, Artificial Sequence
  Synthetic oligonucleotide; AAG chr11 5233910 5233929 5233926 +
ggagaagagcaggtaggtaa

SEQ ID NO: 9469 - DNA, 20 bp, Artificial Sequence
  Synthetic oligonucleotide; AAG chr11 5233924 5233943 5233940 +
aggtaaaagaaccaaaatgt

SEQ ID NO: 9470 - DNA, 20 bp, Artificial Sequence
  Synthetic oligonucleotide; TAG chr11 5233929 5233948 5233945 +
aaagaaccaaaatgtaagat

SEQ ID NO: 9471 - DNA, 20 bp, Artificial Sequence
  Synthetic oligonucleotide; AAG chr11 5233933 5233952 5233949 +
aaccaaaatgtaagattaga

SEQ ID NO: 9472 - DNA, 20 bp, Artificial Sequence
  Synthetic oligonucleotide; AAG chr11 5233940 5233959 5233956 +
atgtaagattagaaagtaaa

SEQ ID NO: 9473 - DNA, 20 bp, Artificial Sequence
  Synthetic oligonucleotide; GAG chr11 5233942 5233961 5233958 +
gtaagattagaaagtaaaaa

SEQ ID NO: 9474 - DNA, 20 bp, Artificial Sequence
  Synthetic oligonucleotide; AAG chr11 5233947 5233966 5233963 +
attagaaagtaaaaagagaa

SEQ ID NO: 9475 - DNA, 20 bp, Artificial Sequence
  Synthetic oligonucleotide; AAG chr11 5233952 5233971 5233968 +
aaagtaaaaagagaaaagtg

SEQ ID NO: 9476 - DNA, 20 bp, Artificial Sequence
  Synthetic oligonucleotide; TGG chr11 5233962 5233981 5233978 +
gagaaaagtgaagcatctcc

SEQ ID NO: 9477 - DNA, 20 bp, Artificial Sequence
  Synthetic oligonucleotide; AAG chr11 5233975 5233994 5233991 +
catctcctggactcaccctg

SEQ ID NO: 9478 - DNA, 20 bp, Artificial Sequence
  Synthetic oligonucleotide; CAG chr11 5233982 5234001 5233998 +
tggactcaccctgaagttct

SEQ ID NO: 9479 - DNA, 20 bp, Artificial Sequence
  Synthetic oligonucleotide; AGG chr11 5233983 5234002 5233999 +
ggactcaccctgaagttctc

SEQ ID NO: 9480 - DNA, 20 bp, Artificial Sequence
  Synthetic oligonucleotide; CAG chr11 5233995 5234014 5234011 +
aagttctcaggatccacgtg

SEQ ID NO: 9481 - DNA, 20 bp, Artificial Sequence
  Synthetic oligonucleotide; CAG chr11 5234005 5234024 5234021 +
gatccacgtgcagcttgtca

SEQ ID NO: 9482 - DNA, 20 bp, Artificial Sequence
  Synthetic oligonucleotide; CAG chr11 5234010 5234029 5234026 +
acgtgcagcttgtcacagtg

SEQ ID NO: 9483 - DNA, 20 bp, Artificial Sequence
  Synthetic oligonucleotide; CAG chr11 5234019 5234038 5234035 +
ttgtcacagtgcagctcact

SEQ ID NO: 9484 - DNA, 20 bp, Artificial Sequence
  Synthetic oligonucleotide; GAG chr11 5234024 5234043 5234040 +
acagtgcagctcactcagct

SEQ ID NO: 9485 - DNA, 20 bp, Artificial Sequence
  Synthetic oligonucleotide; AAG chr11 5234030 5234049 5234046 +
cagctcactcagctgagaaa

SEQ ID NO: 9486 - DNA, 20 bp, Artificial Sequence
  Synthetic oligonucleotide; GAG chr11 5234040 5234059 5234056 +
agctgagaaaaagtgccctt

SEQ ID NO: 9487 - DNA, 20 bp, Artificial Sequence
  Synthetic oligonucleotide; AGG chr11 5234041 5234060 5234057 +
gctgagaaaaagtgcccttg

SEQ ID NO: 9488 - DNA, 20 bp, Artificial Sequence
  Synthetic oligonucleotide; CAG chr11 5234049 5234068 5234065 +
aaagtgcccttgaggttgtc

SEQ ID NO: 9489 - DNA, 20 bp, Artificial Sequence
  Synthetic oligonucleotide; AGG chr11 5234050 5234069 5234066 +
aagtgcccttgaggttgtcc

SEQ ID NO: 9490 - DNA, 20 bp, Artificial Sequence
  Synthetic oligonucleotide; GAG chr11 5234054 5234073 5234070 +
gcccttgaggttgtccaggt

SEQ ID NO: 9491 - DNA, 20 bp, Artificial Sequence
  Synthetic oligonucleotide; CAG chr11 5234058 5234077 5234074 +
ttgaggttgtccaggtgagc

SEQ ID NO: 9492 - DNA, 20 bp, Artificial Sequence
  Synthetic oligonucleotide; AGG chr11 5234059 5234078 5234075 +
tgaggttgtccaggtgagcc

SEQ ID NO: 9493 - DNA, 20 bp, Artificial Sequence
  Synthetic oligonucleotide; AAG chr11 5234071 5234090 5234087 +
ggtgagccaggccatcacta

SEQ ID NO: 9494 - DNA, 20 bp, Artificial Sequence
  Synthetic oligonucleotide; AGG chr11 5234072 5234091 5234088 +
gtgagccaggccatcactaa

SEQ ID NO: 9495 - DNA, 20 bp, Artificial Sequence
  Synthetic oligonucleotide; TAG chr11 5234079 5234098 5234095 +
aggccatcactaaaggcacc

SEQ ID NO: 9496 - DNA, 20 bp, Artificial Sequence
  Synthetic oligonucleotide; GAG chr11 5234096 5234115 5234112 +
acctagcaccttcttgccat

SEQ ID NO: 9497 - DNA, 20 bp, Artificial Sequence
  Synthetic oligonucleotide; TAG chr11 5234108 5234127 5234124 +
cttgccatgagccttcacct

SEQ ID NO: 9498 - DNA, 20 bp, Artificial Sequence
  Synthetic oligonucleotide; AGG chr11 5234109 5234128 5234125 +
ttgccatgagccttcacctt

SEQ ID NO: 9499 - DNA, 20 bp, Artificial Sequence
  Synthetic oligonucleotide; GGG chr11 5234110 5234129 5234126 +
tgccatgagccttcacctta

SEQ ID NO: 9500 - DNA, 20 bp, Artificial Sequence
  Synthetic oligonucleotide; CAG chr11 5234123 5234142 5234139 +
caccttagggttgcccataa

SEQ ID NO: 9501 - DNA, 20 bp, Artificial Sequence
  Synthetic oligonucleotide; CAG chr11 5234129 5234148 5234145 +
agggttgcccataacagcat

SEQ ID NO: 9502 - DNA, 20 bp, Artificial Sequence
  Synthetic oligonucleotide; AGG chr11 5234130 5234149 5234146 +
gggttgcccataacagcatc

SEQ ID NO: 9503 - DNA, 20 bp, Artificial Sequence
  Synthetic oligonucleotide; GAG chr11 5234132 5234151 5234148 +
gttgcccataacagcatcag

SEQ ID NO: 9504 - DNA, 20 bp, Artificial Sequence
  Synthetic oligonucleotide; GAG chr11 5234134 5234153 5234150 +
tgcccataacagcatcagga

SEQ ID NO: 9505 - DNA, 20 bp, Artificial Sequence
  Synthetic oligonucleotide; AGG chr11 5234135 5234154 5234151 +
gcccataacagcatcaggag

SEQ ID NO: 9506 - DNA, 20 bp, Artificial Sequence
  Synthetic oligonucleotide; CAG chr11 5234139 5234158 5234155 +
ataacagcatcaggagagga

SEQ ID NO: 9507 - DNA, 20 bp, Artificial Sequence
  Synthetic oligonucleotide; AAG chr11 5234149 5234168 5234165 +
caggagaggacagatcccca

SEQ ID NO: 9508 - DNA, 20 bp, Artificial Sequence
  Synthetic oligonucleotide; AGG chr11 5234150 5234169 5234166 +
aggagaggacagatccccaa

SEQ ID NO: 9509 - DNA, 20 bp, Artificial Sequence
  Synthetic oligonucleotide; AAG chr11 5234158 5234177 5234174 +
acagatccccaaaggactca

SEQ ID NO: 9510 - DNA, 20 bp, Artificial Sequence
  Synthetic oligonucleotide; TGG chr11 5234167 5234186 5234183 +
caaaggactcaaagaacctc

SEQ ID NO: 9511 - DNA, 20 bp, Artificial Sequence
  Synthetic oligonucleotide; GGG chr11 5234168 5234187 5234184 +
aaaggactcaaagaacctct

SEQ ID NO: 9512 - DNA, 20 bp, Artificial Sequence
  Synthetic oligonucleotide; AAG chr11 5234174 5234193 5234190 +
ctcaaagaacctctgggtcc

SEQ ID NO: 9513 - DNA, 20 bp, Artificial Sequence
  Synthetic oligonucleotide; AGG chr11 5234175 5234194 5234191 +
tcaaagaacctctgggtcca

SEQ ID NO: 9514 - DNA, 20 bp, Artificial Sequence
  Synthetic oligonucleotide; GGG chr11 5234176 5234195 5234192 +
caaagaacctctgggtccaa

SEQ ID NO: 9515 - DNA, 20 bp, Artificial Sequence
  Synthetic oligonucleotide; TAG chr11 5234179 5234198 5234195 +
agaacctctgggtccaaggg

SEQ ID NO: 9516 - DNA, 20 bp, Artificial Sequence
  Synthetic oligonucleotide; CAG chr11 5234187 5234206 5234203 +
tgggtccaagggtagaccac

SEQ ID NO: 9517 - DNA, 20 bp, Artificial Sequence
  Synthetic oligonucleotide; GAG chr11 5234196 5234215 5234212 +
gggtagaccaccagtaatct

SEQ ID NO: 9518 - DNA, 20 bp, Artificial Sequence
  Synthetic oligonucleotide; AGG chr11 5234197 5234216 5234213 +
ggtagaccaccagtaatctg

SEQ ID NO: 9519 - DNA, 20 bp, Artificial Sequence
  Synthetic oligonucleotide; GGG chr11 5234198 5234217 5234214 +
gtagaccaccagtaatctga

SEQ ID NO: 9520 - DNA, 20 bp, Artificial Sequence
  Synthetic oligonucleotide; TAG chr11 5234201 5234220 5234217 +
gaccaccagtaatctgaggg

SEQ ID NO: 9521 - DNA, 20 bp, Artificial Sequence
  Synthetic oligonucleotide; AGG chr11 5234202 5234221 5234218 +
accaccagtaatctgagggt

SEQ ID NO: 9522 - DNA, 20 bp, Artificial Sequence
  Synthetic oligonucleotide; CAG chr11 5234209 5234228 5234225 +
gtaatctgagggtaggaaaa

SEQ ID NO: 9523 - DNA, 20 bp, Artificial Sequence
  Synthetic oligonucleotide; AAG chr11 5234215 5234234 5234231 +
tgagggtaggaaaacagccc

SEQ ID NO: 9524 - DNA, 20 bp, Artificial Sequence
  Synthetic oligonucleotide; AGG chr11 5234216 5234235 5234232 +
gagggtaggaaaacagccca

SEQ ID NO: 9525 - DNA, 20 bp, Artificial Sequence
  Synthetic oligonucleotide; GGG chr11 5234217 5234236 5234233 +
agggtaggaaaacagcccaa

SEQ ID NO: 9526 - DNA, 20 bp, Artificial Sequence
  Synthetic oligonucleotide; CAG chr11 5234221 5234240 5234237 +
taggaaaacagcccaaggga

SEQ ID NO: 9527 - DNA, 20 bp, Artificial Sequence
  Synthetic oligonucleotide; GAG chr11 5234223 5234242 5234239 +
ggaaaacagcccaagggaca

SEQ ID NO: 9528 - DNA, 20 bp, Artificial Sequence
  Synthetic oligonucleotide; GAG chr11 5234225 5234244 5234241 +
aaaacagcccaagggacaga

SEQ ID NO: 9529 - DNA, 20 bp, Artificial Sequence
  Synthetic oligonucleotide; CAG chr11 5234229 5234248 5234245 +
cagcccaagggacagagagt

SEQ ID NO: 9530 - DNA, 20 bp, Artificial Sequence
  Synthetic oligonucleotide; CAG chr11 5234239 5234258 5234255 +
gacagagagtcagtgcctat

SEQ ID NO: 9531 - DNA, 20 bp, Artificial Sequence
  Synthetic oligonucleotide; AAG chr11 5234248 5234267 5234264 +
tcagtgcctatcagaaaccc

SEQ ID NO: 9532 - DNA, 20 bp, Artificial Sequence
  Synthetic oligonucleotide; GAG chr11 5234250 5234269 5234266 +
agtgcctatcagaaacccaa

SEQ ID NO: 9533 - DNA, 20 bp, Artificial Sequence
  Synthetic oligonucleotide; CAG chr11 5234274 5234293 5234290 +
cttctctgtctacacatgcc

SEQ ID NO: 9534 - DNA, 20 bp, Artificial Sequence
  Synthetic oligonucleotide; GAG chr11 5234294 5234313 5234310 +
cagtttccatttgcctcctt

SEQ ID NO: 9535 - DNA, 20 bp, Artificial Sequence
  Synthetic oligonucleotide; CAG chr11 5234327 5234346 5234343 +
aaccttgataccaacctgcc

SEQ ID NO: 9536 - DNA, 20 bp, Artificial Sequence
  Synthetic oligonucleotide; AGG chr11 5234328 5234347 5234344 +
accttgataccaacctgccc

SEQ ID NO: 9537 - DNA, 20 bp, Artificial Sequence
  Synthetic oligonucleotide; GGG chr11 5234329 5234348 5234345 +
ccttgataccaacctgccca

SEQ ID NO: 9538 - DNA, 20 bp, Artificial Sequence
  Synthetic oligonucleotide; CAG chr11 5234369 5234388 5234385 +
tccacgttcactttgcccca

SEQ ID NO: 9539 - DNA, 20 bp, Artificial Sequence
  Synthetic oligonucleotide; AGG chr11 5234370 5234389 5234386 +
ccacgttcactttgccccac

SEQ ID NO: 9540 - DNA, 20 bp, Artificial Sequence
  Synthetic oligonucleotide; GGG chr11 5234371 5234390 5234387 +
cacgttcactttgccccaca

SEQ ID NO: 9541 - DNA, 20 bp, Artificial Sequence
  Synthetic oligonucleotide; CAG chr11 5234380 5234399 5234396 +
tttgccccacagggcattga

SEQ ID NO: 9542 - DNA, 20 bp, Artificial Sequence
  Synthetic oligonucleotide; CAG chr11 5234383 5234402 5234399 +
gccccacagggcattgacag

SEQ ID NO: 9543 - DNA, 20 bp, Artificial Sequence
  Synthetic oligonucleotide; CAG chr11 5234395 5234414 5234411 +
attgacagcagtcttctcct

SEQ ID NO: 9544 - DNA, 20 bp, Artificial Sequence
  Synthetic oligonucleotide; AGG chr11 5234396 5234415 5234412 +
ttgacagcagtcttctcctc

SEQ ID NO: 9545 - DNA, 20 bp, Artificial Sequence
  Synthetic oligonucleotide; GAG chr11 5234398 5234417 5234414 +
gacagcagtcttctcctcag

SEQ ID NO: 9546 - DNA, 20 bp, Artificial Sequence
  Synthetic oligonucleotide; CAG chr11 5234402 5234421 5234418 +
gcagtcttctcctcaggagt

SEQ ID NO: 9547 - DNA, 20 bp, Artificial Sequence
  Synthetic oligonucleotide; TGG chr11 5234413 5234432 5234429 +
ctcaggagtcagatgcacca

SEQ ID NO: 9548 - DNA, 20 bp, Artificial Sequence
  Synthetic oligonucleotide; GAG chr11 5234425 5234444 5234441 +
atgcaccatggtgtctgttt

SEQ ID NO: 9549 - DNA, 20 bp, Artificial Sequence
  Synthetic oligonucleotide; AGG chr11 5234426 5234445 5234442 +
tgcaccatggtgtctgtttg

SEQ ID NO: 9550 - DNA, 20 bp, Artificial Sequence
  Synthetic oligonucleotide; TAG chr11 5234433 5234452 5234449 +
tggtgtctgtttgaggttgc

SEQ ID NO: 9551 - DNA, 20 bp, Artificial Sequence
  Synthetic oligonucleotide; CAG chr11 5234451 5234470 5234467 +
gctagtgaacactgttatgt

SEQ ID NO: 9552 - DNA, 20 bp, Artificial Sequence
  Synthetic oligonucleotide; AAG chr11 5234454 5234473 5234470 +
agtgaacactgttatgtcag

SEQ ID NO: 9553 - DNA, 20 bp, Artificial Sequence
  Synthetic oligonucleotide; AAG chr11 5234458 5234477 5234474 +
aacactgttatgtcagaaga

SEQ ID NO: 9554 - DNA, 20 bp, Artificial Sequence
  Synthetic oligonucleotide; AAG chr11 5234464 5234483 5234480 +
gttatgtcagaagaaagtgt

SEQ ID NO: 9555 - DNA, 20 bp, Artificial Sequence
  Synthetic oligonucleotide; CAG chr11 5234470 5234489 5234486 +
tcagaagaaagtgtaagcaa

SEQ ID NO: 9556 - DNA, 20 bp, Artificial Sequence
  Synthetic oligonucleotide; TGG chr11 5234497 5234516 5234513 +
ctctgccctgccttttatgc

SEQ ID NO: 9557 - DNA, 20 bp, Artificial Sequence
  Synthetic oligonucleotide; CAG chr11 5234517 5234536 5234533 +
tggtcctgtcctccctgctc

SEQ ID NO: 9558 - DNA, 20 bp, Artificial Sequence
  Synthetic oligonucleotide; GAG chr11 5234521 5234540 5234537 +
cctgtcctccctgctccagt

SEQ ID NO: 9559 - DNA, 20 bp, Artificial Sequence
  Synthetic oligonucleotide; CAG chr11 5234524 5234543 5234540 +
gtcctccctgctccagtgag

SEQ ID NO: 9560 - DNA, 20 bp, Artificial Sequence
  Synthetic oligonucleotide; AGG chr11 5234525 5234544 5234541 +
tcctccctgctccagtgagc

SEQ ID NO: 9561 - DNA, 20 bp, Artificial Sequence
  Synthetic oligonucleotide; TGG chr11 5234529 5234548 5234545 +
ccctgctccagtgagcaggt

SEQ ID NO: 9562 - DNA, 20 bp, Artificial Sequence
  Synthetic oligonucleotide; AAG chr11 5234535 5234554 5234551 +
tccagtgagcaggttggttt

SEQ ID NO: 9563 - DNA, 20 bp, Artificial Sequence
  Synthetic oligonucleotide; AAG chr11 5234540 5234559 5234556 +
tgagcaggttggtttaagat

SEQ ID NO: 9564 - DNA, 20 bp, Artificial Sequence
  Synthetic oligonucleotide; CAG chr11 5234543 5234562 5234559 +
gcaggttggtttaagataag

SEQ ID NO: 9565 - DNA, 20 bp, Artificial Sequence
  Synthetic oligonucleotide; AGG chr11 5234544 5234563 5234560 +
caggttggtttaagataagc

SEQ ID NO: 9566 - DNA, 20 bp, Artificial Sequence
  Synthetic oligonucleotide; GGG chr11 5234545 5234564 5234561 +
aggttggtttaagataagca

SEQ ID NO: 9567 - DNA, 20 bp, Artificial Sequence
  Synthetic oligonucleotide; TAG chr11 5234554 5234573 5234570 +
taagataagcagggtttcat

SEQ ID NO: 9568 - DNA, 20 bp, Artificial Sequence
  Synthetic oligonucleotide; GAG chr11 5234562 5234581 5234578 +
gcagggtttcattagtttgt

SEQ ID NO: 9569 - DNA, 20 bp, Artificial Sequence
  Synthetic oligonucleotide; GAG chr11 5234609 5234628 5234625 +
ctattcccttaacttgccct

SEQ ID NO: 9570 - DNA, 20 bp, Artificial Sequence
  Synthetic oligonucleotide; TGG chr11 5234614 5234633 5234630 +
cccttaacttgccctgagat

SEQ ID NO: 9571 - DNA, 20 bp, Artificial Sequence
  Synthetic oligonucleotide; CAG chr11 5234642 5234661 5234658 +
ctgtcatgtgtgtcttgact

SEQ ID NO: 9572 - DNA, 20 bp, Artificial Sequence
  Synthetic oligonucleotide; CAG chr11 5234687 5234706 5234703 +
tctccccaccgcatctcttt

SEQ ID NO: 9573 - DNA, 20 bp, Artificial Sequence
  Synthetic oligonucleotide; CAG chr11 5234690 5234709 5234706 +
ccccaccgcatctctttcag

SEQ ID NO: 9574 - DNA, 20 bp, Artificial Sequence
  Synthetic oligonucleotide; TAG chr11 5234714 5234733 5234730 +
tgtttctaaaaatatcctcc

SEQ ID NO: 9575 - DNA, 20 bp, Artificial Sequence
  Synthetic oligonucleotide; CAG chr11 5234728 5234747 5234744 +
tcctcctagtttcatttttg

SEQ ID NO: 9576 - DNA, 20 bp, Artificial Sequence
  Synthetic oligonucleotide; AAG chr11 5234731 5234750 5234747 +
tcctagtttcatttttgcag

SEQ ID NO: 9577 - DNA, 20 bp, Artificial Sequence
  Synthetic oligonucleotide; TAG chr11 5234739 5234758 5234755 +
tcatttttgcagaagtgttt

SEQ ID NO: 9578 - DNA, 20 bp, Artificial Sequence
  Synthetic oligonucleotide; AGG chr11 5234740 5234759 5234756 +
catttttgcagaagtgtttt

SEQ ID NO: 9579 - DNA, 20 bp, Artificial Sequence
  Synthetic oligonucleotide; TAG chr11 5234749 5234768 5234765 +
agaagtgttttaggctaata

SEQ ID NO: 9580 - DNA, 20 bp, Artificial Sequence
  Synthetic oligonucleotide; TGG chr11 5234752 5234771 5234768 +
agtgttttaggctaatatag

SEQ ID NO: 9581 - DNA, 20 bp, Artificial Sequence
  Synthetic oligonucleotide; TAG chr11 5234764 5234783 5234780 +
taatatagtggaatgtatct

SEQ ID NO: 9582 - DNA, 20 bp, Artificial Sequence
  Synthetic oligonucleotide; GAG chr11 5234766 5234785 5234782 +
atatagtggaatgtatctta

SEQ ID NO: 9583 - DNA, 20 bp, Artificial Sequence
  Synthetic oligonucleotide; AAG chr11 5234800 5234819 5234816 +
tgtttctgtcactttatact

SEQ ID NO: 9584 - DNA, 20 bp, Artificial Sequence
  Synthetic oligonucleotide; AAG chr11 5234816 5234835 5234832 +
tactaagaaaacttatctaa

SEQ ID NO: 9585 - DNA, 20 bp, Artificial Sequence
  Synthetic oligonucleotide; CAG chr11 5234819 5234838 5234835 +
taagaaaacttatctaaaag

SEQ ID NO: 9586 - DNA, 20 bp, Artificial Sequence
  Synthetic oligonucleotide; AAG chr11 5234832 5234851 5234848 +
ctaaaagcagatgttttaac

SEQ ID NO: 9587 - DNA, 20 bp, Artificial Sequence
  Synthetic oligonucleotide; AAG chr11 5234848 5234867 5234864 +
taacaagttgactcaatata

SEQ ID NO: 9588 - DNA, 20 bp, Artificial Sequence
  Synthetic oligonucleotide; TAG chr11 5234865 5234884 5234881 +
ataaagttcttctttgcctc

SEQ ID NO: 9589 - DNA, 20 bp, Artificial Sequence
  Synthetic oligonucleotide; GAG chr11 5234867 5234886 5234883 +
aaagttcttctttgcctcta

SEQ ID NO: 9590 - DNA, 20 bp, Artificial Sequence
  Synthetic oligonucleotide; AAG chr11 5234882 5234901 5234898 +
ctctagagatttttgtctcc

SEQ ID NO: 9591 - DNA, 20 bp, Artificial Sequence
  Synthetic oligonucleotide; AGG chr11 5234883 5234902 5234899 +
tctagagatttttgtctcca

SEQ ID NO: 9592 - DNA, 20 bp, Artificial Sequence
  Synthetic oligonucleotide; GGG chr11 5234884 5234903 5234900 +
ctagagatttttgtctccaa

SEQ ID NO: 9593 - DNA, 20 bp, Artificial Sequence
  Synthetic oligonucleotide; GAG chr11 5234893 5234912 5234909 +
tttgtctccaagggaatttt

SEQ ID NO: 9594 - DNA, 20 bp, Artificial Sequence
  Synthetic oligonucleotide; GAG chr11 5234895 5234914 5234911 +
tgtctccaagggaattttga

SEQ ID NO: 9595 - DNA, 20 bp, Artificial Sequence
  Synthetic oligonucleotide; AGG chr11 5234896 5234915 5234912 +
gtctccaagggaattttgag

SEQ ID NO: 9596 - DNA, 20 bp, Artificial Sequence
  Synthetic oligonucleotide; TGG chr11 5234900 5234919 5234916 +
ccaagggaattttgagaggt

SEQ ID NO: 9597 - DNA, 20 bp, Artificial Sequence
  Synthetic oligonucleotide; TGG chr11 5234905 5234924 5234921 +
ggaattttgagaggttggaa

SEQ ID NO: 9598 - DNA, 20 bp, Artificial Sequence
  Synthetic oligonucleotide; CAG chr11 5234923 5234942 5234939 +
aatggacaaatctattgctg

SEQ ID NO: 9599 - DNA, 20 bp, Artificial Sequence
  Synthetic oligonucleotide; TGG chr11 5234954 5234973 5234970 +
tgcttgcttcctccttcttt

SEQ ID NO: 9600 - DNA, 20 bp, Artificial Sequence
  Synthetic oligonucleotide; AAG chr11 5235016 5235035 5235032 +
ttgaaataaatatccattaa

SEQ ID NO: 9601 - DNA, 20 bp, Artificial Sequence
  Synthetic oligonucleotide; TAG chr11 5235036 5235055 5235052 +
aagaatatttaaaaaatgaa

SEQ ID NO: 9602 - DNA, 20 bp, Artificial Sequence
  Synthetic oligonucleotide; CAG chr11 5235050 5235069 5235066 +
aatgaatagtgtttatttac

SEQ ID NO: 9603 - DNA, 20 bp, Artificial Sequence
  Synthetic oligonucleotide; TAG chr11 5235062 5235081 5235078 +
ttatttaccagttattgaaa

SEQ ID NO: 9604 - DNA, 20 bp, Artificial Sequence
  Synthetic oligonucleotide; AGG chr11 5235063 5235082 5235079 +
tatttaccagttattgaaat

SEQ ID NO: 9605 - DNA, 20 bp, Artificial Sequence
  Synthetic oligonucleotide; TGG chr11 5235069 5235088 5235085 +
ccagttattgaaataggttc

SEQ ID NO: 9606 - DNA, 20 bp, Artificial Sequence
  Synthetic oligonucleotide; AAG chr11 5235085 5235104 5235101 +
gttctggaaacatgaatttt

SEQ ID NO: 9607 - DNA, 20 bp, Artificial Sequence
  Synthetic oligonucleotide; AGG chr11 5235086 5235105 5235102 +
ttctggaaacatgaatttta

SEQ ID NO: 9608 - DNA, 20 bp, Artificial Sequence
  Synthetic oligonucleotide; CAG chr11 5235104 5235123 5235120 +
taaggttaacattttaatga

SEQ ID NO: 9609 - DNA, 20 bp, Artificial Sequence
  Synthetic oligonucleotide; TGG chr11 5235152 5235171 5235168 +
attttgaatgtttaaaatta

SEQ ID NO: 9610 - DNA, 20 bp, Artificial Sequence
  Synthetic oligonucleotide; AAG chr11 5235163 5235182 5235179 +
ttaaaattatggtatgacta

SEQ ID NO: 9611 - DNA, 20 bp, Artificial Sequence
  Synthetic oligonucleotide; AAG chr11 5235167 5235186 5235183 +
aattatggtatgactaaaga

SEQ ID NO: 9612 - DNA, 20 bp, Artificial Sequence
  Synthetic oligonucleotide; AAG chr11 5235176 5235195 5235192 +
atgactaaagaaagaatgca

SEQ ID NO: 9613 - DNA, 20 bp, Artificial Sequence
  Synthetic oligonucleotide; AAG chr11 5235183 5235202 5235199 +
aagaaagaatgcaaagtgaa

SEQ ID NO: 9614 - DNA, 20 bp, Artificial Sequence
  Synthetic oligonucleotide; TAG chr11 5235186 5235205 5235202 +
aaagaatgcaaagtgaaaag

SEQ ID NO: 9615 - DNA, 20 bp, Artificial Sequence
  Synthetic oligonucleotide; CAG chr11 5235201 5235220 5235217 +
aaaagtagatttaccatatt

SEQ ID NO: 9616 - DNA, 20 bp, Artificial Sequence
  Synthetic oligonucleotide; CAG chr11 5235205 5235224 5235221 +
gtagatttaccatattcagc

SEQ ID NO: 9617 - DNA, 20 bp, Artificial Sequence
  Synthetic oligonucleotide; AAG chr11 5235221 5235240 5235237 +
cagccagattaaatttaacg

SEQ ID NO: 9618 - DNA, 20 bp, Artificial Sequence
  Synthetic oligonucleotide; TGG chr11 5235228 5235247 5235244 +
attaaatttaacgaagttcc

SEQ ID NO: 9619 - DNA, 20 bp, Artificial Sequence
  Synthetic oligonucleotide; GGG chr11 5235229 5235248 5235245 +
ttaaatttaacgaagttcct

SEQ ID NO: 9620 - DNA, 20 bp, Artificial Sequence
  Synthetic oligonucleotide; TAG chr11 5235239 5235258 5235255 +
cgaagttcctgggaatatgc

SEQ ID NO: 9621 - DNA, 20 bp, Artificial Sequence
  Synthetic oligonucleotide; CAG chr11 5235244 5235263 5235260 +
ttcctgggaatatgctagta

SEQ ID NO: 9622 - DNA, 20 bp, Artificial Sequence
  Synthetic oligonucleotide; CAG chr11 5235257 5235276 5235273 +
gctagtacagaacattttta

SEQ ID NO: 9623 - DNA, 20 bp, Artificial Sequence
  Synthetic oligonucleotide; TGG chr11 5235281 5235300 5235297 +
tgtgttcttaaaaaaaaatg

SEQ ID NO: 9624 - DNA, 20 bp, Artificial Sequence
  Synthetic oligonucleotide; TAG chr11 5235287 5235306 5235303 +
cttaaaaaaaaatgtggaat

SEQ ID NO: 9625 - DNA, 20 bp, Artificial Sequence
  Synthetic oligonucleotide; CAG chr11 5235293 5235312 5235309 +
aaaaaatgtggaattagacc

SEQ ID NO: 9626 - DNA, 20 bp, Artificial Sequence
  Synthetic oligonucleotide; AGG chr11 5235294 5235313 5235310 +
aaaaatgtggaattagaccc

SEQ ID NO: 9627 - DNA, 20 bp, Artificial Sequence
  Synthetic oligonucleotide; AAG chr11 5235301 5235320 5235317 +
tggaattagacccaggaatg

SEQ ID NO: 9628 - DNA, 20 bp, Artificial Sequence
  Synthetic oligonucleotide; CAG chr11 5235308 5235327 5235324 +
agacccaggaatgaagatcc

SEQ ID NO: 9629 - DNA, 20 bp, Artificial Sequence
  Synthetic oligonucleotide; TAG chr11 5235311 5235330 5235327 +
cccaggaatgaagatcccag

SEQ ID NO: 9630 - DNA, 20 bp, Artificial Sequence
  Synthetic oligonucleotide; TGG chr11 5235350 5235369 5235366 +
gaattcaaataatgccacaa

SEQ ID NO: 9631 - DNA, 20 bp, Artificial Sequence
  Synthetic oligonucleotide; CAG chr11 5235353 5235372 5235369 +
ttcaaataatgccacaatgg

SEQ ID NO: 9632 - DNA, 20 bp, Artificial Sequence
  Synthetic oligonucleotide; GAG chr11 5235372 5235391 5235388 +
gcagacaaatacacacccat

SEQ ID NO: 9633 - DNA, 20 bp, Artificial Sequence
  Synthetic oligonucleotide; AAG chr11 5235384 5235403 5235400 +
acacccatgagcatatccaa

SEQ ID NO: 9634 - DNA, 20 bp, Artificial Sequence
  Synthetic oligonucleotide; AGG chr11 5235385 5235404 5235401 +
cacccatgagcatatccaaa

SEQ ID NO: 9635 - DNA, 20 bp, Artificial Sequence
  Synthetic oligonucleotide; AAG chr11 5235388 5235407 5235404 +
ccatgagcatatccaaaagg

SEQ ID NO: 9636 - DNA, 20 bp, Artificial Sequence
  Synthetic oligonucleotide; AGG chr11 5235389 5235408 5235405 +
catgagcatatccaaaagga

SEQ ID NO: 9637 - DNA, 20 bp, Artificial Sequence
  Synthetic oligonucleotide; AAG chr11 5235396 5235415 5235412 +
atatccaaaaggaaggattg

SEQ ID NO: 9638 - DNA, 20 bp, Artificial Sequence
  Synthetic oligonucleotide; AGG chr11 5235397 5235416 5235413 +
tatccaaaaggaaggattga

SEQ ID NO: 9639 - DNA, 20 bp, Artificial Sequence
  Synthetic oligonucleotide; AAG chr11 5235401 5235420 5235417 +
caaaaggaaggattgaagga

SEQ ID NO: 9640 - DNA, 20 bp, Artificial Sequence
  Synthetic oligonucleotide; GAG chr11 5235403 5235422 5235419 +
aaaggaaggattgaaggaaa

SEQ ID NO: 9641 - DNA, 20 bp, Artificial Sequence
  Synthetic oligonucleotide; AGG chr11 5235404 5235423 5235420 +
aaggaaggattgaaggaaag

SEQ ID NO: 9642 - DNA, 20 bp, Artificial Sequence
  Synthetic oligonucleotide; GAG chr11 5235406 5235425 5235422 +
ggaaggattgaaggaaagag

SEQ ID NO: 9643 - DNA, 20 bp, Artificial Sequence
  Synthetic oligonucleotide; AGG chr11 5235407 5235426 5235423 +
gaaggattgaaggaaagagg

SEQ ID NO: 9644 - DNA, 20 bp, Artificial Sequence
  Synthetic oligonucleotide; AAG chr11 5235410 5235429 5235426 +
ggattgaaggaaagaggagg

SEQ ID NO: 9645 - DNA, 20 bp, Artificial Sequence
  Synthetic oligonucleotide; TGG chr11 5235416 5235435 5235432 +
aaggaaagaggaggaagaaa

SEQ ID NO: 9646 - DNA, 20 bp, Artificial Sequence
  Synthetic oligonucleotide; GAG chr11 5235418 5235437 5235434 +
ggaaagaggaggaagaaatg

SEQ ID NO: 9647 - DNA, 20 bp, Artificial Sequence
  Synthetic oligonucleotide; AAG chr11 5235422 5235441 5235438 +
agaggaggaagaaatggaga

SEQ ID NO: 9648 - DNA, 20 bp, Artificial Sequence
  Synthetic oligonucleotide; AGG chr11 5235423 5235442 5235439 +
gaggaggaagaaatggagaa

SEQ ID NO: 9649 - DNA, 20 bp, Artificial Sequence
  Synthetic oligonucleotide; AAG chr11 5235426 5235445 5235442 +
gaggaagaaatggagaaagg

SEQ ID NO: 9650 - DNA, 20 bp, Artificial Sequence
  Synthetic oligonucleotide; AGG chr11 5235427 5235446 5235443 +
aggaagaaatggagaaagga

SEQ ID NO: 9651 - DNA, 20 bp, Artificial Sequence
  Synthetic oligonucleotide; AAG chr11 5235430 5235449 5235446 +
aagaaatggagaaaggaagg

SEQ ID NO: 9652 - DNA, 20 bp, Artificial Sequence
  Synthetic oligonucleotide; AGG chr11 5235431 5235450 5235447 +
agaaatggagaaaggaagga

SEQ ID NO: 9653 - DNA, 20 bp, Artificial Sequence
  Synthetic oligonucleotide; AAG chr11 5235434 5235453 5235450 +
aatggagaaaggaaggaagg

SEQ ID NO: 9654 - DNA, 20 bp, Artificial Sequence
  Synthetic oligonucleotide; GAG chr11 5235436 5235455 5235452 +
tggagaaaggaaggaaggaa

SEQ ID NO: 9655 - DNA, 20 bp, Artificial Sequence
  Synthetic oligonucleotide; AGG chr11 5235437 5235456 5235453 +
ggagaaaggaaggaaggaag

SEQ ID NO: 9656 - DNA, 20 bp, Artificial Sequence
  Synthetic oligonucleotide; GGG chr11 5235438 5235457 5235454 +
gagaaaggaaggaaggaaga

SEQ ID NO: 9657 - DNA, 20 bp, Artificial Sequence
  Synthetic oligonucleotide; GGG chr11 5235439 5235458 5235455 +
agaaaggaaggaaggaagag

SEQ ID NO: 9658 - DNA, 20 bp, Artificial Sequence
  Synthetic oligonucleotide; AAG chr11 5235442 5235461 5235458 +
aaggaaggaaggaagagggg

SEQ ID NO: 9659 - DNA, 20 bp, Artificial Sequence
  Synthetic oligonucleotide; GAG chr11 5235444 5235463 5235460 +
ggaaggaaggaagaggggaa

SEQ ID NO: 9660 - DNA, 20 bp, Artificial Sequence
  Synthetic oligonucleotide; GAG chr11 5235446 5235465 5235462 +
aaggaaggaagaggggaaga

SEQ ID NO: 9661 - DNA, 20 bp, Artificial Sequence
  Synthetic oligonucleotide; GAG chr11 5235448 5235467 5235464 +
ggaaggaagaggggaagaga

SEQ ID NO: 9662 - DNA, 20 bp, Artificial Sequence
  Synthetic oligonucleotide; AGG chr11 5235449 5235468 5235465 +
gaaggaagaggggaagagag

SEQ ID NO: 9663 - DNA, 20 bp, Artificial Sequence
  Synthetic oligonucleotide; TGG chr11 5235453 5235472 5235469 +
gaagaggggaagagagagga

SEQ ID NO: 9664 - DNA, 20 bp, Artificial Sequence
  Synthetic oligonucleotide; AAG chr11 5235456 5235475 5235472 +
gaggggaagagagaggatgg

SEQ ID NO: 9665 - DNA, 20 bp, Artificial Sequence
  Synthetic oligonucleotide; AGG chr11 5235457 5235476 5235473 +
aggggaagagagaggatgga

SEQ ID NO: 9666 - DNA, 20 bp, Artificial Sequence
  Synthetic oligonucleotide; GGG chr11 5235458 5235477 5235474 +
ggggaagagagaggatggaa

SEQ ID NO: 9667 - DNA, 20 bp, Artificial Sequence
  Synthetic oligonucleotide; TGG chr11 5235462 5235481 5235478 +
aagagagaggatggaaggga

SEQ ID NO: 9668 - DNA, 20 bp, Artificial Sequence
  Synthetic oligonucleotide; GAG chr11 5235464 5235483 5235480 +
gagagaggatggaagggatg

SEQ ID NO: 9669 - DNA, 20 bp, Artificial Sequence
  Synthetic oligonucleotide; AGG chr11 5235465 5235484 5235481 +
agagaggatggaagggatgg

SEQ ID NO: 9670 - DNA, 20 bp, Artificial Sequence
  Synthetic oligonucleotide; GAG chr11 5235467 5235486 5235483 +
agaggatggaagggatggag

SEQ ID NO: 9671 - DNA, 20 bp, Artificial Sequence
  Synthetic oligonucleotide; AAG chr11 5235470 5235489 5235486 +
ggatggaagggatggaggag

SEQ ID NO: 9672 - DNA, 20 bp, Artificial Sequence
  Synthetic oligonucleotide; AAG chr11 5235473 5235492 5235489 +
tggaagggatggaggagaag

SEQ ID NO: 9673 - DNA, 20 bp, Artificial Sequence
  Synthetic oligonucleotide; AGG chr11 5235474 5235493 5235490 +
ggaagggatggaggagaaga

SEQ ID NO: 9674 - DNA, 20 bp, Artificial Sequence
  Synthetic oligonucleotide; TGG chr11 5235489 5235508 5235505 +
gaagaaggaaaaataaataa

SEQ ID NO: 9675 - DNA, 20 bp, Artificial Sequence
  Synthetic oligonucleotide; GAG chr11 5235491 5235510 5235507 +
agaaggaaaaataaataatg

SEQ ID NO: 9676 - DNA, 20 bp, Artificial Sequence
  Synthetic oligonucleotide; GAG chr11 5235493 5235512 5235509 +
aaggaaaaataaataatgga

SEQ ID NO: 9677 - DNA, 20 bp, Artificial Sequence
  Synthetic oligonucleotide; AGG chr11 5235494 5235513 5235510 +
aggaaaaataaataatggag

SEQ ID NO: 9678 - DNA, 20 bp, Artificial Sequence
  Synthetic oligonucleotide; GAG chr11 5235496 5235515 5235512 +
gaaaaataaataatggagag

SEQ ID NO: 9679 - DNA, 20 bp, Artificial Sequence
  Synthetic oligonucleotide; GAG chr11 5235498 5235517 5235514 +
aaaataaataatggagagga

SEQ ID NO: 9680 - DNA, 20 bp, Artificial Sequence
  Synthetic oligonucleotide; AGG chr11 5235499 5235518 5235515 +
aaataaataatggagaggag

SEQ ID NO: 9681 - DNA, 20 bp, Artificial Sequence
  Synthetic oligonucleotide; GAG chr11 5235501 5235520 5235517 +
ataaataatggagaggagag

SEQ ID NO: 9682 - DNA, 20 bp, Artificial Sequence
  Synthetic oligonucleotide; AAG chr11 5235508 5235527 5235524 +
atggagaggagaggagaaaa

SEQ ID NO: 9683 - DNA, 20 bp, Artificial Sequence
  Synthetic oligonucleotide; AGG chr11 5235509 5235528 5235525 +
tggagaggagaggagaaaaa

SEQ ID NO: 9684 - DNA, 20 bp, Artificial Sequence
  Synthetic oligonucleotide; GAG chr11 5235511 5235530 5235527 +
gagaggagaggagaaaaaag

SEQ ID NO: 9685 - DNA, 20 bp, Artificial Sequence
  Synthetic oligonucleotide; AGG chr11 5235512 5235531 5235528 +
agaggagaggagaaaaaagg

SEQ ID NO: 9686 - DNA, 20 bp, Artificial Sequence
  Synthetic oligonucleotide; GGG chr11 5235513 5235532 5235529 +
gaggagaggagaaaaaagga

SEQ ID NO: 9687 - DNA, 20 bp, Artificial Sequence
  Synthetic oligonucleotide; GGG chr11 5235514 5235533 5235530 +
aggagaggagaaaaaaggag

SEQ ID NO: 9688 - DNA, 20 bp, Artificial Sequence
  Synthetic oligonucleotide; GAG chr11 5235516 5235535 5235532 +
gagaggagaaaaaaggaggg

SEQ ID NO: 9689 - DNA, 20 bp, Artificial Sequence
  Synthetic oligonucleotide; GAG chr11 5235518 5235537 5235534 +
gaggagaaaaaaggagggga

SEQ ID NO: 9690 - DNA, 20 bp, Artificial Sequence
  Synthetic oligonucleotide; AGG chr11 5235519 5235538 5235535 +
aggagaaaaaaggaggggag

SEQ ID NO: 9691 - DNA, 20 bp, Artificial Sequence
  Synthetic oligonucleotide; GAG chr11 5235521 5235540 5235537 +
gagaaaaaaggaggggagag

SEQ ID NO: 9692 - DNA, 20 bp, Artificial Sequence
  Synthetic oligonucleotide; GAG chr11 5235523 5235542 5235539 +
gaaaaaaggaggggagagga

SEQ ID NO: 9693 - DNA, 20 bp, Artificial Sequence
  Synthetic oligonucleotide; AGG chr11 5235524 5235543 5235540 +
aaaaaaggaggggagaggag

SEQ ID NO: 9694 - DNA, 20 bp, Artificial Sequence
  Synthetic oligonucleotide; GAG chr11 5235526 5235545 5235542 +
aaaaggaggggagaggagag

SEQ ID NO: 9695 - DNA, 20 bp, Artificial Sequence
  Synthetic oligonucleotide; AAG chr11 5235529 5235548 5235545 +
aggaggggagaggagaggag

SEQ ID NO: 9696 - DNA, 20 bp, Artificial Sequence
  Synthetic oligonucleotide; AGG chr11 5235530 5235549 5235546 +
ggaggggagaggagaggaga

SEQ ID NO: 9697 - DNA, 20 bp, Artificial Sequence
  Synthetic oligonucleotide; GGG chr11 5235531 5235550 5235547 +
gaggggagaggagaggagaa

SEQ ID NO: 9698 - DNA, 20 bp, Artificial Sequence
  Synthetic oligonucleotide; TAG chr11 5235535 5235554 5235551 +
ggagaggagaggagaaggga

SEQ ID NO: 9699 - DNA, 20 bp, Artificial Sequence
  Synthetic oligonucleotide; AGG chr11 5235536 5235555 5235552 +
gagaggagaggagaagggat

SEQ ID NO: 9700 - DNA, 20 bp, Artificial Sequence
  Synthetic oligonucleotide; GGG chr11 5235537 5235556 5235553 +
agaggagaggagaagggata

SEQ ID NO: 9701 - DNA, 20 bp, Artificial Sequence
  Synthetic oligonucleotide; AAG chr11 5235540 5235559 5235556 +
ggagaggagaagggataggg

SEQ ID NO: 9702 - DNA, 20 bp, Artificial Sequence
  Synthetic oligonucleotide; GAG chr11 5235542 5235561 5235558 +
agaggagaagggatagggaa

SEQ ID NO: 9703 - DNA, 20 bp, Artificial Sequence
  Synthetic oligonucleotide; AAG chr11 5235546 5235565 5235562 +
gagaagggatagggaagaga

SEQ ID NO: 9704 - DNA, 20 bp, Artificial Sequence
  Synthetic oligonucleotide; GAG chr11 5235548 5235567 5235564 +
gaagggatagggaagagaaa

SEQ ID NO: 9705 - DNA, 20 bp, Artificial Sequence
  Synthetic oligonucleotide; AAG chr11 5235552 5235571 5235568 +
ggatagggaagagaaagaga

SEQ ID NO: 9706 - DNA, 20 bp, Artificial Sequence
  Synthetic oligonucleotide; AGG chr11 5235553 5235572 5235569 +
gatagggaagagaaagagaa

SEQ ID NO: 9707 - DNA, 20 bp, Artificial Sequence
  Synthetic oligonucleotide; GGG chr11 5235554 5235573 5235570 +
atagggaagagaaagagaaa

SEQ ID NO: 9708 - DNA, 20 bp, Artificial Sequence
  Synthetic oligonucleotide; AAG chr11 5235557 5235576 5235573 +
gggaagagaaagagaaaggg

SEQ ID NO: 9709 - DNA, 20 bp, Artificial Sequence
  Synthetic oligonucleotide; AGG chr11 5235558 5235577 5235574 +
ggaagagaaagagaaaggga

SEQ ID NO: 9710 - DNA, 20 bp, Artificial Sequence
  Synthetic oligonucleotide; GGG chr11 5235559 5235578 5235575 +
gaagagaaagagaaagggaa

SEQ ID NO: 9711 - DNA, 20 bp, Artificial Sequence
  Synthetic oligonucleotide; AAG chr11 5235562 5235581 5235578 +
gagaaagagaaagggaaggg

SEQ ID NO: 9712 - DNA, 20 bp, Artificial Sequence
  Synthetic oligonucleotide; GAG chr11 5235564 5235583 5235580 +
gaaagagaaagggaagggaa

SEQ ID NO: 9713 - DNA, 20 bp, Artificial Sequence
  Synthetic oligonucleotide; GAG chr11 5235566 5235585 5235582 +
aagagaaagggaagggaaga

SEQ ID NO: 9714 - DNA, 20 bp, Artificial Sequence
  Synthetic oligonucleotide; AGG chr11 5235567 5235586 5235583 +
agagaaagggaagggaagag

SEQ ID NO: 9715 - DNA, 20 bp, Artificial Sequence
  Synthetic oligonucleotide; AAG chr11 5235571 5235590 5235587 +
aaagggaagggaagagagga

SEQ ID NO: 9716 - DNA, 20 bp, Artificial Sequence
  Synthetic oligonucleotide; AAG chr11 5235574 5235593 5235590 +
gggaagggaagagaggaaag

SEQ ID NO: 9717 - DNA, 20 bp, Artificial Sequence
  Synthetic oligonucleotide; GAG chr11 5235576 5235595 5235592 +
gaagggaagagaggaaagaa

SEQ ID NO: 9718 - DNA, 20 bp, Artificial Sequence
  Synthetic oligonucleotide; AAG chr11 5235579 5235598 5235595 +
gggaagagaggaaagaagag

SEQ ID NO: 9719 - DNA, 20 bp, Artificial Sequence
  Synthetic oligonucleotide; GAG chr11 5235581 5235600 5235597 +
gaagagaggaaagaagagaa

SEQ ID NO: 9720 - DNA, 20 bp, Artificial Sequence
  Synthetic oligonucleotide; AGG chr11 5235582 5235601 5235598 +
aagagaggaaagaagagaag

SEQ ID NO: 9721 - DNA, 20 bp, Artificial Sequence
  Synthetic oligonucleotide; GAG chr11 5235584 5235603 5235600 +
gagaggaaagaagagaagag

SEQ ID NO: 9722 - DNA, 20 bp, Artificial Sequence
  Synthetic oligonucleotide; GAG chr11 5235586 5235605 5235602 +
gaggaaagaagagaagagga

SEQ ID NO: 9723 - DNA, 20 bp, Artificial Sequence
  Synthetic oligonucleotide; AAG chr11 5235591 5235610 5235607 +
aagaagagaagaggagagaa

SEQ ID NO: 9724 - DNA, 20 bp, Artificial Sequence
  Synthetic oligonucleotide; AAG chr11 5235599 5235618 5235615 +
aagaggagagaaaagaaacg

SEQ ID NO: 9725 - DNA, 20 bp, Artificial Sequence
  Synthetic oligonucleotide; GAG chr11 5235601 5235620 5235617 +
gaggagagaaaagaaacgaa

SEQ ID NO: 9726 - DNA, 20 bp, Artificial Sequence
  Synthetic oligonucleotide; GAG chr11 5235603 5235622 5235619 +
ggagagaaaagaaacgaaga

SEQ ID NO: 9727 - DNA, 20 bp, Artificial Sequence
  Synthetic oligonucleotide; AGG chr11 5235604 5235623 5235620 +
gagagaaaagaaacgaagag

SEQ ID NO: 9728 - DNA, 20 bp, Artificial Sequence
  Synthetic oligonucleotide; GGG chr11 5235605 5235624 5235621 +
agagaaaagaaacgaagaga

SEQ ID NO: 9729 - DNA, 20 bp, Artificial Sequence
  Synthetic oligonucleotide; GGG chr11 5235606 5235625 5235622 +
gagaaaagaaacgaagagag

SEQ ID NO: 9730 - DNA, 20 bp, Artificial Sequence
  Synthetic oligonucleotide; AAG chr11 5235609 5235628 5235625 +
aaaagaaacgaagagagggg

SEQ ID NO: 9731 - DNA, 20 bp, Artificial Sequence
  Synthetic oligonucleotide; AGG chr11 5235610 5235629 5235626 +
aaagaaacgaagagagggga

SEQ ID NO: 9732 - DNA, 20 bp, Artificial Sequence
  Synthetic oligonucleotide; GGG chr11 5235611 5235630 5235627 +
aagaaacgaagagaggggaa

SEQ ID NO: 9733 - DNA, 20 bp, Artificial Sequence
  Synthetic oligonucleotide; AAG chr11 5235614 5235633 5235630 +
aaacgaagagaggggaaggg

SEQ ID NO: 9734 - DNA, 20 bp, Artificial Sequence
  Synthetic oligonucleotide; AGG chr11 5235615 5235634 5235631 +
aacgaagagaggggaaggga

SEQ ID NO: 9735 - DNA, 20 bp, Artificial Sequence
  Synthetic oligonucleotide; AAG chr11 5235624 5235643 5235640 +
aggggaagggaaggaaaaaa

SEQ ID NO: 9736 - DNA, 20 bp, Artificial Sequence
  Synthetic oligonucleotide; GAG chr11 5235626 5235645 5235642 +
gggaagggaaggaaaaaaaa

SEQ ID NO: 9737 - DNA, 20 bp, Artificial Sequence
  Synthetic oligonucleotide; AGG chr11 5235627 5235646 5235643 +
ggaagggaaggaaaaaaaag

SEQ ID NO: 9738 - DNA, 20 bp, Artificial Sequence
  Synthetic oligonucleotide; AAG chr11 5235634 5235653 5235650 +
aaggaaaaaaaagaggaaaa

SEQ ID NO: 9739 - DNA, 20 bp, Artificial Sequence
  Synthetic oligonucleotide; GAG chr11 5235636 5235655 5235652 +
ggaaaaaaaagaggaaaaaa

SEQ ID NO: 9740 - DNA, 20 bp, Artificial Sequence
  Synthetic oligonucleotide; AAG chr11 5235641 5235660 5235657 +
aaaaagaggaaaaaagagac

SEQ ID NO: 9741 - DNA, 20 bp, Artificial Sequence
  Synthetic oligonucleotide; GAG chr11 5235643 5235662 5235659 +
aaagaggaaaaaagagacaa

SEQ ID NO: 9742 - DNA, 20 bp, Artificial Sequence
  Synthetic oligonucleotide; AAG chr11 5235646 5235665 5235662 +
gaggaaaaaagagacaagag

SEQ ID NO: 9743 - DNA, 20 bp, Artificial Sequence
  Synthetic oligonucleotide; GAG chr11 5235648 5235667 5235664 +
ggaaaaaagagacaagagaa

SEQ ID NO: 9744 - DNA, 20 bp, Artificial Sequence
  Synthetic oligonucleotide; AAG chr11 5235653 5235672 5235669 +
aaagagacaagagaagagat

SEQ ID NO: 9745 - DNA, 20 bp, Artificial Sequence
  Synthetic oligonucleotide; CAG chr11 5235661 5235680 5235677 +
aagagaagagataagactga

SEQ ID NO: 9746 - DNA, 20 bp, Artificial Sequence
  Synthetic oligonucleotide; TGG chr11 5235673 5235692 5235689 +
aagactgacagttcaaattt

SEQ ID NO: 9747 - DNA, 20 bp, Artificial Sequence
  Synthetic oligonucleotide; TGG chr11 5235676 5235695 5235692 +
actgacagttcaaattttgg

SEQ ID NO: 9748 - DNA, 20 bp, Artificial Sequence
  Synthetic oligonucleotide; TGG chr11 5235684 5235703 5235700 +
ttcaaattttggtggtgata

SEQ ID NO: 9749 - DNA, 20 bp, Artificial Sequence
  Synthetic oligonucleotide; TAG chr11 5235692 5235711 5235708 +
ttggtggtgatatggatcaa

SEQ ID NO: 9750 - DNA, 20 bp, Artificial Sequence
  Synthetic oligonucleotide; TGG chr11 5235710 5235729 5235726 +
aatagaaactcaaactctgt

SEQ ID NO: 9751 - DNA, 20 bp, Artificial Sequence
  Synthetic oligonucleotide; TAG chr11 5235726 5235745 5235742 +
ctgttggtgacactgtacaa

SEQ ID NO: 9752 - DNA, 20 bp, Artificial Sequence
  Synthetic oligonucleotide; TGG chr11 5235740 5235759 5235756 +
gtacaatagtataacccctt

SEQ ID NO: 9753 - DNA, 20 bp, Artificial Sequence
  Synthetic oligonucleotide; TAG chr11 5235754 5235773 5235770 +
cccctttggaaaacctttaa

SEQ ID NO: 9754 - DNA, 20 bp, Artificial Sequence
  Synthetic oligonucleotide; TGG chr11 5235770 5235789 5235786 +
ttaatagtatccacaaatgc

SEQ ID NO: 9755 - DNA, 20 bp, Artificial Sequence
  Synthetic oligonucleotide; AAG chr11 5235782 5235801 5235798 +
acaaatgctggatgcttgat

SEQ ID NO: 9756 - DNA, 20 bp, Artificial Sequence
  Synthetic oligonucleotide; TAG chr11 5235794 5235813 5235810 +
tgcttgataagtctattacc

SEQ ID NO: 9757 - DNA, 20 bp, Artificial Sequence
  Synthetic oligonucleotide; TAG chr11 5235809 5235828 5235825 +
ttacctagcaattacatttt

SEQ ID NO: 9758 - DNA, 20 bp, Artificial Sequence
  Synthetic oligonucleotide; CAG chr11 5235817 5235836 5235833 +
caattacatttttagatatt

SEQ ID NO: 9759 - DNA, 20 bp, Artificial Sequence
  Synthetic oligonucleotide; AAG chr11 5235843 5235862 5235859 +
cacatgcatgtgtgtatcca

SEQ ID NO: 9760 - DNA, 20 bp, Artificial Sequence
  Synthetic oligonucleotide; TAG chr11 5235853 5235872 5235869 +
tgtgtatccaaagacatgta

SEQ ID NO: 9761 - DNA, 20 bp, Artificial Sequence
  Synthetic oligonucleotide; CAG chr11 5235868 5235887 5235884 +
atgtatagaaatgcttatga

SEQ ID NO: 9762 - DNA, 20 bp, Artificial Sequence
  Synthetic oligonucleotide; CGG chr11 5235894 5235913 5235910 +
taatcataaaaacctcaaac

SEQ ID NO: 9763 - DNA, 20 bp, Artificial Sequence
  Synthetic oligonucleotide; TAG chr11 5235897 5235916 5235913 +
tcataaaaacctcaaaccgg

SEQ ID NO: 9764 - DNA, 20 bp, Artificial Sequence
  Synthetic oligonucleotide; CAG chr11 5235919 5235938 5235935 +
gccacttaaatgcttaccaa

SEQ ID NO: 9765 - DNA, 20 bp, Artificial Sequence
  Synthetic oligonucleotide; TAG chr11 5235922 5235941 5235938 +
acttaaatgcttaccaacag

SEQ ID NO: 9766 - DNA, 20 bp, Artificial Sequence
  Synthetic oligonucleotide; CGG chr11 5235938 5235957 5235954 +
acagtagaattgataaatta

SEQ ID NO: 9767 - DNA, 20 bp, Artificial Sequence
  Synthetic oligonucleotide; TAG chr11 5235943 5235962 5235959 +
agaattgataaattacggta

SEQ ID NO: 9768 - DNA, 20 bp, Artificial Sequence
  Synthetic oligonucleotide; AAG chr11 5235949 5235968 5235965 +
gataaattacggtatagtca

SEQ ID NO: 9769 - DNA, 20 bp, Artificial Sequence
  Synthetic oligonucleotide; TAG chr11 5235954 5235973 5235970 +
attacggtatagtcaaagaa

SEQ ID NO: 9770 - DNA, 20 bp, Artificial Sequence
  Synthetic oligonucleotide; CAG chr11 5235966 5235985 5235982 +
tcaaagaatagaatattaca

SEQ ID NO: 9771 - DNA, 20 bp, Artificial Sequence
  Synthetic oligonucleotide; AAG chr11 5235976 5235995 5235992 +
gaatattacacagaaatgaa

SEQ ID NO: 9772 - DNA, 20 bp, Artificial Sequence
  Synthetic oligonucleotide; TAG chr11 5236000 5236019 5236016 +
atcaactactgcttaacacg

SEQ ID NO: 9773 - DNA, 20 bp, Artificial Sequence
  Synthetic oligonucleotide; CAG chr11 5236021 5236040 5236037 +
agcgatacaaatgcatttta

SEQ ID NO: 9774 - DNA, 20 bp, Artificial Sequence
  Synthetic oligonucleotide; TGG chr11 5236028 5236047 5236044 +
caaatgcattttacagcatt

SEQ ID NO: 9775 - DNA, 20 bp, Artificial Sequence
  Synthetic oligonucleotide; AAG chr11 5236039 5236058 5236055 +
tacagcatttggttgattaa

SEQ ID NO: 9776 - DNA, 20 bp, Artificial Sequence
  Synthetic oligonucleotide; CAG chr11 5236046 5236065 5236062 +
tttggttgattaaaagtaac

SEQ ID NO: 9777 - DNA, 20 bp, Artificial Sequence
  Synthetic oligonucleotide; GAG chr11 5236048 5236067 5236064 +
tggttgattaaaagtaacca

SEQ ID NO: 9778 - DNA, 20 bp, Artificial Sequence
  Synthetic oligonucleotide; AGG chr11 5236049 5236068 5236065 +
ggttgattaaaagtaaccag

SEQ ID NO: 9779 - DNA, 20 bp, Artificial Sequence
  Synthetic oligonucleotide; GAG chr11 5236053 5236072 5236069 +
gattaaaagtaaccagaggt

SEQ ID NO: 9780 - DNA, 20 bp, Artificial Sequence
  Synthetic oligonucleotide; TAG chr11 5236083 5236102 5236099 +
tatatgactttatttgtata

SEQ ID NO: 9781 - DNA, 20 bp, Artificial Sequence
  Synthetic oligonucleotide; AAG chr11 5236087 5236106 5236103 +
tgactttatttgtatataga

SEQ ID NO: 9782 - DNA, 20 bp, Artificial Sequence
  Synthetic oligonucleotide; TGG chr11 5236091 5236110 5236107 +
tttatttgtatatagaaaga

SEQ ID NO: 9783 - DNA, 20 bp, Artificial Sequence
  Synthetic oligonucleotide; GAG chr11 5236105 5236124 5236121 +
gaaagatggatgatgtgcct

SEQ ID NO: 9784 - DNA, 20 bp, Artificial Sequence
  Synthetic oligonucleotide; AAG chr11 5236119 5236138 5236135 +
gtgcctgagattctgatcac

SEQ ID NO: 9785 - DNA, 20 bp, Artificial Sequence
  Synthetic oligonucleotide; AGG chr11 5236120 5236139 5236136 +
tgcctgagattctgatcaca

SEQ ID NO: 9786 - DNA, 20 bp, Artificial Sequence
  Synthetic oligonucleotide; GGG chr11 5236121 5236140 5236137 +
gcctgagattctgatcacaa

SEQ ID NO: 9787 - DNA, 20 bp, Artificial Sequence
  Synthetic oligonucleotide; GGG chr11 5236122 5236141 5236138 +
cctgagattctgatcacaag

SEQ ID NO: 9788 - DNA, 20 bp, Artificial Sequence
  Synthetic oligonucleotide; TAG chr11 5236138 5236157 5236154 +
caaggggaaatgttataaaa

SEQ ID NO: 9789 - DNA, 20 bp, Artificial Sequence
  Synthetic oligonucleotide; AGG chr11 5236139 5236158 5236155 +
aaggggaaatgttataaaat

SEQ ID NO: 9790 - DNA, 20 bp, Artificial Sequence
  Synthetic oligonucleotide; GGG chr11 5236140 5236159 5236156 +
aggggaaatgttataaaata

SEQ ID NO: 9791 - DNA, 20 bp, Artificial Sequence
  Synthetic oligonucleotide; TAG chr11 5236143 5236162 5236159 +
ggaaatgttataaaataggg

SEQ ID NO: 9792 - DNA, 20 bp, Artificial Sequence
  Synthetic oligonucleotide; GAG chr11 5236145 5236164 5236161 +
aaatgttataaaatagggta

SEQ ID NO: 9793 - DNA, 20 bp, Artificial Sequence
  Synthetic oligonucleotide; GAG chr11 5236147 5236166 5236163 +
atgttataaaatagggtaga

SEQ ID NO: 9794 - DNA, 20 bp, Artificial Sequence
  Synthetic oligonucleotide; AGG chr11 5236148 5236167 5236164 +
tgttataaaatagggtagag

SEQ ID NO: 9795 - DNA, 20 bp, Artificial Sequence
  Synthetic oligonucleotide; GAG chr11 5236150 5236169 5236166 +
ttataaaatagggtagagag

SEQ ID NO: 9796 - DNA, 20 bp, Artificial Sequence
  Synthetic oligonucleotide; AAG chr11 5236180 5236199 5236196 +
tgacctttaaactttgttac

SEQ ID NO: 9797 - DNA, 20 bp, Artificial Sequence
  Synthetic oligonucleotide; TGG chr11 5236199 5236218 5236215 +
caagttatttttctgtaacc

SEQ ID NO: 9798 - DNA, 20 bp, Artificial Sequence
  Synthetic oligonucleotide; AAG chr11 5236202 5236221 5236218 +
gttatttttctgtaacctgg

SEQ ID NO: 9799 - DNA, 20 bp, Artificial Sequence
  Synthetic oligonucleotide; AAG chr11 5236212 5236231 5236228 +
tgtaacctggaagccaacga

SEQ ID NO: 9800 - DNA, 20 bp, Artificial Sequence
  Synthetic oligonucleotide; AAG chr11 5236229 5236248 5236245 +
cgaaagatattgaataattc

SEQ ID NO: 9801 - DNA, 20 bp, Artificial Sequence
  Synthetic oligonucleotide; AAG chr11 5236233 5236252 5236249 +
agatattgaataattcaaga

SEQ ID NO: 9802 - DNA, 20 bp, Artificial Sequence
  Synthetic oligonucleotide; AGG chr11 5236234 5236253 5236250 +
gatattgaataattcaagaa

SEQ ID NO: 9803 - DNA, 20 bp, Artificial Sequence
  Synthetic oligonucleotide; TGG chr11 5236237 5236256 5236253 +
attgaataattcaagaaagg

SEQ ID NO: 9804 - DNA, 20 bp, Artificial Sequence
  Synthetic oligonucleotide; TGG chr11 5236240 5236259 5236256 +
gaataattcaagaaaggtgg

SEQ ID NO: 9805 - DNA, 20 bp, Artificial Sequence
  Synthetic oligonucleotide; TGG chr11 5236245 5236264 5236261 +
attcaagaaaggtggtggca

SEQ ID NO: 9806 - DNA, 20 bp, Artificial Sequence
  Synthetic oligonucleotide; AAG chr11 5236266 5236285 5236282 +
ggtttgatttgtgtctttaa

SEQ ID NO: 9807 - DNA, 20 bp, Artificial Sequence
  Synthetic oligonucleotide; TAG chr11 5236281 5236300 5236297 +
tttaaaagattattctcact

SEQ ID NO: 9808 - DNA, 20 bp, Artificial Sequence
  Synthetic oligonucleotide; AAG chr11 5236286 5236305 5236302 +
aagattattctcacttagtg

SEQ ID NO: 9809 - DNA, 20 bp, Artificial Sequence
  Synthetic oligonucleotide; TAG chr11 5236299 5236318 5236315 +
cttagtgaagaaatgtattt

SEQ ID NO: 9810 - DNA, 20 bp, Artificial Sequence
  Synthetic oligonucleotide; AAG chr11 5236302 5236321 5236318 +
agtgaagaaatgtattttag

SEQ ID NO: 9811 - DNA, 20 bp, Artificial Sequence
  Synthetic oligonucleotide; TAG chr11 5236305 5236324 5236321 +
gaagaaatgtattttagaag

SEQ ID NO: 9812 - DNA, 20 bp, Artificial Sequence
  Synthetic oligonucleotide; GAG chr11 5236307 5236326 5236323 +
agaaatgtattttagaagta

SEQ ID NO: 9813 - DNA, 20 bp, Artificial Sequence
  Synthetic oligonucleotide; TGG chr11 5236314 5236333 5236330 +
tattttagaagtagagaaaa

SEQ ID NO: 9814 - DNA, 20 bp, Artificial Sequence
  Synthetic oligonucleotide; GGG chr11 5236315 5236334 5236331 +
attttagaagtagagaaaat

SEQ ID NO: 9815 - DNA, 20 bp, Artificial Sequence
  Synthetic oligonucleotide; GAG chr11 5236317 5236336 5236333 +
tttagaagtagagaaaatgg

SEQ ID NO: 9816 - DNA, 20 bp, Artificial Sequence
  Synthetic oligonucleotide; TAG chr11 5236325 5236344 5236341 +
tagagaaaatgggagacaaa

SEQ ID NO: 9817 - DNA, 20 bp, Artificial Sequence
  Synthetic oligonucleotide; TGG chr11 5236329 5236348 5236345 +
gaaaatgggagacaaatagc

SEQ ID NO: 9818 - DNA, 20 bp, Artificial Sequence
  Synthetic oligonucleotide; GGG chr11 5236330 5236349 5236346 +
aaaatgggagacaaatagct

SEQ ID NO: 9819 - DNA, 20 bp, Artificial Sequence
  Synthetic oligonucleotide; CAG chr11 5236342 5236361 5236358 +
aaatagctgggcttctgttg

SEQ ID NO: 9820 - DNA, 20 bp, Artificial Sequence
  Synthetic oligonucleotide; TAG chr11 5236345 5236364 5236361 +
tagctgggcttctgttgcag

SEQ ID NO: 9821 - DNA, 20 bp, Artificial Sequence
  Synthetic oligonucleotide; AGG chr11 5236346 5236365 5236362 +
agctgggcttctgttgcagt

SEQ ID NO: 9822 - DNA, 20 bp, Artificial Sequence
  Synthetic oligonucleotide; GGG chr11 5236347 5236366 5236363 +
gctgggcttctgttgcagta

SEQ ID NO: 9823 - DNA, 20 bp, Artificial Sequence
  Synthetic oligonucleotide; AAG chr11 5236350 5236369 5236366 +
gggcttctgttgcagtaggg

SEQ ID NO: 9824 - DNA, 20 bp, Artificial Sequence
  Synthetic oligonucleotide; AAG chr11 5236354 5236373 5236370 +
ttctgttgcagtagggaaga

SEQ ID NO: 9825 - DNA, 20 bp, Artificial Sequence
  Synthetic oligonucleotide; CAG chr11 5236378 5236397 5236394 +
gacaatgccatttctattat

SEQ ID NO: 9826 - DNA, 20 bp, Artificial Sequence
  Synthetic oligonucleotide; TGG chr11 5236384 5236403 5236400 +
gccatttctattatcagact

SEQ ID NO: 9827 - DNA, 20 bp, Artificial Sequence
  Synthetic oligonucleotide; CGG chr11 5236394 5236413 5236410 +
ttatcagacttggaccatga

SEQ ID NO: 9828 - DNA, 20 bp, Artificial Sequence
  Synthetic oligonucleotide; CAG chr11 5236403 5236422 5236419 +
ttggaccatgacggtgatgt

SEQ ID NO: 9829 - DNA, 20 bp, Artificial Sequence
  Synthetic oligonucleotide; AAG chr11 5236416 5236435 5236432 +
gtgatgtcagtcgtgaacac

SEQ ID NO: 9830 - DNA, 20 bp, Artificial Sequence
  Synthetic oligonucleotide; TAG chr11 5236421 5236440 5236437 +
gtcagtcgtgaacacaagaa

SEQ ID NO: 9831 - DNA, 20 bp, Artificial Sequence
  Synthetic oligonucleotide; AGG chr11 5236422 5236441 5236438 +
tcagtcgtgaacacaagaat

SEQ ID NO: 9832 - DNA, 20 bp, Artificial Sequence
  Synthetic oligonucleotide; GGG chr11 5236423 5236442 5236439 +
cagtcgtgaacacaagaata

SEQ ID NO: 9833 - DNA, 20 bp, Artificial Sequence
  Synthetic oligonucleotide; GAG chr11 5236436 5236455 5236452 +
aagaatagggccacatttgt

SEQ ID NO: 9834 - DNA, 20 bp, Artificial Sequence
  Synthetic oligonucleotide; TAG chr11 5236441 5236460 5236457 +
tagggccacatttgtgagtt

SEQ ID NO: 9835 - DNA, 20 bp, Artificial Sequence
  Synthetic oligonucleotide; TGG chr11 5236444 5236463 5236460 +
ggccacatttgtgagtttag

SEQ ID NO: 9836 - DNA, 20 bp, Artificial Sequence
  Synthetic oligonucleotide; CAG chr11 5236458 5236477 5236474 +
gtttagtggtacgataaaat

SEQ ID NO: 9837 - DNA, 20 bp, Artificial Sequence
  Synthetic oligonucleotide; CAG chr11 5236466 5236485 5236482 +
gtacgataaaatcagaaata

SEQ ID NO: 9838 - DNA, 20 bp, Artificial Sequence
  Synthetic oligonucleotide; TGG chr11 5236472 5236491 5236488 +
taaaatcagaaatacagtct

SEQ ID NO: 9839 - DNA, 20 bp, Artificial Sequence
  Synthetic oligonucleotide; AAG chr11 5236511 5236530 5236527 +
gcactcttgtaaaatgcaaa

SEQ ID NO: 9840 - DNA, 20 bp, Artificial Sequence
  Synthetic oligonucleotide; TAG chr11 5236521 5236540 5236537 +
aaaatgcaaaaagatgtact

SEQ ID NO: 9841 - DNA, 20 bp, Artificial Sequence
  Synthetic oligonucleotide; TGG chr11 5236529 5236548 5236545 +
aaaagatgtacttagatatg

SEQ ID NO: 9842 - DNA, 20 bp, Artificial Sequence
  Synthetic oligonucleotide; TGG chr11 5236535 5236554 5236551 +
tgtacttagatatgtggatc

SEQ ID NO: 9843 - DNA, 20 bp, Artificial Sequence
  Synthetic oligonucleotide; GAG chr11 5236537 5236556 5236553 +
tacttagatatgtggatctg

SEQ ID NO: 9844 - DNA, 20 bp, Artificial Sequence
  Synthetic oligonucleotide; CAG chr11 5236542 5236561 5236558 +
agatatgtggatctggagct

SEQ ID NO: 9845 - DNA, 20 bp, Artificial Sequence
  Synthetic oligonucleotide; AAG chr11 5236546 5236565 5236562 +
atgtggatctggagctcaga

SEQ ID NO: 9846 - DNA, 20 bp, Artificial Sequence
  Synthetic oligonucleotide; CAG chr11 5236557 5236576 5236573 +
gagctcagaaagaatacaac

SEQ ID NO: 9847 - DNA, 20 bp, Artificial Sequence
  Synthetic oligonucleotide; AGG chr11 5236558 5236577 5236574 +
agctcagaaagaatacaacc

SEQ ID NO: 9848 - DNA, 20 bp, Artificial Sequence
  Synthetic oligonucleotide; AAG chr11 5236563 5236582 5236579 +
agaaagaatacaaccaggtc

SEQ ID NO: 9849 - DNA, 20 bp, Artificial Sequence
  Synthetic oligonucleotide; CAG chr11 5236570 5236589 5236586 +
atacaaccaggtcaagaata

SEQ ID NO: 9850 - DNA, 20 bp, Artificial Sequence
  Synthetic oligonucleotide; TGG chr11 5236575 5236594 5236591 +
accaggtcaagaatacagaa

SEQ ID NO: 9851 - DNA, 20 bp, Artificial Sequence
  Synthetic oligonucleotide; CAG chr11 5236580 5236599 5236596 +
gtcaagaatacagaatggaa

SEQ ID NO: 9852 - DNA, 20 bp, Artificial Sequence
  Synthetic oligonucleotide; AAG chr11 5236590 5236609 5236606 +
cagaatggaacagaacatac

SEQ ID NO: 9853 - DNA, 20 bp, Artificial Sequence
  Synthetic oligonucleotide; CAG chr11 5236595 5236614 5236611 +
tggaacagaacatacaagaa

SEQ ID NO: 9854 - DNA, 20 bp, Artificial Sequence
  Synthetic oligonucleotide; CAG chr11 5236644 5236663 5236660 +
ccactacctgttaaaaatga

SEQ ID NO: 9855 - DNA, 20 bp, Artificial Sequence
  Synthetic oligonucleotide; TAG chr11 5236680 5236699 5236696 +
tcaatatctccttaaaatct

SEQ ID NO: 9856 - DNA, 20 bp, Artificial Sequence
  Synthetic oligonucleotide; GAG chr11 5236694 5236713 5236710 +
aaatcttagaatgtgtttgt

SEQ ID NO: 9857 - DNA, 20 bp, Artificial Sequence
  Synthetic oligonucleotide; AGG chr11 5236695 5236714 5236711 +
aatcttagaatgtgtttgtg

SEQ ID NO: 9858 - DNA, 20 bp, Artificial Sequence
  Synthetic oligonucleotide; GGG chr11 5236696 5236715 5236712 +
atcttagaatgtgtttgtga

SEQ ID NO: 9859 - DNA, 20 bp, Artificial Sequence
  Synthetic oligonucleotide; GAG chr11 5236698 5236717 5236714 +
cttagaatgtgtttgtgagg

SEQ ID NO: 9860 - DNA, 20 bp, Artificial Sequence
  Synthetic oligonucleotide; AGG chr11 5236699 5236718 5236715 +
ttagaatgtgtttgtgaggg

SEQ ID NO: 9861 - DNA, 20 bp, Artificial Sequence
  Synthetic oligonucleotide; AAG chr11 5236725 5236744 5236741 +
tatgtttccaattcatatat

SEQ ID NO: 9862 - DNA, 20 bp, Artificial Sequence
  Synthetic oligonucleotide; TAG chr11 5236751 5236770 5236767 +
attgattctaaaaaaaatgt

SEQ ID NO: 9863 - DNA, 20 bp, Artificial Sequence
  Synthetic oligonucleotide; AGG chr11 5236752 5236771 5236768 +
ttgattctaaaaaaaatgtt

SEQ ID NO: 9864 - DNA, 20 bp, Artificial Sequence
  Synthetic oligonucleotide; AAG chr11 5236764 5236783 5236780 +
aaaatgttaggtaaattctt

SEQ ID NO: 9865 - DNA, 20 bp, Artificial Sequence
  Synthetic oligonucleotide; AGG chr11 5236765 5236784 5236781 +
aaatgttaggtaaattctta

SEQ ID NO: 9866 - DNA, 20 bp, Artificial Sequence
  Synthetic oligonucleotide; GAG chr11 5236772 5236791 5236788 +
aggtaaattcttaaggccat

SEQ ID NO: 9867 - DNA, 20 bp, Artificial Sequence
  Synthetic oligonucleotide; AGG chr11 5236773 5236792 5236789 +
ggtaaattcttaaggccatg

SEQ ID NO: 9868 - DNA, 20 bp, Artificial Sequence
  Synthetic oligonucleotide; AAG chr11 5236807 5236826 5236823 +
atctttgtctgttaattcca

SEQ ID NO: 9869 - DNA, 20 bp, Artificial Sequence
  Synthetic oligonucleotide; TGG chr11 5236813 5236832 5236829 +
gtctgttaattccaaagact

SEQ ID NO: 9870 - DNA, 20 bp, Artificial Sequence
  Synthetic oligonucleotide; TGG chr11 5236859 5236878 5236875 +
cctgaaatgattttacacat

SEQ ID NO: 9871 - DNA, 20 bp, Artificial Sequence
  Synthetic oligonucleotide; GGG chr11 5236860 5236879 5236876 +
ctgaaatgattttacacatt

SEQ ID NO: 9872 - DNA, 20 bp, Artificial Sequence
  Synthetic oligonucleotide; GAG chr11 5236862 5236881 5236878 +
gaaatgattttacacattgg

SEQ ID NO: 9873 - DNA, 20 bp, Artificial Sequence
  Synthetic oligonucleotide; TGG chr11 5236868 5236887 5236884 +
attttacacattgggagatc

SEQ ID NO: 9874 - DNA, 20 bp, Artificial Sequence
  Synthetic oligonucleotide; TGG chr11 5236889 5236908 5236905 +
ggttacatgtttattctata

SEQ ID NO: 9875 - DNA, 20 bp, Artificial Sequence
  Synthetic oligonucleotide; GAG chr11 5236900 5236919 5236916 +
tattctatatggattgcatt

SEQ ID NO: 9876 - DNA, 20 bp, Artificial Sequence
  Synthetic oligonucleotide; GAG chr11 5236902 5236921 5236918 +
ttctatatggattgcattga

SEQ ID NO: 9877 - DNA, 20 bp, Artificial Sequence
  Synthetic oligonucleotide; AGG chr11 5236903 5236922 5236919 +
tctatatggattgcattgag

SEQ ID NO: 9878 - DNA, 20 bp, Artificial Sequence
  Synthetic oligonucleotide; CAG chr11 5236916 5236935 5236932 +
cattgagaggatttgtataa

SEQ ID NO: 9879 - DNA, 20 bp, Artificial Sequence
  Synthetic oligonucleotide; AAG chr11 5236922 5236941 5236938 +
gaggatttgtataacagaat

SEQ ID NO: 9880 - DNA, 20 bp, Artificial Sequence
  Synthetic oligonucleotide; AGG chr11 5236923 5236942 5236939 +
aggatttgtataacagaata

SEQ ID NO: 9881 - DNA, 20 bp, Artificial Sequence
  Synthetic oligonucleotide; GAG chr11 5236947 5236966 5236963 +
ctttttttcttttctcttct

SEQ ID NO: 9882 - DNA, 20 bp, Artificial Sequence
  Synthetic oligonucleotide; TGG chr11 5236951 5236970 5236967 +
ttttcttttctcttctgaga

SEQ ID NO: 9883 - DNA, 20 bp, Artificial Sequence
  Synthetic oligonucleotide; GAG chr11 5236953 5236972 5236969 +
ttcttttctcttctgagatg

SEQ ID NO: 9884 - DNA, 20 bp, Artificial Sequence
  Synthetic oligonucleotide; AAG chr11 5236973 5236992 5236989 +
gagtttcatccctattgccc

SEQ ID NO: 9885 - DNA, 20 bp, Artificial Sequence
  Synthetic oligonucleotide; TAG chr11 5236977 5236996 5236993 +
ttcatccctattgcccaagc

SEQ ID NO: 9886 - DNA, 20 bp, Artificial Sequence
  Synthetic oligonucleotide; GAG chr11 5236979 5236998 5236995 +
catccctattgcccaagcta

SEQ ID NO: 9887 - DNA, 20 bp, Artificial Sequence
  Synthetic oligonucleotide; TGG chr11 5236987 5237006 5237003 +
ttgcccaagctagagtgcaa

SEQ ID NO: 9888 - DNA, 20 bp, Artificial Sequence
  Synthetic oligonucleotide; TAG chr11 5236997 5237016 5237013 +
tagagtgcaatggtgcaatc

SEQ ID NO: 9889 - DNA, 20 bp, Artificial Sequence
  Synthetic oligonucleotide; AGG chr11 5236998 5237017 5237014 +
agagtgcaatggtgcaatct

SEQ ID NO: 9890 - DNA, 20 bp, Artificial Sequence
  Synthetic oligonucleotide; TGG chr11 5237022 5237041 5237038 +
tcaccgcaacctctgcctcc

SEQ ID NO: 9891 - DNA, 20 bp, Artificial Sequence
  Synthetic oligonucleotide; GGG chr11 5237023 5237042 5237039 +
caccgcaacctctgcctcct

SEQ ID NO: 9892 - DNA, 20 bp, Artificial Sequence
  Synthetic oligonucleotide; AAG chr11 5237029 5237048 5237045 +
aacctctgcctcctgggttc

SEQ ID NO: 9893 - DNA, 20 bp, Artificial Sequence
  Synthetic oligonucleotide; CAG chr11 5237046 5237065 5237062 +
ttcaagcaattctcctgcct

SEQ ID NO: 9894 - DNA, 20 bp, Artificial Sequence
  Synthetic oligonucleotide; TAG chr11 5237058 5237077 5237074 +
tcctgcctcagccacctgaa

SEQ ID NO: 9895 - DNA, 20 bp, Artificial Sequence
  Synthetic oligonucleotide; TGG chr11 5237062 5237081 5237078 +
gcctcagccacctgaatagc

SEQ ID NO: 9896 - DNA, 20 bp, Artificial Sequence
  Synthetic oligonucleotide; GGG chr11 5237063 5237082 5237079 +
cctcagccacctgaatagct

SEQ ID NO: 9897 - DNA, 20 bp, Artificial Sequence
  Synthetic oligonucleotide; CAG chr11 5237070 5237089 5237086 +
cacctgaatagctgggactg

SEQ ID NO: 9898 - DNA, 20 bp, Artificial Sequence
  Synthetic oligonucleotide; AGG chr11 5237071 5237090 5237087 +
acctgaatagctgggactgc

SEQ ID NO: 9899 - DNA, 20 bp, Artificial Sequence
  Synthetic oligonucleotide; CGG chr11 5237089 5237108 5237105 +
gcaggcatgcaccacacgcc

SEQ ID NO: 9900 - DNA, 20 bp, Artificial Sequence
  Synthetic oligonucleotide; TAG chr11 5237107 5237126 5237123 +
cccggctgattttgtatttt

SEQ ID NO: 9901 - DNA, 20 bp, Artificial Sequence
  Synthetic oligonucleotide; TAG chr11 5237110 5237129 5237126 +
ggctgattttgtatttttag

SEQ ID NO: 9902 - DNA, 20 bp, Artificial Sequence
  Synthetic oligonucleotide; GAG chr11 5237112 5237131 5237128 +
ctgattttgtatttttagta

SEQ ID NO: 9903 - DNA, 20 bp, Artificial Sequence
  Synthetic oligonucleotide; TGG chr11 5237116 5237135 5237132 +
ttttgtatttttagtagaga

SEQ ID NO: 9904 - DNA, 20 bp, Artificial Sequence
  Synthetic oligonucleotide; GGG chr11 5237117 5237136 5237133 +
tttgtatttttagtagagat

SEQ ID NO: 9905 - DNA, 20 bp, Artificial Sequence
  Synthetic oligonucleotide; GGG chr11 5237118 5237137 5237134 +
ttgtatttttagtagagatg

SEQ ID NO: 9906 - DNA, 20 bp, Artificial Sequence
  Synthetic oligonucleotide; TGG chr11 5237132 5237151 5237148 +
gagatggggtttcaccatgt

SEQ ID NO: 9907 - DNA, 20 bp, Artificial Sequence
  Synthetic oligonucleotide; CAG chr11 5237136 5237155 5237152 +
tggggtttcaccatgttggt

SEQ ID NO: 9908 - DNA, 20 bp, Artificial Sequence
  Synthetic oligonucleotide; AGG chr11 5237137 5237156 5237153 +
ggggtttcaccatgttggtc

SEQ ID NO: 9909 - DNA, 20 bp, Artificial Sequence
  Synthetic oligonucleotide; TGG chr11 5237141 5237160 5237157 +
tttcaccatgttggtcaggc

SEQ ID NO: 9910 - DNA, 20 bp, Artificial Sequence
  Synthetic oligonucleotide; AAG chr11 5237162 5237181 5237178 +
ggtcttgaactcctgacctc

SEQ ID NO: 9911 - DNA, 20 bp, Artificial Sequence
  Synthetic oligonucleotide; TGG chr11 5237179 5237198 5237195 +
ctcaagtgatctgcctgcct

SEQ ID NO: 9912 - DNA, 20 bp, Artificial Sequence
  Synthetic oligonucleotide; AAG chr11 5237189 5237208 5237205 +
ctgcctgccttggcctccca

SEQ ID NO: 9913 - DNA, 20 bp, Artificial Sequence
  Synthetic oligonucleotide; TGG chr11 5237195 5237214 5237211 +
gccttggcctcccaaagtgc

SEQ ID NO: 9914 - DNA, 20 bp, Artificial Sequence
  Synthetic oligonucleotide; GGG chr11 5237196 5237215 5237212 +
ccttggcctcccaaagtgct

SEQ ID NO: 9915 - DNA, 20 bp, Artificial Sequence
  Synthetic oligonucleotide; AAG chr11 5237204 5237223 5237220 +
tcccaaagtgctgggtttac

SEQ ID NO: 9916 - DNA, 20 bp, Artificial Sequence
  Synthetic oligonucleotide; GAG chr11 5237210 5237229 5237226 +
agtgctgggtttacaagcct

SEQ ID NO: 9917 - DNA, 20 bp, Artificial Sequence
  Synthetic oligonucleotide; CAG chr11 5237223 5237242 5237239 +
caagcctgagccaccgcatc

SEQ ID NO: 9918 - DNA, 20 bp, Artificial Sequence
  Synthetic oligonucleotide; CAG chr11 5237227 5237246 5237243 +
cctgagccaccgcatccagc

SEQ ID NO: 9919 - DNA, 20 bp, Artificial Sequence
  Synthetic oligonucleotide; AGG chr11 5237228 5237247 5237244 +
ctgagccaccgcatccagcc

SEQ ID NO: 9920 - DNA, 20 bp, Artificial Sequence
  Synthetic oligonucleotide; AAG chr11 5237233 5237252 5237249 +
ccaccgcatccagccaggat

SEQ ID NO: 9921 - DNA, 20 bp, Artificial Sequence
  Synthetic oligonucleotide; AGG chr11 5237234 5237253 5237250 +
caccgcatccagccaggata

SEQ ID NO: 9922 - DNA, 20 bp, Artificial Sequence
  Synthetic oligonucleotide; AAG chr11 5237242 5237261 5237258 +
ccagccaggataaggtctaa

SEQ ID NO: 9923 - DNA, 20 bp, Artificial Sequence
  Synthetic oligonucleotide; TGG chr11 5237245 5237264 5237261 +
gccaggataaggtctaaaag

SEQ ID NO: 9924 - DNA, 20 bp, Artificial Sequence
  Synthetic oligonucleotide; AAG chr11 5237249 5237268 5237265 +
ggataaggtctaaaagtgga

SEQ ID NO: 9925 - DNA, 20 bp, Artificial Sequence
  Synthetic oligonucleotide; TAG chr11 5237254 5237273 5237270 +
aggtctaaaagtggaaagaa

SEQ ID NO: 9926 - DNA, 20 bp, Artificial Sequence
  Synthetic oligonucleotide; CAG chr11 5237271 5237290 5237287 +
gaatagcatctactcttgtt

SEQ ID NO: 9927 - DNA, 20 bp, Artificial Sequence
  Synthetic oligonucleotide; AGG chr11 5237272 5237291 5237288 +
aatagcatctactcttgttc

SEQ ID NO: 9928 - DNA, 20 bp, Artificial Sequence
  Synthetic oligonucleotide; GAG chr11 5237282 5237301 5237298 +
actcttgttcaggaaacaat

SEQ ID NO: 9929 - DNA, 20 bp, Artificial Sequence
  Synthetic oligonucleotide; AGG chr11 5237283 5237302 5237299 +
ctcttgttcaggaaacaatg

SEQ ID NO: 9930 - DNA, 20 bp, Artificial Sequence
  Synthetic oligonucleotide; TGG chr11 5237293 5237312 5237309 +
ggaaacaatgaggacctgac

SEQ ID NO: 9931 - DNA, 20 bp, Artificial Sequence
  Synthetic oligonucleotide; GGG chr11 5237294 5237313 5237310 +
gaaacaatgaggacctgact

SEQ ID NO: 9932 - DNA, 20 bp, Artificial Sequence
  Synthetic oligonucleotide; CAG chr11 5237297 5237316 5237313 +
acaatgaggacctgactggg

SEQ ID NO: 9933 - DNA, 20 bp, Artificial Sequence
  Synthetic oligonucleotide; AAG chr11 5237301 5237320 5237317 +
tgaggacctgactgggcagt

SEQ ID NO: 9934 - DNA, 20 bp, Artificial Sequence
  Synthetic oligonucleotide; GAG chr11 5237303 5237322 5237319 +
aggacctgactgggcagtaa

SEQ ID NO: 9935 - DNA, 20 bp, Artificial Sequence
  Synthetic oligonucleotide; TGG chr11 5237306 5237325 5237322 +
acctgactgggcagtaagag

SEQ ID NO: 9936 - DNA, 20 bp, Artificial Sequence
  Synthetic oligonucleotide; TAG chr11 5237316 5237335 5237332 +
gcagtaagagtggtgattaa

SEQ ID NO: 9937 - DNA, 20 bp, Artificial Sequence
  Synthetic oligonucleotide; TAG chr11 5237320 5237339 5237336 +
taagagtggtgattaataga

SEQ ID NO: 9938 - DNA, 20 bp, Artificial Sequence
  Synthetic oligonucleotide; AGG chr11 5237321 5237340 5237337 +
aagagtggtgattaatagat

SEQ ID NO: 9939 - DNA, 20 bp, Artificial Sequence
  Synthetic oligonucleotide; GGG chr11 5237322 5237341 5237338 +
agagtggtgattaatagata

SEQ ID NO: 9940 - DNA, 20 bp, Artificial Sequence
  Synthetic oligonucleotide; AAG chr11 5237333 5237352 5237349 +
taatagatagggacaaattg

SEQ ID NO: 9941 - DNA, 20 bp, Artificial Sequence
  Synthetic oligonucleotide; CAG chr11 5237336 5237355 5237352 +
tagatagggacaaattgaag

SEQ ID NO: 9942 - DNA, 20 bp, Artificial Sequence
  Synthetic oligonucleotide; TAG chr11 5237354 5237373 5237370 +
agcagaatcgaactgttgat

SEQ ID NO: 9943 - DNA, 20 bp, Artificial Sequence
  Synthetic oligonucleotide; GAG chr11 5237356 5237375 5237372 +
cagaatcgaactgttgatta

SEQ ID NO: 9944 - DNA, 20 bp, Artificial Sequence
  Synthetic oligonucleotide; AGG chr11 5237357 5237376 5237373 +
agaatcgaactgttgattag

SEQ ID NO: 9945 - DNA, 20 bp, Artificial Sequence
  Synthetic oligonucleotide; TAG chr11 5237360 5237379 5237376 +
atcgaactgttgattagagg

SEQ ID NO: 9946 - DNA, 20 bp, Artificial Sequence
  Synthetic oligonucleotide; AGG chr11 5237361 5237380 5237377 +
tcgaactgttgattagaggt

SEQ ID NO: 9947 - DNA, 20 bp, Artificial Sequence
  Synthetic oligonucleotide; GGG chr11 5237362 5237381 5237378 +
cgaactgttgattagaggta

SEQ ID NO: 9948 - DNA, 20 bp, Artificial Sequence
  Synthetic oligonucleotide; TGG chr11 5237387 5237406 5237403 +
atgattttaatctgtgacct

SEQ ID NO: 9949 - DNA, 20 bp, Artificial Sequence
  Synthetic oligonucleotide; TGG chr11 5237394 5237413 5237410 +
taatctgtgaccttggtgaa

SEQ ID NO: 9950 - DNA, 20 bp, Artificial Sequence
  Synthetic oligonucleotide; GGG chr11 5237395 5237414 5237411 +
aatctgtgaccttggtgaat

SEQ ID NO: 9951 - DNA, 20 bp, Artificial Sequence
  Synthetic oligonucleotide; AAG chr11 5237399 5237418 5237415 +
tgtgaccttggtgaatgggc

SEQ ID NO: 9952 - DNA, 20 bp, Artificial Sequence
  Synthetic oligonucleotide; TAG chr11 5237402 5237421 5237418 +
gaccttggtgaatgggcaag

SEQ ID NO: 9953 - DNA, 20 bp, Artificial Sequence
  Synthetic oligonucleotide; TGG chr11 5237422 5237441 5237438 +
tagctatctaatgactaaaa

SEQ ID NO: 9954 - DNA, 20 bp, Artificial Sequence
  Synthetic oligonucleotide; TGG chr11 5237432 5237451 5237448 +
atgactaaaatggaaaacac

SEQ ID NO: 9955 - DNA, 20 bp, Artificial Sequence
  Synthetic oligonucleotide; AAG chr11 5237435 5237454 5237451 +
actaaaatggaaaacactgg

SEQ ID NO: 9956 - DNA, 20 bp, Artificial Sequence
  Synthetic oligonucleotide; GAG chr11 5237437 5237456 5237453 +
taaaatggaaaacactggaa

SEQ ID NO: 9957 - DNA, 20 bp, Artificial Sequence
  Synthetic oligonucleotide; CAG chr11 5237443 5237462 5237459 +
ggaaaacactggaagagaaa

SEQ ID NO: 9958 - DNA, 20 bp, Artificial Sequence
  Synthetic oligonucleotide; TAG chr11 5237449 5237468 5237465 +
cactggaagagaaacagttt

SEQ ID NO: 9959 - DNA, 20 bp, Artificial Sequence
  Synthetic oligonucleotide; AAG chr11 5237458 5237477 5237474 +
agaaacagttttagtataac

SEQ ID NO: 9960 - DNA, 20 bp, Artificial Sequence
  Synthetic oligonucleotide; GAG chr11 5237476 5237495 5237492 +
acaagtgaaatacccatgct

SEQ ID NO: 9961 - DNA, 20 bp, Artificial Sequence
  Synthetic oligonucleotide; GAG chr11 5237482 5237501 5237498 +
gaaatacccatgctgagtct

SEQ ID NO: 9962 - DNA, 20 bp, Artificial Sequence
  Synthetic oligonucleotide; AGG chr11 5237483 5237502 5237499 +
aaatacccatgctgagtctg

SEQ ID NO: 9963 - DNA, 20 bp, Artificial Sequence
  Synthetic oligonucleotide; TAG chr11 5237492 5237511 5237508 +
tgctgagtctgaggtgccta

SEQ ID NO: 9964 - DNA, 20 bp, Artificial Sequence
  Synthetic oligonucleotide; AGG chr11 5237493 5237512 5237509 +
gctgagtctgaggtgcctat

SEQ ID NO: 9965 - DNA, 20 bp, Artificial Sequence
  Synthetic oligonucleotide; AAG chr11 5237510 5237529 5237526 +
tataggacatctatataaat

SEQ ID NO: 9966 - DNA, 20 bp, Artificial Sequence
  Synthetic oligonucleotide; CAG chr11 5237515 5237534 5237531 +
gacatctatataaataagcc

SEQ ID NO: 9967 - DNA, 20 bp, Artificial Sequence
  Synthetic oligonucleotide; TGG chr11 5237534 5237553 5237550 +
ccagtacattgtttgatata

SEQ ID NO: 9968 - DNA, 20 bp, Artificial Sequence
  Synthetic oligonucleotide; GGG chr11 5237535 5237554 5237551 +
cagtacattgtttgatatat

SEQ ID NO: 9969 - DNA, 20 bp, Artificial Sequence
  Synthetic oligonucleotide; TGG chr11 5237540 5237559 5237556 +
cattgtttgatatatgggtt

SEQ ID NO: 9970 - DNA, 20 bp, Artificial Sequence
  Synthetic oligonucleotide; GAG chr11 5237547 5237566 5237563 +
tgatatatgggtttggcact

SEQ ID NO: 9971 - DNA, 20 bp, Artificial Sequence
  Synthetic oligonucleotide; AGG chr11 5237548 5237567 5237564 +
gatatatgggtttggcactg

SEQ ID NO: 9972 - DNA, 20 bp, Artificial Sequence
  Synthetic oligonucleotide; TGG chr11 5237552 5237571 5237568 +
tatgggtttggcactgaggt

SEQ ID NO: 9973 - DNA, 20 bp, Artificial Sequence
  Synthetic oligonucleotide; GAG chr11 5237554 5237573 5237570 +
tgggtttggcactgaggttg

SEQ ID NO: 9974 - DNA, 20 bp, Artificial Sequence
  Synthetic oligonucleotide; AGG chr11 5237555 5237574 5237571 +
gggtttggcactgaggttgg

SEQ ID NO: 9975 - DNA, 20 bp, Artificial Sequence
  Synthetic oligonucleotide; CAG chr11 5237559 5237578 5237575 +
ttggcactgaggttggaggt

SEQ ID NO: 9976 - DNA, 20 bp, Artificial Sequence
  Synthetic oligonucleotide; GAG chr11 5237561 5237580 5237577 +
ggcactgaggttggaggtca

SEQ ID NO: 9977 - DNA, 20 bp, Artificial Sequence
  Synthetic oligonucleotide; AGG chr11 5237562 5237581 5237578 +
gcactgaggttggaggtcag

SEQ ID NO: 9978 - DNA, 20 bp, Artificial Sequence
  Synthetic oligonucleotide; TAG chr11 5237566 5237585 5237582 +
tgaggttggaggtcagaggt

SEQ ID NO: 9979 - DNA, 20 bp, Artificial Sequence
  Synthetic oligonucleotide; CAG chr11 5237573 5237592 5237589 +
ggaggtcagaggttagaaat

SEQ ID NO: 9980 - DNA, 20 bp, Artificial Sequence
  Synthetic oligonucleotide; GAG chr11 5237575 5237594 5237591 +
aggtcagaggttagaaatca

SEQ ID NO: 9981 - DNA, 20 bp, Artificial Sequence
  Synthetic oligonucleotide; TGG chr11 5237579 5237598 5237595 +
cagaggttagaaatcagagt

SEQ ID NO: 9982 - DNA, 20 bp, Artificial Sequence
  Synthetic oligonucleotide; GGG chr11 5237580 5237599 5237596 +
agaggttagaaatcagagtt

SEQ ID NO: 9983 - DNA, 20 bp, Artificial Sequence
  Synthetic oligonucleotide; TGG chr11 5237586 5237605 5237602 +
tagaaatcagagttgggaat

SEQ ID NO: 9984 - DNA, 20 bp, Artificial Sequence
  Synthetic oligonucleotide; GGG chr11 5237587 5237606 5237603 +
agaaatcagagttgggaatt

SEQ ID NO: 9985 - DNA, 20 bp, Artificial Sequence
  Synthetic oligonucleotide; CAG chr11 5237596 5237615 5237612 +
agttgggaattgggattata

SEQ ID NO: 9986 - DNA, 20 bp, Artificial Sequence
  Synthetic oligonucleotide; AGG chr11 5237597 5237616 5237613 +
gttgggaattgggattatac

SEQ ID NO: 9987 - DNA, 20 bp, Artificial Sequence
  Synthetic oligonucleotide; AAG chr11 5237608 5237627 5237624 +
ggattatacaggctgtattt

SEQ ID NO: 9988 - DNA, 20 bp, Artificial Sequence
  Synthetic oligonucleotide; GAG chr11 5237610 5237629 5237626 +
attatacaggctgtatttaa

SEQ ID NO: 9989 - DNA, 20 bp, Artificial Sequence
  Synthetic oligonucleotide; TAG chr11 5237615 5237634 5237631 +
acaggctgtatttaagagtt

SEQ ID NO: 9990 - DNA, 20 bp, Artificial Sequence
  Synthetic oligonucleotide; AAG chr11 5237634 5237653 5237650 +
ttagatataactgtgaatcc

SEQ ID NO: 9991 - DNA, 20 bp, Artificial Sequence
  Synthetic oligonucleotide; GAG chr11 5237636 5237655 5237652 +
agatataactgtgaatccaa

SEQ ID NO: 9992 - DNA, 20 bp, Artificial Sequence
  Synthetic oligonucleotide; AAG chr11 5237652 5237671 5237668 +
ccaagagtgtgatgaataca

SEQ ID NO: 9993 - DNA, 20 bp, Artificial Sequence
  Synthetic oligonucleotide; AAG chr11 5237662 5237681 5237678 +
gatgaatacaaagttaaatg

SEQ ID NO: 9994 - DNA, 20 bp, Artificial Sequence
  Synthetic oligonucleotide; AGG chr11 5237663 5237682 5237679 +
atgaatacaaagttaaatga

SEQ ID NO: 9995 - DNA, 20 bp, Artificial Sequence
  Synthetic oligonucleotide; AAG chr11 5237702 5237721 5237718 +
aacatttaatgtgaaatctc

SEQ ID NO: 9996 - DNA, 20 bp, Artificial Sequence
  Synthetic oligonucleotide; AGG chr11 5237703 5237722 5237719 +
acatttaatgtgaaatctca

SEQ ID NO: 9997 - DNA, 20 bp, Artificial Sequence
  Synthetic oligonucleotide; AAG chr11 5237706 5237725 5237722 +
tttaatgtgaaatctcaagg

SEQ ID NO: 9998 - DNA, 20 bp, Artificial Sequence
  Synthetic oligonucleotide; AAG chr11 5237713 5237732 5237729 +
tgaaatctcaaggaagtatg

SEQ ID NO: 9999 - DNA, 20 bp, Artificial Sequence
  Synthetic oligonucleotide; AAG chr11 5237717 5237736 5237733 +
atctcaaggaagtatgaagt

SEQ ID NO: 10000 - DNA, 20 bp, Artificial Sequence
  Synthetic oligonucleotide; TAG chr11 5237723 5237742 5237739 +
aggaagtatgaagtaagaca

SEQ ID NO: 10001 - DNA, 20 bp, Artificial Sequence
  Synthetic oligonucleotide; TAG chr11 5237748 5237767 5237764 +
cccaaaatccccgatgattt

SEQ ID NO: 10002 - DNA, 20 bp, Artificial Sequence
  Synthetic oligonucleotide; CAG chr11 5237755 5237774 5237771 +
tccccgatgattttagaact

SEQ ID NO: 10003 - DNA, 20 bp, Artificial Sequence
  Synthetic oligonucleotide; TAG chr11 5237771 5237790 5237787 +
aactcagtatcgattttaat

SEQ ID NO: 10004 - DNA, 20 bp, Artificial Sequence
  Synthetic oligonucleotide; TGG chr11 5237787 5237806 5237803 +
taattagtgtaatgccaatg

SEQ ID NO: 10005 - DNA, 20 bp, Artificial Sequence
  Synthetic oligonucleotide; GGG chr11 5237788 5237807 5237804 +
aattagtgtaatgccaatgt

SEQ ID NO: 10006 - DNA, 20 bp, Artificial Sequence
  Synthetic oligonucleotide; TAG chr11 5237792 5237811 5237808 +
agtgtaatgccaatgtgggt

SEQ ID NO: 10007 - DNA, 20 bp, Artificial Sequence
  Synthetic oligonucleotide; TGG chr11 5237797 5237816 5237813 +
aatgccaatgtgggttagaa

SEQ ID NO: 10008 - DNA, 20 bp, Artificial Sequence
  Synthetic oligonucleotide; AAG chr11 5237800 5237819 5237816 +
gccaatgtgggttagaatgg

SEQ ID NO: 10009 - DNA, 20 bp, Artificial Sequence
  Synthetic oligonucleotide; TGG chr11 5237815 5237834 5237831 +
aatggaagtcaacttgctgt

SEQ ID NO: 10010 - DNA, 20 bp, Artificial Sequence
  Synthetic oligonucleotide; CAG chr11 5237821 5237840 5237837 +
agtcaacttgctgttggttt

SEQ ID NO: 10011 - DNA, 20 bp, Artificial Sequence
  Synthetic oligonucleotide; GAG chr11 5237823 5237842 5237839 +
tcaacttgctgttggtttca

SEQ ID NO: 10012 - DNA, 20 bp, Artificial Sequence
  Synthetic oligonucleotide; CAG chr11 5237826 5237845 5237842 +
acttgctgttggtttcagag

SEQ ID NO: 10013 - DNA, 20 bp, Artificial Sequence
  Synthetic oligonucleotide; AGG chr11 5237827 5237846 5237843 +
cttgctgttggtttcagagc

SEQ ID NO: 10014 - DNA, 20 bp, Artificial Sequence
  Synthetic oligonucleotide; TAG chr11 5237830 5237849 5237846 +
gctgttggtttcagagcagg

SEQ ID NO: 10015 - DNA, 20 bp, Artificial Sequence
  Synthetic oligonucleotide; AGG chr11 5237831 5237850 5237847 +
ctgttggtttcagagcaggt

SEQ ID NO: 10016 - DNA, 20 bp, Artificial Sequence
  Synthetic oligonucleotide; GAG chr11 5237833 5237852 5237849 +
gttggtttcagagcaggtag

SEQ ID NO: 10017 - DNA, 20 bp, Artificial Sequence
  Synthetic oligonucleotide; AAG chr11 5237838 5237857 5237854 +
tttcagagcaggtaggagat

SEQ ID NO: 10018 - DNA, 20 bp, Artificial Sequence
  Synthetic oligonucleotide; AGG chr11 5237839 5237858 5237855 +
ttcagagcaggtaggagata

SEQ ID NO: 10019 - DNA, 20 bp, Artificial Sequence
  Synthetic oligonucleotide; TAG chr11 5237845 5237864 5237861 +
gcaggtaggagataaggttc

SEQ ID NO: 10020 - DNA, 20 bp, Artificial Sequence
  Synthetic oligonucleotide; CAG chr11 5237857 5237876 5237873 +
taaggttctagattttgaca

SEQ ID NO: 10021 - DNA, 20 bp, Artificial Sequence
  Synthetic oligonucleotide; AAG chr11 5237864 5237883 5237880 +
ctagattttgacacagtgaa

SEQ ID NO: 10022 - DNA, 20 bp, Artificial Sequence
  Synthetic oligonucleotide; AAG chr11 5237877 5237896 5237893 +
cagtgaaaagctgaaacaaa

SEQ ID NO: 10023 - DNA, 20 bp, Artificial Sequence
  Synthetic oligonucleotide; AGG chr11 5237878 5237897 5237894 +
agtgaaaagctgaaacaaaa

SEQ ID NO: 10024 - DNA, 20 bp, Artificial Sequence
  Synthetic oligonucleotide; AAG chr11 5237883 5237902 5237899 +
aaagctgaaacaaaaaggaa

SEQ ID NO: 10025 - DNA, 20 bp, Artificial Sequence
  Synthetic oligonucleotide; AGG chr11 5237884 5237903 5237900 +
aagctgaaacaaaaaggaaa

SEQ ID NO: 10026 - DNA, 20 bp, Artificial Sequence
  Synthetic oligonucleotide; TAG chr11 5237887 5237906 5237903 +
ctgaaacaaaaaggaaaagg

SEQ ID NO: 10027 - DNA, 20 bp, Artificial Sequence
  Synthetic oligonucleotide; AGG chr11 5237888 5237907 5237904 +
tgaaacaaaaaggaaaaggt

SEQ ID NO: 10028 - DNA, 20 bp, Artificial Sequence
  Synthetic oligonucleotide; GGG chr11 5237889 5237908 5237905 +
gaaacaaaaaggaaaaggta

SEQ ID NO: 10029 - DNA, 20 bp, Artificial Sequence
  Synthetic oligonucleotide; AAG chr11 5237895 5237914 5237911 +
aaaaggaaaaggtagggtga

SEQ ID NO: 10030 - DNA, 20 bp, Artificial Sequence
  Synthetic oligonucleotide; TGG chr11 5237899 5237918 5237915 +
ggaaaaggtagggtgaaaga

SEQ ID NO: 10031 - DNA, 20 bp, Artificial Sequence
  Synthetic oligonucleotide; GGG chr11 5237900 5237919 5237916 +
gaaaaggtagggtgaaagat

SEQ ID NO: 10032 - DNA, 20 bp, Artificial Sequence
  Synthetic oligonucleotide; AAG chr11 5237913 5237932 5237929 +
gaaagatgggaaatgtatgt

SEQ ID NO: 10033 - DNA, 20 bp, Artificial Sequence
  Synthetic oligonucleotide; AGG chr11 5237914 5237933 5237930 +
aaagatgggaaatgtatgta

SEQ ID NO: 10034 - DNA, 20 bp, Artificial Sequence
  Synthetic oligonucleotide; GAG chr11 5237916 5237935 5237932 +
agatgggaaatgtatgtaag

SEQ ID NO: 10035 - DNA, 20 bp, Artificial Sequence
  Synthetic oligonucleotide; AGG chr11 5237917 5237936 5237933 +
gatgggaaatgtatgtaagg

SEQ ID NO: 10036 - DNA, 20 bp, Artificial Sequence
  Synthetic oligonucleotide; GAG chr11 5237922 5237941 5237938 +
gaaatgtatgtaaggaggat

SEQ ID NO: 10037 - DNA, 20 bp, Artificial Sequence
  Synthetic oligonucleotide; TGG chr11 5237930 5237949 5237946 +
tgtaaggaggatgagccaca

SEQ ID NO: 10038 - DNA, 20 bp, Artificial Sequence
  Synthetic oligonucleotide; TGG chr11 5237935 5237954 5237951 +
ggaggatgagccacatggta

SEQ ID NO: 10039 - DNA, 20 bp, Artificial Sequence
  Synthetic oligonucleotide; GGG chr11 5237936 5237955 5237952 +
gaggatgagccacatggtat

SEQ ID NO: 10040 - DNA, 20 bp, Artificial Sequence
  Synthetic oligonucleotide; GAG chr11 5237938 5237957 5237954 +
ggatgagccacatggtatgg

SEQ ID NO: 10041 - DNA, 20 bp, Artificial Sequence
  Synthetic oligonucleotide; AGG chr11 5237939 5237958 5237955 +
gatgagccacatggtatggg

SEQ ID NO: 10042 - DNA, 20 bp, Artificial Sequence
  Synthetic oligonucleotide; AAG chr11 5237948 5237967 5237964 +
catggtatgggaggtatact

SEQ ID NO: 10043 - DNA, 20 bp, Artificial Sequence
  Synthetic oligonucleotide; AGG chr11 5237949 5237968 5237965 +
atggtatgggaggtatacta

SEQ ID NO: 10044 - DNA, 20 bp, Artificial Sequence
  Synthetic oligonucleotide; TAG chr11 5237956 5237975 5237972 +
gggaggtatactaaggactc

SEQ ID NO: 10045 - DNA, 20 bp, Artificial Sequence
  Synthetic oligonucleotide; AGG chr11 5237957 5237976 5237973 +
ggaggtatactaaggactct

SEQ ID NO: 10046 - DNA, 20 bp, Artificial Sequence
  Synthetic oligonucleotide; GGG chr11 5237958 5237977 5237974 +
gaggtatactaaggactcta

SEQ ID NO: 10047 - DNA, 20 bp, Artificial Sequence
  Synthetic oligonucleotide; CAG chr11 5237962 5237981 5237978 +
tatactaaggactctagggt

SEQ ID NO: 10048 - DNA, 20 bp, Artificial Sequence
  Synthetic oligonucleotide; GAG chr11 5237964 5237983 5237980 +
tactaaggactctagggtca

SEQ ID NO: 10049 - DNA, 20 bp, Artificial Sequence
  Synthetic oligonucleotide; TGG chr11 5237972 5237991 5237988 +
actctagggtcagagaaata

SEQ ID NO: 10050 - DNA, 20 bp, Artificial Sequence
  Synthetic oligonucleotide; GGG chr11 5237973 5237992 5237989 +
ctctagggtcagagaaatat

SEQ ID NO: 10051 - DNA, 20 bp, Artificial Sequence
  Synthetic oligonucleotide; TGG chr11 5238004 5238023 5238020 +
ttctacaaaattcacattct

SEQ ID NO: 10052 - DNA, 20 bp, Artificial Sequence
  Synthetic oligonucleotide; TGG chr11 5238008 5238027 5238024 +
acaaaattcacattcttggc

SEQ ID NO: 10053 - DNA, 20 bp, Artificial Sequence
  Synthetic oligonucleotide; GGG chr11 5238009 5238028 5238025 +
caaaattcacattcttggct

SEQ ID NO: 10054 - DNA, 20 bp, Artificial Sequence
  Synthetic oligonucleotide; TGG chr11 5238014 5238033 5238030 +
ttcacattcttggctgggtg

SEQ ID NO: 10055 - DNA, 20 bp, Artificial Sequence
  Synthetic oligonucleotide; TGG chr11 5238017 5238036 5238033 +
acattcttggctgggtgtgg

SEQ ID NO: 10056 - DNA, 20 bp, Artificial Sequence
  Synthetic oligonucleotide; CAG chr11 5238036 5238055 5238052 +
gtggctcacgcctgtgatcc

SEQ ID NO: 10057 - DNA, 20 bp, Artificial Sequence
  Synthetic oligonucleotide; CAG chr11 5238045 5238064 5238061 +
gcctgtgatcccagcacttt

SEQ ID NO: 10058 - DNA, 20 bp, Artificial Sequence
  Synthetic oligonucleotide; GAG chr11 5238047 5238066 5238063 +
ctgtgatcccagcactttca

SEQ ID NO: 10059 - DNA, 20 bp, Artificial Sequence
  Synthetic oligonucleotide; AGG chr11 5238048 5238067 5238064 +
tgtgatcccagcactttcag

SEQ ID NO: 10060 - DNA, 20 bp, Artificial Sequence
  Synthetic oligonucleotide; GAG chr11 5238053 5238072 5238069 +
tcccagcactttcagaggcc

SEQ ID NO: 10061 - DNA, 20 bp, Artificial Sequence
  Synthetic oligonucleotide; AGG chr11 5238054 5238073 5238070 +
cccagcactttcagaggccg

SEQ ID NO: 10062 - DNA, 20 bp, Artificial Sequence
  Synthetic oligonucleotide; GAG chr11 5238056 5238075 5238072 +
cagcactttcagaggccgag

SEQ ID NO: 10063 - DNA, 20 bp, Artificial Sequence
  Synthetic oligonucleotide; AGG chr11 5238057 5238076 5238073 +
agcactttcagaggccgagg

SEQ ID NO: 10064 - DNA, 20 bp, Artificial Sequence
  Synthetic oligonucleotide; GGG chr11 5238058 5238077 5238074 +
gcactttcagaggccgagga

SEQ ID NO: 10065 - DNA, 20 bp, Artificial Sequence
  Synthetic oligonucleotide; TGG chr11 5238061 5238080 5238077 +
ctttcagaggccgaggaggg

SEQ ID NO: 10066 - DNA, 20 bp, Artificial Sequence
  Synthetic oligonucleotide; TAG chr11 5238076 5238095 5238092 +
gagggtggatcacctgatgt

SEQ ID NO: 10067 - DNA, 20 bp, Artificial Sequence
  Synthetic oligonucleotide; AGG chr11 5238077 5238096 5238093 +
agggtggatcacctgatgtt

SEQ ID NO: 10068 - DNA, 20 bp, Artificial Sequence
  Synthetic oligonucleotide; GAG chr11 5238079 5238098 5238095 +
ggtggatcacctgatgttag

SEQ ID NO: 10069 - DNA, 20 bp, Artificial Sequence
  Synthetic oligonucleotide; GAG chr11 5238085 5238104 5238101 +
tcacctgatgttaggagttc

SEQ ID NO: 10070 - DNA, 20 bp, Artificial Sequence
  Synthetic oligonucleotide; CAG chr11 5238090 5238109 5238106 +
tgatgttaggagttcgagat

SEQ ID NO: 10071 - DNA, 20 bp, Artificial Sequence
  Synthetic oligonucleotide; TGG chr11 5238104 5238123 5238120 +
cgagatcagcctgaccaaca

SEQ ID NO: 10072 - DNA, 20 bp, Artificial Sequence
  Synthetic oligonucleotide; TAG chr11 5238130 5238149 5238146 +
aaccccctatctactaaaaa

SEQ ID NO: 10073 - DNA, 20 bp, Artificial Sequence
  Synthetic oligonucleotide; TAG chr11 5238138 5238157 5238154 +
atctactaaaaatagaaaat

SEQ ID NO: 10074 - DNA, 20 bp, Artificial Sequence
  Synthetic oligonucleotide; CAG chr11 5238142 5238161 5238158 +
actaaaaatagaaaattagc

SEQ ID NO: 10075 - DNA, 20 bp, Artificial Sequence
  Synthetic oligonucleotide; AGG chr11 5238143 5238162 5238159 +
ctaaaaatagaaaattagcc

SEQ ID NO: 10076 - DNA, 20 bp, Artificial Sequence
  Synthetic oligonucleotide; TGG chr11 5238148 5238167 5238164 +
aatagaaaattagccaggca

SEQ ID NO: 10077 - DNA, 20 bp, Artificial Sequence
  Synthetic oligonucleotide; TGG chr11 5238151 5238170 5238167 +
agaaaattagccaggcatgg

SEQ ID NO: 10078 - DNA, 20 bp, Artificial Sequence
  Synthetic oligonucleotide; TGG chr11 5238154 5238173 5238170 +
aaattagccaggcatggtgg

SEQ ID NO: 10079 - DNA, 20 bp, Artificial Sequence
  Synthetic oligonucleotide; TAG chr11 5238167 5238186 5238183 +
atggtggtggcacatgcctg

SEQ ID NO: 10080 - DNA, 20 bp, Artificial Sequence
  Synthetic oligonucleotide; CAG chr11 5238173 5238192 5238189 +
gtggcacatgcctgtagtgc

SEQ ID NO: 10081 - DNA, 20 bp, Artificial Sequence
  Synthetic oligonucleotide; TGG chr11 5238181 5238200 5238197 +
tgcctgtagtgccagctact

SEQ ID NO: 10082 - DNA, 20 bp, Artificial Sequence
  Synthetic oligonucleotide; GGG chr11 5238182 5238201 5238198 +
gcctgtagtgccagctactt

SEQ ID NO: 10083 - DNA, 20 bp, Artificial Sequence
  Synthetic oligonucleotide; GAG chr11 5238184 5238203 5238200 +
ctgtagtgccagctacttgg

SEQ ID NO: 10084 - DNA, 20 bp, Artificial Sequence
  Synthetic oligonucleotide; AGG chr11 5238185 5238204 5238201 +
tgtagtgccagctacttggg

SEQ ID NO: 10085 - DNA, 20 bp, Artificial Sequence
  Synthetic oligonucleotide; GAG chr11 5238190 5238209 5238206 +
tgccagctacttgggaggct

SEQ ID NO: 10086 - DNA, 20 bp, Artificial Sequence
  Synthetic oligonucleotide; AGG chr11 5238191 5238210 5238207 +
gccagctacttgggaggctg

SEQ ID NO: 10087 - DNA, 20 bp, Artificial Sequence
  Synthetic oligonucleotide; CAG chr11 5238194 5238213 5238210 +
agctacttgggaggctgagg

SEQ ID NO: 10088 - DNA, 20 bp, Artificial Sequence
  Synthetic oligonucleotide; AGG chr11 5238195 5238214 5238211 +
gctacttgggaggctgaggc

SEQ ID NO: 10089 - DNA, 20 bp, Artificial Sequence
  Synthetic oligonucleotide; GAG chr11 5238197 5238216 5238213 +
tacttgggaggctgaggcag

SEQ ID NO: 10090 - DNA, 20 bp, Artificial Sequence
  Synthetic oligonucleotide; TGG chr11 5238213 5238232 5238229 +
gcaggagaatcgcttgaacc

SEQ ID NO: 10091 - DNA, 20 bp, Artificial Sequence
  Synthetic oligonucleotide; GGG chr11 5238214 5238233 5238230 +
caggagaatcgcttgaacct

SEQ ID NO: 10092 - DNA, 20 bp, Artificial Sequence
  Synthetic oligonucleotide; GAG chr11 5238216 5238235 5238232 +
ggagaatcgcttgaacctgg

SEQ ID NO: 10093 - DNA, 20 bp, Artificial Sequence
  Synthetic oligonucleotide; AGG chr11 5238217 5238236 5238233 +
gagaatcgcttgaacctggg

SEQ ID NO: 10094 - DNA, 20 bp, Artificial Sequence
  Synthetic oligonucleotide; CAG chr11 5238220 5238239 5238236 +
aatcgcttgaacctgggagg

SEQ ID NO: 10095 - DNA, 20 bp, Artificial Sequence
  Synthetic oligonucleotide; CAG chr11 5238229 5238248 5238245 +
aacctgggaggcagatgttg

SEQ ID NO: 10096 - DNA, 20 bp, Artificial Sequence
  Synthetic oligonucleotide; GAG chr11 5238233 5238252 5238249 +
tgggaggcagatgttgcagt

SEQ ID NO: 10097 - DNA, 20 bp, Artificial Sequence
  Synthetic oligonucleotide; TGG chr11 5238238 5238257 5238254 +
ggcagatgttgcagtgagcc

SEQ ID NO: 10098 - DNA, 20 bp, Artificial Sequence
  Synthetic oligonucleotide; CAG chr11 5238258 5238277 5238274 +
tggatcatgccattgcactc

SEQ ID NO: 10099 - DNA, 20 bp, Artificial Sequence
  Synthetic oligonucleotide; TGG chr11 5238263 5238282 5238279 +
catgccattgcactccagcc

SEQ ID NO: 10100 - DNA, 20 bp, Artificial Sequence
  Synthetic oligonucleotide; GGG chr11 5238264 5238283 5238280 +
atgccattgcactccagcct

SEQ ID NO: 10101 - DNA, 20 bp, Artificial Sequence
  Synthetic oligonucleotide; TAG chr11 5238273 5238292 5238289 +
cactccagcctgggcaacca

SEQ ID NO: 10102 - DNA, 20 bp, Artificial Sequence
  Synthetic oligonucleotide; CAG chr11 5238289 5238308 5238305 +
accatagcaatgctctatct

SEQ ID NO: 10103 - DNA, 20 bp, Artificial Sequence
  Synthetic oligonucleotide; AAG chr11 5238305 5238324 5238321 +
atctcagaaaaaaaaaaaaa

SEQ ID NO: 10104 - DNA, 20 bp, Artificial Sequence
  Synthetic oligonucleotide; GAG chr11 5238338 5238357 5238354 +
cctgaaaaaataaattattt

SEQ ID NO: 10105 - DNA, 20 bp, Artificial Sequence
  Synthetic oligonucleotide; CAG chr11 5238364 5238383 5238380 +
tgtacctaattcataatttt

SEQ ID NO: 10106 - DNA, 20 bp, Artificial Sequence
  Synthetic oligonucleotide; GAG chr11 5238379 5238398 5238395 +
attttcagataatgaatatt

SEQ ID NO: 10107 - DNA, 20 bp, Artificial Sequence
  Synthetic oligonucleotide; CAG chr11 5238394 5238413 5238410 +
atattgagatgatatatgca

SEQ ID NO: 10108 - DNA, 20 bp, Artificial Sequence
  Synthetic oligonucleotide; TAG chr11 5238406 5238425 5238422 +
tatatgcacagaacaatgcc

SEQ ID NO: 10109 - DNA, 20 bp, Artificial Sequence
  Synthetic oligonucleotide; GAG chr11 5238408 5238427 5238424 +
tatgcacagaacaatgccta

SEQ ID NO: 10110 - DNA, 20 bp, Artificial Sequence
  Synthetic oligonucleotide; AAG chr11 5238420 5238439 5238436 +
aatgcctagagacacattct

SEQ ID NO: 10111 - DNA, 20 bp, Artificial Sequence
  Synthetic oligonucleotide; CAG chr11 5238441 5238460 5238457 +
agtgtgacattcttaaatgc

SEQ ID NO: 10112 - DNA, 20 bp, Artificial Sequence
  Synthetic oligonucleotide; CAG chr11 5238465 5238484 5238481 +
gctctccacaattctaatct

SEQ ID NO: 10113 - DNA, 20 bp, Artificial Sequence
  Synthetic oligonucleotide; TGG chr11 5238559 5238578 5238575 +
cactgtaattattcatttac

SEQ ID NO: 10114 - DNA, 20 bp, Artificial Sequence
  Synthetic oligonucleotide; TAG chr11 5238570 5238589 5238586 +
ttcatttactggacacatcc

SEQ ID NO: 10115 - DNA, 20 bp, Artificial Sequence
  Synthetic oligonucleotide; CAG chr11 5238631 5238650 5238647 +
tttatttctcatccttccct

SEQ ID NO: 10116 - DNA, 20 bp, Artificial Sequence
  Synthetic oligonucleotide; GAG chr11 5238648 5238667 5238664 +
cctcagtgttctctgtattt

SEQ ID NO: 10117 - DNA, 20 bp, Artificial Sequence
  Synthetic oligonucleotide; AGG chr11 5238649 5238668 5238665 +
ctcagtgttctctgtatttg

SEQ ID NO: 10118 - DNA, 20 bp, Artificial Sequence
  Synthetic oligonucleotide; CAG chr11 5238665 5238684 5238681 +
tttgaggaactgacatttcc

SEQ ID NO: 10119 - DNA, 20 bp, Artificial Sequence
  Synthetic oligonucleotide; AGG chr11 5238666 5238685 5238682 +
ttgaggaactgacatttccc

SEQ ID NO: 10120 - DNA, 20 bp, Artificial Sequence
  Synthetic oligonucleotide; CAG chr11 5238683 5238702 5238699 +
cccaggtttcctcacccttt

SEQ ID NO: 10121 - DNA, 20 bp, Artificial Sequence
  Synthetic oligonucleotide; TGG chr11 5238705 5238724 5238721 +
gtcgcatgtacattctgcaa

SEQ ID NO: 10122 - DNA, 20 bp, Artificial Sequence
  Synthetic oligonucleotide; TGG chr11 5238715 5238734 5238731 +
cattctgcaatggtaaacac

SEQ ID NO: 10123 - DNA, 20 bp, Artificial Sequence
  Synthetic oligonucleotide; GAG chr11 5238720 5238739 5238736 +
tgcaatggtaaacactggct

SEQ ID NO: 10124 - DNA, 20 bp, Artificial Sequence
  Synthetic oligonucleotide; AGG chr11 5238721 5238740 5238737 +
gcaatggtaaacactggctg

SEQ ID NO: 10125 - DNA, 20 bp, Artificial Sequence
  Synthetic oligonucleotide; GGG chr11 5238722 5238741 5238738 +
caatggtaaacactggctga

SEQ ID NO: 10126 - DNA, 20 bp, Artificial Sequence
  Synthetic oligonucleotide; AAG chr11 5238726 5238745 5238742 +
ggtaaacactggctgaggga

SEQ ID NO: 10127 - DNA, 20 bp, Artificial Sequence
  Synthetic oligonucleotide; AAG chr11 5238732 5238751 5238748 +
cactggctgagggaaagcat

SEQ ID NO: 10128 - DNA, 20 bp, Artificial Sequence
  Synthetic oligonucleotide; AAG chr11 5238736 5238755 5238752 +
ggctgagggaaagcataagc

SEQ ID NO: 10129 - DNA, 20 bp, Artificial Sequence
  Synthetic oligonucleotide; TGG chr11 5238747 5238766 5238763 +
agcataagcaagattatttc

SEQ ID NO: 10130 - DNA, 20 bp, Artificial Sequence
  Synthetic oligonucleotide; CGG chr11 5238768 5238787 5238784 +
ggtctctctctctctctgaa

SEQ ID NO: 10131 - DNA, 20 bp, Artificial Sequence
  Synthetic oligonucleotide; CAG chr11 5238779 5238798 5238795 +
ctctctgaacggatctccta

SEQ ID NO: 10132 - DNA, 20 bp, Artificial Sequence
  Synthetic oligonucleotide; CAG chr11 5238782 5238801 5238798 +
tctgaacggatctcctacag

SEQ ID NO: 10133 - DNA, 20 bp, Artificial Sequence
  Synthetic oligonucleotide; CAG chr11 5238786 5238805 5238802 +
aacggatctcctacagcaga

SEQ ID NO: 10134 - DNA, 20 bp, Artificial Sequence
  Synthetic oligonucleotide; TGG chr11 5238798 5238817 5238814 +
acagcagacagtctttttta

SEQ ID NO: 10135 - DNA, 20 bp, Artificial Sequence
  Synthetic oligonucleotide; TGG chr11 5238808 5238827 5238824 +
gtcttttttatggtttttta

SEQ ID NO: 10136 - DNA, 20 bp, Artificial Sequence
  Synthetic oligonucleotide; TAG chr11 5238832 5238851 5238848 +
tgatactttgatgcccccat

SEQ ID NO: 10137 - DNA, 20 bp, Artificial Sequence
  Synthetic oligonucleotide; CAG chr11 5238836 5238855 5238852 +
actttgatgcccccattaga

SEQ ID NO: 10138 - DNA, 20 bp, Artificial Sequence
  Synthetic oligonucleotide; TGG chr11 5238842 5238861 5238858 +
atgcccccattagacagttc

SEQ ID NO: 10139 - DNA, 20 bp, Artificial Sequence
  Synthetic oligonucleotide; AAG chr11 5238853 5238872 5238869 +
agacagttctggctctctcc

SEQ ID NO: 10140 - DNA, 20 bp, Artificial Sequence
  Synthetic oligonucleotide; AGG chr11 5238854 5238873 5238870 +
gacagttctggctctctcca

SEQ ID NO: 10141 - DNA, 20 bp, Artificial Sequence
  Synthetic oligonucleotide; GAG chr11 5238856 5238875 5238872 +
cagttctggctctctccaag

SEQ ID NO: 10142 - DNA, 20 bp, Artificial Sequence
  Synthetic oligonucleotide; TAG chr11 5238866 5238885 5238882 +
tctctccaaggagcacccac

SEQ ID NO: 10143 - DNA, 20 bp, Artificial Sequence
  Synthetic oligonucleotide; CAG chr11 5238880 5238899 5238896 +
acccactagctcactgaatc

SEQ ID NO: 10144 - DNA, 20 bp, Artificial Sequence
  Synthetic oligonucleotide; TGG chr11 5238883 5238902 5238899 +
cactagctcactgaatccag

SEQ ID NO: 10145 - DNA, 20 bp, Artificial Sequence
  Synthetic oligonucleotide; TGG chr11 5238891 5238910 5238907 +
cactgaatccagtggacctc

SEQ ID NO: 10146 - DNA, 20 bp, Artificial Sequence
  Synthetic oligonucleotide; TGG chr11 5238897 5238916 5238913 +
atccagtggacctctggtta

SEQ ID NO: 10147 - DNA, 20 bp, Artificial Sequence
  Synthetic oligonucleotide; GGG chr11 5238898 5238917 5238914 +
tccagtggacctctggttat

SEQ ID NO: 10148 - DNA, 20 bp, Artificial Sequence
  Synthetic oligonucleotide; TGG chr11 5238904 5238923 5238920 +
ggacctctggttatgggctc

SEQ ID NO: 10149 - DNA, 20 bp, Artificial Sequence
  Synthetic oligonucleotide; TGG chr11 5238910 5238929 5238926 +
ctggttatgggctctggttc

SEQ ID NO: 10150 - DNA, 20 bp, Artificial Sequence
  Synthetic oligonucleotide; TGG chr11 5238917 5238936 5238933 +
tgggctctggttctggactc

SEQ ID NO: 10151 - DNA, 20 bp, Artificial Sequence
  Synthetic oligonucleotide; TGG chr11 5238920 5238939 5238936 +
gctctggttctggactctgg

SEQ ID NO: 10152 - DNA, 20 bp, Artificial Sequence
  Synthetic oligonucleotide; TAG chr11 5238950 5238969 5238966 +
attttctccttctgcccttc

SEQ ID NO: 10153 - DNA, 20 bp, Artificial Sequence
  Synthetic oligonucleotide; AGG chr11 5238951 5238970 5238967 +
ttttctccttctgcccttct

SEQ ID NO: 10154 - DNA, 20 bp, Artificial Sequence
  Synthetic oligonucleotide; TGG chr11 5238959 5238978 5238975 +
ttctgcccttctaggcctaa

SEQ ID NO: 10155 - DNA, 20 bp, Artificial Sequence
  Synthetic oligonucleotide; CGG chr11 5238962 5238981 5238978 +
tgcccttctaggcctaatgg

SEQ ID NO: 10156 - DNA, 20 bp, Artificial Sequence
  Synthetic oligonucleotide; AAG chr11 5238965 5238984 5238981 +
ccttctaggcctaatggcgg

SEQ ID NO: 10157 - DNA, 20 bp, Artificial Sequence
  Synthetic oligonucleotide; GAG chr11 5238967 5238986 5238983 +
ttctaggcctaatggcggaa

SEQ ID NO: 10158 - DNA, 20 bp, Artificial Sequence
  Synthetic oligonucleotide; AGG chr11 5238968 5238987 5238984 +
tctaggcctaatggcggaag

SEQ ID NO: 10159 - DNA, 20 bp, Artificial Sequence
  Synthetic oligonucleotide; TAG chr11 5238992 5239011 5239008 +
tttctgatgttactaacatc

SEQ ID NO: 10160 - DNA, 20 bp, Artificial Sequence
  Synthetic oligonucleotide; TAG chr11 5239024 5239043 5239040 +
ctgtcctttatttgatattt

SEQ ID NO: 10161 - DNA, 20 bp, Artificial Sequence
  Synthetic oligonucleotide; AAG chr11 5239039 5239058 5239055 +
tattttagctcttccaatac

SEQ ID NO: 10162 - DNA, 20 bp, Artificial Sequence
  Synthetic oligonucleotide; AGG chr11 5239040 5239059 5239056 +
attttagctcttccaataca

SEQ ID NO: 10163 - DNA, 20 bp, Artificial Sequence
  Synthetic oligonucleotide; AAG chr11 5239056 5239075 5239072 +
tacaaggataattaactatt

SEQ ID NO: 10164 - DNA, 20 bp, Artificial Sequence
  Synthetic oligonucleotide; GAG chr11 5239058 5239077 5239074 +
caaggataattaactattaa

SEQ ID NO: 10165 - DNA, 20 bp, Artificial Sequence
  Synthetic oligonucleotide; TAG chr11 5239074 5239093 5239090 +
ttaagagctgtatttaattc

SEQ ID NO: 10166 - DNA, 20 bp, Artificial Sequence
  Synthetic oligonucleotide; AGG chr11 5239075 5239094 5239091 +
taagagctgtatttaattct

SEQ ID NO: 10167 - DNA, 20 bp, Artificial Sequence
  Synthetic oligonucleotide; GAG chr11 5239080 5239099 5239096 +
gctgtatttaattctaggtt

SEQ ID NO: 10168 - DNA, 20 bp, Artificial Sequence
  Synthetic oligonucleotide; TGG chr11 5239093 5239112 5239109 +
ctaggttgagtaactgataa

SEQ ID NO: 10169 - DNA, 20 bp, Artificial Sequence
  Synthetic oligonucleotide; TGG chr11 5239112 5239131 5239128 +
atggtttgtcctttccttga

SEQ ID NO: 10170 - DNA, 20 bp, Artificial Sequence
  Synthetic oligonucleotide; TAG chr11 5239163 5239182 5239179 +
cttctgatactatgtcttat

SEQ ID NO: 10171 - DNA, 20 bp, Artificial Sequence
  Synthetic oligonucleotide; TAG chr11 5239224 5239243 5239240 +
cttgttgactaatcaaacta

SEQ ID NO: 10172 - DNA, 20 bp, Artificial Sequence
  Synthetic oligonucleotide; CAG chr11 5239227 5239246 5239243 +
gttgactaatcaaactatag

SEQ ID NO: 10173 - DNA, 20 bp, Artificial Sequence
  Synthetic oligonucleotide; GAG chr11 5239229 5239248 5239245 +
tgactaatcaaactatagca

SEQ ID NO: 10174 - DNA, 20 bp, Artificial Sequence
  Synthetic oligonucleotide; AGG chr11 5239230 5239249 5239246 +
gactaatcaaactatagcag

SEQ ID NO: 10175 - DNA, 20 bp, Artificial Sequence
  Synthetic oligonucleotide; CAG chr11 5239233 5239252 5239249 +
taatcaaactatagcagagg

SEQ ID NO: 10176 - DNA, 20 bp, Artificial Sequence
  Synthetic oligonucleotide; GAG chr11 5239235 5239254 5239251 +
atcaaactatagcagaggca

SEQ ID NO: 10177 - DNA, 20 bp, Artificial Sequence
  Synthetic oligonucleotide; AGG chr11 5239236 5239255 5239252 +
tcaaactatagcagaggcag

SEQ ID NO: 10178 - DNA, 20 bp, Artificial Sequence
  Synthetic oligonucleotide; AAG chr11 5239239 5239258 5239255 +
aactatagcagaggcagagg

SEQ ID NO: 10179 - DNA, 20 bp, Artificial Sequence
  Synthetic oligonucleotide; AGG chr11 5239240 5239259 5239256 +
actatagcagaggcagagga

SEQ ID NO: 10180 - DNA, 20 bp, Artificial Sequence
  Synthetic oligonucleotide; AAG chr11 5239265 5239284 5239281 +
cctcatgacctataaatact

SEQ ID NO: 10181 - DNA, 20 bp, Artificial Sequence
  Synthetic oligonucleotide; TAG chr11 5239276 5239295 5239292 +
ataaatactaagatatcaca

SEQ ID NO: 10182 - DNA, 20 bp, Artificial Sequence
  Synthetic oligonucleotide; TAG chr11 5239285 5239304 5239301 +
aagatatcacatagtcattt

SEQ ID NO: 10183 - DNA, 20 bp, Artificial Sequence
  Synthetic oligonucleotide; AAG chr11 5239293 5239312 5239309 +
acatagtcattttagaacca

SEQ ID NO: 10184 - DNA, 20 bp, Artificial Sequence
  Synthetic oligonucleotide; AGG chr11 5239294 5239313 5239310 +
catagtcattttagaaccaa

SEQ ID NO: 10185 - DNA, 20 bp, Artificial Sequence
  Synthetic oligonucleotide; CAG chr11 5239302 5239321 5239318 +
ttttagaaccaaaggttcct

SEQ ID NO: 10186 - DNA, 20 bp, Artificial Sequence
  Synthetic oligonucleotide; TAG chr11 5239307 5239326 5239323 +
gaaccaaaggttcctcagtt

SEQ ID NO: 10187 - DNA, 20 bp, Artificial Sequence
  Synthetic oligonucleotide; AGG chr11 5239308 5239327 5239324 +
aaccaaaggttcctcagttt

SEQ ID NO: 10188 - DNA, 20 bp, Artificial Sequence
  Synthetic oligonucleotide; TGG chr11 5239330 5239349 5239346 +
gtctcaaacaaacttctcta

SEQ ID NO: 10189 - DNA, 20 bp, Artificial Sequence
  Synthetic oligonucleotide; TAG chr11 5239334 5239353 5239350 +
caaacaaacttctctatgga

SEQ ID NO: 10190 - DNA, 20 bp, Artificial Sequence
  Synthetic oligonucleotide; TAG chr11 5239353 5239372 5239369 +
atagtgtaatactcataatg

SEQ ID NO: 10191 - DNA, 20 bp, Artificial Sequence
  Synthetic oligonucleotide; AAG chr11 5239358 5239377 5239374 +
gtaatactcataatgtagaa

SEQ ID NO: 10192 - DNA, 20 bp, Artificial Sequence
  Synthetic oligonucleotide; GAG chr11 5239360 5239379 5239376 +
aatactcataatgtagaaaa

SEQ ID NO: 10193 - DNA, 20 bp, Artificial Sequence
  Synthetic oligonucleotide; GAG chr11 5239362 5239381 5239378 +
tactcataatgtagaaaaga

SEQ ID NO: 10194 - DNA, 20 bp, Artificial Sequence
  Synthetic oligonucleotide; TGG chr11 5239374 5239393 5239390 +
agaaaagagagatctaattt

SEQ ID NO: 10195 - DNA, 20 bp, Artificial Sequence
  Synthetic oligonucleotide; TAG chr11 5239409 5239428 5239425 +
tttttttcatctccaaatac

SEQ ID NO: 10196 - DNA, 20 bp, Artificial Sequence
  Synthetic oligonucleotide; AGG chr11 5239410 5239429 5239426 +
ttttttcatctccaaatact

SEQ ID NO: 10197 - DNA, 20 bp, Artificial Sequence
  Synthetic oligonucleotide; GGG chr11 5239411 5239430 5239427 +
tttttcatctccaaatacta

SEQ ID NO: 10198 - DNA, 20 bp, Artificial Sequence
  Synthetic oligonucleotide; AAG chr11 5239418 5239437 5239434 +
tctccaaatactagggaaat

SEQ ID NO: 10199 - DNA, 20 bp, Artificial Sequence
  Synthetic oligonucleotide; GAG chr11 5239420 5239439 5239436 +
tccaaatactagggaaataa

SEQ ID NO: 10200 - DNA, 20 bp, Artificial Sequence
  Synthetic oligonucleotide; AAG chr11 5239428 5239447 5239444 +
ctagggaaataagagtttac

SEQ ID NO: 10201 - DNA, 20 bp, Artificial Sequence
  Synthetic oligonucleotide; AAG chr11 5239449 5239468 5239465 +
agacaatgtctctaccataa

SEQ ID NO: 10202 - DNA, 20 bp, Artificial Sequence
  Synthetic oligonucleotide; GAG chr11 5239451 5239470 5239467 +
acaatgtctctaccataaaa

SEQ ID NO: 10203 - DNA, 20 bp, Artificial Sequence
  Synthetic oligonucleotide; AGG chr11 5239452 5239471 5239468 +
caatgtctctaccataaaag

SEQ ID NO: 10204 - DNA, 20 bp, Artificial Sequence
  Synthetic oligonucleotide; TAG chr11 5239463 5239482 5239479 +
ccataaaagaggttaaaatt

SEQ ID NO: 10205 - DNA, 20 bp, Artificial Sequence
  Synthetic oligonucleotide; TGG chr11 5239466 5239485 5239482 +
taaaagaggttaaaatttag

SEQ ID NO: 10206 - DNA, 20 bp, Artificial Sequence
  Synthetic oligonucleotide; TAG chr11 5239469 5239488 5239485 +
aagaggttaaaatttagtgg

SEQ ID NO: 10207 - DNA, 20 bp, Artificial Sequence
  Synthetic oligonucleotide; AGG chr11 5239470 5239489 5239486 +
agaggttaaaatttagtggt

SEQ ID NO: 10208 - DNA, 20 bp, Artificial Sequence
  Synthetic oligonucleotide; GAG chr11 5239483 5239502 5239499 +
tagtggtaggaatatacaat

SEQ ID NO: 10209 - DNA, 20 bp, Artificial Sequence
  Synthetic oligonucleotide; CAG chr11 5239486 5239505 5239502 +
tggtaggaatatacaatgag

SEQ ID NO: 10210 - DNA, 20 bp, Artificial Sequence
  Synthetic oligonucleotide; AAG chr11 5239492 5239511 5239508 +
gaatatacaatgagcagatt

SEQ ID NO: 10211 - DNA, 20 bp, Artificial Sequence
  Synthetic oligonucleotide; TAG chr11 5239500 5239519 5239516 +
aatgagcagattaagtacat

SEQ ID NO: 10212 - DNA, 20 bp, Artificial Sequence
  Synthetic oligonucleotide; TAG chr11 5239503 5239522 5239519 +
gagcagattaagtacattag

SEQ ID NO: 10213 - DNA, 20 bp, Artificial Sequence
  Synthetic oligonucleotide; AGG chr11 5239504 5239523 5239520 +
agcagattaagtacattagt

SEQ ID NO: 10214 - DNA, 20 bp, Artificial Sequence
  Synthetic oligonucleotide; AAG chr11 5239525 5239544 5239541 +
ggaaaaacactaaatattat

SEQ ID NO: 10215 - DNA, 20 bp, Artificial Sequence
  Synthetic oligonucleotide; AAG chr11 5239529 5239548 5239545 +
aaacactaaatattataaga

SEQ ID NO: 10216 - DNA, 20 bp, Artificial Sequence
  Synthetic oligonucleotide; GAG chr11 5239531 5239550 5239547 +
acactaaatattataagaaa

SEQ ID NO: 10217 - DNA, 20 bp, Artificial Sequence
  Synthetic oligonucleotide; TAG chr11 5239544 5239563 5239560 +
taagaaagagcccataattg

SEQ ID NO: 10218 - DNA, 20 bp, Artificial Sequence
  Synthetic oligonucleotide; CAG chr11 5239547 5239566 5239563 +
gaaagagcccataattgtag

SEQ ID NO: 10219 - DNA, 20 bp, Artificial Sequence
  Synthetic oligonucleotide; GAG chr11 5239549 5239568 5239565 +
aagagcccataattgtagca

SEQ ID NO: 10220 - DNA, 20 bp, Artificial Sequence
  Synthetic oligonucleotide; TAG chr11 5239556 5239575 5239572 +
cataattgtagcagagttta

SEQ ID NO: 10221 - DNA, 20 bp, Artificial Sequence
  Synthetic oligonucleotide; CAG chr11 5239560 5239579 5239576 +
attgtagcagagtttataga

SEQ ID NO: 10222 - DNA, 20 bp, Artificial Sequence
  Synthetic oligonucleotide; AGG chr11 5239561 5239580 5239577 +
ttgtagcagagtttatagac

SEQ ID NO: 10223 - DNA, 20 bp, Artificial Sequence
  Synthetic oligonucleotide; GGG chr11 5239562 5239581 5239578 +
tgtagcagagtttatagaca

SEQ ID NO: 10224 - DNA, 20 bp, Artificial Sequence
  Synthetic oligonucleotide; AAG chr11 5239569 5239588 5239585 +
gagtttatagacagggcttt

SEQ ID NO: 10225 - DNA, 20 bp, Artificial Sequence
  Synthetic oligonucleotide; CAG chr11 5239574 5239593 5239590 +
tatagacagggctttaagcc

SEQ ID NO: 10226 - DNA, 20 bp, Artificial Sequence
  Synthetic oligonucleotide; TAG chr11 5239594 5239613 5239610 +
cagttaaaattaaaaaaaaa

SEQ ID NO: 10227 - DNA, 20 bp, Artificial Sequence
  Synthetic oligonucleotide; TAG chr11 5239602 5239621 5239618 +
attaaaaaaaaatagcttct

SEQ ID NO: 10228 - DNA, 20 bp, Artificial Sequence
  Synthetic oligonucleotide; GAG chr11 5239607 5239626 5239623 +
aaaaaaatagcttcttagtt

SEQ ID NO: 10229 - DNA, 20 bp, Artificial Sequence
  Synthetic oligonucleotide; AAG chr11 5239619 5239638 5239635 +
tcttagttgagataacatat

SEQ ID NO: 10230 - DNA, 20 bp, Artificial Sequence
  Synthetic oligonucleotide; TAG chr11 5239623 5239642 5239639 +
agttgagataacatataagt

SEQ ID NO: 10231 - DNA, 20 bp, Artificial Sequence
  Synthetic oligonucleotide; AGG chr11 5239624 5239643 5239640 +
gttgagataacatataagtt

SEQ ID NO: 10232 - DNA, 20 bp, Artificial Sequence
  Synthetic oligonucleotide; AAG chr11 5239632 5239651 5239648 +
aacatataagttaggactta

SEQ ID NO: 10233 - DNA, 20 bp, Artificial Sequence
  Synthetic oligonucleotide; GAG chr11 5239638 5239657 5239654 +
taagttaggacttaaagtat

SEQ ID NO: 10234 - DNA, 20 bp, Artificial Sequence
  Synthetic oligonucleotide; AAG chr11 5239644 5239663 5239660 +
aggacttaaagtatgagtac

SEQ ID NO: 10235 - DNA, 20 bp, Artificial Sequence
  Synthetic oligonucleotide; TAG chr11 5239648 5239667 5239664 +
cttaaagtatgagtacaaga

SEQ ID NO: 10236 - DNA, 20 bp, Artificial Sequence
  Synthetic oligonucleotide; AAG chr11 5239653 5239672 5239669 +
agtatgagtacaagatagac

SEQ ID NO: 10237 - DNA, 20 bp, Artificial Sequence
  Synthetic oligonucleotide; AGG chr11 5239654 5239673 5239670 +
gtatgagtacaagatagaca

SEQ ID NO: 10238 - DNA, 20 bp, Artificial Sequence
  Synthetic oligonucleotide; GAG chr11 5239663 5239682 5239679 +
caagatagacaaggcaaaat

SEQ ID NO: 10239 - DNA, 20 bp, Artificial Sequence
  Synthetic oligonucleotide; AGG chr11 5239664 5239683 5239680 +
aagatagacaaggcaaaatg

SEQ ID NO: 10240 - DNA, 20 bp, Artificial Sequence
  Synthetic oligonucleotide; GGG chr11 5239665 5239684 5239681 +
agatagacaaggcaaaatga

SEQ ID NO: 10241 - DNA, 20 bp, Artificial Sequence
  Synthetic oligonucleotide; AAG chr11 5239669 5239688 5239685 +
agacaaggcaaaatgaggga

SEQ ID NO: 10242 - DNA, 20 bp, Artificial Sequence
  Synthetic oligonucleotide; CAG chr11 5239680 5239699 5239696 +
aatgagggaaagacatcacc

SEQ ID NO: 10243 - DNA, 20 bp, Artificial Sequence
  Synthetic oligonucleotide; GAG chr11 5239682 5239701 5239698 +
tgagggaaagacatcaccca

SEQ ID NO: 10244 - DNA, 20 bp, Artificial Sequence
  Synthetic oligonucleotide; CAG chr11 5239693 5239712 5239709 +
catcacccagagtaaatgaa

SEQ ID NO: 10245 - DNA, 20 bp, Artificial Sequence
  Synthetic oligonucleotide; AAG chr11 5239704 5239723 5239720 +
gtaaatgaacagcatgtaca

SEQ ID NO: 10246 - DNA, 20 bp, Artificial Sequence
  Synthetic oligonucleotide; CAG chr11 5239711 5239730 5239727 +
aacagcatgtacaaagctaa

SEQ ID NO: 10247 - DNA, 20 bp, Artificial Sequence
  Synthetic oligonucleotide; GAG chr11 5239713 5239732 5239729 +
cagcatgtacaaagctaaca

SEQ ID NO: 10248 - DNA, 20 bp, Artificial Sequence
  Synthetic oligonucleotide; CAG chr11 5239723 5239742 5239739 +
aaagctaacagagtcaaatg

SEQ ID NO: 10249 - DNA, 20 bp, Artificial Sequence
  Synthetic oligonucleotide; TAG chr11 5239740 5239759 5239756 +
atgcagaaatccaaattctc

SEQ ID NO: 10250 - DNA, 20 bp, Artificial Sequence
  Synthetic oligonucleotide; TGG chr11 5239749 5239768 5239765 +
tccaaattctctagattgac

SEQ ID NO: 10251 - DNA, 20 bp, Artificial Sequence
  Synthetic oligonucleotide; GGG chr11 5239750 5239769 5239766 +
ccaaattctctagattgact

SEQ ID NO: 10252 - DNA, 20 bp, Artificial Sequence
  Synthetic oligonucleotide; GGG chr11 5239751 5239770 5239767 +
caaattctctagattgactg

SEQ ID NO: 10253 - DNA, 20 bp, Artificial Sequence
  Synthetic oligonucleotide; AAG chr11 5239773 5239792 5239789 +
gtaattttgtcaatgcactc

SEQ ID NO: 10254 - DNA, 20 bp, Artificial Sequence
  Synthetic oligonucleotide; CAG chr11 5239789 5239808 5239805 +
actcaagtatgcatctgtaa

SEQ ID NO: 10255 - DNA, 20 bp, Artificial Sequence
  Synthetic oligonucleotide; TGG chr11 5239812 5239831 5239828 +
tgtgtgttcttatgtgtgca

SEQ ID NO: 10256 - DNA, 20 bp, Artificial Sequence
  Synthetic oligonucleotide; TGG chr11 5239827 5239846 5239843 +
gtgcatggaatgtttgttca

SEQ ID NO: 10257 - DNA, 20 bp, Artificial Sequence
  Synthetic oligonucleotide; GAG chr11 5239829 5239848 5239845 +
gcatggaatgtttgttcatg

SEQ ID NO: 10258 - DNA, 20 bp, Artificial Sequence
  Synthetic oligonucleotide; AAG chr11 5239835 5239854 5239851 +
aatgtttgttcatggagcat

SEQ ID NO: 10259 - DNA, 20 bp, Artificial Sequence
  Synthetic oligonucleotide; TAG chr11 5239846 5239865 5239862 +
atggagcataagaaattgtg

SEQ ID NO: 10260 - DNA, 20 bp, Artificial Sequence
  Synthetic oligonucleotide; TAG chr11 5239854 5239873 5239870 +
taagaaattgtgtagacata

SEQ ID NO: 10261 - DNA, 20 bp, Artificial Sequence
  Synthetic oligonucleotide; CAG chr11 5239877 5239896 5239893 +
acacatctgtatgtgtatat

SEQ ID NO: 10262 - DNA, 20 bp, Artificial Sequence
  Synthetic oligonucleotide; GAG chr11 5239879 5239898 5239895 +
acatctgtatgtgtatatca

SEQ ID NO: 10263 - DNA, 20 bp, Artificial Sequence
  Synthetic oligonucleotide; AAG chr11 5239899 5239918 5239915 +
gagaatgtttacattgctac

SEQ ID NO: 10264 - DNA, 20 bp, Artificial Sequence
  Synthetic oligonucleotide; AAG chr11 5239923 5239942 5239939 +
ttttatatgactacatgcac

SEQ ID NO: 10265 - DNA, 20 bp, Artificial Sequence
  Synthetic oligonucleotide; CAG chr11 5239942 5239961 5239958 +
caagcattcatgctacatgt

SEQ ID NO: 10266 - DNA, 20 bp, Artificial Sequence
  Synthetic oligonucleotide; TGG chr11 5239947 5239966 5239963 +
attcatgctacatgtcagtt

SEQ ID NO: 10267 - DNA, 20 bp, Artificial Sequence
  Synthetic oligonucleotide; AAG chr11 5239964 5239983 5239980 +
gtttggtatatttttcctgt

SEQ ID NO: 10268 - DNA, 20 bp, Artificial Sequence
  Synthetic oligonucleotide; AAG chr11 5239992 5240011 5240008 +
tacttatgtgttttccacta

SEQ ID NO: 10269 - DNA, 20 bp, Artificial Sequence
  Synthetic oligonucleotide; AGG chr11 5239993 5240012 5240009 +
acttatgtgttttccactaa

SEQ ID NO: 10270 - DNA, 20 bp, Artificial Sequence
  Synthetic oligonucleotide; GAG chr11 5240017 5240036 5240033 +
gaatgtgaaaactcctcatc

SEQ ID NO: 10271 - DNA, 20 bp, Artificial Sequence
  Synthetic oligonucleotide; AAG chr11 5240031 5240050 5240047 +
ctcatcgagaaatgaacaat

SEQ ID NO: 10272 - DNA, 20 bp, Artificial Sequence
  Synthetic oligonucleotide; CAG chr11 5240039 5240058 5240055 +
gaaatgaacaataagtaaca

SEQ ID NO: 10273 - DNA, 20 bp, Artificial Sequence
  Synthetic oligonucleotide; AGG chr11 5240040 5240059 5240056 +
aaatgaacaataagtaacac

SEQ ID NO: 10274 - DNA, 20 bp, Artificial Sequence
  Synthetic oligonucleotide; CAG chr11 5240074 5240093 5240090 +
tcatctcttcatttaaaata

SEQ ID NO: 10275 - DNA, 20 bp, Artificial Sequence
  Synthetic oligonucleotide; GAG chr11 5240076 5240095 5240092 +
atctcttcatttaaaataca

SEQ ID NO: 10276 - DNA, 20 bp, Artificial Sequence
  Synthetic oligonucleotide; CAG chr11 5240086 5240105 5240102 +
ttaaaatacagagtgacatt

SEQ ID NO: 10277 - DNA, 20 bp, Artificial Sequence
  Synthetic oligonucleotide; AAG chr11 5240089 5240108 5240105 +
aaatacagagtgacattcag

SEQ ID NO: 10278 - DNA, 20 bp, Artificial Sequence
  Synthetic oligonucleotide; AGG chr11 5240090 5240109 5240106 +
aatacagagtgacattcaga

SEQ ID NO: 10279 - DNA, 20 bp, Artificial Sequence
  Synthetic oligonucleotide; GGG chr11 5240091 5240110 5240107 +
atacagagtgacattcagaa

SEQ ID NO: 10280 - DNA, 20 bp, Artificial Sequence
  Synthetic oligonucleotide; AAG chr11 5240095 5240114 5240111 +
agagtgacattcagaagggc

SEQ ID NO: 10281 - DNA, 20 bp, Artificial Sequence
  Synthetic oligonucleotide; AGG chr11 5240096 5240115 5240112 +
gagtgacattcagaagggca

SEQ ID NO: 10282 - DNA, 20 bp, Artificial Sequence
  Synthetic oligonucleotide; GGG chr11 5240097 5240116 5240113 +
agtgacattcagaagggcaa

SEQ ID NO: 10283 - DNA, 20 bp, Artificial Sequence
  Synthetic oligonucleotide; TAG chr11 5240101 5240120 5240117 +
acattcagaagggcaaggga

SEQ ID NO: 10284 - DNA, 20 bp, Artificial Sequence
  Synthetic oligonucleotide; AAG chr11 5240107 5240126 5240123 +
agaagggcaagggatagcac

SEQ ID NO: 10285 - DNA, 20 bp, Artificial Sequence
  Synthetic oligonucleotide; GAG chr11 5240113 5240132 5240129 +
gcaagggatagcacaagtgt

SEQ ID NO: 10286 - DNA, 20 bp, Artificial Sequence
  Synthetic oligonucleotide; AAG chr11 5240122 5240141 5240138 +
agcacaagtgtgagatttta

SEQ ID NO: 10287 - DNA, 20 bp, Artificial Sequence
  Synthetic oligonucleotide; TGG chr11 5240135 5240154 5240151 +
gattttaaagtgtgattgtt

SEQ ID NO: 10288 - DNA, 20 bp, Artificial Sequence
  Synthetic oligonucleotide; CAG chr11 5240141 5240160 5240157 +
aaagtgtgattgtttggaca

SEQ ID NO: 10289 - DNA, 20 bp, Artificial Sequence
  Synthetic oligonucleotide; AAG chr11 5240154 5240173 5240170 +
ttggacacagtaattattca

SEQ ID NO: 10290 - DNA, 20 bp, Artificial Sequence
  Synthetic oligonucleotide; AAG chr11 5240182 5240201 5240198 +
gcttaattaatgtatgctac

SEQ ID NO: 10291 - DNA, 20 bp, Artificial Sequence
  Synthetic oligonucleotide; CAG chr11 5240186 5240205 5240202 +
aattaatgtatgctacaaga

SEQ ID NO: 10292 - DNA, 20 bp, Artificial Sequence
  Synthetic oligonucleotide; CAG chr11 5240189 5240208 5240205 +
taatgtatgctacaagacag

SEQ ID NO: 10293 - DNA, 20 bp, Artificial Sequence
  Synthetic oligonucleotide; GAG chr11 5240194 5240213 5240210 +
tatgctacaagacagcagtt

SEQ ID NO: 10294 - DNA, 20 bp, Artificial Sequence
  Synthetic oligonucleotide; GAG chr11 5240211 5240230 5240227 +
gttgagtgattattgtacat

SEQ ID NO: 10295 - DNA, 20 bp, Artificial Sequence
  Synthetic oligonucleotide; TGG chr11 5240218 5240237 5240234 +
gattattgtacatgagcaac

SEQ ID NO: 10296 - DNA, 20 bp, Artificial Sequence
  Synthetic oligonucleotide; TGG chr11 5240237 5240256 5240253 +
ctggtatttattctgctttg

SEQ ID NO: 10297 - DNA, 20 bp, Artificial Sequence
  Synthetic oligonucleotide; GGG chr11 5240238 5240257 5240254 +
tggtatttattctgctttgt

SEQ ID NO: 10298 - DNA, 20 bp, Artificial Sequence
  Synthetic oligonucleotide; TAG chr11 5240245 5240264 5240261 +
tattctgctttgtgggttat

SEQ ID NO: 10299 - DNA, 20 bp, Artificial Sequence
  Synthetic oligonucleotide; TGG chr11 5240248 5240267 5240264 +
tctgctttgtgggttattag

SEQ ID NO: 10300 - DNA, 20 bp, Artificial Sequence
  Synthetic oligonucleotide; GGG chr11 5240249 5240268 5240265 +
ctgctttgtgggttattagt

SEQ ID NO: 10301 - DNA, 20 bp, Artificial Sequence
  Synthetic oligonucleotide; GGG chr11 5240250 5240269 5240266 +
tgctttgtgggttattagtg

SEQ ID NO: 10302 - DNA, 20 bp, Artificial Sequence
  Synthetic oligonucleotide; AAG chr11 5240269 5240288 5240285 +
ggggactcaaaaatatgaca

SEQ ID NO: 10303 - DNA, 20 bp, Artificial Sequence
  Synthetic oligonucleotide; AGG chr11 5240270 5240289 5240286 +
gggactcaaaaatatgacaa

SEQ ID NO: 10304 - DNA, 20 bp, Artificial Sequence
  Synthetic oligonucleotide; CAG chr11 5240278 5240297 5240294 +
aaaatatgacaaaggaattt

SEQ ID NO: 10305 - DNA, 20 bp, Artificial Sequence
  Synthetic oligonucleotide; AAG chr11 5240281 5240300 5240297 +
atatgacaaaggaatttcag

SEQ ID NO: 10306 - DNA, 20 bp, Artificial Sequence
  Synthetic oligonucleotide; TAG chr11 5240288 5240307 5240304 +
aaaggaatttcagaagctgt

SEQ ID NO: 10307 - DNA, 20 bp, Artificial Sequence
  Synthetic oligonucleotide; TGG chr11 5240292 5240311 5240308 +
gaatttcagaagctgttaga

SEQ ID NO: 10308 - DNA, 20 bp, Artificial Sequence
  Synthetic oligonucleotide; TAG chr11 5240295 5240314 5240311 +
tttcagaagctgttagatgg

SEQ ID NO: 10309 - DNA, 20 bp, Artificial Sequence
  Synthetic oligonucleotide; AAG chr11 5240324 5240343 5240340 +
ctatctatgtgctcccactc

SEQ ID NO: 10310 - DNA, 20 bp, Artificial Sequence
  Synthetic oligonucleotide; GAG chr11 5240326 5240345 5240342 +
atctatgtgctcccactcaa

SEQ ID NO: 10311 - DNA, 20 bp, Artificial Sequence
  Synthetic oligonucleotide; TGG chr11 5240332 5240351 5240348 +
gtgctcccactcaagagata

SEQ ID NO: 10312 - DNA, 20 bp, Artificial Sequence
  Synthetic oligonucleotide; GAG chr11 5240336 5240355 5240352 +
tcccactcaagagatatggt

SEQ ID NO: 10313 - DNA, 20 bp, Artificial Sequence
  Synthetic oligonucleotide; AGG chr11 5240337 5240356 5240353 +
cccactcaagagatatggtg

SEQ ID NO: 10314 - DNA, 20 bp, Artificial Sequence
  Synthetic oligonucleotide; GAG chr11 5240341 5240360 5240357 +
ctcaagagatatggtgaggt

SEQ ID NO: 10315 - DNA, 20 bp, Artificial Sequence
  Synthetic oligonucleotide; TGG chr11 5240349 5240368 5240365 +
atatggtgaggtgagctctt

SEQ ID NO: 10316 - DNA, 20 bp, Artificial Sequence
  Synthetic oligonucleotide; GGG chr11 5240350 5240369 5240366 +
tatggtgaggtgagctcttt

SEQ ID NO: 10317 - DNA, 20 bp, Artificial Sequence
  Synthetic oligonucleotide; GGG chr11 5240351 5240370 5240367 +
atggtgaggtgagctctttg

SEQ ID NO: 10318 - DNA, 20 bp, Artificial Sequence
  Synthetic oligonucleotide; TGG chr11 5240354 5240373 5240370 +
gtgaggtgagctctttgggg

SEQ ID NO: 10319 - DNA, 20 bp, Artificial Sequence
  Synthetic oligonucleotide; TAG chr11 5240362 5240381 5240378 +
agctctttggggtggacaca

SEQ ID NO: 10320 - DNA, 20 bp, Artificial Sequence
  Synthetic oligonucleotide; GAG chr11 5240364 5240383 5240380 +
ctctttggggtggacacata

SEQ ID NO: 10321 - DNA, 20 bp, Artificial Sequence
  Synthetic oligonucleotide; AGG chr11 5240365 5240384 5240381 +
tctttggggtggacacatag

SEQ ID NO: 10322 - DNA, 20 bp, Artificial Sequence
  Synthetic oligonucleotide; GAG chr11 5240377 5240396 5240393 +
acacatagaggaaatacttt

SEQ ID NO: 10323 - DNA, 20 bp, Artificial Sequence
  Synthetic oligonucleotide; AAG chr11 5240381 5240400 5240397 +
atagaggaaatactttgaga

SEQ ID NO: 10324 - DNA, 20 bp, Artificial Sequence
  Synthetic oligonucleotide; GAG chr11 5240383 5240402 5240399 +
agaggaaatactttgagaaa

SEQ ID NO: 10325 - DNA, 20 bp, Artificial Sequence
  Synthetic oligonucleotide; AGG chr11 5240384 5240403 5240400 +
gaggaaatactttgagaaag

SEQ ID NO: 10326 - DNA, 20 bp, Artificial Sequence
  Synthetic oligonucleotide; TGG chr11 5240390 5240409 5240406 +
atactttgagaaagaggttt

SEQ ID NO: 10327 - DNA, 20 bp, Artificial Sequence
  Synthetic oligonucleotide; GGG chr11 5240391 5240410 5240407 +
tactttgagaaagaggtttt

SEQ ID NO: 10328 - DNA, 20 bp, Artificial Sequence
  Synthetic oligonucleotide; TGG chr11 5240405 5240424 5240421 +
ggttttgggattaatgaaac

SEQ ID NO: 10329 - DNA, 20 bp, Artificial Sequence
  Synthetic oligonucleotide; GAG chr11 5240407 5240426 5240423 +
ttttgggattaatgaaactg

SEQ ID NO: 10330 - DNA, 20 bp, Artificial Sequence
  Synthetic oligonucleotide; AAG chr11 5240410 5240429 5240426 +
tgggattaatgaaactggag

SEQ ID NO: 10331 - DNA, 20 bp, Artificial Sequence
  Synthetic oligonucleotide; AAG chr11 5240414 5240433 5240430 +
attaatgaaactggagaaga

SEQ ID NO: 10332 - DNA, 20 bp, Artificial Sequence
  Synthetic oligonucleotide; AGG chr11 5240415 5240434 5240431 +
ttaatgaaactggagaagaa

SEQ ID NO: 10333 - DNA, 20 bp, Artificial Sequence
  Synthetic oligonucleotide; GGG chr11 5240416 5240435 5240432 +
taatgaaactggagaagaaa

SEQ ID NO: 10334 - DNA, 20 bp, Artificial Sequence
  Synthetic oligonucleotide; GAG chr11 5240447 5240466 5240463 +
cttctaaaacctctttcttt

SEQ ID NO: 10335 - DNA, 20 bp, Artificial Sequence
  Synthetic oligonucleotide; AGG chr11 5240448 5240467 5240464 +
ttctaaaacctctttctttg

SEQ ID NO: 10336 - DNA, 20 bp, Artificial Sequence
  Synthetic oligonucleotide; TAG chr11 5240454 5240473 5240470 +
aacctctttctttgaggttt

SEQ ID NO: 10337 - DNA, 20 bp, Artificial Sequence
  Synthetic oligonucleotide; AGG chr11 5240455 5240474 5240471 +
acctctttctttgaggtttt

SEQ ID NO: 10338 - DNA, 20 bp, Artificial Sequence
  Synthetic oligonucleotide; GAG chr11 5240461 5240480 5240477 +
ttctttgaggttttaggttt

SEQ ID NO: 10339 - DNA, 20 bp, Artificial Sequence
  Synthetic oligonucleotide; AGG chr11 5240462 5240481 5240478 +
tctttgaggttttaggtttg

SEQ ID NO: 10340 - DNA, 20 bp, Artificial Sequence
  Synthetic oligonucleotide; GGG chr11 5240463 5240482 5240479 +
ctttgaggttttaggtttga

SEQ ID NO: 10341 - DNA, 20 bp, Artificial Sequence
  Synthetic oligonucleotide; AAG chr11 5240481 5240500 5240497 +
gagggtgctacatacttcct

SEQ ID NO: 10342 - DNA, 20 bp, Artificial Sequence
  Synthetic oligonucleotide; AGG chr11 5240482 5240501 5240498 +
agggtgctacatacttccta

SEQ ID NO: 10343 - DNA, 20 bp, Artificial Sequence
  Synthetic oligonucleotide; GGG chr11 5240483 5240502 5240499 +
gggtgctacatacttcctaa

SEQ ID NO: 10344 - DNA, 20 bp, Artificial Sequence
  Synthetic oligonucleotide; TGG chr11 5240489 5240508 5240505 +
tacatacttcctaagggtct

SEQ ID NO: 10345 - DNA, 20 bp, Artificial Sequence
  Synthetic oligonucleotide; GGG chr11 5240490 5240509 5240506 +
acatacttcctaagggtctt

SEQ ID NO: 10346 - DNA, 20 bp, Artificial Sequence
  Synthetic oligonucleotide; CAG chr11 5240495 5240514 5240511 +
cttcctaagggtcttgggta

SEQ ID NO: 10347 - DNA, 20 bp, Artificial Sequence
  Synthetic oligonucleotide; AGG chr11 5240496 5240515 5240512 +
ttcctaagggtcttgggtac

SEQ ID NO: 10348 - DNA, 20 bp, Artificial Sequence
  Synthetic oligonucleotide; GAG chr11 5240498 5240517 5240514 +
cctaagggtcttgggtacag

SEQ ID NO: 10349 - DNA, 20 bp, Artificial Sequence
  Synthetic oligonucleotide; AAG chr11 5240505 5240524 5240521 +
gtcttgggtacaggagtttg

SEQ ID NO: 10350 - DNA, 20 bp, Artificial Sequence
  Synthetic oligonucleotide; CAG chr11 5240517 5240536 5240533 +
ggagtttgaagtgattgcca

SEQ ID NO: 10351 - DNA, 20 bp, Artificial Sequence
  Synthetic oligonucleotide; TGG chr11 5240522 5240541 5240538 +
ttgaagtgattgccacagaa

SEQ ID NO: 10352 - DNA, 20 bp, Artificial Sequence
  Synthetic oligonucleotide; CAG chr11 5240538 5240557 5240554 +
agaatggctacgttcattgc

SEQ ID NO: 10353 - DNA, 20 bp, Artificial Sequence
  Synthetic oligonucleotide; CAG chr11 5240548 5240567 5240564 +
cgttcattgccagatccaaa

SEQ ID NO: 10354 - DNA, 20 bp, Artificial Sequence
  Synthetic oligonucleotide; AGG chr11 5240549 5240568 5240565 +
gttcattgccagatccaaac

SEQ ID NO: 10355 - DNA, 20 bp, Artificial Sequence
  Synthetic oligonucleotide; GGG chr11 5240550 5240569 5240566 +
ttcattgccagatccaaaca

SEQ ID NO: 10356 - DNA, 20 bp, Artificial Sequence
  Synthetic oligonucleotide; GGG chr11 5240551 5240570 5240567 +
tcattgccagatccaaacag

SEQ ID NO: 10357 - DNA, 20 bp, Artificial Sequence
  Synthetic oligonucleotide; GGG chr11 5240552 5240571 5240568 +
cattgccagatccaaacagg

SEQ ID NO: 10358 - DNA, 20 bp, Artificial Sequence
  Synthetic oligonucleotide; TAG chr11 5240559 5240578 5240575 +
agatccaaacagggggcttg

SEQ ID NO: 10359 - DNA, 20 bp, Artificial Sequence
  Synthetic oligonucleotide; AGG chr11 5240560 5240579 5240576 +
gatccaaacagggggcttgt

SEQ ID NO: 10360 - DNA, 20 bp, Artificial Sequence
  Synthetic oligonucleotide; CAG chr11 5240603 5240622 5240619 +
aatttccttcttttcattca

SEQ ID NO: 10361 - DNA, 20 bp, Artificial Sequence
  Synthetic oligonucleotide; CAG chr11 5240607 5240626 5240623 +
tccttcttttcattcacaga

SEQ ID NO: 10362 - DNA, 20 bp, Artificial Sequence
  Synthetic oligonucleotide; AGG chr11 5240608 5240627 5240624 +
ccttcttttcattcacagac

SEQ ID NO: 10363 - DNA, 20 bp, Artificial Sequence
  Synthetic oligonucleotide; GGG chr11 5240609 5240628 5240625 +
cttcttttcattcacagaca

SEQ ID NO: 10364 - DNA, 20 bp, Artificial Sequence
  Synthetic oligonucleotide; TAG chr11 5240616 5240635 5240632 +
tcattcacagacagggattt

SEQ ID NO: 10365 - DNA, 20 bp, Artificial Sequence
  Synthetic oligonucleotide; CAG chr11 5240654 5240673 5240670 +
ctctgtttcacaatgttttc

SEQ ID NO: 10366 - DNA, 20 bp, Artificial Sequence
  Synthetic oligonucleotide; TGG chr11 5240679 5240698 5240695 +
ctgtgcaatcactgccacaa

SEQ ID NO: 10367 - DNA, 20 bp, Artificial Sequence
  Synthetic oligonucleotide; CAG chr11 5240728 5240747 5240744 +
ttcattgtttccatcaactt

SEQ ID NO: 10368 - DNA, 20 bp, Artificial Sequence
  Synthetic oligonucleotide; CAG chr11 5240759 5240778 5240775 +
ccatcacctcaatataatta

SEQ ID NO: 10369 - DNA, 20 bp, Artificial Sequence
  Synthetic oligonucleotide; AAG chr11 5240763 5240782 5240779 +
cacctcaatataattacagc

SEQ ID NO: 10370 - DNA, 20 bp, Artificial Sequence
  Synthetic oligonucleotide; AAG chr11 5240783 5240802 5240799 +
aagctcctctgactataccc

SEQ ID NO: 10371 - DNA, 20 bp, Artificial Sequence
  Synthetic oligonucleotide; TAG chr11 5240787 5240806 5240803 +
tcctctgactatacccaagt

SEQ ID NO: 10372 - DNA, 20 bp, Artificial Sequence
  Synthetic oligonucleotide; CAG chr11 5240802 5240821 5240818 +
caagttagactttgtctaat

SEQ ID NO: 10373 - DNA, 20 bp, Artificial Sequence
  Synthetic oligonucleotide; AAG chr11 5240874 5240893 5240890 +
attatgtcactctcatatgc

SEQ ID NO: 10374 - DNA, 20 bp, Artificial Sequence
  Synthetic oligonucleotide; CAG chr11 5240883 5240902 5240899 +
ctctcatatgcaagaaactt

SEQ ID NO: 10375 - DNA, 20 bp, Artificial Sequence
  Synthetic oligonucleotide; TAG chr11 5240905 5240924 5240921 +
gtgatttttgctcaaaacga

SEQ ID NO: 10376 - DNA, 20 bp, Artificial Sequence
  Synthetic oligonucleotide; TGG chr11 5240927 5240946 5240943 +
gctatttttcttacttcatc

SEQ ID NO: 10377 - DNA, 20 bp, Artificial Sequence
  Synthetic oligonucleotide; CAG chr11 5240940 5240959 5240956 +
cttcatctggtctctgcatc

SEQ ID NO: 10378 - DNA, 20 bp, Artificial Sequence
  Synthetic oligonucleotide; CAG chr11 5241029 5241048 5241045 +
acgtgctgtttcctaaatct

SEQ ID NO: 10379 - DNA, 20 bp, Artificial Sequence
  Synthetic oligonucleotide; CAG chr11 5241068 5241087 5241084 +
ttgctcacataaacaaaaat

SEQ ID NO: 10380 - DNA, 20 bp, Artificial Sequence
  Synthetic oligonucleotide; TGG chr11 5241071 5241090 5241087 +
ctcacataaacaaaaatcag

SEQ ID NO: 10381 - DNA, 20 bp, Artificial Sequence
  Synthetic oligonucleotide; TAG chr11 5241155 5241174 5241171 +
cacatgtgtgtgtatatata

SEQ ID NO: 10382 - DNA, 20 bp, Artificial Sequence
  Synthetic oligonucleotide; AAG chr11 5241159 5241178 5241175 +
tgtgtgtgtatatatataga

SEQ ID NO: 10383 - DNA, 20 bp, Artificial Sequence
  Synthetic oligonucleotide; GAG chr11 5241161 5241180 5241177 +
tgtgtgtatatatatagaaa

SEQ ID NO: 10384 - DNA, 20 bp, Artificial Sequence
  Synthetic oligonucleotide; TAG chr11 5241209 5241228 5241225 +
ataaaacttgtacatattta

SEQ ID NO: 10385 - DNA, 20 bp, Artificial Sequence
  Synthetic oligonucleotide; CAG chr11 5241215 5241234 5241231 +
cttgtacatatttatagaaa

SEQ ID NO: 10386 - DNA, 20 bp, Artificial Sequence
  Synthetic oligonucleotide; GAG chr11 5241217 5241236 5241233 +
tgtacatatttatagaaaca

SEQ ID NO: 10387 - DNA, 20 bp, Artificial Sequence
  Synthetic oligonucleotide; GAG chr11 5241219 5241238 5241235 +
tacatatttatagaaacaga

SEQ ID NO: 10388 - DNA, 20 bp, Artificial Sequence
  Synthetic oligonucleotide; AAG chr11 5241229 5241248 5241245 +
tagaaacagagagctgaaca

SEQ ID NO: 10389 - DNA, 20 bp, Artificial Sequence
  Synthetic oligonucleotide; GAG chr11 5241231 5241250 5241247 +
gaaacagagagctgaacaaa

SEQ ID NO: 10390 - DNA, 20 bp, Artificial Sequence
  Synthetic oligonucleotide; TGG chr11 5241247 5241266 5241263 +
caaagagatttattatttat

SEQ ID NO: 10391 - DNA, 20 bp, Artificial Sequence
  Synthetic oligonucleotide; GGG chr11 5241248 5241267 5241264 +
aaagagatttattatttatt

SEQ ID NO: 10392 - DNA, 20 bp, Artificial Sequence
  Synthetic oligonucleotide; TAG chr11 5241251 5241270 5241267 +
gagatttattatttattggg

SEQ ID NO: 10393 - DNA, 20 bp, Artificial Sequence
  Synthetic oligonucleotide; AAG chr11 5241261 5241280 5241277 +
atttattgggtagtgtgata

SEQ ID NO: 10394 - DNA, 20 bp, Artificial Sequence
  Synthetic oligonucleotide; CAG chr11 5241270 5241289 5241286 +
gtagtgtgataaagacttta

SEQ ID NO: 10395 - DNA, 20 bp, Artificial Sequence
  Synthetic oligonucleotide; AGG chr11 5241271 5241290 5241287 +
tagtgtgataaagactttac

SEQ ID NO: 10396 - DNA, 20 bp, Artificial Sequence
  Synthetic oligonucleotide; TAG chr11 5241286 5241305 5241302 +
tttacaggtatcaattcaat

SEQ ID NO: 10397 - DNA, 20 bp, Artificial Sequence
  Synthetic oligonucleotide; AAG chr11 5241307 5241326 5241323 +
agttcttacaaaaatccttt

SEQ ID NO: 10398 - DNA, 20 bp, Artificial Sequence
  Synthetic oligonucleotide; AGG chr11 5241308 5241327 5241324 +
gttcttacaaaaatccttta

SEQ ID NO: 10399 - DNA, 20 bp, Artificial Sequence
  Synthetic oligonucleotide; CAG chr11 5241341 5241360 5241357 +
tgataaatctatcatatgca

SEQ ID NO: 10400 - DNA, 20 bp, Artificial Sequence
  Synthetic oligonucleotide; TGG chr11 5241349 5241368 5241365 +
ctatcatatgcacagcttaa

SEQ ID NO: 10401 - DNA, 20 bp, Artificial Sequence
  Synthetic oligonucleotide; CAG chr11 5241368 5241387 5241384 +
atggaattataaatatgttt

SEQ ID NO: 10402 - DNA, 20 bp, Artificial Sequence
  Synthetic oligonucleotide; AGG chr11 5241369 5241388 5241385 +
tggaattataaatatgtttc

SEQ ID NO: 10403 - DNA, 20 bp, Artificial Sequence
  Synthetic oligonucleotide; CAG chr11 5241375 5241394 5241391 +
tataaatatgtttcaggtca

SEQ ID NO: 10404 - DNA, 20 bp, Artificial Sequence
  Synthetic oligonucleotide; GAG chr11 5241377 5241396 5241393 +
taaatatgtttcaggtcaca

SEQ ID NO: 10405 - DNA, 20 bp, Artificial Sequence
  Synthetic oligonucleotide; AGG chr11 5241378 5241397 5241394 +
aaatatgtttcaggtcacag

SEQ ID NO: 10406 - DNA, 20 bp, Artificial Sequence
  Synthetic oligonucleotide; TAG chr11 5241381 5241400 5241397 +
tatgtttcaggtcacagagg

SEQ ID NO: 10407 - DNA, 20 bp, Artificial Sequence
  Synthetic oligonucleotide; CAG chr11 5241384 5241403 5241400 +
gtttcaggtcacagaggtag

SEQ ID NO: 10408 - DNA, 20 bp, Artificial Sequence
  Synthetic oligonucleotide; AAG chr11 5241390 5241409 5241406 +
ggtcacagaggtagcagatg

SEQ ID NO: 10409 - DNA, 20 bp, Artificial Sequence
  Synthetic oligonucleotide; CAG chr11 5241395 5241414 5241411 +
cagaggtagcagatgaagta

SEQ ID NO: 10410 - DNA, 20 bp, Artificial Sequence
  Synthetic oligonucleotide; AAG chr11 5241407 5241426 5241423 +
atgaagtacagatgaaaacc

SEQ ID NO: 10411 - DNA, 20 bp, Artificial Sequence
  Synthetic oligonucleotide; CAG chr11 5241411 5241430 5241427 +
agtacagatgaaaaccaaga

SEQ ID NO: 10412 - DNA, 20 bp, Artificial Sequence
  Synthetic oligonucleotide; CAG chr11 5241415 5241434 5241431 +
cagatgaaaaccaagacagc

SEQ ID NO: 10413 - DNA, 20 bp, Artificial Sequence
  Synthetic oligonucleotide; TAG chr11 5241429 5241448 5241445 +
gacagccagttcacatgcct

SEQ ID NO: 10414 - DNA, 20 bp, Artificial Sequence
  Synthetic oligonucleotide; GAG chr11 5241431 5241450 5241447 +
cagccagttcacatgcctta

SEQ ID NO: 10415 - DNA, 20 bp, Artificial Sequence
  Synthetic oligonucleotide; AAG chr11 5241457 5241476 5241473 +
attctctattaataccattg

SEQ ID NO: 10416 - DNA, 20 bp, Artificial Sequence
  Synthetic oligonucleotide; AAG chr11 5241465 5241484 5241481 +
ttaataccattgaagacgtt

SEQ ID NO: 10417 - DNA, 20 bp, Artificial Sequence
  Synthetic oligonucleotide; GAG chr11 5241467 5241486 5241483 +
aataccattgaagacgttaa

SEQ ID NO: 10418 - DNA, 20 bp, Artificial Sequence
  Synthetic oligonucleotide; AAG chr11 5241471 5241490 5241487 +
ccattgaagacgttaagaga

SEQ ID NO: 10419 - DNA, 20 bp, Artificial Sequence
  Synthetic oligonucleotide; AAG chr11 5241477 5241496 5241493 +
aagacgttaagagaaagttc

SEQ ID NO: 10420 - DNA, 20 bp, Artificial Sequence
  Synthetic oligonucleotide; AGG chr11 5241478 5241497 5241494 +
agacgttaagagaaagttca

SEQ ID NO: 10421 - DNA, 20 bp, Artificial Sequence
  Synthetic oligonucleotide; TGG chr11 5241483 5241502 5241499 +
ttaagagaaagttcaaggtt

SEQ ID NO: 10422 - DNA, 20 bp, Artificial Sequence
  Synthetic oligonucleotide; TGG chr11 5241494 5241513 5241510 +
ttcaaggtttggcccttgat

SEQ ID NO: 10423 - DNA, 20 bp, Artificial Sequence
  Synthetic oligonucleotide; TAG chr11 5241501 5241520 5241517 +
tttggcccttgattggtctc

SEQ ID NO: 10424 - DNA, 20 bp, Artificial Sequence
  Synthetic oligonucleotide; AGG chr11 5241502 5241521 5241518 +
ttggcccttgattggtctct

SEQ ID NO: 10425 - DNA, 20 bp, Artificial Sequence
  Synthetic oligonucleotide; AAG chr11 5241505 5241524 5241521 +
gcccttgattggtctctagg

SEQ ID NO: 10426 - DNA, 20 bp, Artificial Sequence
  Synthetic oligonucleotide; AAG chr11 5241556 5241575 5241572 +
aaaaatatgttgtttaaaat

SEQ ID NO: 10427 - DNA, 20 bp, Artificial Sequence
  Synthetic oligonucleotide; TAG chr11 5241559 5241578 5241575 +
aatatgttgtttaaaataag

SEQ ID NO: 10428 - DNA, 20 bp, Artificial Sequence
  Synthetic oligonucleotide; AAG chr11 5241562 5241581 5241578 +
atgttgtttaaaataagtag

SEQ ID NO: 10429 - DNA, 20 bp, Artificial Sequence
  Synthetic oligonucleotide; CAG chr11 5241572 5241591 5241588 +
aaataagtagaagtgaactg

SEQ ID NO: 10430 - DNA, 20 bp, Artificial Sequence
  Synthetic oligonucleotide; GAG chr11 5241584 5241603 5241600 +
gtgaactgcagtcaccaaat

SEQ ID NO: 10431 - DNA, 20 bp, Artificial Sequence
  Synthetic oligonucleotide; GAG chr11 5241596 5241615 5241612 +
caccaaatgagctatatcct

SEQ ID NO: 10432 - DNA, 20 bp, Artificial Sequence
  Synthetic oligonucleotide; TAG chr11 5241613 5241632 5241629 +
cctgagtttcatacaaataa

SEQ ID NO: 10433 - DNA, 20 bp, Artificial Sequence
  Synthetic oligonucleotide; CAG chr11 5241622 5241641 5241638 +
catacaaataatagcctata

SEQ ID NO: 10434 - DNA, 20 bp, Artificial Sequence
  Synthetic oligonucleotide; GAG chr11 5241637 5241656 5241653 +
ctatacagaacttctaattt

SEQ ID NO: 10435 - DNA, 20 bp, Artificial Sequence
  Synthetic oligonucleotide; AAG chr11 5241686 5241705 5241702 +
acaatcctcttacacctcca

SEQ ID NO: 10436 - DNA, 20 bp, Artificial Sequence
  Synthetic oligonucleotide; GAG chr11 5241688 5241707 5241704 +
aatcctcttacacctccaaa

SEQ ID NO: 10437 - DNA, 20 bp, Artificial Sequence
  Synthetic oligonucleotide; TAG chr11 5241734 5241753 5241750 +
gtaaaaacattgtcttattc

SEQ ID NO: 10438 - DNA, 20 bp, Artificial Sequence
  Synthetic oligonucleotide; GAG chr11 5241736 5241755 5241752 +
aaaaacattgtcttattcta

SEQ ID NO: 10439 - DNA, 20 bp, Artificial Sequence
  Synthetic oligonucleotide; TAG chr11 5241754 5241773 5241770 +
tagagacgatttccccttcc

SEQ ID NO: 10440 - DNA, 20 bp, Artificial Sequence
  Synthetic oligonucleotide; AGG chr11 5241755 5241774 5241771 +
agagacgatttccccttcct

SEQ ID NO: 10441 - DNA, 20 bp, Artificial Sequence
  Synthetic oligonucleotide; GAG chr11 5241757 5241776 5241773 +
agacgatttccccttcctag

SEQ ID NO: 10442 - DNA, 20 bp, Artificial Sequence
  Synthetic oligonucleotide; GAG chr11 5241785 5241804 5241801 +
accccactaaatccacccac

SEQ ID NO: 10443 - DNA, 20 bp, Artificial Sequence
  Synthetic oligonucleotide; CAG chr11 5241803 5241822 5241819 +
acgagttctctcttttcttg

SEQ ID NO: 10444 - DNA, 20 bp, Artificial Sequence
  Synthetic oligonucleotide; AGG chr11 5241804 5241823 5241820 +
cgagttctctcttttcttgc

SEQ ID NO: 10445 - DNA, 20 bp, Artificial Sequence
  Synthetic oligonucleotide; AAG chr11 5241812 5241831 5241828 +
ctcttttcttgcaggattgc

SEQ ID NO: 10446 - DNA, 20 bp, Artificial Sequence
  Synthetic oligonucleotide; AAG chr11 5241816 5241835 5241832 +
tttcttgcaggattgcaaga

SEQ ID NO: 10447 - DNA, 20 bp, Artificial Sequence
  Synthetic oligonucleotide; CAG chr11 5241867 5241886 5241883 +
tccaacattctcatttccat

SEQ ID NO: 10448 - DNA, 20 bp, Artificial Sequence
  Synthetic oligonucleotide; TAG chr11 5241873 5241892 5241889 +
attctcatttccatcagaaa

SEQ ID NO: 10449 - DNA, 20 bp, Artificial Sequence
  Synthetic oligonucleotide; TGG chr11 5241886 5241905 5241902 +
tcagaaatagtgcgtccttt

SEQ ID NO: 10450 - DNA, 20 bp, Artificial Sequence
  Synthetic oligonucleotide; CAG chr11 5241895 5241914 5241911 +
gtgcgtccttttggctgaat

SEQ ID NO: 10451 - DNA, 20 bp, Artificial Sequence
  Synthetic oligonucleotide; AGG chr11 5241896 5241915 5241912 +
tgcgtccttttggctgaatc

SEQ ID NO: 10452 - DNA, 20 bp, Artificial Sequence
  Synthetic oligonucleotide; GGG chr11 5241897 5241916 5241913 +
gcgtccttttggctgaatca

SEQ ID NO: 10453 - DNA, 20 bp, Artificial Sequence
  Synthetic oligonucleotide; AAG chr11 5241909 5241928 5241925 +
ctgaatcagggtaaaatata

SEQ ID NO: 10454 - DNA, 20 bp, Artificial Sequence
  Synthetic oligonucleotide; CAG chr11 5241913 5241932 5241929 +
atcagggtaaaatataaaga

SEQ ID NO: 10455 - DNA, 20 bp, Artificial Sequence
  Synthetic oligonucleotide; AAG chr11 5241919 5241938 5241935 +
gtaaaatataaagacagaaa

SEQ ID NO: 10456 - DNA, 20 bp, Artificial Sequence
  Synthetic oligonucleotide; GAG chr11 5241921 5241940 5241937 +
aaaatataaagacagaaaaa

SEQ ID NO: 10457 - DNA, 20 bp, Artificial Sequence
  Synthetic oligonucleotide; TAG chr11 5241939 5241958 5241955 +
aagagtacaatgatatttct

SEQ ID NO: 10458 - DNA, 20 bp, Artificial Sequence
  Synthetic oligonucleotide; GAG chr11 5241941 5241960 5241957 +
gagtacaatgatatttctta

SEQ ID NO: 10459 - DNA, 20 bp, Artificial Sequence
  Synthetic oligonucleotide; GAG chr11 5241943 5241962 5241959 +
gtacaatgatatttcttaga

SEQ ID NO: 10460 - DNA, 20 bp, Artificial Sequence
  Synthetic oligonucleotide; CAG chr11 5241974 5241993 5241990 +
tttattctatttttatcatg

SEQ ID NO: 10461 - DNA, 20 bp, Artificial Sequence
  Synthetic oligonucleotide; AGG chr11 5241975 5241994 5241991 +
ttattctatttttatcatgc

SEQ ID NO: 10462 - DNA, 20 bp, Artificial Sequence
  Synthetic oligonucleotide; CAG chr11 5241986 5242005 5242002 +
ttatcatgcaggaactgaat

SEQ ID NO: 10463 - DNA, 20 bp, Artificial Sequence
  Synthetic oligonucleotide; CAG chr11 5241989 5242008 5242005 +
tcatgcaggaactgaatcag

SEQ ID NO: 10464 - DNA, 20 bp, Artificial Sequence
  Synthetic oligonucleotide; AGG chr11 5241990 5242009 5242006 +
catgcaggaactgaatcagc

SEQ ID NO: 10465 - DNA, 20 bp, Artificial Sequence
  Synthetic oligonucleotide; CAG chr11 5241993 5242012 5242009 +
gcaggaactgaatcagcagg

SEQ ID NO: 10466 - DNA, 20 bp, Artificial Sequence
  Synthetic oligonucleotide; AGG chr11 5241994 5242013 5242010 +
caggaactgaatcagcaggc

SEQ ID NO: 10467 - DNA, 20 bp, Artificial Sequence
  Synthetic oligonucleotide; AAG chr11 5242029 5242048 5242045 +
tccccaacctcccccatcta

SEQ ID NO: 10468 - DNA, 20 bp, Artificial Sequence
  Synthetic oligonucleotide; AGG chr11 5242030 5242049 5242046 +
ccccaacctcccccatctaa

SEQ ID NO: 10469 - DNA, 20 bp, Artificial Sequence
  Synthetic oligonucleotide; GAG chr11 5242032 5242051 5242048 +
ccaacctcccccatctaaag

SEQ ID NO: 10470 - DNA, 20 bp, Artificial Sequence
  Synthetic oligonucleotide; GAG chr11 5242037 5242056 5242053 +
ctcccccatctaaaggagat

SEQ ID NO: 10471 - DNA, 20 bp, Artificial Sequence
  Synthetic oligonucleotide; TGG chr11 5242044 5242063 5242060 +
atctaaaggagatgagattt

SEQ ID NO: 10472 - DNA, 20 bp, Artificial Sequence
  Synthetic oligonucleotide; GGG chr11 5242045 5242064 5242061 +
tctaaaggagatgagatttt

SEQ ID NO: 10473 - DNA, 20 bp, Artificial Sequence
  Synthetic oligonucleotide; TAG chr11 5242051 5242070 5242067 +
ggagatgagattttgggaca

SEQ ID NO: 10474 - DNA, 20 bp, Artificial Sequence
  Synthetic oligonucleotide; AGG chr11 5242052 5242071 5242068 +
gagatgagattttgggacat

SEQ ID NO: 10475 - DNA, 20 bp, Artificial Sequence
  Synthetic oligonucleotide; TAG chr11 5242063 5242082 5242079 +
ttgggacataggtacaaaca

SEQ ID NO: 10476 - DNA, 20 bp, Artificial Sequence
  Synthetic oligonucleotide; TGG chr11 5242066 5242085 5242082 +
ggacataggtacaaacatag

SEQ ID NO: 10477 - DNA, 20 bp, Artificial Sequence
  Synthetic oligonucleotide; TAG chr11 5242073 5242092 5242089 +
ggtacaaacatagtggacca

SEQ ID NO: 10478 - DNA, 20 bp, Artificial Sequence
  Synthetic oligonucleotide; AGG chr11 5242074 5242093 5242090 +
gtacaaacatagtggaccat

SEQ ID NO: 10479 - DNA, 20 bp, Artificial Sequence
  Synthetic oligonucleotide; TAG chr11 5242085 5242104 5242101 +
gtggaccataggtacaaaca

SEQ ID NO: 10480 - DNA, 20 bp, Artificial Sequence
  Synthetic oligonucleotide; TGG chr11 5242088 5242107 5242104 +
gaccataggtacaaacatag

SEQ ID NO: 10481 - DNA, 20 bp, Artificial Sequence
  Synthetic oligonucleotide; CAG chr11 5242092 5242111 5242108 +
ataggtacaaacatagtgga

SEQ ID NO: 10482 - DNA, 20 bp, Artificial Sequence
  Synthetic oligonucleotide; AGG chr11 5242093 5242112 5242109 +
taggtacaaacatagtggac

SEQ ID NO: 10483 - DNA, 20 bp, Artificial Sequence
  Synthetic oligonucleotide; GGG chr11 5242094 5242113 5242110 +
aggtacaaacatagtggaca

SEQ ID NO: 10484 - DNA, 20 bp, Artificial Sequence
  Synthetic oligonucleotide; CAG chr11 5242101 5242120 5242117 +
aacatagtggacagggaact

SEQ ID NO: 10485 - DNA, 20 bp, Artificial Sequence
  Synthetic oligonucleotide; TGG chr11 5242104 5242123 5242120 +
atagtggacagggaactcag

SEQ ID NO: 10486 - DNA, 20 bp, Artificial Sequence
  Synthetic oligonucleotide; TGG chr11 5242112 5242131 5242128 +
cagggaactcagtggtcttg

SEQ ID NO: 10487 - DNA, 20 bp, Artificial Sequence
  Synthetic oligonucleotide; GGG chr11 5242113 5242132 5242129 +
agggaactcagtggtcttgt

SEQ ID NO: 10488 - DNA, 20 bp, Artificial Sequence
  Synthetic oligonucleotide; CAG chr11 5242119 5242138 5242135 +
ctcagtggtcttgtgggcta

SEQ ID NO: 10489 - DNA, 20 bp, Artificial Sequence
  Synthetic oligonucleotide; CAG chr11 5242131 5242150 5242147 +
gtgggctacagcattaacca

SEQ ID NO: 10490 - DNA, 20 bp, Artificial Sequence
  Synthetic oligonucleotide; TAG chr11 5242141 5242160 5242157 +
gcattaaccacagcatttgt

SEQ ID NO: 10491 - DNA, 20 bp, Artificial Sequence
  Synthetic oligonucleotide; AAG chr11 5242152 5242171 5242168 +
agcatttgttagttactgcc

SEQ ID NO: 10492 - DNA, 20 bp, Artificial Sequence
  Synthetic oligonucleotide; AAG chr11 5242155 5242174 5242171 +
atttgttagttactgccaag

SEQ ID NO: 10493 - DNA, 20 bp, Artificial Sequence
  Synthetic oligonucleotide; TAG chr11 5242168 5242187 5242184 +
tgccaagaagcctgtatctg

SEQ ID NO: 10494 - DNA, 20 bp, Artificial Sequence
  Synthetic oligonucleotide; AGG chr11 5242169 5242188 5242185 +
gccaagaagcctgtatctgt

SEQ ID NO: 10495 - DNA, 20 bp, Artificial Sequence
  Synthetic oligonucleotide; GGG chr11 5242170 5242189 5242186 +
ccaagaagcctgtatctgta

SEQ ID NO: 10496 - DNA, 20 bp, Artificial Sequence
  Synthetic oligonucleotide; AAG chr11 5242187 5242206 5242203 +
gtagggtaaaatcctcgctg

SEQ ID NO: 10497 - DNA, 20 bp, Artificial Sequence
  Synthetic oligonucleotide; TGG chr11 5242190 5242209 5242206 +
gggtaaaatcctcgctgaag

SEQ ID NO: 10498 - DNA, 20 bp, Artificial Sequence
  Synthetic oligonucleotide; GGG chr11 5242191 5242210 5242207 +
ggtaaaatcctcgctgaagt

SEQ ID NO: 10499 - DNA, 20 bp, Artificial Sequence
  Synthetic oligonucleotide; AAG chr11 5242223 5242242 5242239 +
caatcaatatcacgttgcct

SEQ ID NO: 10500 - DNA, 20 bp, Artificial Sequence
  Synthetic oligonucleotide; GAG chr11 5242225 5242244 5242241 +
atcaatatcacgttgcctaa

SEQ ID NO: 10501 - DNA, 20 bp, Artificial Sequence
  Synthetic oligonucleotide; TGG chr11 5242229 5242248 5242245 +
atatcacgttgcctaagagc

SEQ ID NO: 10502 - DNA, 20 bp, Artificial Sequence
  Synthetic oligonucleotide; GGG chr11 5242230 5242249 5242246 +
tatcacgttgcctaagagct

SEQ ID NO: 10503 - DNA, 20 bp, Artificial Sequence
  Synthetic oligonucleotide; GGG chr11 5242231 5242250 5242247 +
atcacgttgcctaagagctg

SEQ ID NO: 10504 - DNA, 20 bp, Artificial Sequence
  Synthetic oligonucleotide; GAG chr11 5242233 5242252 5242249 +
cacgttgcctaagagctggg

SEQ ID NO: 10505 - DNA, 20 bp, Artificial Sequence
  Synthetic oligonucleotide; AGG chr11 5242234 5242253 5242250 +
acgttgcctaagagctgggg

SEQ ID NO: 10506 - DNA, 20 bp, Artificial Sequence
  Synthetic oligonucleotide; GGG chr11 5242235 5242254 5242251 +
cgttgcctaagagctgggga

SEQ ID NO: 10507 - DNA, 20 bp, Artificial Sequence
  Synthetic oligonucleotide; GAG chr11 5242237 5242256 5242253 +
ttgcctaagagctggggagg

SEQ ID NO: 10508 - DNA, 20 bp, Artificial Sequence
  Synthetic oligonucleotide; AAG chr11 5242242 5242261 5242258 +
taagagctggggagggagtg

SEQ ID NO: 10509 - DNA, 20 bp, Artificial Sequence
  Synthetic oligonucleotide; AAG chr11 5242251 5242270 5242267 +
gggagggagtgaagataaaa

SEQ ID NO: 10510 - DNA, 20 bp, Artificial Sequence
  Synthetic oligonucleotide; TGG chr11 5242258 5242277 5242274 +
agtgaagataaaaaagaaaa

SEQ ID NO: 10511 - DNA, 20 bp, Artificial Sequence
  Synthetic oligonucleotide; TAG chr11 5242265 5242284 5242281 +
ataaaaaagaaaatggtaca

SEQ ID NO: 10512 - DNA, 20 bp, Artificial Sequence
  Synthetic oligonucleotide; TAG chr11 5242272 5242291 5242288 +
agaaaatggtacatagtgaa

SEQ ID NO: 10513 - DNA, 20 bp, Artificial Sequence
  Synthetic oligonucleotide; AAG chr11 5242275 5242294 5242291 +
aaatggtacatagtgaatag

SEQ ID NO: 10514 - DNA, 20 bp, Artificial Sequence
  Synthetic oligonucleotide; AGG chr11 5242276 5242295 5242292 +
aatggtacatagtgaataga

SEQ ID NO: 10515 - DNA, 20 bp, Artificial Sequence
  Synthetic oligonucleotide; AAG chr11 5242283 5242302 5242299 +
catagtgaatagaaggcctc

SEQ ID NO: 10516 - DNA, 20 bp, Artificial Sequence
  Synthetic oligonucleotide; TGG chr11 5242287 5242306 5242303 +
gtgaatagaaggcctcaagc

SEQ ID NO: 10517 - DNA, 20 bp, Artificial Sequence
  Synthetic oligonucleotide; CAG chr11 5242295 5242314 5242311 +
aaggcctcaagctggacttg

SEQ ID NO: 10518 - DNA, 20 bp, Artificial Sequence
  Synthetic oligonucleotide; TAG chr11 5242302 5242321 5242318 +
caagctggacttgcagtaaa

SEQ ID NO: 10519 - DNA, 20 bp, Artificial Sequence
  Synthetic oligonucleotide; CAG chr11 5242330 5242349 5242346 +
acacttacatcctttttcac

SEQ ID NO: 10520 - DNA, 20 bp, Artificial Sequence
  Synthetic oligonucleotide; GAG chr11 5242332 5242351 5242348 +
acttacatcctttttcacca

SEQ ID NO: 10521 - DNA, 20 bp, Artificial Sequence
  Synthetic oligonucleotide; GAG chr11 5242338 5242357 5242354 +
atcctttttcaccagagttt

SEQ ID NO: 10522 - DNA, 20 bp, Artificial Sequence
  Synthetic oligonucleotide; TGG chr11 5242356 5242375 5242372 +
ttgagcaactctcaccatta

SEQ ID NO: 10523 - DNA, 20 bp, Artificial Sequence
  Synthetic oligonucleotide; GGG chr11 5242357 5242376 5242373 +
tgagcaactctcaccattat

SEQ ID NO: 10524 - DNA, 20 bp, Artificial Sequence
  Synthetic oligonucleotide; TAG chr11 5242361 5242380 5242377 +
caactctcaccattatgggc

SEQ ID NO: 10525 - DNA, 20 bp, Artificial Sequence
  Synthetic oligonucleotide; CAG chr11 5242368 5242387 5242384 +
caccattatgggctagatat

SEQ ID NO: 10526 - DNA, 20 bp, Artificial Sequence
  Synthetic oligonucleotide; TGG chr11 5242383 5242402 5242399 +
gatatcagcttcaatatgac

SEQ ID NO: 10527 - DNA, 20 bp, Artificial Sequence
  Synthetic oligonucleotide; CAG chr11 5242386 5242405 5242402 +
atcagcttcaatatgactgg

SEQ ID NO: 10528 - DNA, 20 bp, Artificial Sequence
  Synthetic oligonucleotide; TAG chr11 5242477 5242496 5242493 +
tgattgtttcattttttttt

SEQ ID NO: 10529 - DNA, 20 bp, Artificial Sequence
  Synthetic oligonucleotide; GAG chr11 5242479 5242498 5242495 +
attgtttcatttttttttta

SEQ ID NO: 10530 - DNA, 20 bp, Artificial Sequence
  Synthetic oligonucleotide; AAG chr11 5242498 5242517 5242514 +
agagacttcgtccttttaaa

SEQ ID NO: 10531 - DNA, 20 bp, Artificial Sequence
  Synthetic oligonucleotide; TAG chr11 5242501 5242520 5242517 +
gacttcgtccttttaaaaag

SEQ ID NO: 10532 - DNA, 20 bp, Artificial Sequence
  Synthetic oligonucleotide; AGG chr11 5242502 5242521 5242518 +
acttcgtccttttaaaaagt

SEQ ID NO: 10533 - DNA, 20 bp, Artificial Sequence
  Synthetic oligonucleotide; TAG chr11 5242509 5242528 5242525 +
ccttttaaaaagtaggataa

SEQ ID NO: 10534 - DNA, 20 bp, Artificial Sequence
  Synthetic oligonucleotide; AAG chr11 5242518 5242537 5242534 +
aagtaggataatagtacttc

SEQ ID NO: 10535 - DNA, 20 bp, Artificial Sequence
  Synthetic oligonucleotide; AGG chr11 5242519 5242538 5242535 +
agtaggataatagtacttca

SEQ ID NO: 10536 - DNA, 20 bp, Artificial Sequence
  Synthetic oligonucleotide; CAG chr11 5242524 5242543 5242540 +
gataatagtacttcaaggaa

SEQ ID NO: 10537 - DNA, 20 bp, Artificial Sequence
  Synthetic oligonucleotide; TGG chr11 5242530 5242549 5242546 +
agtacttcaaggaacagtaa

SEQ ID NO: 10538 - DNA, 20 bp, Artificial Sequence
  Synthetic oligonucleotide; TAG chr11 5242534 5242553 5242550 +
cttcaaggaacagtaatgga

SEQ ID NO: 10539 - DNA, 20 bp, Artificial Sequence
  Synthetic oligonucleotide; AGG chr11 5242535 5242554 5242551 +
ttcaaggaacagtaatggat

SEQ ID NO: 10540 - DNA, 20 bp, Artificial Sequence
  Synthetic oligonucleotide; AAG chr11 5242540 5242559 5242556 +
ggaacagtaatggataggat

SEQ ID NO: 10541 - DNA, 20 bp, Artificial Sequence
  Synthetic oligonucleotide; CAG chr11 5242547 5242566 5242563 +
taatggataggataagtccc

SEQ ID NO: 10542 - DNA, 20 bp, Artificial Sequence
  Synthetic oligonucleotide; AAG chr11 5242604 5242623 5242620 +
tttcccaaacactcataaca

SEQ ID NO: 10543 - DNA, 20 bp, Artificial Sequence
  Synthetic oligonucleotide; AAG chr11 5242628 5242647 5242644 +
atcctgtaccatgcgtacaa

SEQ ID NO: 10544 - DNA, 20 bp, Artificial Sequence
  Synthetic oligonucleotide; CGG chr11 5242646 5242665 5242662 +
aaaagtataccatcatcatt

SEQ ID NO: 10545 - DNA, 20 bp, Artificial Sequence
  Synthetic oligonucleotide; GAG chr11 5242648 5242667 5242664 +
aagtataccatcatcattcg

SEQ ID NO: 10546 - DNA, 20 bp, Artificial Sequence
  Synthetic oligonucleotide; AGG chr11 5242649 5242668 5242665 +
agtataccatcatcattcgg

SEQ ID NO: 10547 - DNA, 20 bp, Artificial Sequence
  Synthetic oligonucleotide; GGG chr11 5242650 5242669 5242666 +
gtataccatcatcattcgga

SEQ ID NO: 10548 - DNA, 20 bp, Artificial Sequence
  Synthetic oligonucleotide; CAG chr11 5242671 5242690 5242687 +
ggaaacaatcctctttttaa

SEQ ID NO: 10549 - DNA, 20 bp, Artificial Sequence
  Synthetic oligonucleotide; CAG chr11 5242691 5242710 5242707 +
cagcttcccactactttgtt

SEQ ID NO: 10550 - DNA, 20 bp, Artificial Sequence
  Synthetic oligonucleotide; CAG chr11 5242713 5242732 5242729 +
gttgatctttttctaacctc

SEQ ID NO: 10551 - DNA, 20 bp, Artificial Sequence
  Synthetic oligonucleotide; AGG chr11 5242714 5242733 5242730 +
ttgatctttttctaacctcc

SEQ ID NO: 10552 - DNA, 20 bp, Artificial Sequence
  Synthetic oligonucleotide; CAG chr11 5242723 5242742 5242739 +
ttctaacctccaggactatg

SEQ ID NO: 10553 - DNA, 20 bp, Artificial Sequence
  Synthetic oligonucleotide; AAG chr11 5242728 5242747 5242744 +
acctccaggactatgcagaa

SEQ ID NO: 10554 - DNA, 20 bp, Artificial Sequence
  Synthetic oligonucleotide; TAG chr11 5242747 5242766 5242763 +
aaagtgactattaattttta

SEQ ID NO: 10555 - DNA, 20 bp, Artificial Sequence
  Synthetic oligonucleotide; AAG chr11 5242766 5242785 5242782 +
atagaaaatttcgctgacca

SEQ ID NO: 10556 - DNA, 20 bp, Artificial Sequence
  Synthetic oligonucleotide; AGG chr11 5242767 5242786 5242783 +
tagaaaatttcgctgaccaa

SEQ ID NO: 10557 - DNA, 20 bp, Artificial Sequence
  Synthetic oligonucleotide; AAG chr11 5242771 5242790 5242787 +
aaatttcgctgaccaaagga

SEQ ID NO: 10558 - DNA, 20 bp, Artificial Sequence
  Synthetic oligonucleotide; CAG chr11 5242821 5242840 5242837 +
ttccctcatccaaaaacact

SEQ ID NO: 10559 - DNA, 20 bp, Artificial Sequence
  Synthetic oligonucleotide; TGG chr11 5242832 5242851 5242848 +
aaaaacactcagtttgattt

SEQ ID NO: 10560 - DNA, 20 bp, Artificial Sequence
  Synthetic oligonucleotide; CAG chr11 5242836 5242855 5242852 +
acactcagtttgattttggc

SEQ ID NO: 10561 - DNA, 20 bp, Artificial Sequence
  Synthetic oligonucleotide; AAG chr11 5242849 5242868 5242865 +
ttttggccagaattttttat

SEQ ID NO: 10562 - DNA, 20 bp, Artificial Sequence
  Synthetic oligonucleotide; CAG chr11 5242862 5242881 5242878 +
tttttataagatgtgttttt

SEQ ID NO: 10563 - DNA, 20 bp, Artificial Sequence
  Synthetic oligonucleotide; GAG chr11 5242864 5242883 5242880 +
tttataagatgtgtttttca

SEQ ID NO: 10564 - DNA, 20 bp, Artificial Sequence
  Synthetic oligonucleotide; TGG chr11 5242875 5242894 5242891 +
tgtttttcagagctatcaaa

SEQ ID NO: 10565 - DNA, 20 bp, Artificial Sequence
  Synthetic oligonucleotide; AAG chr11 5242879 5242898 5242895 +
tttcagagctatcaaatggt

SEQ ID NO: 10566 - DNA, 20 bp, Artificial Sequence
  Synthetic oligonucleotide; TGG chr11 5242882 5242901 5242898 +
cagagctatcaaatggtaag

SEQ ID NO: 10567 - DNA, 20 bp, Artificial Sequence
  Synthetic oligonucleotide; TAG chr11 5242899 5242918 5242915 +
aagtggccttccattattca

SEQ ID NO: 10568 - DNA, 20 bp, Artificial Sequence
  Synthetic oligonucleotide; TAG chr11 5242921 5242940 5242937 +
gtccttgctctaccaaattt

SEQ ID NO: 10569 - DNA, 20 bp, Artificial Sequence
  Synthetic oligonucleotide; CAG chr11 5242936 5242955 5242952 +
aattttagttatgttattta

SEQ ID NO: 10570 - DNA, 20 bp, Artificial Sequence
  Synthetic oligonucleotide; TAG chr11 5242982 5243001 5242998 +
tgctgaaatatcatatccca

SEQ ID NO: 10571 - DNA, 20 bp, Artificial Sequence
  Synthetic oligonucleotide; AAG chr11 5242999 5243018 5243015 +
ccatagctgactcataacac

SEQ ID NO: 10572 - DNA, 20 bp, Artificial Sequence
  Synthetic oligonucleotide; GAG chr11 5243001 5243020 5243017 +
atagctgactcataacacaa

SEQ ID NO: 10573 - DNA, 20 bp, Artificial Sequence
  Synthetic oligonucleotide; AAG chr11 5243005 5243024 5243021 +
ctgactcataacacaagaga

SEQ ID NO: 10574 - DNA, 20 bp, Artificial Sequence
  Synthetic oligonucleotide; AAG chr11 5243024 5243043 5243040 +
aaagccacctctgctttcaa

SEQ ID NO: 10575 - DNA, 20 bp, Artificial Sequence
  Synthetic oligonucleotide; TAG chr11 5243033 5243052 5243049 +
tctgctttcaaaagtaccca

SEQ ID NO: 10576 - DNA, 20 bp, Artificial Sequence
  Synthetic oligonucleotide; AAG chr11 5243047 5243066 5243063 +
tacccatagtgcaaatatct

SEQ ID NO: 10577 - DNA, 20 bp, Artificial Sequence
  Synthetic oligonucleotide; AGG chr11 5243048 5243067 5243064 +
acccatagtgcaaatatcta

SEQ ID NO: 10578 - DNA, 20 bp, Artificial Sequence
  Synthetic oligonucleotide; GGG chr11 5243049 5243068 5243065 +
cccatagtgcaaatatctaa

SEQ ID NO: 10579 - DNA, 20 bp, Artificial Sequence
  Synthetic oligonucleotide; AAG chr11 5243054 5243073 5243070 +
agtgcaaatatctaagggta

SEQ ID NO: 10580 - DNA, 20 bp, Artificial Sequence
  Synthetic oligonucleotide; AAG chr11 5243057 5243076 5243073 +
gcaaatatctaagggtaaag

SEQ ID NO: 10581 - DNA, 20 bp, Artificial Sequence
  Synthetic oligonucleotide; AAG chr11 5243061 5243080 5243077 +
atatctaagggtaaagaaga

SEQ ID NO: 10582 - DNA, 20 bp, Artificial Sequence
  Synthetic oligonucleotide; GAG chr11 5243067 5243086 5243083 +
aagggtaaagaagaaagcgt

SEQ ID NO: 10583 - DNA, 20 bp, Artificial Sequence
  Synthetic oligonucleotide; CAG chr11 5243086 5243105 5243102 +
tgagtgtacttactactcac

SEQ ID NO: 10584 - DNA, 20 bp, Artificial Sequence
  Synthetic oligonucleotide; AGG chr11 5243087 5243106 5243103 +
gagtgtacttactactcacc

SEQ ID NO: 10585 - DNA, 20 bp, Artificial Sequence
  Synthetic oligonucleotide; AAG chr11 5243090 5243109 5243106 +
tgtacttactactcaccagg

SEQ ID NO: 10586 - DNA, 20 bp, Artificial Sequence
  Synthetic oligonucleotide; CAG chr11 5243097 5243116 5243113 +
actactcaccaggaagttct

SEQ ID NO: 10587 - DNA, 20 bp, Artificial Sequence
  Synthetic oligonucleotide; AGG chr11 5243098 5243117 5243114 +
ctactcaccaggaagttctc

SEQ ID NO: 10588 - DNA, 20 bp, Artificial Sequence
  Synthetic oligonucleotide; GGG chr11 5243099 5243118 5243115 +
tactcaccaggaagttctca

SEQ ID NO: 10589 - DNA, 20 bp, Artificial Sequence
  Synthetic oligonucleotide; CAG chr11 5243110 5243129 5243126 +
aagttctcagggtccacgtg

SEQ ID NO: 10590 - DNA, 20 bp, Artificial Sequence
  Synthetic oligonucleotide; CAG chr11 5243120 5243139 5243136 +
ggtccacgtgcagcttgtta

SEQ ID NO: 10591 - DNA, 20 bp, Artificial Sequence
  Synthetic oligonucleotide; CAG chr11 5243125 5243144 5243141 +
acgtgcagcttgttacagtg

SEQ ID NO: 10592 - DNA, 20 bp, Artificial Sequence
  Synthetic oligonucleotide; AGG chr11 5243126 5243145 5243142 +
cgtgcagcttgttacagtgc

SEQ ID NO: 10593 - DNA, 20 bp, Artificial Sequence
  Synthetic oligonucleotide; CAG chr11 5243134 5243153 5243150 +
ttgttacagtgcaggtcact

SEQ ID NO: 10594 - DNA, 20 bp, Artificial Sequence
  Synthetic oligonucleotide; TAG chr11 5243139 5243158 5243155 +
acagtgcaggtcactcagtg

SEQ ID NO: 10595 - DNA, 20 bp, Artificial Sequence
  Synthetic oligonucleotide; AAG chr11 5243144 5243163 5243160 +
gcaggtcactcagtgtagca

SEQ ID NO: 10596 - DNA, 20 bp, Artificial Sequence
  Synthetic oligonucleotide; AGG chr11 5243145 5243164 5243161 +
caggtcactcagtgtagcaa

SEQ ID NO: 10597 - DNA, 20 bp, Artificial Sequence
  Synthetic oligonucleotide; GAG chr11 5243155 5243174 5243171 +
agtgtagcaaaggtgccttt

SEQ ID NO: 10598 - DNA, 20 bp, Artificial Sequence
  Synthetic oligonucleotide; AGG chr11 5243156 5243175 5243172 +
gtgtagcaaaggtgcctttg

SEQ ID NO: 10599 - DNA, 20 bp, Artificial Sequence
  Synthetic oligonucleotide; GAG chr11 5243167 5243186 5243183 +
gtgcctttgaggtcatccgt

SEQ ID NO: 10600 - DNA, 20 bp, Artificial Sequence
  Synthetic oligonucleotide; CAG chr11 5243175 5243194 5243191 +
gaggtcatccgtgagcataa

SEQ ID NO: 10601 - DNA, 20 bp, Artificial Sequence
  Synthetic oligonucleotide; AAG chr11 5243186 5243205 5243202 +
tgagcataacagcttttccg

SEQ ID NO: 10602 - DNA, 20 bp, Artificial Sequence
  Synthetic oligonucleotide; AGG chr11 5243187 5243206 5243203 +
gagcataacagcttttccga

SEQ ID NO: 10603 - DNA, 20 bp, Artificial Sequence
  Synthetic oligonucleotide; GAG chr11 5243189 5243208 5243205 +
gcataacagcttttccgaag

SEQ ID NO: 10604 - DNA, 20 bp, Artificial Sequence
  Synthetic oligonucleotide; CAG chr11 5243194 5243213 5243210 +
acagcttttccgaaggagat

SEQ ID NO: 10605 - DNA, 20 bp, Artificial Sequence
  Synthetic oligonucleotide; TGG chr11 5243223 5243242 5243239 +
cttgccatgtgccttgactt

SEQ ID NO: 10606 - DNA, 20 bp, Artificial Sequence
  Synthetic oligonucleotide; GGG chr11 5243224 5243243 5243240 +
ttgccatgtgccttgacttt

SEQ ID NO: 10607 - DNA, 20 bp, Artificial Sequence
  Synthetic oligonucleotide; GGG chr11 5243225 5243244 5243241 +
tgccatgtgccttgactttg

SEQ ID NO: 10608 - DNA, 20 bp, Artificial Sequence
  Synthetic oligonucleotide; CAG chr11 5243243 5243262 5243259 +
tggggttgcccattattgca

SEQ ID NO: 10609 - DNA, 20 bp, Artificial Sequence
  Synthetic oligonucleotide; CAG chr11 5243247 5243266 5243263 +
gttgcccattattgcacagt

SEQ ID NO: 10610 - DNA, 20 bp, Artificial Sequence
  Synthetic oligonucleotide; GAG chr11 5243249 5243268 5243265 +
tgcccattattgcacagtca

SEQ ID NO: 10611 - DNA, 20 bp, Artificial Sequence
  Synthetic oligonucleotide; CAG chr11 5243254 5243273 5243270 +
attattgcacagtcagagcc

SEQ ID NO: 10612 - DNA, 20 bp, Artificial Sequence
  Synthetic oligonucleotide; AAG chr11 5243273 5243292 5243289 +
ccagatatccaaaactttca

SEQ ID NO: 10613 - DNA, 20 bp, Artificial Sequence
  Synthetic oligonucleotide; TAG chr11 5243282 5243301 5243298 +
caaaactttcaaagtacctc

SEQ ID NO: 10614 - DNA, 20 bp, Artificial Sequence
  Synthetic oligonucleotide; AGG chr11 5243283 5243302 5243299 +
aaaactttcaaagtacctct

SEQ ID NO: 10615 - DNA, 20 bp, Artificial Sequence
  Synthetic oligonucleotide; TGG chr11 5243290 5243309 5243306 +
tcaaagtacctctaggtcca

SEQ ID NO: 10616 - DNA, 20 bp, Artificial Sequence
  Synthetic oligonucleotide; GGG chr11 5243291 5243310 5243307 +
caaagtacctctaggtccat

SEQ ID NO: 10617 - DNA, 20 bp, Artificial Sequence
  Synthetic oligonucleotide; TAG chr11 5243294 5243313 5243310 +
agtacctctaggtccatggg

SEQ ID NO: 10618 - DNA, 20 bp, Artificial Sequence
  Synthetic oligonucleotide; CAG chr11 5243302 5243321 5243318 +
taggtccatgggtagacaac

SEQ ID NO: 10619 - DNA, 20 bp, Artificial Sequence
  Synthetic oligonucleotide; AGG chr11 5243303 5243322 5243319 +
aggtccatgggtagacaacc

SEQ ID NO: 10620 - DNA, 20 bp, Artificial Sequence
  Synthetic oligonucleotide; GAG chr11 5243305 5243324 5243321 +
gtccatgggtagacaaccag

SEQ ID NO: 10621 - DNA, 20 bp, Artificial Sequence
  Synthetic oligonucleotide; TGG chr11 5243312 5243331 5243328 +
ggtagacaaccaggagactg

SEQ ID NO: 10622 - DNA, 20 bp, Artificial Sequence
  Synthetic oligonucleotide; GGG chr11 5243313 5243332 5243329 +
gtagacaaccaggagactgt

SEQ ID NO: 10623 - DNA, 20 bp, Artificial Sequence
  Synthetic oligonucleotide; TAG chr11 5243317 5243336 5243333 +
acaaccaggagactgtggga

SEQ ID NO: 10624 - DNA, 20 bp, Artificial Sequence
  Synthetic oligonucleotide; CAG chr11 5243329 5243348 5243345 +
ctgtgggatagtcataatca

SEQ ID NO: 10625 - DNA, 20 bp, Artificial Sequence
  Synthetic oligonucleotide; GAG chr11 5243331 5243350 5243347 +
gtgggatagtcataatcaca

SEQ ID NO: 10626 - DNA, 20 bp, Artificial Sequence
  Synthetic oligonucleotide; CAG chr11 5243334 5243353 5243350 +
ggatagtcataatcacagag

SEQ ID NO: 10627 - DNA, 20 bp, Artificial Sequence
  Synthetic oligonucleotide; AGG chr11 5243335 5243354 5243351 +
gatagtcataatcacagagc

SEQ ID NO: 10628 - DNA, 20 bp, Artificial Sequence
  Synthetic oligonucleotide; AAG chr11 5243342 5243361 5243358 +
ataatcacagagcaggtgca

SEQ ID NO: 10629 - DNA, 20 bp, Artificial Sequence
  Synthetic oligonucleotide; CAG chr11 5243346 5243365 5243362 +
tcacagagcaggtgcaaagt

SEQ ID NO: 10630 - DNA, 20 bp, Artificial Sequence
  Synthetic oligonucleotide; AAG chr11 5243356 5243375 5243372 +
ggtgcaaagtcagactatgt

SEQ ID NO: 10631 - DNA, 20 bp, Artificial Sequence
  Synthetic oligonucleotide; CGG chr11 5243363 5243382 5243379 +
agtcagactatgtaagacaa

SEQ ID NO: 10632 - DNA, 20 bp, Artificial Sequence
  Synthetic oligonucleotide; GGG chr11 5243364 5243383 5243380 +
gtcagactatgtaagacaac

SEQ ID NO: 10633 - DNA, 20 bp, Artificial Sequence
  Synthetic oligonucleotide; CAG chr11 5243380 5243399 5243396 +
caacgggctaatccctcttt

SEQ ID NO: 10634 - DNA, 20 bp, Artificial Sequence
  Synthetic oligonucleotide; CGG chr11 5243413 5243432 5243429 +
tgcctttctgcaccttgtcc

SEQ ID NO: 10635 - DNA, 20 bp, Artificial Sequence
  Synthetic oligonucleotide; CAG chr11 5243420 5243439 5243436 +
ctgcaccttgtcccggcttc

SEQ ID NO: 10636 - DNA, 20 bp, Artificial Sequence
  Synthetic oligonucleotide; CAG chr11 5243435 5243454 5243451 +
gcttccagtacctacctgcc

SEQ ID NO: 10637 - DNA, 20 bp, Artificial Sequence
  Synthetic oligonucleotide; CAG chr11 5243449 5243468 5243465 +
cctgcccagaatctcacctc

SEQ ID NO: 10638 - DNA, 20 bp, Artificial Sequence
  Synthetic oligonucleotide; CAG chr11 5243476 5243495 5243492 +
ctcaccttaaccttgcttca

SEQ ID NO: 10639 - DNA, 20 bp, Artificial Sequence
  Synthetic oligonucleotide; AGG chr11 5243477 5243496 5243493 +
tcaccttaaccttgcttcac

SEQ ID NO: 10640 - DNA, 20 bp, Artificial Sequence
  Synthetic oligonucleotide; TGG chr11 5243481 5243500 5243497 +
cttaaccttgcttcacaggc

SEQ ID NO: 10641 - DNA, 20 bp, Artificial Sequence
  Synthetic oligonucleotide; TGG chr11 5243484 5243503 5243500 +
aaccttgcttcacaggctgg

SEQ ID NO: 10642 - DNA, 20 bp, Artificial Sequence
  Synthetic oligonucleotide; CAG chr11 5243487 5243506 5243503 +
cttgcttcacaggctggtgg

SEQ ID NO: 10643 - DNA, 20 bp, Artificial Sequence
  Synthetic oligonucleotide; CAG chr11 5243490 5243509 5243506 +
gcttcacaggctggtggcag

SEQ ID NO: 10644 - DNA, 20 bp, Artificial Sequence
  Synthetic oligonucleotide; CAG chr11 5243502 5243521 5243518 +
ggtggcagcagccttcttgt

SEQ ID NO: 10645 - DNA, 20 bp, Artificial Sequence
  Synthetic oligonucleotide; CAG chr11 5243505 5243524 5243521 +
ggcagcagccttcttgtcag

SEQ ID NO: 10646 - DNA, 20 bp, Artificial Sequence
  Synthetic oligonucleotide; CAG chr11 5243520 5243539 5243536 +
gtcagcagtgaaatgcacta

SEQ ID NO: 10647 - DNA, 20 bp, Artificial Sequence
  Synthetic oligonucleotide; CAG chr11 5243526 5243545 5243542 +
agtgaaatgcactacagtgt

SEQ ID NO: 10648 - DNA, 20 bp, Artificial Sequence
  Synthetic oligonucleotide; TGG chr11 5243532 5243551 5243548 +
atgcactacagtgtcagatc

SEQ ID NO: 10649 - DNA, 20 bp, Artificial Sequence
  Synthetic oligonucleotide; GGG chr11 5243533 5243552 5243549 +
tgcactacagtgtcagatct

SEQ ID NO: 10650 - DNA, 20 bp, Artificial Sequence
  Synthetic oligonucleotide; GAG chr11 5243535 5243554 5243551 +
cactacagtgtcagatctgg

SEQ ID NO: 10651 - DNA, 20 bp, Artificial Sequence
  Synthetic oligonucleotide; TGG chr11 5243543 5243562 5243559 +
tgtcagatctgggagtttcc

SEQ ID NO: 10652 - DNA, 20 bp, Artificial Sequence
  Synthetic oligonucleotide; CAG chr11 5243552 5243571 5243568 +
tgggagtttcctggtgatca

SEQ ID NO: 10653 - DNA, 20 bp, Artificial Sequence
  Synthetic oligonucleotide; GAG chr11 5243557 5243576 5243573 +
gtttcctggtgatcacagat

SEQ ID NO: 10654 - DNA, 20 bp, Artificial Sequence
  Synthetic oligonucleotide; CAG chr11 5243561 5243580 5243577 +
cctggtgatcacagatgagc

SEQ ID NO: 10655 - DNA, 20 bp, Artificial Sequence
  Synthetic oligonucleotide; AAG chr11 5243564 5243583 5243580 +
ggtgatcacagatgagccag

SEQ ID NO: 10656 - DNA, 20 bp, Artificial Sequence
  Synthetic oligonucleotide; TGG chr11 5243592 5243611 5243608 +
ctgcattgctgcttcatgtg

SEQ ID NO: 10657 - DNA, 20 bp, Artificial Sequence
  Synthetic oligonucleotide; TGG chr11 5243613 5243632 5243629 +
ggctttttacttctcctctc

SEQ ID NO: 10658 - DNA, 20 bp, Artificial Sequence
  Synthetic oligonucleotide; CAG chr11 5243620 5243639 5243636 +
tacttctcctctctggcccc

SEQ ID NO: 10659 - DNA, 20 bp, Artificial Sequence
  Synthetic oligonucleotide; CAG chr11 5243637 5243656 5243653 +
ccccagccctttgcctctcc

SEQ ID NO: 10660 - DNA, 20 bp, Artificial Sequence
  Synthetic oligonucleotide; CAG chr11 5243658 5243677 5243674 +
agtgaaatgaatctattgac

SEQ ID NO: 10661 - DNA, 20 bp, Artificial Sequence
  Synthetic oligonucleotide; CAG chr11 5243675 5243694 5243691 +
gaccagccctttgcctccct

SEQ ID NO: 10662 - DNA, 20 bp, Artificial Sequence
  Synthetic oligonucleotide; TGG chr11 5243692 5243711 5243708 +
cctcagtaaaatgaatctat

SEQ ID NO: 10663 - DNA, 20 bp, Artificial Sequence
  Synthetic oligonucleotide; AAG chr11 5243697 5243716 5243713 +
gtaaaatgaatctattggtc

SEQ ID NO: 10664 - DNA, 20 bp, Artificial Sequence
  Synthetic oligonucleotide; AGG chr11 5243698 5243717 5243714 +
taaaatgaatctattggtca

SEQ ID NO: 10665 - DNA, 20 bp, Artificial Sequence
  Synthetic oligonucleotide; GGG chr11 5243699 5243718 5243715 +
aaaatgaatctattggtcaa

SEQ ID NO: 10666 - DNA, 20 bp, Artificial Sequence
  Synthetic oligonucleotide; TGG chr11 5243702 5243721 5243718 +
atgaatctattggtcaaggg

SEQ ID NO: 10667 - DNA, 20 bp, Artificial Sequence
  Synthetic oligonucleotide; GGG chr11 5243703 5243722 5243719 +
tgaatctattggtcaagggt

SEQ ID NO: 10668 - DNA, 20 bp, Artificial Sequence
  Synthetic oligonucleotide; CAG chr11 5243715 5243734 5243731 +
tcaagggtgggttgtgactc

SEQ ID NO: 10669 - DNA, 20 bp, Artificial Sequence
  Synthetic oligonucleotide; AGG chr11 5243716 5243735 5243732 +
caagggtgggttgtgactcc

SEQ ID NO: 10670 - DNA, 20 bp, Artificial Sequence
  Synthetic oligonucleotide; GGG chr11 5243717 5243736 5243733 +
aagggtgggttgtgactcca

SEQ ID NO: 10671 - DNA, 20 bp, Artificial Sequence
  Synthetic oligonucleotide; GGG chr11 5243718 5243737 5243734 +
agggtgggttgtgactccag

SEQ ID NO: 10672 - DNA, 20 bp, Artificial Sequence
  Synthetic oligonucleotide; TGG chr11 5243721 5243740 5243737 +
gtgggttgtgactccagggg

SEQ ID NO: 10673 - DNA, 20 bp, Artificial Sequence
  Synthetic oligonucleotide; GGG chr11 5243722 5243741 5243738 +
tgggttgtgactccaggggt

SEQ ID NO: 10674 - DNA, 20 bp, Artificial Sequence
  Synthetic oligonucleotide; GGG chr11 5243723 5243742 5243739 +
gggttgtgactccaggggtg

SEQ ID NO: 10675 - DNA, 20 bp, Artificial Sequence
  Synthetic oligonucleotide; TGG chr11 5243728 5243747 5243744 +
gtgactccaggggtggggtt

SEQ ID NO: 10676 - DNA, 20 bp, Artificial Sequence
  Synthetic oligonucleotide; GGG chr11 5243729 5243748 5243745 +
tgactccaggggtggggttt

SEQ ID NO: 10677 - DNA, 20 bp, Artificial Sequence
  Synthetic oligonucleotide; AAG chr11 5243733 5243752 5243749 +
tccaggggtggggtttgggc

SEQ ID NO: 10678 - DNA, 20 bp, Artificial Sequence
  Synthetic oligonucleotide; AGG chr11 5243734 5243753 5243750 +
ccaggggtggggtttgggca

SEQ ID NO: 10679 - DNA, 20 bp, Artificial Sequence
  Synthetic oligonucleotide; AAG chr11 5243737 5243756 5243753 +
ggggtggggtttgggcaagg

SEQ ID NO: 10680 - DNA, 20 bp, Artificial Sequence
  Synthetic oligonucleotide; AAG chr11 5243746 5243765 5243762 +
tttgggcaaggaagttttgc

SEQ ID NO: 10681 - DNA, 20 bp, Artificial Sequence
  Synthetic oligonucleotide; TGG chr11 5243750 5243769 5243766 +
ggcaaggaagttttgcaaga

SEQ ID NO: 10682 - DNA, 20 bp, Artificial Sequence
  Synthetic oligonucleotide; GAG chr11 5243759 5243778 5243775 +
gttttgcaagatggacattc

SEQ ID NO: 10683 - DNA, 20 bp, Artificial Sequence
  Synthetic oligonucleotide; TAG chr11 5243769 5243788 5243785 +
atggacattcgagtttctga

SEQ ID NO: 10684 - DNA, 20 bp, Artificial Sequence
  Synthetic oligonucleotide; CAG chr11 5243776 5243795 5243792 +
ttcgagtttctgatagaatc

SEQ ID NO: 10685 - DNA, 20 bp, Artificial Sequence
  Synthetic oligonucleotide; AGG chr11 5243777 5243796 5243793 +
tcgagtttctgatagaatcc

SEQ ID NO: 10686 - DNA, 20 bp, Artificial Sequence
  Synthetic oligonucleotide; TGG chr11 5243780 5243799 5243796 +
agtttctgatagaatccagg

SEQ ID NO: 10687 - DNA, 20 bp, Artificial Sequence
  Synthetic oligonucleotide; CAG chr11 5243789 5243808 5243805 +
tagaatccaggtggccttct

SEQ ID NO: 10688 - DNA, 20 bp, Artificial Sequence
  Synthetic oligonucleotide; AGG chr11 5243790 5243809 5243806 +
agaatccaggtggccttctc

SEQ ID NO: 10689 - DNA, 20 bp, Artificial Sequence
  Synthetic oligonucleotide; GGG chr11 5243791 5243810 5243807 +
gaatccaggtggccttctca

SEQ ID NO: 10690 - DNA, 20 bp, Artificial Sequence
  Synthetic oligonucleotide; GGG chr11 5243792 5243811 5243808 +
aatccaggtggccttctcag

SEQ ID NO: 10691 - DNA, 20 bp, Artificial Sequence
  Synthetic oligonucleotide; CAG chr11 5243807 5243826 5243823 +
ctcaggggaactttgctgtt

SEQ ID NO: 10692 - DNA, 20 bp, Artificial Sequence
  Synthetic oligonucleotide; AGG chr11 5243808 5243827 5243824 +
tcaggggaactttgctgttc

SEQ ID NO: 10693 - DNA, 20 bp, Artificial Sequence
  Synthetic oligonucleotide; CAG chr11 5243867 5243886 5243883 +
cctacactacccccaccatc

SEQ ID NO: 10694 - DNA, 20 bp, Artificial Sequence
  Synthetic oligonucleotide; CAG chr11 5243874 5243893 5243890 +
tacccccaccatccagtgtg

SEQ ID NO: 10695 - DNA, 20 bp, Artificial Sequence
  Synthetic oligonucleotide; AAG chr11 5243887 5243906 5243903 +
cagtgtgcagtttatttctc

SEQ ID NO: 10696 - DNA, 20 bp, Artificial Sequence
  Synthetic oligonucleotide; AGG chr11 5243888 5243907 5243904 +
agtgtgcagtttatttctca

SEQ ID NO: 10697 - DNA, 20 bp, Artificial Sequence
  Synthetic oligonucleotide; CAG chr11 5243898 5243917 5243914 +
ttatttctcaaggacttcgc

SEQ ID NO: 10698 - DNA, 20 bp, Artificial Sequence
  Synthetic oligonucleotide; CAG chr11 5243901 5243920 5243917 +
tttctcaaggacttcgccag

SEQ ID NO: 10699 - DNA, 20 bp, Artificial Sequence
  Synthetic oligonucleotide; TAG chr11 5243930 5243949 5243946 +
ataacctgaatgctgacaaa

SEQ ID NO: 10700 - DNA, 20 bp, Artificial Sequence
  Synthetic oligonucleotide; AGG chr11 5243931 5243950 5243947 +
taacctgaatgctgacaaat

SEQ ID NO: 10701 - DNA, 20 bp, Artificial Sequence
  Synthetic oligonucleotide; AAG chr11 5243937 5243956 5243953 +
gaatgctgacaaataggaat

SEQ ID NO: 10702 - DNA, 20 bp, Artificial Sequence
  Synthetic oligonucleotide; AAG chr11 5243951 5243970 5243967 +
aggaataagttacaactgaa

SEQ ID NO: 10703 - DNA, 20 bp, Artificial Sequence
  Synthetic oligonucleotide; AGG chr11 5243952 5243971 5243968 +
ggaataagttacaactgaaa

SEQ ID NO: 10704 - DNA, 20 bp, Artificial Sequence
  Synthetic oligonucleotide; AAG chr11 5243957 5243976 5243973 +
aagttacaactgaaaaggat

SEQ ID NO: 10705 - DNA, 20 bp, Artificial Sequence
  Synthetic oligonucleotide; TAG chr11 5243974 5243993 5243990 +
gataagaattacgaatatct

SEQ ID NO: 10706 - DNA, 20 bp, Artificial Sequence
  Synthetic oligonucleotide; TGG chr11 5243988 5244007 5244004 +
atatcttagccatcaattcc

SEQ ID NO: 10707 - DNA, 20 bp, Artificial Sequence
  Synthetic oligonucleotide; CAG chr11 5243993 5244012 5244009 +
ttagccatcaattcctggat

SEQ ID NO: 10708 - DNA, 20 bp, Artificial Sequence
  Synthetic oligonucleotide; AGG chr11 5243994 5244013 5244010 +
tagccatcaattcctggatc

SEQ ID NO: 10709 - DNA, 20 bp, Artificial Sequence
  Synthetic oligonucleotide; GAG chr11 5243996 5244015 5244012 +
gccatcaattcctggatcag

SEQ ID NO: 10710 - DNA, 20 bp, Artificial Sequence
  Synthetic oligonucleotide; CAG chr11 5244037 5244056 5244053 +
gtgttatcctgttattcatc

SEQ ID NO: 10711 - DNA, 20 bp, Artificial Sequence
  Synthetic oligonucleotide; AGG chr11 5244038 5244057 5244054 +
tgttatcctgttattcatcc

SEQ ID NO: 10712 - DNA, 20 bp, Artificial Sequence
  Synthetic oligonucleotide; TGG chr11 5244048 5244067 5244064 +
ttattcatccaggctttatg

SEQ ID NO: 10713 - DNA, 20 bp, Artificial Sequence
  Synthetic oligonucleotide; AAG chr11 5244051 5244070 5244067 +
ttcatccaggctttatgtgg

SEQ ID NO: 10714 - DNA, 20 bp, Artificial Sequence
  Synthetic oligonucleotide; AAG chr11 5244054 5244073 5244070 +
atccaggctttatgtggaag

SEQ ID NO: 10715 - DNA, 20 bp, Artificial Sequence
  Synthetic oligonucleotide; CAG chr11 5244060 5244079 5244076 +
gctttatgtggaagaagcca

SEQ ID NO: 10716 - DNA, 20 bp, Artificial Sequence
  Synthetic oligonucleotide; TGG chr11 5244070 5244089 5244086 +
gaagaagccacagcctttct

SEQ ID NO: 10717 - DNA, 20 bp, Artificial Sequence
  Synthetic oligonucleotide; GAG chr11 5244087 5244106 5244103 +
tcttggttttcaattctctt

SEQ ID NO: 10718 - DNA, 20 bp, Artificial Sequence
  Synthetic oligonucleotide; CAG chr11 5244114 5244133 5244130 +
cattgaatacacaatttcat

SEQ ID NO: 10719 - DNA, 20 bp, Artificial Sequence
  Synthetic oligonucleotide; GAG chr11 5244165 5244184 5244181 +
tttttttttttttttttttt

SEQ ID NO: 10720 - DNA, 20 bp, Artificial Sequence
  Synthetic oligonucleotide; TGG chr11 5244169 5244188 5244185 +
ttttttttttttttttgaga

SEQ ID NO: 10721 - DNA, 20 bp, Artificial Sequence
  Synthetic oligonucleotide; GAG chr11 5244171 5244190 5244187 +
ttttttttttttttgagatg

SEQ ID NO: 10722 - DNA, 20 bp, Artificial Sequence
  Synthetic oligonucleotide; CAG chr11 5244189 5244208 5244205 +
tggagtctcgctttgtcacc

SEQ ID NO: 10723 - DNA, 20 bp, Artificial Sequence
  Synthetic oligonucleotide; AGG chr11 5244190 5244209 5244206 +
ggagtctcgctttgtcaccc

SEQ ID NO: 10724 - DNA, 20 bp, Artificial Sequence
  Synthetic oligonucleotide; TGG chr11 5244194 5244213 5244210 +
tctcgctttgtcacccaggc

SEQ ID NO: 10725 - DNA, 20 bp, Artificial Sequence
  Synthetic oligonucleotide; GAG chr11 5244196 5244215 5244212 +
tcgctttgtcacccaggctg

SEQ ID NO: 10726 - DNA, 20 bp, Artificial Sequence
  Synthetic oligonucleotide; CAG chr11 5244203 5244222 5244219 +
gtcacccaggctggagtgtg

SEQ ID NO: 10727 - DNA, 20 bp, Artificial Sequence
  Synthetic oligonucleotide; TGG chr11 5244206 5244225 5244222 +
acccaggctggagtgtgcag

SEQ ID NO: 10728 - DNA, 20 bp, Artificial Sequence
  Synthetic oligonucleotide; AAG chr11 5244228 5244247 5244244 +
gcgcgatctctgctcaccgc

SEQ ID NO: 10729 - DNA, 20 bp, Artificial Sequence
  Synthetic oligonucleotide; CAG chr11 5244241 5244260 5244257 +
tcaccgcaagctctgcctcc

SEQ ID NO: 10730 - DNA, 20 bp, Artificial Sequence
  Synthetic oligonucleotide; AGG chr11 5244242 5244261 5244258 +
caccgcaagctctgcctccc

SEQ ID NO: 10731 - DNA, 20 bp, Artificial Sequence
  Synthetic oligonucleotide; CAG chr11 5244265 5244284 5244281 +
ttcacgccattctcctgcct

SEQ ID NO: 10732 - DNA, 20 bp, Artificial Sequence
  Synthetic oligonucleotide; GAG chr11 5244274 5244293 5244290 +
ttctcctgcctcagcctccc

SEQ ID NO: 10733 - DNA, 20 bp, Artificial Sequence
  Synthetic oligonucleotide; TAG chr11 5244277 5244296 5244293 +
tcctgcctcagcctcccgag

SEQ ID NO: 10734 - DNA, 20 bp, Artificial Sequence
  Synthetic oligonucleotide; TGG chr11 5244281 5244300 5244297 +
gcctcagcctcccgagtagc

SEQ ID NO: 10735 - DNA, 20 bp, Artificial Sequence
  Synthetic oligonucleotide; GGG chr11 5244282 5244301 5244298 +
cctcagcctcccgagtagct

SEQ ID NO: 10736 - DNA, 20 bp, Artificial Sequence
  Synthetic oligonucleotide; CAG chr11 5244289 5244308 5244305 +
ctcccgagtagctgggacta

SEQ ID NO: 10737 - DNA, 20 bp, Artificial Sequence
  Synthetic oligonucleotide; AGG chr11 5244290 5244309 5244306 +
tcccgagtagctgggactac

SEQ ID NO: 10738 - DNA, 20 bp, Artificial Sequence
  Synthetic oligonucleotide; TGG chr11 5244309 5244328 5244325 +
caggcacccgccactgtctc

SEQ ID NO: 10739 - DNA, 20 bp, Artificial Sequence
  Synthetic oligonucleotide; TAG chr11 5244329 5244348 5244345 +
tggctaattttttgtatttt

SEQ ID NO: 10740 - DNA, 20 bp, Artificial Sequence
  Synthetic oligonucleotide; TAG chr11 5244332 5244351 5244348 +
ctaattttttgtatttttag

SEQ ID NO: 10741 - DNA, 20 bp, Artificial Sequence
  Synthetic oligonucleotide; GAG chr11 5244334 5244353 5244350 +
aattttttgtatttttagta

SEQ ID NO: 10742 - DNA, 20 bp, Artificial Sequence
  Synthetic oligonucleotide; TGG chr11 5244338 5244357 5244354 +
ttttgtatttttagtagaga

SEQ ID NO: 10743 - DNA, 20 bp, Artificial Sequence
  Synthetic oligonucleotide; GGG chr11 5244339 5244358 5244355 +
tttgtatttttagtagagat

SEQ ID NO: 10744 - DNA, 20 bp, Artificial Sequence
  Synthetic oligonucleotide; GGG chr11 5244340 5244359 5244356 +
ttgtatttttagtagagatg

SEQ ID NO: 10745 - DNA, 20 bp, Artificial Sequence
  Synthetic oligonucleotide; TAG chr11 5244354 5244373 5244370 +
gagatggggtttcaccatgt

SEQ ID NO: 10746 - DNA, 20 bp, Artificial Sequence
  Synthetic oligonucleotide; CAG chr11 5244358 5244377 5244374 +
tggggtttcaccatgttagc

SEQ ID NO: 10747 - DNA, 20 bp, Artificial Sequence
  Synthetic oligonucleotide; AGG chr11 5244359 5244378 5244375 +
ggggtttcaccatgttagcc

SEQ ID NO: 10748 - DNA, 20 bp, Artificial Sequence
  Synthetic oligonucleotide; TGG chr11 5244363 5244382 5244379 +
tttcaccatgttagccagga

SEQ ID NO: 10749 - DNA, 20 bp, Artificial Sequence
  Synthetic oligonucleotide; CAG chr11 5244399 5244418 5244415 +
acctcgtgatccgcccacct

SEQ ID NO: 10750 - DNA, 20 bp, Artificial Sequence
  Synthetic oligonucleotide; AAG chr11 5244409 5244428 5244425 +
ccgcccacctcagcctccca

SEQ ID NO: 10751 - DNA, 20 bp, Artificial Sequence
  Synthetic oligonucleotide; TGG chr11 5244415 5244434 5244431 +
acctcagcctcccaaagtgc

SEQ ID NO: 10752 - DNA, 20 bp, Artificial Sequence
  Synthetic oligonucleotide; GGG chr11 5244416 5244435 5244432 +
cctcagcctcccaaagtgct

SEQ ID NO: 10753 - DNA, 20 bp, Artificial Sequence
  Synthetic oligonucleotide; CAG chr11 5244423 5244442 5244439 +
ctcccaaagtgctgggatta

SEQ ID NO: 10754 - DNA, 20 bp, Artificial Sequence
  Synthetic oligonucleotide; AGG chr11 5244424 5244443 5244440 +
tcccaaagtgctgggattac

SEQ ID NO: 10755 - DNA, 20 bp, Artificial Sequence
  Synthetic oligonucleotide; GAG chr11 5244430 5244449 5244446 +
agtgctgggattacaggtgt

SEQ ID NO: 10756 - DNA, 20 bp, Artificial Sequence
  Synthetic oligonucleotide; CGG chr11 5244443 5244462 5244459 +
caggtgtgagccaccgcgcc

SEQ ID NO: 10757 - DNA, 20 bp, Artificial Sequence
  Synthetic oligonucleotide; TAG chr11 5244463 5244482 5244479 +
cggccaatttcatcactttt

SEQ ID NO: 10758 - DNA, 20 bp, Artificial Sequence
  Synthetic oligonucleotide; TAG chr11 5244468 5244487 5244484 +
aatttcatcactttttagaa

SEQ ID NO: 10759 - DNA, 20 bp, Artificial Sequence
  Synthetic oligonucleotide; CAG chr11 5244488 5244507 5244504 +
tagaaataaacacctctatc

SEQ ID NO: 10760 - DNA, 20 bp, Artificial Sequence
  Synthetic oligonucleotide; TGG chr11 5244499 5244518 5244515 +
acctctatccagcatcaact

SEQ ID NO: 10761 - DNA, 20 bp, Artificial Sequence
  Synthetic oligonucleotide; AAG chr11 5244502 5244521 5244518 +
tctatccagcatcaacttgg

SEQ ID NO: 10762 - DNA, 20 bp, Artificial Sequence
  Synthetic oligonucleotide; AAG chr11 5244506 5244525 5244522 +
tccagcatcaacttggaaga

SEQ ID NO: 10763 - DNA, 20 bp, Artificial Sequence
  Synthetic oligonucleotide; CAG chr11 5244509 5244528 5244525 +
agcatcaacttggaagaaag

SEQ ID NO: 10764 - DNA, 20 bp, Artificial Sequence
  Synthetic oligonucleotide; AAG chr11 5244515 5244534 5244531 +
aacttggaagaaagcagaat

SEQ ID NO: 10765 - DNA, 20 bp, Artificial Sequence
  Synthetic oligonucleotide; TAG chr11 5244526 5244545 5244542 +
aagcagaataagaaacaaac

SEQ ID NO: 10766 - DNA, 20 bp, Artificial Sequence
  Synthetic oligonucleotide; AGG chr11 5244527 5244546 5244543 +
agcagaataagaaacaaact

SEQ ID NO: 10767 - DNA, 20 bp, Artificial Sequence
  Synthetic oligonucleotide; GGG chr11 5244528 5244547 5244544 +
gcagaataagaaacaaacta

SEQ ID NO: 10768 - DNA, 20 bp, Artificial Sequence
  Synthetic oligonucleotide; AAG chr11 5244531 5244550 5244547 +
gaataagaaacaaactaggg

SEQ ID NO: 10769 - DNA, 20 bp, Artificial Sequence
  Synthetic oligonucleotide; AAG chr11 5244535 5244554 5244551 +
aagaaacaaactagggaagt

SEQ ID NO: 10770 - DNA, 20 bp, Artificial Sequence
  Synthetic oligonucleotide; AGG chr11 5244536 5244555 5244552 +
agaaacaaactagggaagta

SEQ ID NO: 10771 - DNA, 20 bp, Artificial Sequence
  Synthetic oligonucleotide; GGG chr11 5244537 5244556 5244553 +
gaaacaaactagggaagtaa

SEQ ID NO: 10772 - DNA, 20 bp, Artificial Sequence
  Synthetic oligonucleotide; GGG chr11 5244538 5244557 5244554 +
aaacaaactagggaagtaag

SEQ ID NO: 10773 - DNA, 20 bp, Artificial Sequence
  Synthetic oligonucleotide; TGG chr11 5244546 5244565 5244562 +
tagggaagtaaggggaaaac

SEQ ID NO: 10774 - DNA, 20 bp, Artificial Sequence
  Synthetic oligonucleotide; GGG chr11 5244547 5244566 5244563 +
agggaagtaaggggaaaact

SEQ ID NO: 10775 - DNA, 20 bp, Artificial Sequence
  Synthetic oligonucleotide; TAG chr11 5244577 5244596 5244593 +
actgtgttttttaatccatt

SEQ ID NO: 10776 - DNA, 20 bp, Artificial Sequence
  Synthetic oligonucleotide; TAG chr11 5244580 5244599 5244596 +
gtgttttttaatccatttag

SEQ ID NO: 10777 - DNA, 20 bp, Artificial Sequence
  Synthetic oligonucleotide; CAG chr11 5244584 5244603 5244600 +
tttttaatccatttagtagt

SEQ ID NO: 10778 - DNA, 20 bp, Artificial Sequence
  Synthetic oligonucleotide; AAG chr11 5244603 5244622 5244619 +
tcagtgtacttatctgaaca

SEQ ID NO: 10779 - DNA, 20 bp, Artificial Sequence
  Synthetic oligonucleotide; AGG chr11 5244604 5244623 5244620 +
cagtgtacttatctgaacaa

SEQ ID NO: 10780 - DNA, 20 bp, Artificial Sequence
  Synthetic oligonucleotide; GAG chr11 5244606 5244625 5244622 +
gtgtacttatctgaacaaag

SEQ ID NO: 10781 - DNA, 20 bp, Artificial Sequence
  Synthetic oligonucleotide; TAG chr11 5244632 5244651 5244648 +
tcctctgaatcattgaacaa

SEQ ID NO: 10782 - DNA, 20 bp, Artificial Sequence
  Synthetic oligonucleotide; CAG chr11 5244670 5244689 5244686 +
acatatctacaaaattatgc

SEQ ID NO: 10783 - DNA, 20 bp, Artificial Sequence
  Synthetic oligonucleotide; TAG chr11 5244682 5244701 5244698 +
aattatgccagaacatctaa

SEQ ID NO: 10784 - DNA, 20 bp, Artificial Sequence
  Synthetic oligonucleotide; TGG chr11 5244688 5244707 5244704 +
gccagaacatctaatagtgt

SEQ ID NO: 10785 - DNA, 20 bp, Artificial Sequence
  Synthetic oligonucleotide; GGG chr11 5244689 5244708 5244705 +
ccagaacatctaatagtgtt

SEQ ID NO: 10786 - DNA, 20 bp, Artificial Sequence
  Synthetic oligonucleotide; GGG chr11 5244690 5244709 5244706 +
cagaacatctaatagtgttg

SEQ ID NO: 10787 - DNA, 20 bp, Artificial Sequence
  Synthetic oligonucleotide; GGG chr11 5244691 5244710 5244707 +
agaacatctaatagtgttgg

SEQ ID NO: 10788 - DNA, 20 bp, Artificial Sequence
  Synthetic oligonucleotide; GAG chr11 5244693 5244712 5244709 +
aacatctaatagtgttgggg

SEQ ID NO: 10789 - DNA, 20 bp, Artificial Sequence
  Synthetic oligonucleotide; AAG chr11 5244696 5244715 5244712 +
atctaatagtgttgggggag

SEQ ID NO: 10790 - DNA, 20 bp, Artificial Sequence
  Synthetic oligonucleotide; AAG chr11 5244714 5244733 5244730 +
agaagtgtgctgctctgttc

SEQ ID NO: 10791 - DNA, 20 bp, Artificial Sequence
  Synthetic oligonucleotide; AAG chr11 5244718 5244737 5244734 +
gtgtgctgctctgttcaagc

SEQ ID NO: 10792 - DNA, 20 bp, Artificial Sequence
  Synthetic oligonucleotide; GAG chr11 5244720 5244739 5244736 +
gtgctgctctgttcaagcaa

SEQ ID NO: 10793 - DNA, 20 bp, Artificial Sequence
  Synthetic oligonucleotide; AGG chr11 5244721 5244740 5244737 +
tgctgctctgttcaagcaag

SEQ ID NO: 10794 - DNA, 20 bp, Artificial Sequence
  Synthetic oligonucleotide; TAG chr11 5244725 5244744 5244741 +
gctctgttcaagcaagagga

SEQ ID NO: 10795 - DNA, 20 bp, Artificial Sequence
  Synthetic oligonucleotide; AGG chr11 5244726 5244745 5244742 +
ctctgttcaagcaagaggat

SEQ ID NO: 10796 - DNA, 20 bp, Artificial Sequence
  Synthetic oligonucleotide; GAG chr11 5244728 5244747 5244744 +
ctgttcaagcaagaggatag

SEQ ID NO: 10797 - DNA, 20 bp, Artificial Sequence
  Synthetic oligonucleotide; TGG chr11 5244737 5244756 5244753 +
caagaggataggagattccg

SEQ ID NO: 10798 - DNA, 20 bp, Artificial Sequence
  Synthetic oligonucleotide; TGG chr11 5244747 5244766 5244763 +
ggagattccgtggcccgtgc

SEQ ID NO: 10799 - DNA, 20 bp, Artificial Sequence
  Synthetic oligonucleotide; GGG chr11 5244748 5244767 5244764 +
gagattccgtggcccgtgct

SEQ ID NO: 10800 - DNA, 20 bp, Artificial Sequence
  Synthetic oligonucleotide; TAG chr11 5244754 5244773 5244770 +
ccgtggcccgtgctgggcat

SEQ ID NO: 10801 - DNA, 20 bp, Artificial Sequence
  Synthetic oligonucleotide; AGG chr11 5244755 5244774 5244771 +
cgtggcccgtgctgggcatt

SEQ ID NO: 10802 - DNA, 20 bp, Artificial Sequence
  Synthetic oligonucleotide; TGG chr11 5244769 5244788 5244785 +
ggcattaggtcatttgtgtc

SEQ ID NO: 10803 - DNA, 20 bp, Artificial Sequence
  Synthetic oligonucleotide; CAG chr11 5244774 5244793 5244790 +
taggtcatttgtgtctggca

SEQ ID NO: 10804 - DNA, 20 bp, Artificial Sequence
  Synthetic oligonucleotide; AGG chr11 5244775 5244794 5244791 +
aggtcatttgtgtctggcac

SEQ ID NO: 10805 - DNA, 20 bp, Artificial Sequence
  Synthetic oligonucleotide; TAG chr11 5244787 5244806 5244803 +
tctggcacaggcttgatcta

SEQ ID NO: 10806 - DNA, 20 bp, Artificial Sequence
  Synthetic oligonucleotide; CAG chr11 5244825 5244844 5244841 +
aacttgtctttatatctaat

SEQ ID NO: 10807 - DNA, 20 bp, Artificial Sequence
  Synthetic oligonucleotide; AGG chr11 5244826 5244845 5244842 +
acttgtctttatatctaatc

SEQ ID NO: 10808 - DNA, 20 bp, Artificial Sequence
  Synthetic oligonucleotide; AAG chr11 5244831 5244850 5244847 +
tctttatatctaatcaggca

SEQ ID NO: 10809 - DNA, 20 bp, Artificial Sequence
  Synthetic oligonucleotide; CAG chr11 5244858 5244877 5244874 +
tcttcactgacaatattcca

SEQ ID NO: 10810 - DNA, 20 bp, Artificial Sequence
  Synthetic oligonucleotide; AGG chr11 5244859 5244878 5244875 +
cttcactgacaatattccac

SEQ ID NO: 10811 - DNA, 20 bp, Artificial Sequence
  Synthetic oligonucleotide; AAG chr11 5244907 5244926 5244923 +
acgtctcatgcgtctcaaac

SEQ ID NO: 10812 - DNA, 20 bp, Artificial Sequence
  Synthetic oligonucleotide; CAG chr11 5244916 5244935 5244932 +
gcgtctcaaacaagcaattt

SEQ ID NO: 10813 - DNA, 20 bp, Artificial Sequence
  Synthetic oligonucleotide; AGG chr11 5244917 5244936 5244933 +
cgtctcaaacaagcaatttc

SEQ ID NO: 10814 - DNA, 20 bp, Artificial Sequence
  Synthetic oligonucleotide; TAG chr11 5244922 5244941 5244938 +
caaacaagcaatttcaggaa

SEQ ID NO: 10815 - DNA, 20 bp, Artificial Sequence
  Synthetic oligonucleotide; CAG chr11 5244926 5244945 5244942 +
caagcaatttcaggaataga

SEQ ID NO: 10816 - DNA, 20 bp, Artificial Sequence
  Synthetic oligonucleotide; AGG chr11 5244927 5244946 5244943 +
aagcaatttcaggaatagac

SEQ ID NO: 10817 - DNA, 20 bp, Artificial Sequence
  Synthetic oligonucleotide; GGG chr11 5244928 5244947 5244944 +
agcaatttcaggaatagaca

SEQ ID NO: 10818 - DNA, 20 bp, Artificial Sequence
  Synthetic oligonucleotide; CGG chr11 5244942 5244961 5244958 +
tagacagggcacacttccac

SEQ ID NO: 10819 - DNA, 20 bp, Artificial Sequence
  Synthetic oligonucleotide; CAG chr11 5244945 5244964 5244961 +
acagggcacacttccaccgg

SEQ ID NO: 10820 - DNA, 20 bp, Artificial Sequence
  Synthetic oligonucleotide; GAG chr11 5244947 5244966 5244963 +
agggcacacttccaccggca

SEQ ID NO: 10821 - DNA, 20 bp, Artificial Sequence
  Synthetic oligonucleotide; GAG chr11 5244949 5244968 5244965 +
ggcacacttccaccggcaga

SEQ ID NO: 10822 - DNA, 20 bp, Artificial Sequence
  Synthetic oligonucleotide; AAG chr11 5244952 5244971 5244968 +
acacttccaccggcagagag

SEQ ID NO: 10823 - DNA, 20 bp, Artificial Sequence
  Synthetic oligonucleotide; CAG chr11 5244957 5244976 5244973 +
tccaccggcagagagaagaa

SEQ ID NO: 10824 - DNA, 20 bp, Artificial Sequence
  Synthetic oligonucleotide; AAG chr11 5244976 5244995 5244992 +
acagtttattttatattctt

SEQ ID NO: 10825 - DNA, 20 bp, Artificial Sequence
  Synthetic oligonucleotide; AGG chr11 5244977 5244996 5244993 +
cagtttattttatattctta

SEQ ID NO: 10826 - DNA, 20 bp, Artificial Sequence
  Synthetic oligonucleotide; TAG chr11 5244997 5245016 5245013 +
aggcttactgtcctcatact

SEQ ID NO: 10827 - DNA, 20 bp, Artificial Sequence
  Synthetic oligonucleotide; GAG chr11 5244999 5245018 5245015 +
gcttactgtcctcatactta

SEQ ID NO: 10828 - DNA, 20 bp, Artificial Sequence
  Synthetic oligonucleotide; AGG chr11 5245000 5245019 5245016 +
cttactgtcctcatacttag

SEQ ID NO: 10829 - DNA, 20 bp, Artificial Sequence
  Synthetic oligonucleotide; CAG chr11 5245005 5245024 5245021 +
tgtcctcatacttagaggtt

SEQ ID NO: 10830 - DNA, 20 bp, Artificial Sequence
  Synthetic oligonucleotide; AGG chr11 5245006 5245025 5245022 +
gtcctcatacttagaggttc

SEQ ID NO: 10831 - DNA, 20 bp, Artificial Sequence
  Synthetic oligonucleotide; TGG chr11 5245013 5245032 5245029 +
tacttagaggttcaggatgc

SEQ ID NO: 10832 - DNA, 20 bp, Artificial Sequence
  Synthetic oligonucleotide; GAG chr11 5245032 5245051 5245048 +
ctggtttgtgtgttacccct

SEQ ID NO: 10833 - DNA, 20 bp, Artificial Sequence
  Synthetic oligonucleotide; AAG chr11 5245047 5245066 5245063 +
cccctgagataaatccttac

SEQ ID NO: 10834 - DNA, 20 bp, Artificial Sequence
  Synthetic oligonucleotide; AAG chr11 5245055 5245074 5245071 +
ataaatccttacaagaaata

SEQ ID NO: 10835 - DNA, 20 bp, Artificial Sequence
  Synthetic oligonucleotide; TAG chr11 5245060 5245079 5245076 +
tccttacaagaaataaagtt

SEQ ID NO: 10836 - DNA, 20 bp, Artificial Sequence
  Synthetic oligonucleotide; AGG chr11 5245061 5245080 5245077 +
ccttacaagaaataaagttt

SEQ ID NO: 10837 - DNA, 20 bp, Artificial Sequence
  Synthetic oligonucleotide; AAG chr11 5245086 5245105 5245102 +
atcacccccatgtgtatttc

SEQ ID NO: 10838 - DNA, 20 bp, Artificial Sequence
  Synthetic oligonucleotide; AGG chr11 5245087 5245106 5245103 +
tcacccccatgtgtatttca

SEQ ID NO: 10839 - DNA, 20 bp, Artificial Sequence
  Synthetic oligonucleotide; GAG chr11 5245089 5245108 5245105 +
acccccatgtgtatttcaag

SEQ ID NO: 10840 - DNA, 20 bp, Artificial Sequence
  Synthetic oligonucleotide; AAG chr11 5245105 5245124 5245121 +
caaggagactctaaatttca

SEQ ID NO: 10841 - DNA, 20 bp, Artificial Sequence
  Synthetic oligonucleotide; GAG chr11 5245107 5245126 5245123 +
aggagactctaaatttcaaa

SEQ ID NO: 10842 - DNA, 20 bp, Artificial Sequence
  Synthetic oligonucleotide; AAG chr11 5245127 5245146 5245143 +
gagttaaacccaatatatta

SEQ ID NO: 10843 - DNA, 20 bp, Artificial Sequence
  Synthetic oligonucleotide; TAG chr11 5245145 5245164 5245161 +
taaagctgaatttctgatat

SEQ ID NO: 10844 - DNA, 20 bp, Artificial Sequence
  Synthetic oligonucleotide; GAG chr11 5245147 5245166 5245163 +
aagctgaatttctgatatta

SEQ ID NO: 10845 - DNA, 20 bp, Artificial Sequence
  Synthetic oligonucleotide; TAG chr11 5245161 5245180 5245177 +
atattagagacacaatattt

SEQ ID NO: 10846 - DNA, 20 bp, Artificial Sequence
  Synthetic oligonucleotide; TAG chr11 5245175 5245194 5245191 +
atattttagtctacttgata

SEQ ID NO: 10847 - DNA, 20 bp, Artificial Sequence
  Synthetic oligonucleotide; GAG chr11 5245180 5245199 5245196 +
ttagtctacttgatatagtt

SEQ ID NO: 10848 - DNA, 20 bp, Artificial Sequence
  Synthetic oligonucleotide; GAG chr11 5245182 5245201 5245198 +
agtctacttgatatagttga

SEQ ID NO: 10849 - DNA, 20 bp, Artificial Sequence
  Synthetic oligonucleotide; AGG chr11 5245183 5245202 5245199 +
gtctacttgatatagttgag

SEQ ID NO: 10850 - DNA, 20 bp, Artificial Sequence
  Synthetic oligonucleotide; CAG chr11 5245186 5245205 5245202 +
tacttgatatagttgagagg

SEQ ID NO: 10851 - DNA, 20 bp, Artificial Sequence
  Synthetic oligonucleotide; TAG chr11 5245203 5245222 5245219 +
aggcagttacctgttttact

SEQ ID NO: 10852 - DNA, 20 bp, Artificial Sequence
  Synthetic oligonucleotide; AGG chr11 5245204 5245223 5245220 +
ggcagttacctgttttactt

SEQ ID NO: 10853 - DNA, 20 bp, Artificial Sequence
  Synthetic oligonucleotide; TGG chr11 5245211 5245230 5245227 +
acctgttttacttaggaaca

SEQ ID NO: 10854 - DNA, 20 bp, Artificial Sequence
  Synthetic oligonucleotide; GGG chr11 5245212 5245231 5245228 +
cctgttttacttaggaacat

SEQ ID NO: 10855 - DNA, 20 bp, Artificial Sequence
  Synthetic oligonucleotide; GGG chr11 5245213 5245232 5245229 +
ctgttttacttaggaacatg

SEQ ID NO: 10856 - DNA, 20 bp, Artificial Sequence
  Synthetic oligonucleotide; AAG chr11 5245217 5245236 5245233 +
tttacttaggaacatgggga

SEQ ID NO: 10857 - DNA, 20 bp, Artificial Sequence
  Synthetic oligonucleotide; TAG chr11 5245224 5245243 5245240 +
aggaacatggggaaagtttg

SEQ ID NO: 10858 - DNA, 20 bp, Artificial Sequence
  Synthetic oligonucleotide; CAG chr11 5245234 5245253 5245250 +
ggaaagtttgtagtgacaaa

SEQ ID NO: 10859 - DNA, 20 bp, Artificial Sequence
  Synthetic oligonucleotide; GAG chr11 5245240 5245259 5245256 +
tttgtagtgacaaacagttt

SEQ ID NO: 10860 - DNA, 20 bp, Artificial Sequence
  Synthetic oligonucleotide; AGG chr11 5245241 5245260 5245257 +
ttgtagtgacaaacagtttg

SEQ ID NO: 10861 - DNA, 20 bp, Artificial Sequence
  Synthetic oligonucleotide; AAG chr11 5245251 5245270 5245267 +
aaacagtttgaggcaaaacc

SEQ ID NO: 10862 - DNA, 20 bp, Artificial Sequence
  Synthetic oligonucleotide; AAG chr11 5245263 5245282 5245279 +
gcaaaaccaagattatcttt

SEQ ID NO: 10863 - DNA, 20 bp, Artificial Sequence
  Synthetic oligonucleotide; GAG chr11 5245265 5245284 5245281 +
aaaaccaagattatctttaa

SEQ ID NO: 10864 - DNA, 20 bp, Artificial Sequence
  Synthetic oligonucleotide; CAG chr11 5245268 5245287 5245284 +
accaagattatctttaagag

SEQ ID NO: 10865 - DNA, 20 bp, Artificial Sequence
  Synthetic oligonucleotide; GAG chr11 5245270 5245289 5245286 +
caagattatctttaagagca

SEQ ID NO: 10866 - DNA, 20 bp, Artificial Sequence
  Synthetic oligonucleotide; AAG chr11 5245285 5245304 5245301 +
gagcagagatcgatgatatg

SEQ ID NO: 10867 - DNA, 20 bp, Artificial Sequence
  Synthetic oligonucleotide; AAG chr11 5245291 5245310 5245307 +
agatcgatgatatgaagaaa

SEQ ID NO: 10868 - DNA, 20 bp, Artificial Sequence
  Synthetic oligonucleotide; AAG chr11 5245294 5245313 5245310 +
tcgatgatatgaagaaaaag

SEQ ID NO: 10869 - DNA, 20 bp, Artificial Sequence
  Synthetic oligonucleotide; TGG chr11 5245297 5245316 5245313 +
atgatatgaagaaaaagaag

SEQ ID NO: 10870 - DNA, 20 bp, Artificial Sequence
  Synthetic oligonucleotide; CAG chr11 5245316 5245335 5245332 +
gtggcaactttgactatatg

SEQ ID NO: 10871 - DNA, 20 bp, Artificial Sequence
  Synthetic oligonucleotide; AGG chr11 5245317 5245336 5245333 +
tggcaactttgactatatgc

SEQ ID NO: 10872 - DNA, 20 bp, Artificial Sequence
  Synthetic oligonucleotide; GAG chr11 5245335 5245354 5245351 +
gcaggaaacacatttatatt

SEQ ID NO: 10873 - DNA, 20 bp, Artificial Sequence
  Synthetic oligonucleotide; TGG chr11 5245341 5245360 5245357 +
aacacatttatattgagttg

SEQ ID NO: 10874 - DNA, 20 bp, Artificial Sequence
  Synthetic oligonucleotide; GGG chr11 5245342 5245361 5245358 +
acacatttatattgagttgt

SEQ ID NO: 10875 - DNA, 20 bp, Artificial Sequence
  Synthetic oligonucleotide; GGG chr11 5245343 5245362 5245359 +
cacatttatattgagttgtg

SEQ ID NO: 10876 - DNA, 20 bp, Artificial Sequence
  Synthetic oligonucleotide; TGG chr11 5245348 5245367 5245364 +
ttatattgagttgtggggac

SEQ ID NO: 10877 - DNA, 20 bp, Artificial Sequence
  Synthetic oligonucleotide; CAG chr11 5245354 5245373 5245370 +
tgagttgtggggactggcct

SEQ ID NO: 10878 - DNA, 20 bp, Artificial Sequence
  Synthetic oligonucleotide; GAG chr11 5245356 5245375 5245372 +
agttgtggggactggcctca

SEQ ID NO: 10879 - DNA, 20 bp, Artificial Sequence
  Synthetic oligonucleotide; AGG chr11 5245357 5245376 5245373 +
gttgtggggactggcctcag

SEQ ID NO: 10880 - DNA, 20 bp, Artificial Sequence
  Synthetic oligonucleotide; CAG chr11 5245366 5245385 5245382 +
actggcctcagaggaaactt

SEQ ID NO: 10881 - DNA, 20 bp, Artificial Sequence
  Synthetic oligonucleotide; AGG chr11 5245367 5245386 5245383 +
ctggcctcagaggaaacttc

SEQ ID NO: 10882 - DNA, 20 bp, Artificial Sequence
  Synthetic oligonucleotide; TGG chr11 5245383 5245402 5245399 +
cttcaggtcatgtcctttaa

SEQ ID NO: 10883 - DNA, 20 bp, Artificial Sequence
  Synthetic oligonucleotide; AAG chr11 5245405 5245424 5245421 +
gccctaaaactcattcccaa

SEQ ID NO: 10884 - DNA, 20 bp, Artificial Sequence
  Synthetic oligonucleotide; TAG chr11 5245439 5245458 5245455 +
attgccatacctcatatcct

SEQ ID NO: 10885 - DNA, 20 bp, Artificial Sequence
  Synthetic oligonucleotide; AGG chr11 5245440 5245459 5245456 +
ttgccatacctcatatcctt

SEQ ID NO: 10886 - DNA, 20 bp, Artificial Sequence
  Synthetic oligonucleotide; CAG chr11 5245468 5245487 5245484 +
acatctaaaaccctgcgtac

SEQ ID NO: 10887 - DNA, 20 bp, Artificial Sequence
  Synthetic oligonucleotide; CAG chr11 5245475 5245494 5245491 +
aaaccctgcgtaccagtgaa

SEQ ID NO: 10888 - DNA, 20 bp, Artificial Sequence
  Synthetic oligonucleotide; CAG chr11 5245495 5245514 5245511 +
cagctgccccatctttccat

SEQ ID NO: 10889 - DNA, 20 bp, Artificial Sequence
  Synthetic oligonucleotide; CAG chr11 5245503 5245522 5245519 +
ccatctttccatcagccaac

SEQ ID NO: 10890 - DNA, 20 bp, Artificial Sequence
  Synthetic oligonucleotide; AGG chr11 5245504 5245523 5245520 +
catctttccatcagccaacc

SEQ ID NO: 10891 - DNA, 20 bp, Artificial Sequence
  Synthetic oligonucleotide; CAG chr11 5245511 5245530 5245527 +
ccatcagccaaccaggaatt

SEQ ID NO: 10892 - DNA, 20 bp, Artificial Sequence
  Synthetic oligonucleotide; CAG chr11 5245514 5245533 5245530 +
tcagccaaccaggaattcag

SEQ ID NO: 10893 - DNA, 20 bp, Artificial Sequence
  Synthetic oligonucleotide; CAG chr11 5245551 5245570 5245567 +
cacttttctctcacccgctc

SEQ ID NO: 10894 - DNA, 20 bp, Artificial Sequence
  Synthetic oligonucleotide; AGG chr11 5245552 5245571 5245568 +
acttttctctcacccgctcc

SEQ ID NO: 10895 - DNA, 20 bp, Artificial Sequence
  Synthetic oligonucleotide; AAG chr11 5245557 5245576 5245573 +
tctctcacccgctccaggaa

SEQ ID NO: 10896 - DNA, 20 bp, Artificial Sequence
  Synthetic oligonucleotide; CAG chr11 5245567 5245586 5245583 +
gctccaggaaaagtgacctg

SEQ ID NO: 10897 - DNA, 20 bp, Artificial Sequence
  Synthetic oligonucleotide; TGG chr11 5245579 5245598 5245595 +
gtgacctgcagtcactttcc

SEQ ID NO: 10898 - DNA, 20 bp, Artificial Sequence
  Synthetic oligonucleotide; AAG chr11 5245582 5245601 5245598 +
acctgcagtcactttcctgg

SEQ ID NO: 10899 - DNA, 20 bp, Artificial Sequence
  Synthetic oligonucleotide; TGG chr11 5245605 5245624 5245621 +
tattgattctttcttgtttg

SEQ ID NO: 10900 - DNA, 20 bp, Artificial Sequence
  Synthetic oligonucleotide; TAG chr11 5245660 5245679 5245676 +
attgcttctactgtgatcta

SEQ ID NO: 10901 - DNA, 20 bp, Artificial Sequence
  Synthetic oligonucleotide; CAG chr11 5245682 5245701 5245698 +
gactcttatatcatcaatac

SEQ ID NO: 10902 - DNA, 20 bp, Artificial Sequence
  Synthetic oligonucleotide; AGG chr11 5245683 5245702 5245699 +
actcttatatcatcaatacc

SEQ ID NO: 10903 - DNA, 20 bp, Artificial Sequence
  Synthetic oligonucleotide; CAG chr11 5245695 5245714 5245711 +
tcaataccaggttatcattg

SEQ ID NO: 10904 - DNA, 20 bp, Artificial Sequence
  Synthetic oligonucleotide; TAG chr11 5245749 5245768 5245765 +
ttaattcaacaaatacatat

SEQ ID NO: 10905 - DNA, 20 bp, Artificial Sequence
  Synthetic oligonucleotide; AAG chr11 5245771 5245790 5245787 +
gattccatatgtcatccatg

SEQ ID NO: 10906 - DNA, 20 bp, Artificial Sequence
  Synthetic oligonucleotide; GAG chr11 5245808 5245827 5245824 +
catccatttttcttaattct

SEQ ID NO: 10907 - DNA, 20 bp, Artificial Sequence
  Synthetic oligonucleotide; TAG chr11 5245825 5245844 5245841 +
tctgagaatcttacatgaac

SEQ ID NO: 10908 - DNA, 20 bp, Artificial Sequence
  Synthetic oligonucleotide; CAG chr11 5245829 5245848 5245845 +
agaatcttacatgaactaga

SEQ ID NO: 10909 - DNA, 20 bp, Artificial Sequence
  Synthetic oligonucleotide; CAG chr11 5245833 5245852 5245849 +
tcttacatgaactagacaga

SEQ ID NO: 10910 - DNA, 20 bp, Artificial Sequence
  Synthetic oligonucleotide; TGG chr11 5245842 5245861 5245858 +
aactagacagacagattctc

SEQ ID NO: 10911 - DNA, 20 bp, Artificial Sequence
  Synthetic oligonucleotide; TGG chr11 5245849 5245868 5245865 +
cagacagattctctggctaa

SEQ ID NO: 10912 - DNA, 20 bp, Artificial Sequence
  Synthetic oligonucleotide; TAG chr11 5245863 5245882 5245879 +
ggctaatggtgccctcacta

SEQ ID NO: 10913 - DNA, 20 bp, Artificial Sequence
  Synthetic oligonucleotide; GAG chr11 5245867 5245886 5245883 +
aatggtgccctcactatagt

SEQ ID NO: 10914 - DNA, 20 bp, Artificial Sequence
  Synthetic oligonucleotide; CAG chr11 5245870 5245889 5245886 +
ggtgccctcactatagtgag

SEQ ID NO: 10915 - DNA, 20 bp, Artificial Sequence
  Synthetic oligonucleotide; GAG chr11 5245872 5245891 5245888 +
tgccctcactatagtgagca

SEQ ID NO: 10916 - DNA, 20 bp, Artificial Sequence
  Synthetic oligonucleotide; AGG chr11 5245873 5245892 5245889 +
gccctcactatagtgagcag

SEQ ID NO: 10917 - DNA, 20 bp, Artificial Sequence
  Synthetic oligonucleotide; GAG chr11 5245875 5245894 5245891 +
cctcactatagtgagcagag

SEQ ID NO: 10918 - DNA, 20 bp, Artificial Sequence
  Synthetic oligonucleotide; CAG chr11 5245880 5245899 5245896 +
ctatagtgagcagaggagac

SEQ ID NO: 10919 - DNA, 20 bp, Artificial Sequence
  Synthetic oligonucleotide; AAG chr11 5245895 5245914 5245911 +
gagaccagcatacatactaa

SEQ ID NO: 10920 - DNA, 20 bp, Artificial Sequence
  Synthetic oligonucleotide; AAG chr11 5245910 5245929 5245926 +
actaaaagaaatgaattaat

SEQ ID NO: 10921 - DNA, 20 bp, Artificial Sequence
  Synthetic oligonucleotide; GAG chr11 5245912 5245931 5245928 +
taaaagaaatgaattaataa

SEQ ID NO: 10922 - DNA, 20 bp, Artificial Sequence
  Synthetic oligonucleotide; CAG chr11 5245919 5245938 5245935 +
aatgaattaataagagattt

SEQ ID NO: 10923 - DNA, 20 bp, Artificial Sequence
  Synthetic oligonucleotide; TGG chr11 5245923 5245942 5245939 +
aattaataagagatttcaga

SEQ ID NO: 10924 - DNA, 20 bp, Artificial Sequence
  Synthetic oligonucleotide; AAG chr11 5245940 5245959 5245956 +
agatggtattatatgacttg

SEQ ID NO: 10925 - DNA, 20 bp, Artificial Sequence
  Synthetic oligonucleotide; TGG chr11 5245970 5245989 5245986 +
atattgtacctacaaccatc

SEQ ID NO: 10926 - DNA, 20 bp, Artificial Sequence
  Synthetic oligonucleotide; TAG chr11 5245978 5245997 5245994 +
cctacaaccatctggtcttt

SEQ ID NO: 10927 - DNA, 20 bp, Artificial Sequence
  Synthetic oligonucleotide; AAG chr11 5245992 5246011 5246008 +
gtcttttagaaacctgacaa

SEQ ID NO: 10928 - DNA, 20 bp, Artificial Sequence
  Synthetic oligonucleotide; AAG chr11 5245996 5246015 5246012 +
tttagaaacctgacaaaagc

SEQ ID NO: 10929 - DNA, 20 bp, Artificial Sequence
  Synthetic oligonucleotide; TGG chr11 5246002 5246021 5246018 +
aacctgacaaaagcaagcaa

SEQ ID NO: 10930 - DNA, 20 bp, Artificial Sequence
  Synthetic oligonucleotide; GGG chr11 5246003 5246022 5246019 +
acctgacaaaagcaagcaat

SEQ ID NO: 10931 - DNA, 20 bp, Artificial Sequence
  Synthetic oligonucleotide; GGG chr11 5246004 5246023 5246020 +
cctgacaaaagcaagcaatg

SEQ ID NO: 10932 - DNA, 20 bp, Artificial Sequence
  Synthetic oligonucleotide; AAG chr11 5246008 5246027 5246024 +
acaaaagcaagcaatgggga

SEQ ID NO: 10933 - DNA, 20 bp, Artificial Sequence
  Synthetic oligonucleotide; AGG chr11 5246009 5246028 5246025 +
caaaagcaagcaatggggaa

SEQ ID NO: 10934 - DNA, 20 bp, Artificial Sequence
  Synthetic oligonucleotide; TGG chr11 5246032 5246051 5246048 +
attttcaatttaataaatga

SEQ ID NO: 10935 - DNA, 20 bp, Artificial Sequence
  Synthetic oligonucleotide; GGG chr11 5246033 5246052 5246049 +
ttttcaatttaataaatgat

SEQ ID NO: 10936 - DNA, 20 bp, Artificial Sequence
  Synthetic oligonucleotide; GGG chr11 5246034 5246053 5246050 +
tttcaatttaataaatgatg

SEQ ID NO: 10937 - DNA, 20 bp, Artificial Sequence
  Synthetic oligonucleotide; GGG chr11 5246035 5246054 5246051 +
ttcaatttaataaatgatgg

SEQ ID NO: 10938 - DNA, 20 bp, Artificial Sequence
  Synthetic oligonucleotide; GAG chr11 5246037 5246056 5246053 +
caatttaataaatgatgggg

SEQ ID NO: 10939 - DNA, 20 bp, Artificial Sequence
  Synthetic oligonucleotide; TGG chr11 5246043 5246062 5246059 +
aataaatgatgggggagaac

SEQ ID NO: 10940 - DNA, 20 bp, Artificial Sequence
  Synthetic oligonucleotide; TAG chr11 5246047 5246066 5246063 +
aatgatgggggagaactggc

SEQ ID NO: 10941 - DNA, 20 bp, Artificial Sequence
  Synthetic oligonucleotide; TGG chr11 5246071 5246090 5246087 +
catatgctgaaaaatgaaac

SEQ ID NO: 10942 - DNA, 20 bp, Artificial Sequence
  Synthetic oligonucleotide; CAG chr11 5246107 5246126 5246123 +
accttatccaaaattaactc

SEQ ID NO: 10943 - DNA, 20 bp, Artificial Sequence
  Synthetic oligonucleotide; TGG chr11 5246111 5246130 5246127 +
tatccaaaattaactccaga

SEQ ID NO: 10944 - DNA, 20 bp, Artificial Sequence
  Synthetic oligonucleotide; TAG chr11 5246116 5246135 5246132 +
aaaattaactccagatggat

SEQ ID NO: 10945 - DNA, 20 bp, Artificial Sequence
  Synthetic oligonucleotide; GAG chr11 5246118 5246137 5246134 +
aattaactccagatggatta

SEQ ID NO: 10946 - DNA, 20 bp, Artificial Sequence
  Synthetic oligonucleotide; AAG chr11 5246149 5246168 5246165 +
gaaaaaccccaaactataaa

SEQ ID NO: 10947 - DNA, 20 bp, Artificial Sequence
  Synthetic oligonucleotide; TAG chr11 5246154 5246173 5246170 +
accccaaactataaaaagcc

SEQ ID NO: 10948 - DNA, 20 bp, Artificial Sequence
  Synthetic oligonucleotide; AAG chr11 5246166 5246185 5246182 +
aaaaagcctagaaaaaaatc

SEQ ID NO: 10949 - DNA, 20 bp, Artificial Sequence
  Synthetic oligonucleotide; AGG chr11 5246167 5246186 5246183 +
aaaagcctagaaaaaaatca

SEQ ID NO: 10950 - DNA, 20 bp, Artificial Sequence
  Synthetic oligonucleotide; CGG chr11 5246193 5246212 5246209 +
tactattcatgatataaaca

SEQ ID NO: 10951 - DNA, 20 bp, Artificial Sequence
  Synthetic oligonucleotide; GGG chr11 5246194 5246213 5246210 +
actattcatgatataaacac

SEQ ID NO: 10952 - DNA, 20 bp, Artificial Sequence
  Synthetic oligonucleotide; CAG chr11 5246199 5246218 5246215 +
tcatgatataaacacgggca

SEQ ID NO: 10953 - DNA, 20 bp, Artificial Sequence
  Synthetic oligonucleotide; AAG chr11 5246214 5246233 5246230 +
gggcacagatttcatgatga

SEQ ID NO: 10954 - DNA, 20 bp, Artificial Sequence
  Synthetic oligonucleotide; AAG chr11 5246223 5246242 5246239 +
tttcatgatgaaagcgtgaa

SEQ ID NO: 10955 - DNA, 20 bp, Artificial Sequence
  Synthetic oligonucleotide; CAG chr11 5246232 5246251 5246248 +
gaaagcgtgaaaagcaattg

SEQ ID NO: 10956 - DNA, 20 bp, Artificial Sequence
  Synthetic oligonucleotide; AAG chr11 5246238 5246257 5246254 +
gtgaaaagcaattgcagcaa

SEQ ID NO: 10957 - DNA, 20 bp, Artificial Sequence
  Synthetic oligonucleotide; TGG chr11 5246255 5246274 5246271 +
caaaagcaaaaattgaccaa

SEQ ID NO: 10958 - DNA, 20 bp, Artificial Sequence
  Synthetic oligonucleotide; AAG chr11 5246273 5246292 5246289 +
aatggaatctaattaaacta

SEQ ID NO: 10959 - DNA, 20 bp, Artificial Sequence
  Synthetic oligonucleotide; GAG chr11 5246275 5246294 5246291 +
tggaatctaattaaactaaa

SEQ ID NO: 10960 - DNA, 20 bp, Artificial Sequence
  Synthetic oligonucleotide; CAG chr11 5246286 5246305 5246302 +
taaactaaagagctcctgct

SEQ ID NO: 10961 - DNA, 20 bp, Artificial Sequence
  Synthetic oligonucleotide; AAG chr11 5246292 5246311 5246308 +
aaagagctcctgctcagcaa

SEQ ID NO: 10962 - DNA, 20 bp, Artificial Sequence
  Synthetic oligonucleotide; CAG chr11 5246305 5246324 5246321 +
tcagcaaaagaaactaccat

SEQ ID NO: 10963 - DNA, 20 bp, Artificial Sequence
  Synthetic oligonucleotide; GAG chr11 5246307 5246326 5246323 +
agcaaaagaaactaccatca

SEQ ID NO: 10964 - DNA, 20 bp, Artificial Sequence
  Synthetic oligonucleotide; AAG chr11 5246313 5246332 5246329 +
agaaactaccatcagagcga

SEQ ID NO: 10965 - DNA, 20 bp, Artificial Sequence
  Synthetic oligonucleotide; CAG chr11 5246324 5246343 5246340 +
tcagagcgaaagacaatcta

SEQ ID NO: 10966 - DNA, 20 bp, Artificial Sequence
  Synthetic oligonucleotide; TGG chr11 5246329 5246348 5246345 +
gcgaaagacaatctacagaa

SEQ ID NO: 10967 - DNA, 20 bp, Artificial Sequence
  Synthetic oligonucleotide; GGG chr11 5246330 5246349 5246346 +
cgaaagacaatctacagaat

SEQ ID NO: 10968 - DNA, 20 bp, Artificial Sequence
  Synthetic oligonucleotide; AAG chr11 5246336 5246355 5246352 +
acaatctacagaatgggaaa

SEQ ID NO: 10969 - DNA, 20 bp, Artificial Sequence
  Synthetic oligonucleotide; AAG chr11 5246363 5246382 5246379 +
tccaatctattcttctgaca

SEQ ID NO: 10970 - DNA, 20 bp, Artificial Sequence
  Synthetic oligonucleotide; AGG chr11 5246364 5246383 5246380 +
ccaatctattcttctgacaa

SEQ ID NO: 10971 - DNA, 20 bp, Artificial Sequence
  Synthetic oligonucleotide; CAG chr11 5246376 5246395 5246392 +
tctgacaaaggcctaatatc

SEQ ID NO: 10972 - DNA, 20 bp, Artificial Sequence
  Synthetic oligonucleotide; GAG chr11 5246378 5246397 5246394 +
tgacaaaggcctaatatcca

SEQ ID NO: 10973 - DNA, 20 bp, Artificial Sequence
  Synthetic oligonucleotide; AAG chr11 5246386 5246405 5246402 +
gcctaatatccagagtaaac

SEQ ID NO: 10974 - DNA, 20 bp, Artificial Sequence
  Synthetic oligonucleotide; AAG chr11 5246407 5246426 5246423 +
agaaacttaaacaactttac

SEQ ID NO: 10975 - DNA, 20 bp, Artificial Sequence
  Synthetic oligonucleotide; TGG chr11 5246433 5246452 5246449 +
aaaaaaacccattaaaacca

SEQ ID NO: 10976 - DNA, 20 bp, Artificial Sequence
  Synthetic oligonucleotide; AAG chr11 5246491 5246510 5246507 +
gtacgtgtacccctgaattt

SEQ ID NO: 10977 - DNA, 20 bp, Artificial Sequence
  Synthetic oligonucleotide; AGG chr11 5246492 5246511 5246508 +
tacgtgtacccctgaattta

SEQ ID NO: 10978 - DNA, 20 bp, Artificial Sequence
  Synthetic oligonucleotide; CAG chr11 5246498 5246517 5246514 +
tacccctgaatttaaggtaa

SEQ ID NO: 10979 - DNA, 20 bp, Artificial Sequence
  Synthetic oligonucleotide; AAG chr11 5246514 5246533 5246530 +
gtaacagtaaattaaattaa

SEQ ID NO: 10980 - DNA, 20 bp, Artificial Sequence
  Synthetic oligonucleotide; TGG chr11 5246527 5246546 5246543 +
aaattaaaagaaaaatgcca

SEQ ID NO: 10981 - DNA, 20 bp, Artificial Sequence
  Synthetic oligonucleotide; CAG chr11 5246536 5246555 5246552 +
gaaaaatgccatggcaatgt

SEQ ID NO: 10982 - DNA, 20 bp, Artificial Sequence
  Synthetic oligonucleotide; AAG chr11 5246540 5246559 5246556 +
aatgccatggcaatgtcaga

SEQ ID NO: 10983 - DNA, 20 bp, Artificial Sequence
  Synthetic oligonucleotide; TGG chr11 5246553 5246572 5246569 +
tgtcagaaagttaccctata

SEQ ID NO: 10984 - DNA, 20 bp, Artificial Sequence
  Synthetic oligonucleotide; AAG chr11 5246562 5246581 5246578 +
gttaccctatatggcctaaa

SEQ ID NO: 10985 - DNA, 20 bp, Artificial Sequence
  Synthetic oligonucleotide; GAG chr11 5246564 5246583 5246580 +
taccctatatggcctaaaaa

SEQ ID NO: 10986 - DNA, 20 bp, Artificial Sequence
  Synthetic oligonucleotide; AAG chr11 5246567 5246586 5246583 +
cctatatggcctaaaaagag

SEQ ID NO: 10987 - DNA, 20 bp, Artificial Sequence
  Synthetic oligonucleotide; AGG chr11 5246568 5246587 5246584 +
ctatatggcctaaaaagaga

SEQ ID NO: 10988 - DNA, 20 bp, Artificial Sequence
  Synthetic oligonucleotide; AAG chr11 5246605 5246624 5246621 +
aacttgtttaacatatcatc

SEQ ID NO: 10989 - DNA, 20 bp, Artificial Sequence
  Synthetic oligonucleotide; AAG chr11 5246620 5246639 5246636 +
tcatcaagaaataaccataa

SEQ ID NO: 10990 - DNA, 20 bp, Artificial Sequence
  Synthetic oligonucleotide; AGG chr11 5246621 5246640 5246637 +
catcaagaaataaccataaa

SEQ ID NO: 10991 - DNA, 20 bp, Artificial Sequence
  Synthetic oligonucleotide; CAG chr11 5246630 5246649 5246646 +
ataaccataaaaggaacaac

SEQ ID NO: 10992 - DNA, 20 bp, Artificial Sequence
  Synthetic oligonucleotide; CGG chr11 5246633 5246652 5246649 +
accataaaaggaacaaccag

SEQ ID NO: 10993 - DNA, 20 bp, Artificial Sequence
  Synthetic oligonucleotide; CGG chr11 5246640 5246659 5246656 +
aaggaacaaccagcggccct

SEQ ID NO: 10994 - DNA, 20 bp, Artificial Sequence
  Synthetic oligonucleotide; GGG chr11 5246641 5246660 5246657 +
aggaacaaccagcggccctc

SEQ ID NO: 10995 - DNA, 20 bp, Artificial Sequence
  Synthetic oligonucleotide; GGG chr11 5246642 5246661 5246658 +
ggaacaaccagcggccctcg

SEQ ID NO: 10996 - DNA, 20 bp, Artificial Sequence
  Synthetic oligonucleotide; CAG chr11 5246659 5246678 5246675 +
tcggggctgctctgcctatg

SEQ ID NO: 10997 - DNA, 20 bp, Artificial Sequence
  Synthetic oligonucleotide; TAG chr11 5246662 5246681 5246678 +
gggctgctctgcctatgcag

SEQ ID NO: 10998 - DNA, 20 bp, Artificial Sequence
  Synthetic oligonucleotide; AAG chr11 5246691 5246710 5246707 +
gtttatttctttactctctc

SEQ ID NO: 10999 - DNA, 20 bp, Artificial Sequence
  Synthetic oligonucleotide; AAG chr11 5246730 5246749 5246746 +
aaaaaaaacaaaaaacaaaa

SEQ ID NO: 11000 - DNA, 20 bp, Artificial Sequence
  Synthetic oligonucleotide; AAG chr11 5246734 5246753 5246750 +
aaaacaaaaaacaaaaaaga

SEQ ID NO: 11001 - DNA, 20 bp, Artificial Sequence
  Synthetic oligonucleotide; AAG chr11 5246738 5246757 5246754 +
caaaaaacaaaaaagaaaga

SEQ ID NO: 11002 - DNA, 20 bp, Artificial Sequence
  Synthetic oligonucleotide; CGG chr11 5246755 5246774 5246771 +
agaaagtgcatattctgaaa

SEQ ID NO: 11003 - DNA, 20 bp, Artificial Sequence
  Synthetic oligonucleotide; TAG chr11 5246758 5246777 5246774 +
aagtgcatattctgaaacgg

SEQ ID NO: 11004 - DNA, 20 bp, Artificial Sequence
  Synthetic oligonucleotide; AAG chr11 5246773 5246792 5246789 +
aacggtagtgactgcatttg

SEQ ID NO: 11005 - DNA, 20 bp, Artificial Sequence
  Synthetic oligonucleotide; TGG chr11 5246776 5246795 5246792 +
ggtagtgactgcatttgaag

SEQ ID NO: 11006 - DNA, 20 bp, Artificial Sequence
  Synthetic oligonucleotide; GGG chr11 5246777 5246796 5246793 +
gtagtgactgcatttgaagt

SEQ ID NO: 11007 - DNA, 20 bp, Artificial Sequence
  Synthetic oligonucleotide; TGG chr11 5246795 5246814 5246811 +
gtgggacctttatgatatga

SEQ ID NO: 11008 - DNA, 20 bp, Artificial Sequence
  Synthetic oligonucleotide; GAG chr11 5246797 5246816 5246813 +
gggacctttatgatatgatg

SEQ ID NO: 11009 - DNA, 20 bp, Artificial Sequence
  Synthetic oligonucleotide; CAG chr11 5246801 5246820 5246817 +
cctttatgatatgatggagc

SEQ ID NO: 11010 - DNA, 20 bp, Artificial Sequence
  Synthetic oligonucleotide; AGG chr11 5246802 5246821 5246818 +
ctttatgatatgatggagcc

SEQ ID NO: 11011 - DNA, 20 bp, Artificial Sequence
  Synthetic oligonucleotide; CAG chr11 5246805 5246824 5246821 +
tatgatatgatggagccagg

SEQ ID NO: 11012 - DNA, 20 bp, Artificial Sequence
  Synthetic oligonucleotide; GAG chr11 5246807 5246826 5246823 +
tgatatgatggagccaggca

SEQ ID NO: 11013 - DNA, 20 bp, Artificial Sequence
  Synthetic oligonucleotide; TGG chr11 5246814 5246833 5246830 +
atggagccaggcagagatgt

SEQ ID NO: 11014 - DNA, 20 bp, Artificial Sequence
  Synthetic oligonucleotide; GAG chr11 5246816 5246835 5246832 +
ggagccaggcagagatgttg

SEQ ID NO: 11015 - DNA, 20 bp, Artificial Sequence
  Synthetic oligonucleotide; AAG chr11 5246819 5246838 5246835 +
gccaggcagagatgttggag

SEQ ID NO: 11016 - DNA, 20 bp, Artificial Sequence
  Synthetic oligonucleotide; AAG chr11 5246829 5246848 5246845 +
gatgttggagaagttcctga

SEQ ID NO: 11017 - DNA, 20 bp, Artificial Sequence
  Synthetic oligonucleotide; AAG chr11 5246832 5246851 5246848 +
gttggagaagttcctgaaag

SEQ ID NO: 11018 - DNA, 20 bp, Artificial Sequence
  Synthetic oligonucleotide; AGG chr11 5246833 5246852 5246849 +
ttggagaagttcctgaaaga

SEQ ID NO: 11019 - DNA, 20 bp, Artificial Sequence
  Synthetic oligonucleotide; AAG chr11 5246836 5246855 5246852 +
gagaagttcctgaaagaagg

SEQ ID NO: 11020 - DNA, 20 bp, Artificial Sequence
  Synthetic oligonucleotide; AGG chr11 5246837 5246856 5246853 +
agaagttcctgaaagaagga

SEQ ID NO: 11021 - DNA, 20 bp, Artificial Sequence
  Synthetic oligonucleotide; GGG chr11 5246838 5246857 5246854 +
gaagttcctgaaagaaggaa

SEQ ID NO: 11022 - DNA, 20 bp, Artificial Sequence
  Synthetic oligonucleotide; GAG chr11 5246856 5246875 5246872 +
aagggcatgtgccaaattct

SEQ ID NO: 11023 - DNA, 20 bp, Artificial Sequence
  Synthetic oligonucleotide; AGG chr11 5246857 5246876 5246873 +
agggcatgtgccaaattctg

SEQ ID NO: 11024 - DNA, 20 bp, Artificial Sequence
  Synthetic oligonucleotide; GAG chr11 5246862 5246881 5246878 +
atgtgccaaattctgaggct

SEQ ID NO: 11025 - DNA, 20 bp, Artificial Sequence
  Synthetic oligonucleotide; AGG chr11 5246863 5246882 5246879 +
tgtgccaaattctgaggctg

SEQ ID NO: 11026 - DNA, 20 bp, Artificial Sequence
  Synthetic oligonucleotide; GAG chr11 5246865 5246884 5246881 +
tgccaaattctgaggctgag

SEQ ID NO: 11027 - DNA, 20 bp, Artificial Sequence
  Synthetic oligonucleotide; AAG chr11 5246872 5246891 5246888 +
ttctgaggctgaggagaaaa

SEQ ID NO: 11028 - DNA, 20 bp, Artificial Sequence
  Synthetic oligonucleotide; AAG chr11 5246876 5246895 5246892 +
gaggctgaggagaaaaaaga

SEQ ID NO: 11029 - DNA, 20 bp, Artificial Sequence
  Synthetic oligonucleotide; AAG chr11 5246880 5246899 5246896 +
ctgaggagaaaaaagaaaga

SEQ ID NO: 11030 - DNA, 20 bp, Artificial Sequence
  Synthetic oligonucleotide; AAG chr11 5246888 5246907 5246904 +
aaaaaagaaagaaagaaaaa

SEQ ID NO: 11031 - DNA, 20 bp, Artificial Sequence
  Synthetic oligonucleotide; AAG chr11 5246895 5246914 5246911 +
aaagaaagaaaaaaagaata

SEQ ID NO: 11032 - DNA, 20 bp, Artificial Sequence
  Synthetic oligonucleotide; AAG chr11 5246921 5246940 5246937 +
tttacatttcactgtatgta

SEQ ID NO: 11033 - DNA, 20 bp, Artificial Sequence
  Synthetic oligonucleotide; AAG chr11 5246931 5246950 5246947 +
actgtatgtaaagacattac

SEQ ID NO: 11034 - DNA, 20 bp, Artificial Sequence
  Synthetic oligonucleotide; AGG chr11 5246932 5246951 5246948 +
ctgtatgtaaagacattaca

SEQ ID NO: 11035 - DNA, 20 bp, Artificial Sequence
  Synthetic oligonucleotide; TAG chr11 5246936 5246955 5246952 +
atgtaaagacattacaaggc

SEQ ID NO: 11036 - DNA, 20 bp, Artificial Sequence
  Synthetic oligonucleotide; GAG chr11 5246938 5246957 5246954 +
gtaaagacattacaaggcta

SEQ ID NO: 11037 - DNA, 20 bp, Artificial Sequence
  Synthetic oligonucleotide; AAG chr11 5246943 5246962 5246959 +
gacattacaaggctagagta

SEQ ID NO: 11038 - DNA, 20 bp, Artificial Sequence
  Synthetic oligonucleotide; AAG chr11 5246953 5246972 5246969 +
ggctagagtaaagcatgttg

SEQ ID NO: 11039 - DNA, 20 bp, Artificial Sequence
  Synthetic oligonucleotide; TAG chr11 5246962 5246981 5246978 +
aaagcatgttgaagtaaaaa

SEQ ID NO: 11040 - DNA, 20 bp, Artificial Sequence
  Synthetic oligonucleotide; AGG chr11 5246963 5246982 5246979 +
aagcatgttgaagtaaaaat

SEQ ID NO: 11041 - DNA, 20 bp, Artificial Sequence
  Synthetic oligonucleotide; GAG chr11 5246965 5246984 5246981 +
gcatgttgaagtaaaaatag

SEQ ID NO: 11042 - DNA, 20 bp, Artificial Sequence
  Synthetic oligonucleotide; AAG chr11 5246974 5246993 5246990 +
agtaaaaataggagaaatca

SEQ ID NO: 11043 - DNA, 20 bp, Artificial Sequence
  Synthetic oligonucleotide; TAG chr11 5246978 5246997 5246994 +
aaaataggagaaatcaaagt

SEQ ID NO: 11044 - DNA, 20 bp, Artificial Sequence
  Synthetic oligonucleotide; GAG chr11 5246980 5246999 5246996 +
aataggagaaatcaaagtta

SEQ ID NO: 11045 - DNA, 20 bp, Artificial Sequence
  Synthetic oligonucleotide; GAG chr11 5246982 5247001 5246998 +
taggagaaatcaaagttaga

SEQ ID NO: 11046 - DNA, 20 bp, Artificial Sequence
  Synthetic oligonucleotide; AAG chr11 5246985 5247004 5247001 +
gagaaatcaaagttagagag

SEQ ID NO: 11047 - DNA, 20 bp, Artificial Sequence
  Synthetic oligonucleotide; AGG chr11 5246986 5247005 5247002 +
agaaatcaaagttagagaga

SEQ ID NO: 11048 - DNA, 20 bp, Artificial Sequence
  Synthetic oligonucleotide; GGG chr11 5246987 5247006 5247003 +
gaaatcaaagttagagagaa

SEQ ID NO: 11049 - DNA, 20 bp, Artificial Sequence
  Synthetic oligonucleotide; CAG chr11 5246992 5247011 5247008 +
caaagttagagagaagggcg

SEQ ID NO: 11050 - DNA, 20 bp, Artificial Sequence
  Synthetic oligonucleotide; AGG chr11 5246993 5247012 5247009 +
aaagttagagagaagggcgc

SEQ ID NO: 11051 - DNA, 20 bp, Artificial Sequence
  Synthetic oligonucleotide; TGG chr11 5247005 5247024 5247021 +
aagggcgcaggcttattatt

SEQ ID NO: 11052 - DNA, 20 bp, Artificial Sequence
  Synthetic oligonucleotide; GGG chr11 5247006 5247025 5247022 +
agggcgcaggcttattattt

SEQ ID NO: 11053 - DNA, 20 bp, Artificial Sequence
  Synthetic oligonucleotide; TAG chr11 5247014 5247033 5247030 +
ggcttattatttgggtctta

SEQ ID NO: 11054 - DNA, 20 bp, Artificial Sequence
  Synthetic oligonucleotide; GAG chr11 5247019 5247038 5247035 +
attatttgggtcttatagat

SEQ ID NO: 11055 - DNA, 20 bp, Artificial Sequence
  Synthetic oligonucleotide; GAG chr11 5247021 5247040 5247037 +
tatttgggtcttatagatga

SEQ ID NO: 11056 - DNA, 20 bp, Artificial Sequence
  Synthetic oligonucleotide; TAG chr11 5247024 5247043 5247040 +
ttgggtcttatagatgagag

SEQ ID NO: 11057 - DNA, 20 bp, Artificial Sequence
  Synthetic oligonucleotide; TAG chr11 5247027 5247046 5247043 +
ggtcttatagatgagagtag

SEQ ID NO: 11058 - DNA, 20 bp, Artificial Sequence
  Synthetic oligonucleotide; GAG chr11 5247029 5247048 5247045 +
tcttatagatgagagtagta

SEQ ID NO: 11059 - DNA, 20 bp, Artificial Sequence
  Synthetic oligonucleotide; TAG chr11 5247032 5247051 5247048 +
tatagatgagagtagtagag

SEQ ID NO: 11060 - DNA, 20 bp, Artificial Sequence
  Synthetic oligonucleotide; AGG chr11 5247033 5247052 5247049 +
atagatgagagtagtagagt

SEQ ID NO: 11061 - DNA, 20 bp, Artificial Sequence
  Synthetic oligonucleotide; TAG chr11 5247053 5247072 5247069 +
aggtattttatactgaaaca

SEQ ID NO: 11062 - DNA, 20 bp, Artificial Sequence
  Synthetic oligonucleotide; AGG chr11 5247054 5247073 5247070 +
ggtattttatactgaaacat

SEQ ID NO: 11063 - DNA, 20 bp, Artificial Sequence
  Synthetic oligonucleotide; GGG chr11 5247055 5247074 5247071 +
gtattttatactgaaacata

SEQ ID NO: 11064 - DNA, 20 bp, Artificial Sequence
  Synthetic oligonucleotide; GGG chr11 5247056 5247075 5247072 +
tattttatactgaaacatag

SEQ ID NO: 11065 - DNA, 20 bp, Artificial Sequence
  Synthetic oligonucleotide; GAG chr11 5247061 5247080 5247077 +
tatactgaaacataggggac

SEQ ID NO: 11066 - DNA, 20 bp, Artificial Sequence
  Synthetic oligonucleotide; AGG chr11 5247062 5247081 5247078 +
atactgaaacataggggacg

SEQ ID NO: 11067 - DNA, 20 bp, Artificial Sequence
  Synthetic oligonucleotide; GGG chr11 5247063 5247082 5247079 +
tactgaaacataggggacga

SEQ ID NO: 11068 - DNA, 20 bp, Artificial Sequence
  Synthetic oligonucleotide; GGG chr11 5247064 5247083 5247080 +
actgaaacataggggacgag

SEQ ID NO: 11069 - DNA, 20 bp, Artificial Sequence
  Synthetic oligonucleotide; GAG chr11 5247066 5247085 5247082 +
tgaaacataggggacgaggg

SEQ ID NO: 11070 - DNA, 20 bp, Artificial Sequence
  Synthetic oligonucleotide; GAG chr11 5247081 5247100 5247097 +
gaggggagctttgcaaacct

SEQ ID NO: 11071 - DNA, 20 bp, Artificial Sequence
  Synthetic oligonucleotide; TGG chr11 5247091 5247110 5247107 +
ttgcaaacctgagataaaca

SEQ ID NO: 11072 - DNA, 20 bp, Artificial Sequence
  Synthetic oligonucleotide; TAG chr11 5247098 5247117 5247114 +
cctgagataaacatggtctg

SEQ ID NO: 11073 - DNA, 20 bp, Artificial Sequence
  Synthetic oligonucleotide; AAG chr11 5247115 5247134 5247131 +
ctgtagtccactcaaaaccc

SEQ ID NO: 11074 - DNA, 20 bp, Artificial Sequence
  Synthetic oligonucleotide; CAG chr11 5247151 5247170 5247167 +
ccttcttcatctgccttact

SEQ ID NO: 11075 - DNA, 20 bp, Artificial Sequence
  Synthetic oligonucleotide; AAG chr11 5247157 5247176 5247173 +
tcatctgccttactcagtgc

SEQ ID NO: 11076 - DNA, 20 bp, Artificial Sequence
  Synthetic oligonucleotide; AGG chr11 5247158 5247177 5247174 +
catctgccttactcagtgca

SEQ ID NO: 11077 - DNA, 20 bp, Artificial Sequence
  Synthetic oligonucleotide; AAG chr11 5247179 5247198 5247195 +
ggtgctataacaaaatacaa

SEQ ID NO: 11078 - DNA, 20 bp, Artificial Sequence
  Synthetic oligonucleotide; TGG chr11 5247184 5247203 5247200 +
tataacaaaatacaaaagac

SEQ ID NO: 11079 - DNA, 20 bp, Artificial Sequence
  Synthetic oligonucleotide; GGG chr11 5247185 5247204 5247201 +
ataacaaaatacaaaagact

SEQ ID NO: 11080 - DNA, 20 bp, Artificial Sequence
  Synthetic oligonucleotide; TGG chr11 5247188 5247207 5247204 +
acaaaatacaaaagactggg

SEQ ID NO: 11081 - DNA, 20 bp, Artificial Sequence
  Synthetic oligonucleotide; CAG chr11 5247200 5247219 5247216 +
agactgggtggcttcaacaa

SEQ ID NO: 11082 - DNA, 20 bp, Artificial Sequence
  Synthetic oligonucleotide; GAG chr11 5247202 5247221 5247218 +
actgggtggcttcaacaaca

SEQ ID NO: 11083 - DNA, 20 bp, Artificial Sequence
  Synthetic oligonucleotide; AAG chr11 5247223 5247242 5247239 +
agttttttctcacatttctg

SEQ ID NO: 11084 - DNA, 20 bp, Artificial Sequence
  Synthetic oligonucleotide; AGG chr11 5247224 5247243 5247240 +
gttttttctcacatttctga

SEQ ID NO: 11085 - DNA, 20 bp, Artificial Sequence
  Synthetic oligonucleotide; TGG chr11 5247235 5247254 5247251 +
catttctgaaggctgactcg

SEQ ID NO: 11086 - DNA, 20 bp, Artificial Sequence
  Synthetic oligonucleotide; CAG chr11 5247239 5247258 5247255 +
tctgaaggctgactcgtggt

SEQ ID NO: 11087 - DNA, 20 bp, Artificial Sequence
  Synthetic oligonucleotide; AGG chr11 5247240 5247259 5247256 +
ctgaaggctgactcgtggtc

SEQ ID NO: 11088 - DNA, 20 bp, Artificial Sequence
  Synthetic oligonucleotide; GGG chr11 5247241 5247260 5247257 +
tgaaggctgactcgtggtca

SEQ ID NO: 11089 - DNA, 20 bp, Artificial Sequence
  Synthetic oligonucleotide; TGG chr11 5247253 5247272 5247269 +
cgtggtcagggttctcttcc

SEQ ID NO: 11090 - DNA, 20 bp, Artificial Sequence
  Synthetic oligonucleotide; CAG chr11 5247260 5247279 5247276 +
agggttctcttcctggattg

SEQ ID NO: 11091 - DNA, 20 bp, Artificial Sequence
  Synthetic oligonucleotide; TGG chr11 5247264 5247283 5247280 +
ttctcttcctggattgcaga

SEQ ID NO: 11092 - DNA, 20 bp, Artificial Sequence
  Synthetic oligonucleotide; CGG chr11 5247267 5247286 5247283 +
tcttcctggattgcagatgg

SEQ ID NO: 11093 - DNA, 20 bp, Artificial Sequence
  Synthetic oligonucleotide; CGG chr11 5247290 5247309 5247306 +
acttctcactgtgtcctcac

SEQ ID NO: 11094 - DNA, 20 bp, Artificial Sequence
  Synthetic oligonucleotide; GGG chr11 5247291 5247310 5247307 +
cttctcactgtgtcctcacc

SEQ ID NO: 11095 - DNA, 20 bp, Artificial Sequence
  Synthetic oligonucleotide; GAG chr11 5247293 5247312 5247309 +
tctcactgtgtcctcaccgg

SEQ ID NO: 11096 - DNA, 20 bp, Artificial Sequence
  Synthetic oligonucleotide; AGG chr11 5247294 5247313 5247310 +
ctcactgtgtcctcaccggg

SEQ ID NO: 11097 - DNA, 20 bp, Artificial Sequence
  Synthetic oligonucleotide; AAG chr11 5247298 5247317 5247314 +
ctgtgtcctcaccgggagga

SEQ ID NO: 11098 - DNA, 20 bp, Artificial Sequence
  Synthetic oligonucleotide; GAG chr11 5247300 5247319 5247316 +
gtgtcctcaccgggaggaaa

SEQ ID NO: 11099 - DNA, 20 bp, Artificial Sequence
  Synthetic oligonucleotide; TGG chr11 5247306 5247325 5247322 +
tcaccgggaggaaagagaaa

SEQ ID NO: 11100 - DNA, 20 bp, Artificial Sequence
  Synthetic oligonucleotide; AAG chr11 5247329 5247348 5247345 +
cttgtctctctgcttctgat

SEQ ID NO: 11101 - DNA, 20 bp, Artificial Sequence
  Synthetic oligonucleotide; AGG chr11 5247330 5247349 5247346 +
ttgtctctctgcttctgata

SEQ ID NO: 11102 - DNA, 20 bp, Artificial Sequence
  Synthetic oligonucleotide; TGG chr11 5247348 5247367 5247364 +
taaggaaaataattttatga

SEQ ID NO: 11103 - DNA, 20 bp, Artificial Sequence
  Synthetic oligonucleotide; GGG chr11 5247349 5247368 5247365 +
aaggaaaataattttatgat

SEQ ID NO: 11104 - DNA, 20 bp, Artificial Sequence
  Synthetic oligonucleotide; GGG chr11 5247350 5247369 5247366 +
aggaaaataattttatgatg

SEQ ID NO: 11105 - DNA, 20 bp, Artificial Sequence
  Synthetic oligonucleotide; GAG chr11 5247365 5247384 5247381 +
tgatggggatctgctcttat

SEQ ID NO: 11106 - DNA, 20 bp, Artificial Sequence
  Synthetic oligonucleotide; AAG chr11 5247394 5247413 5247410 +
taaacctaattacttttcaa

SEQ ID NO: 11107 - DNA, 20 bp, Artificial Sequence
  Synthetic oligonucleotide; CAG chr11 5247406 5247425 5247422 +
cttttcaaaagcctccccca

SEQ ID NO: 11108 - DNA, 20 bp, Artificial Sequence
  Synthetic oligonucleotide; AAG chr11 5247411 5247430 5247427 +
caaaagcctcccccacagat

SEQ ID NO: 11109 - DNA, 20 bp, Artificial Sequence
  Synthetic oligonucleotide; AGG chr11 5247412 5247431 5247428 +
aaaagcctcccccacagata

SEQ ID NO: 11110 - DNA, 20 bp, Artificial Sequence
  Synthetic oligonucleotide; CAG chr11 5247416 5247435 5247432 +
gcctcccccacagataaggt

SEQ ID NO: 11111 - DNA, 20 bp, Artificial Sequence
  Synthetic oligonucleotide; TGG chr11 5247420 5247439 5247436 +
cccccacagataaggtcagt

SEQ ID NO: 11112 - DNA, 20 bp, Artificial Sequence
  Synthetic oligonucleotide; GGG chr11 5247421 5247440 5247437 +
ccccacagataaggtcagtt

SEQ ID NO: 11113 - DNA, 20 bp, Artificial Sequence
  Synthetic oligonucleotide; GAG chr11 5247423 5247442 5247439 +
ccacagataaggtcagttgg

SEQ ID NO: 11114 - DNA, 20 bp, Artificial Sequence
  Synthetic oligonucleotide; TGG chr11 5247427 5247446 5247443 +
agataaggtcagttgggagt

SEQ ID NO: 11115 - DNA, 20 bp, Artificial Sequence
  Synthetic oligonucleotide; GGG chr11 5247428 5247447 5247444 +
gataaggtcagttgggagtt

SEQ ID NO: 11116 - DNA, 20 bp, Artificial Sequence
  Synthetic oligonucleotide; GGG chr11 5247429 5247448 5247445 +
ataaggtcagttgggagttg

SEQ ID NO: 11117 - DNA, 20 bp, Artificial Sequence
  Synthetic oligonucleotide; CAG chr11 5247435 5247454 5247451 +
tcagttgggagttggggatt

SEQ ID NO: 11118 - DNA, 20 bp, Artificial Sequence
  Synthetic oligonucleotide; GAG chr11 5247450 5247469 5247466 +
ggattcagcatgtgaatttt

SEQ ID NO: 11119 - DNA, 20 bp, Artificial Sequence
  Synthetic oligonucleotide; AGG chr11 5247451 5247470 5247467 +
gattcagcatgtgaattttg

SEQ ID NO: 11120 - DNA, 20 bp, Artificial Sequence
  Synthetic oligonucleotide; GAG chr11 5247453 5247472 5247469 +
ttcagcatgtgaattttgag

SEQ ID NO: 11121 - DNA, 20 bp, Artificial Sequence
  Synthetic oligonucleotide; TAG chr11 5247466 5247485 5247482 +
ttttgaggagacacaaacat

SEQ ID NO: 11122 - DNA, 20 bp, Artificial Sequence
  Synthetic oligonucleotide; AGG chr11 5247467 5247486 5247483 +
tttgaggagacacaaacatt

SEQ ID NO: 11123 - DNA, 20 bp, Artificial Sequence
  Synthetic oligonucleotide; TAG chr11 5247502 5247521 5247518 +
tcatattaaactcttactta

SEQ ID NO: 11124 - DNA, 20 bp, Artificial Sequence
  Synthetic oligonucleotide; GAG chr11 5247504 5247523 5247520 +
atattaaactcttacttata

SEQ ID NO: 11125 - DNA, 20 bp, Artificial Sequence
  Synthetic oligonucleotide; AAG chr11 5247541 5247560 5247557 +
aactatacaaaaattccatt

SEQ ID NO: 11126 - DNA, 20 bp, Artificial Sequence
  Synthetic oligonucleotide; AAG chr11 5247545 5247564 5247561 +
atacaaaaattccattaagt

SEQ ID NO: 11127 - DNA, 20 bp, Artificial Sequence
  Synthetic oligonucleotide; CAG chr11 5247596 5247615 5247612 +
cccactacattttgatctca

SEQ ID NO: 11128 - DNA, 20 bp, Artificial Sequence
  Synthetic oligonucleotide; TGG chr11 5247602 5247621 5247618 +
acattttgatctcacagtgc

SEQ ID NO: 11129 - DNA, 20 bp, Artificial Sequence
  Synthetic oligonucleotide; CAG chr11 5247614 5247633 5247630 +
cacagtgctggtctgtttct

SEQ ID NO: 11130 - DNA, 20 bp, Artificial Sequence
  Synthetic oligonucleotide; GAG chr11 5247642 5247661 5247658 +
acatgctcatgctgacttgt

SEQ ID NO: 11131 - DNA, 20 bp, Artificial Sequence
  Synthetic oligonucleotide; AAG chr11 5247671 5247690 5247687 +
ctgattcatttcttacacct

SEQ ID NO: 11132 - DNA, 20 bp, Artificial Sequence
  Synthetic oligonucleotide; CAG chr11 5247687 5247706 5247703 +
acctaagtccccacctcccc

SEQ ID NO: 11133 - DNA, 20 bp, Artificial Sequence
  Synthetic oligonucleotide; GAG chr11 5247689 5247708 5247705 +
ctaagtccccacctccccca

SEQ ID NO: 11134 - DNA, 20 bp, Artificial Sequence
  Synthetic oligonucleotide; GAG chr11 5247701 5247720 5247717 +
ctcccccagagtcttacaat

SEQ ID NO: 11135 - DNA, 20 bp, Artificial Sequence
  Synthetic oligonucleotide; AGG chr11 5247702 5247721 5247718 +
tcccccagagtcttacaatg

SEQ ID NO: 11136 - DNA, 20 bp, Artificial Sequence
  Synthetic oligonucleotide; GAG chr11 5247742 5247761 5247758 +
tgtgaccaatctgcacactt

SEQ ID NO: 11137 - DNA, 20 bp, Artificial Sequence
  Synthetic oligonucleotide; AGG chr11 5247743 5247762 5247759 +
gtgaccaatctgcacacttg

SEQ ID NO: 11138 - DNA, 20 bp, Artificial Sequence
  Synthetic oligonucleotide; GGG chr11 5247744 5247763 5247760 +
tgaccaatctgcacacttga

SEQ ID NO: 11139 - DNA, 20 bp, Artificial Sequence
  Synthetic oligonucleotide; TGG chr11 5247749 5247768 5247765 +
aatctgcacacttgagggca

SEQ ID NO: 11140 - DNA, 20 bp, Artificial Sequence
  Synthetic oligonucleotide; GGG chr11 5247750 5247769 5247766 +
atctgcacacttgagggcat

SEQ ID NO: 11141 - DNA, 20 bp, Artificial Sequence
  Synthetic oligonucleotide; TAG chr11 5247769 5247788 5247785 +
tgggattaatttcactttct

SEQ ID NO: 11142 - DNA, 20 bp, Artificial Sequence
  Synthetic oligonucleotide; AGG chr11 5247770 5247789 5247786 +
gggattaatttcactttctt

SEQ ID NO: 11143 - DNA, 20 bp, Artificial Sequence
  Synthetic oligonucleotide; AAG chr11 5247780 5247799 5247796 +
tcactttcttaggcatccac

SEQ ID NO: 11144 - DNA, 20 bp, Artificial Sequence
  Synthetic oligonucleotide; AGG chr11 5247781 5247800 5247797 +
cactttcttaggcatccaca

SEQ ID NO: 11145 - DNA, 20 bp, Artificial Sequence
  Synthetic oligonucleotide; GGG chr11 5247782 5247801 5247798 +
actttcttaggcatccacaa

SEQ ID NO: 11146 - DNA, 20 bp, Artificial Sequence
  Synthetic oligonucleotide; AAG chr11 5247792 5247811 5247808 +
gcatccacaagggctgtgaa

SEQ ID NO: 11147 - DNA, 20 bp, Artificial Sequence
  Synthetic oligonucleotide; AAG chr11 5247797 5247816 5247813 +
cacaagggctgtgaaaagct

SEQ ID NO: 11148 - DNA, 20 bp, Artificial Sequence
  Synthetic oligonucleotide; TAG chr11 5247806 5247825 5247822 +
tgtgaaaagctaagtgccat

SEQ ID NO: 11149 - DNA, 20 bp, Artificial Sequence
  Synthetic oligonucleotide; TAG chr11 5247812 5247831 5247828 +
aagctaagtgccattagaaa

SEQ ID NO: 11150 - DNA, 20 bp, Artificial Sequence
  Synthetic oligonucleotide; TAG chr11 5247832 5247851 5247848 +
tagtattcctcctaataaaa

SEQ ID NO: 11151 - DNA, 20 bp, Artificial Sequence
  Synthetic oligonucleotide; AAG chr11 5247868 5247887 5247884 +
gactaaaccttgaattccta

SEQ ID NO: 11152 - DNA, 20 bp, Artificial Sequence
  Synthetic oligonucleotide; TGG chr11 5247873 5247892 5247889 +
aaccttgaattcctaaagct

SEQ ID NO: 11153 - DNA, 20 bp, Artificial Sequence
  Synthetic oligonucleotide; AAG chr11 5247893 5247912 5247909 +
tggaacactttcccttcctt

SEQ ID NO: 11154 - DNA, 20 bp, Artificial Sequence
  Synthetic oligonucleotide; CAG chr11 5247912 5247931 5247928 +
taagaaccatccttgctact

SEQ ID NO: 11155 - DNA, 20 bp, Artificial Sequence
  Synthetic oligonucleotide; CAG chr11 5247927 5247946 5247943 +
ctactcagctgcaatcaatc

SEQ ID NO: 11156 - DNA, 20 bp, Artificial Sequence
  Synthetic oligonucleotide; CAG chr11 5247934 5247953 5247950 +
gctgcaatcaatccagcccc

SEQ ID NO: 11157 - DNA, 20 bp, Artificial Sequence
  Synthetic oligonucleotide; AGG chr11 5247935 5247954 5247951 +
ctgcaatcaatccagccccc

SEQ ID NO: 11158 - DNA, 20 bp, Artificial Sequence
  Synthetic oligonucleotide; GAG chr11 5247982 5248001 5247998 +
cttccaaaacatctgtttct

SEQ ID NO: 11159 - DNA, 20 bp, Artificial Sequence
  Synthetic oligonucleotide; AAG chr11 5247985 5248004 5248001 +
ccaaaacatctgtttctgag

SEQ ID NO: 11160 - DNA, 20 bp, Artificial Sequence
  Synthetic oligonucleotide; TAG chr11 5247998 5248017 5248014 +
ttctgagaagtcctgtccta

SEQ ID NO: 11161 - DNA, 20 bp, Artificial Sequence
  Synthetic oligonucleotide; GAG chr11 5248000 5248019 5248016 +
ctgagaagtcctgtcctata

SEQ ID NO: 11162 - DNA, 20 bp, Artificial Sequence
  Synthetic oligonucleotide; AGG chr11 5248001 5248020 5248017 +
tgagaagtcctgtcctatag

SEQ ID NO: 11163 - DNA, 20 bp, Artificial Sequence
  Synthetic oligonucleotide; CGG chr11 5248017 5248036 5248033 +
atagaggtctttcttcccac

SEQ ID NO: 11164 - DNA, 20 bp, Artificial Sequence
  Synthetic oligonucleotide; CAG chr11 5248049 5248068 5248065 +
acaccatttactcccacttg

SEQ ID NO: 11165 - DNA, 20 bp, Artificial Sequence
  Synthetic oligonucleotide; AAG chr11 5248065 5248084 5248081 +
cttgcagaactcccgtgtac

SEQ ID NO: 11166 - DNA, 20 bp, Artificial Sequence
  Synthetic oligonucleotide; GAG chr11 5248123 5248142 5248139 +
catctcatataaaaataaat

SEQ ID NO: 11167 - DNA, 20 bp, Artificial Sequence
  Synthetic oligonucleotide; AGG chr11 5248124 5248143 5248140 +
atctcatataaaaataaatg

SEQ ID NO: 11168 - DNA, 20 bp, Artificial Sequence
  Synthetic oligonucleotide; GAG chr11 5248126 5248145 5248142 +
ctcatataaaaataaatgag

SEQ ID NO: 11169 - DNA, 20 bp, Artificial Sequence
  Synthetic oligonucleotide; CAG chr11 5248152 5248171 5248168 +
gcacacaccacaaacacaaa

SEQ ID NO: 11170 - DNA, 20 bp, Artificial Sequence
  Synthetic oligonucleotide; AGG chr11 5248153 5248172 5248169 +
cacacaccacaaacacaaac

SEQ ID NO: 11171 - DNA, 20 bp, Artificial Sequence
  Synthetic oligonucleotide; CAG chr11 5248160 5248179 5248176 +
cacaaacacaaacaggcatg

SEQ ID NO: 11172 - DNA, 20 bp, Artificial Sequence
  Synthetic oligonucleotide; TGG chr11 5248201 5248220 5248217 +
ccctcaatataaaccctttg

SEQ ID NO: 11173 - DNA, 20 bp, Artificial Sequence
  Synthetic oligonucleotide; AAG chr11 5248218 5248237 5248234 +
ttgtggctcatatatttaaa

SEQ ID NO: 11174 - DNA, 20 bp, Artificial Sequence
  Synthetic oligonucleotide; AAG chr11 5248231 5248250 5248247 +
atttaaaaagatgtaaaaaa

SEQ ID NO: 11175 - DNA, 20 bp, Artificial Sequence
  Synthetic oligonucleotide; GAG chr11 5248233 5248252 5248249 +
ttaaaaagatgtaaaaaaaa

SEQ ID NO: 11176 - DNA, 20 bp, Artificial Sequence
  Synthetic oligonucleotide; AAG chr11 5248239 5248258 5248255 +
agatgtaaaaaaaagagctg

SEQ ID NO: 11177 - DNA, 20 bp, Artificial Sequence
  Synthetic oligonucleotide; CAG chr11 5248261 5248280 5248277 +
gaaaatcatgtgtgatctct

SEQ ID NO: 11178 - DNA, 20 bp, Artificial Sequence
  Synthetic oligonucleotide; CAG chr11 5248264 5248283 5248280 +
aatcatgtgtgatctctcag

SEQ ID NO: 11179 - DNA, 20 bp, Artificial Sequence
  Synthetic oligonucleotide; TAG chr11 5248269 5248288 5248285 +
tgtgtgatctctcagcagaa

SEQ ID NO: 11180 - DNA, 20 bp, Artificial Sequence
  Synthetic oligonucleotide; CAG chr11 5248293 5248312 5248309 +
tttattatttgtattgcttg

SEQ ID NO: 11181 - DNA, 20 bp, Artificial Sequence
  Synthetic oligonucleotide; AAG chr11 5248300 5248319 5248316 +
tttgtattgcttgcagaata

SEQ ID NO: 11182 - DNA, 20 bp, Artificial Sequence
  Synthetic oligonucleotide; AAG chr11 5248314 5248333 5248330 +
agaataaagcctatccttga

SEQ ID NO: 11183 - DNA, 20 bp, Artificial Sequence
  Synthetic oligonucleotide; TGG chr11 5248327 5248346 5248343 +
tccttgaaagctctgaatca

SEQ ID NO: 11184 - DNA, 20 bp, Artificial Sequence
  Synthetic oligonucleotide; GGG chr11 5248328 5248347 5248344 +
ccttgaaagctctgaatcat

SEQ ID NO: 11185 - DNA, 20 bp, Artificial Sequence
  Synthetic oligonucleotide; CAG chr11 5248331 5248350 5248347 +
tgaaagctctgaatcatggg

SEQ ID NO: 11186 - DNA, 20 bp, Artificial Sequence
  Synthetic oligonucleotide; GAG chr11 5248335 5248354 5248351 +
agctctgaatcatgggcagt

SEQ ID NO: 11187 - DNA, 20 bp, Artificial Sequence
  Synthetic oligonucleotide; CAG chr11 5248340 5248359 5248356 +
tgaatcatgggcagtgagct

SEQ ID NO: 11188 - DNA, 20 bp, Artificial Sequence
  Synthetic oligonucleotide; TGG chr11 5248343 5248362 5248359 +
atcatgggcagtgagctcag

SEQ ID NO: 11189 - DNA, 20 bp, Artificial Sequence
  Synthetic oligonucleotide; TGG chr11 5248350 5248369 5248366 +
gcagtgagctcagtggtatc

SEQ ID NO: 11190 - DNA, 20 bp, Artificial Sequence
  Synthetic oligonucleotide; GAG chr11 5248352 5248371 5248368 +
agtgagctcagtggtatctg

SEQ ID NO: 11191 - DNA, 20 bp, Artificial Sequence
  Synthetic oligonucleotide; AGG chr11 5248353 5248372 5248369 +
gtgagctcagtggtatctgg

SEQ ID NO: 11192 - DNA, 20 bp, Artificial Sequence
  Synthetic oligonucleotide; CAG chr11 5248357 5248376 5248373 +
gctcagtggtatctggagga

SEQ ID NO: 11193 - DNA, 20 bp, Artificial Sequence
  Synthetic oligonucleotide; AGG chr11 5248358 5248377 5248374 +
ctcagtggtatctggaggac

SEQ ID NO: 11194 - DNA, 20 bp, Artificial Sequence
  Synthetic oligonucleotide; GGG chr11 5248359 5248378 5248375 +
tcagtggtatctggaggaca

SEQ ID NO: 11195 - DNA, 20 bp, Artificial Sequence
  Synthetic oligonucleotide; TGG chr11 5248365 5248384 5248381 +
gtatctggaggacagggcac

SEQ ID NO: 11196 - DNA, 20 bp, Artificial Sequence
  Synthetic oligonucleotide; CAG chr11 5248374 5248393 5248390 +
ggacagggcactggccactg

SEQ ID NO: 11197 - DNA, 20 bp, Artificial Sequence
  Synthetic oligonucleotide; CAG chr11 5248391 5248410 5248407 +
ctgcagtcaccatcttctgc

SEQ ID NO: 11198 - DNA, 20 bp, Artificial Sequence
  Synthetic oligonucleotide; AGG chr11 5248392 5248411 5248408 +
tgcagtcaccatcttctgcc

SEQ ID NO: 11199 - DNA, 20 bp, Artificial Sequence
  Synthetic oligonucleotide; AAG chr11 5248395 5248414 5248411 +
agtcaccatcttctgccagg

SEQ ID NO: 11200 - DNA, 20 bp, Artificial Sequence
  Synthetic oligonucleotide; CAG chr11 5248407 5248426 5248423 +
ctgccaggaagcctgcacct

SEQ ID NO: 11201 - DNA, 20 bp, Artificial Sequence
  Synthetic oligonucleotide; AGG chr11 5248408 5248427 5248424 +
tgccaggaagcctgcacctc

SEQ ID NO: 11202 - DNA, 20 bp, Artificial Sequence
  Synthetic oligonucleotide; GGG chr11 5248409 5248428 5248425 +
gccaggaagcctgcacctca

SEQ ID NO: 11203 - DNA, 20 bp, Artificial Sequence
  Synthetic oligonucleotide; GGG chr11 5248410 5248429 5248426 +
ccaggaagcctgcacctcag

SEQ ID NO: 11204 - DNA, 20 bp, Artificial Sequence
  Synthetic oligonucleotide; TGG chr11 5248430 5248449 5248446 +
gggtgaattctttgccgaaa

SEQ ID NO: 11205 - DNA, 20 bp, Artificial Sequence
  Synthetic oligonucleotide; CGG chr11 5248443 5248462 5248459 +
gccgaaatggattgccaaaa

SEQ ID NO: 11206 - DNA, 20 bp, Artificial Sequence
  Synthetic oligonucleotide; CAG chr11 5248450 5248469 5248466 +
tggattgccaaaacggtcac

SEQ ID NO: 11207 - DNA, 20 bp, Artificial Sequence
  Synthetic oligonucleotide; CAG chr11 5248462 5248481 5248478 +
acggtcaccagcacatttcc

SEQ ID NO: 11208 - DNA, 20 bp, Artificial Sequence
  Synthetic oligonucleotide; AGG chr11 5248463 5248482 5248479 +
cggtcaccagcacatttccc

SEQ ID NO: 11209 - DNA, 20 bp, Artificial Sequence
  Synthetic oligonucleotide; GAG chr11 5248465 5248484 5248481 +
gtcaccagcacatttcccag

SEQ ID NO: 11210 - DNA, 20 bp, Artificial Sequence
  Synthetic oligonucleotide; GAG chr11 5248473 5248492 5248489 +
cacatttcccaggagctgtt

SEQ ID NO: 11211 - DNA, 20 bp, Artificial Sequence
  Synthetic oligonucleotide; AAG chr11 5248480 5248499 5248496 +
cccaggagctgttgagatga

SEQ ID NO: 11212 - DNA, 20 bp, Artificial Sequence
  Synthetic oligonucleotide; AGG chr11 5248481 5248500 5248497 +
ccaggagctgttgagatgaa

SEQ ID NO: 11213 - DNA, 20 bp, Artificial Sequence
  Synthetic oligonucleotide; GAG chr11 5248483 5248502 5248499 +
aggagctgttgagatgaaag

SEQ ID NO: 11214 - DNA, 20 bp, Artificial Sequence
  Synthetic oligonucleotide; AAG chr11 5248492 5248511 5248508 +
tgagatgaaaggagacaata

SEQ ID NO: 11215 - DNA, 20 bp, Artificial Sequence
  Synthetic oligonucleotide; TAG chr11 5248504 5248523 5248520 +
agacaataaagatgaaccca

SEQ ID NO: 11216 - DNA, 20 bp, Artificial Sequence
  Synthetic oligonucleotide; GAG chr11 5248508 5248527 5248524 +
aataaagatgaacccatagt

SEQ ID NO: 11217 - DNA, 20 bp, Artificial Sequence
  Synthetic oligonucleotide; GAG chr11 5248513 5248532 5248529 +
agatgaacccatagtgagct

SEQ ID NO: 11218 - DNA, 20 bp, Artificial Sequence
  Synthetic oligonucleotide; GAG chr11 5248515 5248534 5248531 +
atgaacccatagtgagctga

SEQ ID NO: 11219 - DNA, 20 bp, Artificial Sequence
  Synthetic oligonucleotide; CAG chr11 5248521 5248540 5248537 +
ccatagtgagctgagagctc

SEQ ID NO: 11220 - DNA, 20 bp, Artificial Sequence
  Synthetic oligonucleotide; TGG chr11 5248526 5248545 5248542 +
gtgagctgagagctccagcc

SEQ ID NO: 11221 - DNA, 20 bp, Artificial Sequence
  Synthetic oligonucleotide; CAG chr11 5248533 5248552 5248549 +
gagagctccagcctggcctc

SEQ ID NO: 11222 - DNA, 20 bp, Artificial Sequence
  Synthetic oligonucleotide; AAG chr11 5248549 5248568 5248565 +
cctccagataactacacacc

SEQ ID NO: 11223 - DNA, 20 bp, Artificial Sequence
  Synthetic oligonucleotide; CAG chr11 5248560 5248579 5248576 +
ctacacaccaagcttccacc

SEQ ID NO: 11224 - DNA, 20 bp, Artificial Sequence
  Synthetic oligonucleotide; AAG chr11 5248567 5248586 5248583 +
ccaagcttccacccagaatc

SEQ ID NO: 11225 - DNA, 20 bp, Artificial Sequence
  Synthetic oligonucleotide; AAG chr11 5248589 5248608 5248605 +
gcctatgttaacttccctca

SEQ ID NO: 11226 - DNA, 20 bp, Artificial Sequence
  Synthetic oligonucleotide; GAG chr11 5248595 5248614 5248611 +
gttaacttccctcaaagcct

SEQ ID NO: 11227 - DNA, 20 bp, Artificial Sequence
  Synthetic oligonucleotide; CAG chr11 5248619 5248638 5248635 +
ttttgccttcccattaaatg

SEQ ID NO: 11228 - DNA, 20 bp, Artificial Sequence
  Synthetic oligonucleotide; AGG chr11 5248620 5248639 5248636 +
tttgccttcccattaaatgc

SEQ ID NO: 11229 - DNA, 20 bp, Artificial Sequence
  Synthetic oligonucleotide; TAG chr11 5248623 5248642 5248639 +
gccttcccattaaatgcagg

SEQ ID NO: 11230 - DNA, 20 bp, Artificial Sequence
  Synthetic oligonucleotide; AAG chr11 5248638 5248657 5248654 +
gcaggtagttgttccccttc

SEQ ID NO: 11231 - DNA, 20 bp, Artificial Sequence
  Synthetic oligonucleotide; TAG chr11 5248644 5248663 5248660 +
agttgttccccttcaagcac

SEQ ID NO: 11232 - DNA, 20 bp, Artificial Sequence
  Synthetic oligonucleotide; TGG chr11 5248651 5248670 5248667 +
ccccttcaagcactagtcac

SEQ ID NO: 11233 - DNA, 20 bp, Artificial Sequence
  Synthetic oligonucleotide; TAG chr11 5248704 5248723 5248720 +
accatgaaccctgtatgttg

SEQ ID NO: 11234 - DNA, 20 bp, Artificial Sequence
  Synthetic oligonucleotide; AGG chr11 5248705 5248724 5248721 +
ccatgaaccctgtatgttgt

SEQ ID NO: 11235 - DNA, 20 bp, Artificial Sequence
  Synthetic oligonucleotide; AAG chr11 5248711 5248730 5248727 +
accctgtatgttgtaggctg

SEQ ID NO: 11236 - DNA, 20 bp, Artificial Sequence
  Synthetic oligonucleotide; AAG chr11 5248721 5248740 5248737 +
ttgtaggctgaagacgttaa

SEQ ID NO: 11237 - DNA, 20 bp, Artificial Sequence
  Synthetic oligonucleotide; CAG chr11 5248779 5248798 5248795 +
cgcacacacacacacacaca

SEQ ID NO: 11238 - DNA, 20 bp, Artificial Sequence
  Synthetic oligonucleotide; GAG chr11 5248781 5248800 5248797 +
cacacacacacacacacaca

SEQ ID NO: 11239 - DNA, 20 bp, Artificial Sequence
  Synthetic oligonucleotide; CAG chr11 5248804 5248823 5248820 +
ctgactttcaaaatctactc

SEQ ID NO: 11240 - DNA, 20 bp, Artificial Sequence
  Synthetic oligonucleotide; TGG chr11 5248835 5248854 5248851 +
tttcaattgttcctcacccc

SEQ ID NO: 11241 - DNA, 20 bp, Artificial Sequence
  Synthetic oligonucleotide; TGG chr11 5248856 5248875 5248872 +
ggacatactttgcccccatc

SEQ ID NO: 11242 - DNA, 20 bp, Artificial Sequence
  Synthetic oligonucleotide; AAG chr11 5248864 5248883 5248880 +
tttgcccccatctggaatta

SEQ ID NO: 11243 - DNA, 20 bp, Artificial Sequence
  Synthetic oligonucleotide; AGG chr11 5248865 5248884 5248881 +
ttgcccccatctggaattaa

SEQ ID NO: 11244 - DNA, 20 bp, Artificial Sequence
  Synthetic oligonucleotide; AAG chr11 5248872 5248891 5248888 +
catctggaattaaaggatat

SEQ ID NO: 11245 - DNA, 20 bp, Artificial Sequence
  Synthetic oligonucleotide; AAG chr11 5248884 5248903 5248900 +
aaggatataagtttgtaatg

SEQ ID NO: 11246 - DNA, 20 bp, Artificial Sequence
  Synthetic oligonucleotide; TAG chr11 5248890 5248909 5248906 +
ataagtttgtaatgaagcat

SEQ ID NO: 11247 - DNA, 20 bp, Artificial Sequence
  Synthetic oligonucleotide; CAG chr11 5248893 5248912 5248909 +
agtttgtaatgaagcattag

SEQ ID NO: 11248 - DNA, 20 bp, Artificial Sequence
  Synthetic oligonucleotide; CAG chr11 5248911 5248930 5248927 +
agcagcattttatatgtgtc

SEQ ID NO: 11249 - DNA, 20 bp, Artificial Sequence
  Synthetic oligonucleotide; TAG chr11 5248920 5248939 5248936 +
ttatatgtgtccagctgata

SEQ ID NO: 11250 - DNA, 20 bp, Artificial Sequence
  Synthetic oligonucleotide; AGG chr11 5248921 5248940 5248937 +
tatatgtgtccagctgatat

SEQ ID NO: 11251 - DNA, 20 bp, Artificial Sequence
  Synthetic oligonucleotide; TAG chr11 5248926 5248945 5248942 +
gtgtccagctgatataggaa

SEQ ID NO: 11252 - DNA, 20 bp, Artificial Sequence
  Synthetic oligonucleotide; TAG chr11 5248932 5248951 5248948 +
agctgatataggaatagcct

SEQ ID NO: 11253 - DNA, 20 bp, Artificial Sequence
  Synthetic oligonucleotide; TGG chr11 5248946 5248965 5248962 +
tagccttagcaatgtatgtt

SEQ ID NO: 11254 - DNA, 20 bp, Artificial Sequence
  Synthetic oligonucleotide; AAG chr11 5248955 5248974 5248971 +
caatgtatgtttggccacca

SEQ ID NO: 11255 - DNA, 20 bp, Artificial Sequence
  Synthetic oligonucleotide; GAG chr11 5248973 5248992 5248989 +
caaagttccccactttgact

SEQ ID NO: 11256 - DNA, 20 bp, Artificial Sequence
  Synthetic oligonucleotide; CAG chr11 5249029 5249048 5249045 +
gaccatacttgtcctgcctc

SEQ ID NO: 11257 - DNA, 20 bp, Artificial Sequence
  Synthetic oligonucleotide; TAG chr11 5249033 5249052 5249049 +
atacttgtcctgcctccaga

SEQ ID NO: 11258 - DNA, 20 bp, Artificial Sequence
  Synthetic oligonucleotide; GAG chr11 5249057 5249076 5249073 +
tgttttaaaacaacaaaaat

SEQ ID NO: 11259 - DNA, 20 bp, Artificial Sequence
  Synthetic oligonucleotide; AGG chr11 5249058 5249077 5249074 +
gttttaaaacaacaaaaatg

SEQ ID NO: 11260 - DNA, 20 bp, Artificial Sequence
  Synthetic oligonucleotide; GGG chr11 5249059 5249078 5249075 +
ttttaaaacaacaaaaatga

SEQ ID NO: 11261 - DNA, 20 bp, Artificial Sequence
  Synthetic oligonucleotide; AAG chr11 5249063 5249082 5249079 +
aaaacaacaaaaatgaggga

SEQ ID NO: 11262 - DNA, 20 bp, Artificial Sequence
  Synthetic oligonucleotide; AAG chr11 5249070 5249089 5249086 +
caaaaatgagggaaagatga

SEQ ID NO: 11263 - DNA, 20 bp, Artificial Sequence
  Synthetic oligonucleotide; TGG chr11 5249083 5249102 5249099 +
aagatgaaagttctttctac

SEQ ID NO: 11264 - DNA, 20 bp, Artificial Sequence
  Synthetic oligonucleotide; AAG chr11 5249095 5249114 5249111 +
ctttctactggaatctaata

SEQ ID NO: 11265 - DNA, 20 bp, Artificial Sequence
  Synthetic oligonucleotide; AAG chr11 5249100 5249119 5249116 +
tactggaatctaataaagaa

SEQ ID NO: 11266 - DNA, 20 bp, Artificial Sequence
  Synthetic oligonucleotide; AAG chr11 5249135 5249154 5249151 +
tttccacctctcttttctca

SEQ ID NO: 11267 - DNA, 20 bp, Artificial Sequence
  Synthetic oligonucleotide; TAG chr11 5249153 5249172 5249169 +
caaagtcaaaattgtccatc

SEQ ID NO: 11268 - DNA, 20 bp, Artificial Sequence
  Synthetic oligonucleotide; TAG chr11 5249161 5249180 5249177 +
aaattgtccatctagatttt

SEQ ID NO: 11269 - DNA, 20 bp, Artificial Sequence
  Synthetic oligonucleotide; GAG chr11 5249163 5249182 5249179 +
attgtccatctagattttta

SEQ ID NO: 11270 - DNA, 20 bp, Artificial Sequence
  Synthetic oligonucleotide; AGG chr11 5249164 5249183 5249180 +
ttgtccatctagatttttag

SEQ ID NO: 11271 - DNA, 20 bp, Artificial Sequence
  Synthetic oligonucleotide; TAG chr11 5249174 5249193 5249190 +
agatttttagaggcactcct

SEQ ID NO: 11272 - DNA, 20 bp, Artificial Sequence
  Synthetic oligonucleotide; AGG chr11 5249175 5249194 5249191 +
gatttttagaggcactcctt

SEQ ID NO: 11273 - DNA, 20 bp, Artificial Sequence
  Synthetic oligonucleotide; TGG chr11 5249195 5249214 5249211 +
aggccctaaaacattaccac

SEQ ID NO: 11274 - DNA, 20 bp, Artificial Sequence
  Synthetic oligonucleotide; GGG chr11 5249196 5249215 5249212 +
ggccctaaaacattaccact

SEQ ID NO: 11275 - DNA, 20 bp, Artificial Sequence
  Synthetic oligonucleotide; CAG chr11 5249202 5249221 5249218 +
aaaacattaccactgggtct

SEQ ID NO: 11276 - DNA, 20 bp, Artificial Sequence
  Synthetic oligonucleotide; CAG chr11 5249207 5249226 5249223 +
attaccactgggtctcagcc

SEQ ID NO: 11277 - DNA, 20 bp, Artificial Sequence
  Synthetic oligonucleotide; TAG chr11 5249211 5249230 5249227 +
ccactgggtctcagcccagt

SEQ ID NO: 11278 - DNA, 20 bp, Artificial Sequence
  Synthetic oligonucleotide; CAG chr11 5249221 5249240 5249237 +
tcagcccagttagtcctctg

SEQ ID NO: 11279 - DNA, 20 bp, Artificial Sequence
  Synthetic oligonucleotide; CAG chr11 5249242 5249261 5249258 +
agtttcttcacccccaaccc

SEQ ID NO: 11280 - DNA, 20 bp, Artificial Sequence
  Synthetic oligonucleotide; CAG chr11 5249255 5249274 5249271 +
ccaaccccagtatcttcaaa

SEQ ID NO: 11281 - DNA, 20 bp, Artificial Sequence
  Synthetic oligonucleotide; CAG chr11 5249276 5249295 5249292 +
agctcacaccctgctgtgct

SEQ ID NO: 11282 - DNA, 20 bp, Artificial Sequence
  Synthetic oligonucleotide; AAG chr11 5249297 5249316 5249313 +
agatcaatactccgttgtct

SEQ ID NO: 11283 - DNA, 20 bp, Artificial Sequence
  Synthetic oligonucleotide; GAG chr11 5249307 5249326 5249323 +
tccgttgtctaagttgcctc

SEQ ID NO: 11284 - DNA, 20 bp, Artificial Sequence
  Synthetic oligonucleotide; AAG chr11 5249314 5249333 5249330 +
tctaagttgcctcgagacta

SEQ ID NO: 11285 - DNA, 20 bp, Artificial Sequence
  Synthetic oligonucleotide; AGG chr11 5249315 5249334 5249331 +
ctaagttgcctcgagactaa

SEQ ID NO: 11286 - DNA, 20 bp, Artificial Sequence
  Synthetic oligonucleotide; CAG chr11 5249321 5249340 5249337 +
tgcctcgagactaaaggcaa

SEQ ID NO: 11287 - DNA, 20 bp, Artificial Sequence
  Synthetic oligonucleotide; AGG chr11 5249322 5249341 5249338 +
gcctcgagactaaaggcaac

SEQ ID NO: 11288 - DNA, 20 bp, Artificial Sequence
  Synthetic oligonucleotide; GGG chr11 5249323 5249342 5249339 +
cctcgagactaaaggcaaca

SEQ ID NO: 11289 - DNA, 20 bp, Artificial Sequence
  Synthetic oligonucleotide; TGG chr11 5249339 5249358 5249355 +
aacagggctgaaacatctcc

SEQ ID NO: 11290 - DNA, 20 bp, Artificial Sequence
  Synthetic oligonucleotide; AAG chr11 5249352 5249371 5249368 +
catctcctggactcaccttg

SEQ ID NO: 11291 - DNA, 20 bp, Artificial Sequence
  Synthetic oligonucleotide; CAG chr11 5249359 5249378 5249375 +
tggactcaccttgaagttct

SEQ ID NO: 11292 - DNA, 20 bp, Artificial Sequence
  Synthetic oligonucleotide; AGG chr11 5249360 5249379 5249376 +
ggactcaccttgaagttctc

SEQ ID NO: 11293 - DNA, 20 bp, Artificial Sequence
  Synthetic oligonucleotide; CAG chr11 5249372 5249391 5249388 +
aagttctcaggatccacatg

SEQ ID NO: 11294 - DNA, 20 bp, Artificial Sequence
  Synthetic oligonucleotide; CAG chr11 5249382 5249401 5249398 +
gatccacatgcagcttgtca

SEQ ID NO: 11295 - DNA, 20 bp, Artificial Sequence
  Synthetic oligonucleotide; CAG chr11 5249387 5249406 5249403 +
acatgcagcttgtcacagtg

SEQ ID NO: 11296 - DNA, 20 bp, Artificial Sequence
  Synthetic oligonucleotide; CAG chr11 5249396 5249415 5249412 +
ttgtcacagtgcagttcact

SEQ ID NO: 11297 - DNA, 20 bp, Artificial Sequence
  Synthetic oligonucleotide; TGG chr11 5249400 5249419 5249416 +
cacagtgcagttcactcagc

SEQ ID NO: 11298 - DNA, 20 bp, Artificial Sequence
  Synthetic oligonucleotide; GGG chr11 5249401 5249420 5249417 +
acagtgcagttcactcagct

SEQ ID NO: 11299 - DNA, 20 bp, Artificial Sequence
  Synthetic oligonucleotide; AAG chr11 5249406 5249425 5249422 +
gcagttcactcagctgggca

SEQ ID NO: 11300 - DNA, 20 bp, Artificial Sequence
  Synthetic oligonucleotide; AGG chr11 5249407 5249426 5249423 +
cagttcactcagctgggcaa

SEQ ID NO: 11301 - DNA, 20 bp, Artificial Sequence
  Synthetic oligonucleotide; GAG chr11 5249417 5249436 5249433 +
agctgggcaaaggtgccctt

SEQ ID NO: 11302 - DNA, 20 bp, Artificial Sequence
  Synthetic oligonucleotide; CAG chr11 5249426 5249445 5249442 +
aaggtgcccttgagatcatc

SEQ ID NO: 11303 - DNA, 20 bp, Artificial Sequence
  Synthetic oligonucleotide; AGG chr11 5249427 5249446 5249443 +
aggtgcccttgagatcatcc

SEQ ID NO: 11304 - DNA, 20 bp, Artificial Sequence
  Synthetic oligonucleotide; TGG chr11 5249437 5249456 5249453 +
gagatcatccaggtgctttg

SEQ ID NO: 11305 - DNA, 20 bp, Artificial Sequence
  Synthetic oligonucleotide; AAG chr11 5249448 5249467 5249464 +
ggtgctttgtggcatctccc

SEQ ID NO: 11306 - DNA, 20 bp, Artificial Sequence
  Synthetic oligonucleotide; AGG chr11 5249449 5249468 5249465 +
gtgctttgtggcatctccca

SEQ ID NO: 11307 - DNA, 20 bp, Artificial Sequence
  Synthetic oligonucleotide; AAG chr11 5249452 5249471 5249468 +
ctttgtggcatctcccaagg

SEQ ID NO: 11308 - DNA, 20 bp, Artificial Sequence
  Synthetic oligonucleotide; CAG chr11 5249456 5249475 5249472 +
gtggcatctcccaaggaagt

SEQ ID NO: 11309 - DNA, 20 bp, Artificial Sequence
  Synthetic oligonucleotide; TGG chr11 5249485 5249504 5249501 +
cttgccatgtgccttgactt

SEQ ID NO: 11310 - DNA, 20 bp, Artificial Sequence
  Synthetic oligonucleotide; GGG chr11 5249486 5249505 5249502 +
ttgccatgtgccttgacttt

SEQ ID NO: 11311 - DNA, 20 bp, Artificial Sequence
  Synthetic oligonucleotide; GGG chr11 5249487 5249506 5249503 +
tgccatgtgccttgactttg

SEQ ID NO: 11312 - DNA, 20 bp, Artificial Sequence
  Synthetic oligonucleotide; TGG chr11 5249500 5249519 5249516 +
gactttggggttgcccatga

SEQ ID NO: 11313 - DNA, 20 bp, Artificial Sequence
  Synthetic oligonucleotide; CAG chr11 5249503 5249522 5249519 +
tttggggttgcccatgatgg

SEQ ID NO: 11314 - DNA, 20 bp, Artificial Sequence
  Synthetic oligonucleotide; GAG chr11 5249505 5249524 5249521 +
tggggttgcccatgatggca

SEQ ID NO: 11315 - DNA, 20 bp, Artificial Sequence
  Synthetic oligonucleotide; AGG chr11 5249506 5249525 5249522 +
ggggttgcccatgatggcag

SEQ ID NO: 11316 - DNA, 20 bp, Artificial Sequence
  Synthetic oligonucleotide; CAG chr11 5249509 5249528 5249525 +
gttgcccatgatggcagagg

SEQ ID NO: 11317 - DNA, 20 bp, Artificial Sequence
  Synthetic oligonucleotide; GAG chr11 5249511 5249530 5249527 +
tgcccatgatggcagaggca

SEQ ID NO: 11318 - DNA, 20 bp, Artificial Sequence
  Synthetic oligonucleotide; AGG chr11 5249512 5249531 5249528 +
gcccatgatggcagaggcag

SEQ ID NO: 11319 - DNA, 20 bp, Artificial Sequence
  Synthetic oligonucleotide; CAG chr11 5249516 5249535 5249532 +
atgatggcagaggcagagga

SEQ ID NO: 11320 - DNA, 20 bp, Artificial Sequence
  Synthetic oligonucleotide; AGG chr11 5249517 5249536 5249533 +
tgatggcagaggcagaggac

SEQ ID NO: 11321 - DNA, 20 bp, Artificial Sequence
  Synthetic oligonucleotide; AAG chr11 5249526 5249545 5249542 +
aggcagaggacaggttgcca

SEQ ID NO: 11322 - DNA, 20 bp, Artificial Sequence
  Synthetic oligonucleotide; AAG chr11 5249535 5249554 5249551 +
acaggttgccaaagctgtca

SEQ ID NO: 11323 - DNA, 20 bp, Artificial Sequence
  Synthetic oligonucleotide; TGG chr11 5249544 5249563 5249560 +
caaagctgtcaaagaacctc

SEQ ID NO: 11324 - DNA, 20 bp, Artificial Sequence
  Synthetic oligonucleotide; GGG chr11 5249545 5249564 5249561 +
aaagctgtcaaagaacctct

SEQ ID NO: 11325 - DNA, 20 bp, Artificial Sequence
  Synthetic oligonucleotide; TGG chr11 5249552 5249571 5249568 +
tcaaagaacctctgggtcca

SEQ ID NO: 11326 - DNA, 20 bp, Artificial Sequence
  Synthetic oligonucleotide; GGG chr11 5249553 5249572 5249569 +
caaagaacctctgggtccat

SEQ ID NO: 11327 - DNA, 20 bp, Artificial Sequence
  Synthetic oligonucleotide; TAG chr11 5249556 5249575 5249572 +
agaacctctgggtccatggg

SEQ ID NO: 11328 - DNA, 20 bp, Artificial Sequence
  Synthetic oligonucleotide; CAG chr11 5249564 5249583 5249580 +
tgggtccatgggtagacaac

SEQ ID NO: 11329 - DNA, 20 bp, Artificial Sequence
  Synthetic oligonucleotide; AGG chr11 5249565 5249584 5249581 +
gggtccatgggtagacaacc

SEQ ID NO: 11330 - DNA, 20 bp, Artificial Sequence
  Synthetic oligonucleotide; GAG chr11 5249567 5249586 5249583 +
gtccatgggtagacaaccag

SEQ ID NO: 11331 - DNA, 20 bp, Artificial Sequence
  Synthetic oligonucleotide; GAG chr11 5249575 5249594 5249591 +
gtagacaaccaggagcctgt

SEQ ID NO: 11332 - DNA, 20 bp, Artificial Sequence
  Synthetic oligonucleotide; AAG chr11 5249584 5249603 5249600 +
caggagcctgtgagattgac

SEQ ID NO: 11333 - DNA, 20 bp, Artificial Sequence
  Synthetic oligonucleotide; CAG chr11 5249589 5249608 5249605 +
gcctgtgagattgacaagaa

SEQ ID NO: 11334 - DNA, 20 bp, Artificial Sequence
  Synthetic oligonucleotide; CAG chr11 5249597 5249616 5249613 +
gattgacaagaacagtttga

SEQ ID NO: 11335 - DNA, 20 bp, Artificial Sequence
  Synthetic oligonucleotide; CAG chr11 5249601 5249620 5249617 +
gacaagaacagtttgacagt

SEQ ID NO: 11336 - DNA, 20 bp, Artificial Sequence
  Synthetic oligonucleotide; AAG chr11 5249604 5249623 5249620 +
aagaacagtttgacagtcag

SEQ ID NO: 11337 - DNA, 20 bp, Artificial Sequence
  Synthetic oligonucleotide; AGG chr11 5249605 5249624 5249621 +
agaacagtttgacagtcaga

SEQ ID NO: 11338 - DNA, 20 bp, Artificial Sequence
  Synthetic oligonucleotide; GAG chr11 5249621 5249640 5249637 +
cagaaggtgccacaaatcct

SEQ ID NO: 11339 - DNA, 20 bp, Artificial Sequence
  Synthetic oligonucleotide; AAG chr11 5249624 5249643 5249640 +
aaggtgccacaaatcctgag

SEQ ID NO: 11340 - DNA, 20 bp, Artificial Sequence
  Synthetic oligonucleotide; TGG chr11 5249632 5249651 5249648 +
acaaatcctgagaagcgacc

SEQ ID NO: 11341 - DNA, 20 bp, Artificial Sequence
  Synthetic oligonucleotide; CAG chr11 5249643 5249662 5249659 +
gaagcgacctggacttttgc

SEQ ID NO: 11342 - DNA, 20 bp, Artificial Sequence
  Synthetic oligonucleotide; AGG chr11 5249644 5249663 5249660 +
aagcgacctggacttttgcc

SEQ ID NO: 11343 - DNA, 20 bp, Artificial Sequence
  Synthetic oligonucleotide; CAG chr11 5249649 5249668 5249665 +
acctggacttttgccaggca

SEQ ID NO: 11344 - DNA, 20 bp, Artificial Sequence
  Synthetic oligonucleotide; AGG chr11 5249650 5249669 5249666 +
cctggacttttgccaggcac

SEQ ID NO: 11345 - DNA, 20 bp, Artificial Sequence
  Synthetic oligonucleotide; GGG chr11 5249651 5249670 5249667 +
ctggacttttgccaggcaca

SEQ ID NO: 11346 - DNA, 20 bp, Artificial Sequence
  Synthetic oligonucleotide; TGG chr11 5249676 5249695 5249692 +
cttccttccctcccttgtcc

SEQ ID NO: 11347 - DNA, 20 bp, Artificial Sequence
  Synthetic oligonucleotide; CAG chr11 5249683 5249702 5249699 +
ccctcccttgtcctggtcac

SEQ ID NO: 11348 - DNA, 20 bp, Artificial Sequence
  Synthetic oligonucleotide; GAG chr11 5249685 5249704 5249701 +
ctcccttgtcctggtcacca

SEQ ID NO: 11349 - DNA, 20 bp, Artificial Sequence
  Synthetic oligonucleotide; CAG chr11 5249698 5249717 5249714 +
gtcaccagagcctaccttcc

SEQ ID NO: 11350 - DNA, 20 bp, Artificial Sequence
  Synthetic oligonucleotide; AGG chr11 5249699 5249718 5249715 +
tcaccagagcctaccttccc

SEQ ID NO: 11351 - DNA, 20 bp, Artificial Sequence
  Synthetic oligonucleotide; GGG chr11 5249700 5249719 5249716 +
caccagagcctaccttccca

SEQ ID NO: 11352 - DNA, 20 bp, Artificial Sequence
  Synthetic oligonucleotide; CAG chr11 5249712 5249731 5249728 +
ccttcccagggtttctcctc

SEQ ID NO: 11353 - DNA, 20 bp, Artificial Sequence
  Synthetic oligonucleotide; CAG chr11 5249740 5249759 5249756 +
tccacattcaccttgcccca

SEQ ID NO: 11354 - DNA, 20 bp, Artificial Sequence
  Synthetic oligonucleotide; AGG chr11 5249741 5249760 5249757 +
ccacattcaccttgccccac

SEQ ID NO: 11355 - DNA, 20 bp, Artificial Sequence
  Synthetic oligonucleotide; TAG chr11 5249751 5249770 5249767 +
cttgccccacaggcttgtga

SEQ ID NO: 11356 - DNA, 20 bp, Artificial Sequence
  Synthetic oligonucleotide; TAG chr11 5249754 5249773 5249770 +
gccccacaggcttgtgatag

SEQ ID NO: 11357 - DNA, 20 bp, Artificial Sequence
  Synthetic oligonucleotide; TGG chr11 5249784 5249803 5249800 +
ctcctctgtgaaatgaccca

SEQ ID NO: 11358 - DNA, 20 bp, Artificial Sequence
  Synthetic oligonucleotide; TGG chr11 5249791 5249810 5249807 +
gtgaaatgacccatggcgtc

SEQ ID NO: 11359 - DNA, 20 bp, Artificial Sequence
  Synthetic oligonucleotide; TAG chr11 5249796 5249815 5249812 +
atgacccatggcgtctggac

SEQ ID NO: 11360 - DNA, 20 bp, Artificial Sequence
  Synthetic oligonucleotide; AGG chr11 5249797 5249816 5249813 +
tgacccatggcgtctggact

SEQ ID NO: 11361 - DNA, 20 bp, Artificial Sequence
  Synthetic oligonucleotide; GAG chr11 5249799 5249818 5249815 +
acccatggcgtctggactag

SEQ ID NO: 11362 - DNA, 20 bp, Artificial Sequence
  Synthetic oligonucleotide; CAG chr11 5249816 5249835 5249832 +
taggagcttattgataacct

SEQ ID NO: 11363 - DNA, 20 bp, Artificial Sequence
  Synthetic oligonucleotide; CAG chr11 5249825 5249844 5249841 +
attgataacctcagacgttc

SEQ ID NO: 11364 - DNA, 20 bp, Artificial Sequence
  Synthetic oligonucleotide; AAG chr11 5249828 5249847 5249844 +
gataacctcagacgttccag

SEQ ID NO: 11365 - DNA, 20 bp, Artificial Sequence
  Synthetic oligonucleotide; GAG chr11 5249832 5249851 5249848 +
acctcagacgttccagaagc

SEQ ID NO: 11366 - DNA, 20 bp, Artificial Sequence
  Synthetic oligonucleotide; TGG chr11 5249839 5249858 5249855 +
acgttccagaagcgagtgtg

SEQ ID NO: 11367 - DNA, 20 bp, Artificial Sequence
  Synthetic oligonucleotide; AAG chr11 5249850 5249869 5249866 +
gcgagtgtgtggaactgctg

SEQ ID NO: 11368 - DNA, 20 bp, Artificial Sequence
  Synthetic oligonucleotide; AGG chr11 5249851 5249870 5249867 +
cgagtgtgtggaactgctga

SEQ ID NO: 11369 - DNA, 20 bp, Artificial Sequence
  Synthetic oligonucleotide; GGG chr11 5249852 5249871 5249868 +
gagtgtgtggaactgctgaa

SEQ ID NO: 11370 - DNA, 20 bp, Artificial Sequence
  Synthetic oligonucleotide; TAG chr11 5249878 5249897 5249894 +
ttccttttattcttcatccc

SEQ ID NO: 11371 - DNA, 20 bp, Artificial Sequence
  Synthetic oligonucleotide; CAG chr11 5249882 5249901 5249898 +
ttttattcttcatccctagc

SEQ ID NO: 11372 - DNA, 20 bp, Artificial Sequence
  Synthetic oligonucleotide; CGG chr11 5249889 5249908 5249905 +
cttcatccctagccagccgc

SEQ ID NO: 11373 - DNA, 20 bp, Artificial Sequence
  Synthetic oligonucleotide; TGG chr11 5249896 5249915 5249912 +
cctagccagccgccggcccc

SEQ ID NO: 11374 - DNA, 20 bp, Artificial Sequence
  Synthetic oligonucleotide; TGG chr11 5249905 5249924 5249921 +
ccgccggcccctggcctcac

SEQ ID NO: 11375 - DNA, 20 bp, Artificial Sequence
  Synthetic oligonucleotide; AAG chr11 5249915 5249934 5249931 +
ctggcctcactggatactct

SEQ ID NO: 11376 - DNA, 20 bp, Artificial Sequence
  Synthetic oligonucleotide; TGG chr11 5249923 5249942 5249939 +
actggatactctaagactat

SEQ ID NO: 11377 - DNA, 20 bp, Artificial Sequence
  Synthetic oligonucleotide; AAG chr11 5249928 5249947 5249944 +
atactctaagactattggtc

SEQ ID NO: 11378 - DNA, 20 bp, Artificial Sequence
  Synthetic oligonucleotide; AAG chr11 5249942 5249961 5249958 +
ttggtcaagtttgccttgtc

SEQ ID NO: 11379 - DNA, 20 bp, Artificial Sequence
  Synthetic oligonucleotide; AGG chr11 5249943 5249962 5249959 +
tggtcaagtttgccttgtca

SEQ ID NO: 11380 - DNA, 20 bp, Artificial Sequence
  Synthetic oligonucleotide; TGG chr11 5249950 5249969 5249966 +
gtttgccttgtcaaggctat

SEQ ID NO: 11381 - DNA, 20 bp, Artificial Sequence
  Synthetic oligonucleotide; AAG chr11 5249955 5249974 5249971 +
ccttgtcaaggctattggtc

SEQ ID NO: 11382 - DNA, 20 bp, Artificial Sequence
  Synthetic oligonucleotide; AGG chr11 5249956 5249975 5249972 +
cttgtcaaggctattggtca

SEQ ID NO: 11383 - DNA, 20 bp, Artificial Sequence
  Synthetic oligonucleotide; AAG chr11 5249960 5249979 5249976 +
tcaaggctattggtcaaggc

SEQ ID NO: 11384 - DNA, 20 bp, Artificial Sequence
  Synthetic oligonucleotide; AGG chr11 5249961 5249980 5249977 +
caaggctattggtcaaggca

SEQ ID NO: 11385 - DNA, 20 bp, Artificial Sequence
  Synthetic oligonucleotide; TGG chr11 5249965 5249984 5249981 +
gctattggtcaaggcaaggc

SEQ ID NO: 11386 - DNA, 20 bp, Artificial Sequence
  Synthetic oligonucleotide; TGG chr11 5249976 5249995 5249992 +
aggcaaggctggccaaccca

SEQ ID NO: 11387 - DNA, 20 bp, Artificial Sequence
  Synthetic oligonucleotide; GGG chr11 5249977 5249996 5249993 +
ggcaaggctggccaacccat

SEQ ID NO: 11388 - DNA, 20 bp, Artificial Sequence
  Synthetic oligonucleotide; TGG chr11 5249980 5249999 5249996 +
aaggctggccaacccatggg

SEQ ID NO: 11389 - DNA, 20 bp, Artificial Sequence
  Synthetic oligonucleotide; GAG chr11 5249982 5250001 5249998 +
ggctggccaacccatgggtg

SEQ ID NO: 11390 - DNA, 20 bp, Artificial Sequence
  Synthetic oligonucleotide; TAG chr11 5249987 5250006 5250003 +
gccaacccatgggtggagtt

SEQ ID NO: 11391 - DNA, 20 bp, Artificial Sequence
  Synthetic oligonucleotide; CAG chr11 5249991 5250010 5250007 +
acccatgggtggagtttagc

SEQ ID NO: 11392 - DNA, 20 bp, Artificial Sequence
  Synthetic oligonucleotide; AGG chr11 5249992 5250011 5250008 +
cccatgggtggagtttagcc

SEQ ID NO: 11393 - DNA, 20 bp, Artificial Sequence
  Synthetic oligonucleotide; GGG chr11 5249993 5250012 5250009 +
ccatgggtggagtttagcca

SEQ ID NO: 11394 - DNA, 20 bp, Artificial Sequence
  Synthetic oligonucleotide; CAG chr11 5250003 5250022 5250019 +
agtttagccagggaccgttt

SEQ ID NO: 11395 - DNA, 20 bp, Artificial Sequence
  Synthetic oligonucleotide; CAG chr11 5250007 5250026 5250023 +
tagccagggaccgtttcaga

SEQ ID NO: 11396 - DNA, 20 bp, Artificial Sequence
  Synthetic oligonucleotide; GAG chr11 5250021 5250040 5250037 +
ttcagacagatatttgcatt

SEQ ID NO: 11397 - DNA, 20 bp, Artificial Sequence
  Synthetic oligonucleotide; TAG chr11 5250025 5250044 5250041 +
gacagatatttgcattgaga

SEQ ID NO: 11398 - DNA, 20 bp, Artificial Sequence
  Synthetic oligonucleotide; TGG chr11 5250030 5250049 5250046 +
atatttgcattgagatagtg

SEQ ID NO: 11399 - DNA, 20 bp, Artificial Sequence
  Synthetic oligonucleotide; GGG chr11 5250031 5250050 5250047 +
tatttgcattgagatagtgt

SEQ ID NO: 11400 - DNA, 20 bp, Artificial Sequence
  Synthetic oligonucleotide; GGG chr11 5250032 5250051 5250048 +
atttgcattgagatagtgtg

SEQ ID NO: 11401 - DNA, 20 bp, Artificial Sequence
  Synthetic oligonucleotide; AAG chr11 5250035 5250054 5250051 +
tgcattgagatagtgtgggg

SEQ ID NO: 11402 - DNA, 20 bp, Artificial Sequence
  Synthetic oligonucleotide; AGG chr11 5250036 5250055 5250052 +
gcattgagatagtgtgggga

SEQ ID NO: 11403 - DNA, 20 bp, Artificial Sequence
  Synthetic oligonucleotide; GGG chr11 5250037 5250056 5250053 +
cattgagatagtgtggggaa

SEQ ID NO: 11404 - DNA, 20 bp, Artificial Sequence
  Synthetic oligonucleotide; GGG chr11 5250038 5250057 5250054 +
attgagatagtgtggggaag

SEQ ID NO: 11405 - DNA, 20 bp, Artificial Sequence
  Synthetic oligonucleotide; AAG chr11 5250046 5250065 5250062 +
agtgtggggaaggggccccc

SEQ ID NO: 11406 - DNA, 20 bp, Artificial Sequence
  Synthetic oligonucleotide; GAG chr11 5250048 5250067 5250064 +
tgtggggaaggggcccccaa

SEQ ID NO: 11407 - DNA, 20 bp, Artificial Sequence
  Synthetic oligonucleotide; AGG chr11 5250049 5250068 5250065 +
gtggggaaggggcccccaag

SEQ ID NO: 11408 - DNA, 20 bp, Artificial Sequence
  Synthetic oligonucleotide; TAG chr11 5250071 5250090 5250087 +
gatactgctaatttttttta

SEQ ID NO: 11409 - DNA, 20 bp, Artificial Sequence
  Synthetic oligonucleotide; CAG chr11 5250093 5250112 5250109 +
gcctttgccttgttccgatt

SEQ ID NO: 11410 - DNA, 20 bp, Artificial Sequence
  Synthetic oligonucleotide; CAG chr11 5250102 5250121 5250118 +
ttgttccgattcagtcattc

SEQ ID NO: 11411 - DNA, 20 bp, Artificial Sequence
  Synthetic oligonucleotide; TAG chr11 5250130 5250149 5250146 +
ctctaatttattcttccctt

SEQ ID NO: 11412 - DNA, 20 bp, Artificial Sequence
  Synthetic oligonucleotide; TAG chr11 5250134 5250153 5250150 +
aatttattcttccctttagc

SEQ ID NO: 11413 - DNA, 20 bp, Artificial Sequence
  Synthetic oligonucleotide; TAG chr11 5250153 5250172 5250169 +
ctagtttccttctcccatca

SEQ ID NO: 11414 - DNA, 20 bp, Artificial Sequence
  Synthetic oligonucleotide; GAG chr11 5250155 5250174 5250171 +
agtttccttctcccatcata

SEQ ID NO: 11415 - DNA, 20 bp, Artificial Sequence
  Synthetic oligonucleotide; AGG chr11 5250156 5250175 5250172 +
gtttccttctcccatcatag

SEQ ID NO: 11416 - DNA, 20 bp, Artificial Sequence
  Synthetic oligonucleotide; CAG chr11 5250163 5250182 5250179 +
tctcccatcatagaggatac

SEQ ID NO: 11417 - DNA, 20 bp, Artificial Sequence
  Synthetic oligonucleotide; AGG chr11 5250164 5250183 5250180 +
ctcccatcatagaggatacc

SEQ ID NO: 11418 - DNA, 20 bp, Artificial Sequence
  Synthetic oligonucleotide; CAG chr11 5250178 5250197 5250194 +
gataccaggacttcttttgt

SEQ ID NO: 11419 - DNA, 20 bp, Artificial Sequence
  Synthetic oligonucleotide; TAG chr11 5250203 5250222 5250219 +
gttttttaccttcttgtctc

SEQ ID NO: 11420 - DNA, 20 bp, Artificial Sequence
  Synthetic oligonucleotide; CAG chr11 5250209 5250228 5250225 +
taccttcttgtctctagctc

SEQ ID NO: 11421 - DNA, 20 bp, Artificial Sequence
  Synthetic oligonucleotide; GAG chr11 5250213 5250232 5250229 +
ttcttgtctctagctccagt

SEQ ID NO: 11422 - DNA, 20 bp, Artificial Sequence
  Synthetic oligonucleotide; AGG chr11 5250214 5250233 5250230 +
tcttgtctctagctccagtg

SEQ ID NO: 11423 - DNA, 20 bp, Artificial Sequence
  Synthetic oligonucleotide; TAG chr11 5250221 5250240 5250237 +
tctagctccagtgaggcctg

SEQ ID NO: 11424 - DNA, 20 bp, Artificial Sequence
  Synthetic oligonucleotide; AAG chr11 5250228 5250247 5250244 +
ccagtgaggcctgtagttta

SEQ ID NO: 11425 - DNA, 20 bp, Artificial Sequence
  Synthetic oligonucleotide; AAG chr11 5250234 5250253 5250250 +
aggcctgtagtttaaagcta

SEQ ID NO: 11426 - DNA, 20 bp, Artificial Sequence
  Synthetic oligonucleotide; AAG chr11 5250255 5250274 5250271 +
agcatgtaccaatttttgaa

SEQ ID NO: 11427 - DNA, 20 bp, Artificial Sequence
  Synthetic oligonucleotide; CAG chr11 5250260 5250279 5250276 +
gtaccaatttttgaaaagtt

SEQ ID NO: 11428 - DNA, 20 bp, Artificial Sequence
  Synthetic oligonucleotide; AGG chr11 5250261 5250280 5250277 +
taccaatttttgaaaagttc

SEQ ID NO: 11429 - DNA, 20 bp, Artificial Sequence
  Synthetic oligonucleotide; GGG chr11 5250262 5250281 5250278 +
accaatttttgaaaagttca

SEQ ID NO: 11430 - DNA, 20 bp, Artificial Sequence
  Synthetic oligonucleotide; TAG chr11 5250281 5250300 5250297 +
agggattgtgaaatgtgttt

SEQ ID NO: 11431 - DNA, 20 bp, Artificial Sequence
  Synthetic oligonucleotide; AGG chr11 5250282 5250301 5250298 +
gggattgtgaaatgtgtttt

SEQ ID NO: 11432 - DNA, 20 bp, Artificial Sequence
  Synthetic oligonucleotide; TAG chr11 5250287 5250306 5250303 +
tgtgaaatgtgttttaggca

SEQ ID NO: 11433 - DNA, 20 bp, Artificial Sequence
  Synthetic oligonucleotide; AGG chr11 5250288 5250307 5250304 +
gtgaaatgtgttttaggcat

SEQ ID NO: 11434 - DNA, 20 bp, Artificial Sequence
  Synthetic oligonucleotide; CAG chr11 5250293 5250312 5250309 +
atgtgttttaggcataggtc

SEQ ID NO: 11435 - DNA, 20 bp, Artificial Sequence
  Synthetic oligonucleotide; AGG chr11 5250294 5250313 5250310 +
tgtgttttaggcataggtcc

SEQ ID NO: 11436 - DNA, 20 bp, Artificial Sequence
  Synthetic oligonucleotide; CGG chr11 5250305 5250324 5250321 +
cataggtccaggatttttga

SEQ ID NO: 11437 - DNA, 20 bp, Artificial Sequence
  Synthetic oligonucleotide; GGG chr11 5250306 5250325 5250322 +
ataggtccaggatttttgac

SEQ ID NO: 11438 - DNA, 20 bp, Artificial Sequence
  Synthetic oligonucleotide; TAG chr11 5250317 5250336 5250333 +
atttttgacgggacaaatct

SEQ ID NO: 11439 - DNA, 20 bp, Artificial Sequence
  Synthetic oligonucleotide; CAG chr11 5250327 5250346 5250343 +
ggacaaatcttagtctcttt

SEQ ID NO: 11440 - DNA, 20 bp, Artificial Sequence
  Synthetic oligonucleotide; TAG chr11 5250331 5250350 5250347 +
aaatcttagtctctttcagt

SEQ ID NO: 11441 - DNA, 20 bp, Artificial Sequence
  Synthetic oligonucleotide; CAG chr11 5250334 5250353 5250350 +
tcttagtctctttcagttag

SEQ ID NO: 11442 - DNA, 20 bp, Artificial Sequence
  Synthetic oligonucleotide; TGG chr11 5250337 5250356 5250353 +
tagtctctttcagttagcag

SEQ ID NO: 11443 - DNA, 20 bp, Artificial Sequence
  Synthetic oligonucleotide; AAG chr11 5250345 5250364 5250361 +
ttcagttagcagtggtttct

SEQ ID NO: 11444 - DNA, 20 bp, Artificial Sequence
  Synthetic oligonucleotide; AGG chr11 5250346 5250365 5250362 +
tcagttagcagtggtttcta

SEQ ID NO: 11445 - DNA, 20 bp, Artificial Sequence
  Synthetic oligonucleotide; AAG chr11 5250352 5250371 5250368 +
agcagtggtttctaaggaaa

SEQ ID NO: 11446 - DNA, 20 bp, Artificial Sequence
  Synthetic oligonucleotide; TAG chr11 5250416 5250435 5250432 +
attatctcttaatttctcaa

SEQ ID NO: 11447 - DNA, 20 bp, Artificial Sequence
  Synthetic oligonucleotide; CAG chr11 5250421 5250440 5250437 +
ctcttaatttctcaatagtg

SEQ ID NO: 11448 - DNA, 20 bp, Artificial Sequence
  Synthetic oligonucleotide; AAG chr11 5250441 5250460 5250457 +
cagtgaaaacaatttctata

SEQ ID NO: 11449 - DNA, 20 bp, Artificial Sequence
  Synthetic oligonucleotide; CAG chr11 5250447 5250466 5250463 +
aaacaatttctataaagcca

SEQ ID NO: 11450 - DNA, 20 bp, Artificial Sequence
  Synthetic oligonucleotide; CAG chr11 5250453 5250472 5250469 +
tttctataaagccacagttt

SEQ ID NO: 11451 - DNA, 20 bp, Artificial Sequence
  Synthetic oligonucleotide; CAG chr11 5250458 5250477 5250474 +
ataaagccacagtttcagcg

SEQ ID NO: 11452 - DNA, 20 bp, Artificial Sequence
  Synthetic oligonucleotide; TAG chr11 5250464 5250483 5250480 +
ccacagtttcagcgcagtaa

SEQ ID NO: 11453 - DNA, 20 bp, Artificial Sequence
  Synthetic oligonucleotide; TAG chr11 5250469 5250488 5250485 +
gtttcagcgcagtaatagat

SEQ ID NO: 11454 - DNA, 20 bp, Artificial Sequence
  Synthetic oligonucleotide; AAG chr11 5250485 5250504 5250501 +
agattagtgttacataatat

SEQ ID NO: 11455 - DNA, 20 bp, Artificial Sequence
  Synthetic oligonucleotide; TAG chr11 5250554 5250573 5250570 +
aaatcatgactgtttcatct

SEQ ID NO: 11456 - DNA, 20 bp, Artificial Sequence
  Synthetic oligonucleotide; CAG chr11 5250578 5250597 5250594 +
aaaatatttgattccatatt

SEQ ID NO: 11457 - DNA, 20 bp, Artificial Sequence
  Synthetic oligonucleotide; AGG chr11 5250579 5250598 5250595 +
aaatatttgattccatattc

SEQ ID NO: 11458 - DNA, 20 bp, Artificial Sequence
  Synthetic oligonucleotide; CAG chr11 5250597 5250616 5250613 +
tcaggtatgtatgtatacac

SEQ ID NO: 11459 - DNA, 20 bp, Artificial Sequence
  Synthetic oligonucleotide; TGG chr11 5250618 5250637 5250634 +
agatgatgtgtatttaccac

SEQ ID NO: 11460 - DNA, 20 bp, Artificial Sequence
  Synthetic oligonucleotide; AAG chr11 5250623 5250642 5250639 +
atgtgtatttaccactggat

SEQ ID NO: 11461 - DNA, 20 bp, Artificial Sequence
  Synthetic oligonucleotide; TGG chr11 5250635 5250654 5250651 +
cactggataagtgtgtgtgc

SEQ ID NO: 11462 - DNA, 20 bp, Artificial Sequence
  Synthetic oligonucleotide; CAG chr11 5250647 5250666 5250663 +
gtgtgtgctggctgatgacc

SEQ ID NO: 11463 - DNA, 20 bp, Artificial Sequence
  Synthetic oligonucleotide; AGG chr11 5250648 5250667 5250664 +
tgtgtgctggctgatgaccc

SEQ ID NO: 11464 - DNA, 20 bp, Artificial Sequence
  Synthetic oligonucleotide; GGG chr11 5250649 5250668 5250665 +
gtgtgctggctgatgaccca

SEQ ID NO: 11465 - DNA, 20 bp, Artificial Sequence
  Synthetic oligonucleotide; TGG chr11 5250655 5250674 5250671 +
tggctgatgacccagggttt

SEQ ID NO: 11466 - DNA, 20 bp, Artificial Sequence
  Synthetic oligonucleotide; TAG chr11 5250660 5250679 5250676 +
gatgacccagggttttggcg

SEQ ID NO: 11467 - DNA, 20 bp, Artificial Sequence
  Synthetic oligonucleotide; CAG chr11 5250675 5250694 5250691 +
tggcgtagctcttctatgct

SEQ ID NO: 11468 - DNA, 20 bp, Artificial Sequence
  Synthetic oligonucleotide; AAG chr11 5250680 5250699 5250696 +
tagctcttctatgctcagta

SEQ ID NO: 11469 - DNA, 20 bp, Artificial Sequence
  Synthetic oligonucleotide; TGG chr11 5250687 5250706 5250703 +
tctatgctcagtaaagatga

SEQ ID NO: 11470 - DNA, 20 bp, Artificial Sequence
  Synthetic oligonucleotide; TAG chr11 5250690 5250709 5250706 +
atgctcagtaaagatgatgg

SEQ ID NO: 11471 - DNA, 20 bp, Artificial Sequence
  Synthetic oligonucleotide; TGG chr11 5250702 5250721 5250718 +
gatgatggtagaatgttctt

SEQ ID NO: 11472 - DNA, 20 bp, Artificial Sequence
  Synthetic oligonucleotide; CAG chr11 5250705 5250724 5250721 +
gatggtagaatgttctttgg

SEQ ID NO: 11473 - DNA, 20 bp, Artificial Sequence
  Synthetic oligonucleotide; AGG chr11 5250706 5250725 5250722 +
atggtagaatgttctttggc

SEQ ID NO: 11474 - DNA, 20 bp, Artificial Sequence
  Synthetic oligonucleotide; TGG chr11 5250714 5250733 5250730 +
atgttctttggcaggtactg

SEQ ID NO: 11475 - DNA, 20 bp, Artificial Sequence
  Synthetic oligonucleotide; TAG chr11 5250719 5250738 5250735 +
ctttggcaggtactgtggat

SEQ ID NO: 11476 - DNA, 20 bp, Artificial Sequence
  Synthetic oligonucleotide; TAG chr11 5250745 5250764 5250761 +
taattatcttgtataaatgc

SEQ ID NO: 11477 - DNA, 20 bp, Artificial Sequence
  Synthetic oligonucleotide; AGG chr11 5250746 5250765 5250762 +
aattatcttgtataaatgct

SEQ ID NO: 11478 - DNA, 20 bp, Artificial Sequence
  Synthetic oligonucleotide; CAG chr11 5250758 5250777 5250774 +
taaatgctaggttcacttct

SEQ ID NO: 11479 - DNA, 20 bp, Artificial Sequence
  Synthetic oligonucleotide; AGG chr11 5250759 5250778 5250775 +
aaatgctaggttcacttctc

SEQ ID NO: 11480 - DNA, 20 bp, Artificial Sequence
  Synthetic oligonucleotide; GGG chr11 5250760 5250779 5250776 +
aatgctaggttcacttctca

SEQ ID NO: 11481 - DNA, 20 bp, Artificial Sequence
  Synthetic oligonucleotide; AAG chr11 5250774 5250793 5250790 +
ttctcagggaatcttactct

SEQ ID NO: 11482 - DNA, 20 bp, Artificial Sequence
  Synthetic oligonucleotide; AAG chr11 5250781 5250800 5250797 +
ggaatcttactctaagacat

SEQ ID NO: 11483 - DNA, 20 bp, Artificial Sequence
  Synthetic oligonucleotide; TGG chr11 5250797 5250816 5250813 +
acataagatgtgcgtgtaca

SEQ ID NO: 11484 - DNA, 20 bp, Artificial Sequence
  Synthetic oligonucleotide; AAG chr11 5250812 5250831 5250828 +
gtacatggaaaacaactcta

SEQ ID NO: 11485 - DNA, 20 bp, Artificial Sequence
  Synthetic oligonucleotide; GAG chr11 5250814 5250833 5250830 +
acatggaaaacaactctaaa

SEQ ID NO: 11486 - DNA, 20 bp, Artificial Sequence
  Synthetic oligonucleotide; AGG chr11 5250815 5250834 5250831 +
catggaaaacaactctaaag

SEQ ID NO: 11487 - DNA, 20 bp, Artificial Sequence
  Synthetic oligonucleotide; AAG chr11 5250819 5250838 5250835 +
gaaaacaactctaaagaggc

SEQ ID NO: 11488 - DNA, 20 bp, Artificial Sequence
  Synthetic oligonucleotide; AGG chr11 5250820 5250839 5250836 +
aaaacaactctaaagaggca

SEQ ID NO: 11489 - DNA, 20 bp, Artificial Sequence
  Synthetic oligonucleotide; GGG chr11 5250821 5250840 5250837 +
aaacaactctaaagaggcaa

SEQ ID NO: 11490 - DNA, 20 bp, Artificial Sequence
  Synthetic oligonucleotide; TAG chr11 5250841 5250860 5250857 +
gggttgtttttattgactaa

SEQ ID NO: 11491 - DNA, 20 bp, Artificial Sequence
  Synthetic oligonucleotide; TAG chr11 5250870 5250889 5250886 +
cactattataactcgaatat

SEQ ID NO: 11492 - DNA, 20 bp, Artificial Sequence
  Synthetic oligonucleotide; TAG chr11 5250880 5250899 5250896 +
actcgaatattagtgtactt

SEQ ID NO: 11493 - DNA, 20 bp, Artificial Sequence
  Synthetic oligonucleotide; CAG chr11 5250884 5250903 5250900 +
gaatattagtgtactttaga

SEQ ID NO: 11494 - DNA, 20 bp, Artificial Sequence
  Synthetic oligonucleotide; CAG chr11 5250901 5250920 5250917 +
agacagctttatttctaaca

SEQ ID NO: 11495 - DNA, 20 bp, Artificial Sequence
  Synthetic oligonucleotide; TGG chr11 5250921 5250940 5250937 +
cagtgctgtttctgacatat

SEQ ID NO: 11496 - DNA, 20 bp, Artificial Sequence
  Synthetic oligonucleotide; CAG chr11 5250932 5250951 5250948 +
ctgacatattggaccattaa

SEQ ID NO: 11497 - DNA, 20 bp, Artificial Sequence
  Synthetic oligonucleotide; AGG chr11 5250933 5250952 5250949 +
tgacatattggaccattaac

SEQ ID NO: 11498 - DNA, 20 bp, Artificial Sequence
  Synthetic oligonucleotide; GGG chr11 5250934 5250953 5250950 +
gacatattggaccattaaca

SEQ ID NO: 11499 - DNA, 20 bp, Artificial Sequence
  Synthetic oligonucleotide; TAG chr11 5250937 5250956 5250953 +
atattggaccattaacaggg

SEQ ID NO: 11500 - DNA, 20 bp, Artificial Sequence
  Synthetic oligonucleotide; AGG chr11 5250938 5250957 5250954 +
tattggaccattaacagggt

SEQ ID NO: 11501 - DNA, 20 bp, Artificial Sequence
  Synthetic oligonucleotide; AAG chr11 5250941 5250960 5250957 +
tggaccattaacagggtagg

SEQ ID NO: 11502 - DNA, 20 bp, Artificial Sequence
  Synthetic oligonucleotide; TGG chr11 5250950 5250969 5250966 +
aacagggtaggaagtattta

SEQ ID NO: 11503 - DNA, 20 bp, Artificial Sequence
  Synthetic oligonucleotide; TGG chr11 5250953 5250972 5250969 +
agggtaggaagtatttatgg

SEQ ID NO: 11504 - DNA, 20 bp, Artificial Sequence
  Synthetic oligonucleotide; TGG chr11 5250961 5250980 5250977 +
aagtatttatggtggttttt

SEQ ID NO: 11505 - DNA, 20 bp, Artificial Sequence
  Synthetic oligonucleotide; TGG chr11 5250978 5250997 5250994 +
ttttggttctgttttgcttt

SEQ ID NO: 11506 - DNA, 20 bp, Artificial Sequence
  Synthetic oligonucleotide; TAG chr11 5250982 5251001 5250998 +
ggttctgttttgcttttggt

SEQ ID NO: 11507 - DNA, 20 bp, Artificial Sequence
  Synthetic oligonucleotide; AAG chr11 5251006 5251025 5251022 +
ttgtttttgtttttctctga

SEQ ID NO: 11508 - DNA, 20 bp, Artificial Sequence
  Synthetic oligonucleotide; TAG chr11 5251032 5251051 5251048 +
tccatgatctctaaccttgc

SEQ ID NO: 11509 - DNA, 20 bp, Artificial Sequence
  Synthetic oligonucleotide; CAG chr11 5251045 5251064 5251061 +
accttgctagattataatgc

SEQ ID NO: 11510 - DNA, 20 bp, Artificial Sequence
  Synthetic oligonucleotide; AAG chr11 5251048 5251067 5251064 +
ttgctagattataatgccag

SEQ ID NO: 11511 - DNA, 20 bp, Artificial Sequence
  Synthetic oligonucleotide; TGG chr11 5251054 5251073 5251070 +
gattataatgccagaagctc

SEQ ID NO: 11512 - DNA, 20 bp, Artificial Sequence
  Synthetic oligonucleotide; TGG chr11 5251062 5251081 5251078 +
tgccagaagctctggaattc

SEQ ID NO: 11513 - DNA, 20 bp, Artificial Sequence
  Synthetic oligonucleotide; CGG chr11 5251070 5251089 5251086 +
gctctggaattctggcttat

SEQ ID NO: 11514 - DNA, 20 bp, Artificial Sequence
  Synthetic oligonucleotide; GAG chr11 5251072 5251091 5251088 +
tctggaattctggcttatcg

SEQ ID NO: 11515 - DNA, 20 bp, Artificial Sequence
  Synthetic oligonucleotide; AGG chr11 5251073 5251092 5251089 +
ctggaattctggcttatcgg

SEQ ID NO: 11516 - DNA, 20 bp, Artificial Sequence
  Synthetic oligonucleotide; AAG chr11 5251077 5251096 5251093 +
aattctggcttatcggaggc

SEQ ID NO: 11517 - DNA, 20 bp, Artificial Sequence
  Synthetic oligonucleotide; TAG chr11 5251094 5251113 5251110 +
ggcaagctgtatcttcaaat

SEQ ID NO: 11518 - DNA, 20 bp, Artificial Sequence
  Synthetic oligonucleotide; AAG chr11 5251107 5251126 5251123 +
ttcaaattagtttatcccct

SEQ ID NO: 11519 - DNA, 20 bp, Artificial Sequence
  Synthetic oligonucleotide; CAG chr11 5251114 5251133 5251130 +
tagtttatcccctaagctat

SEQ ID NO: 11520 - DNA, 20 bp, Artificial Sequence
  Synthetic oligonucleotide; AGG chr11 5251115 5251134 5251131 +
agtttatcccctaagctatc

SEQ ID NO: 11521 - DNA, 20 bp, Artificial Sequence
  Synthetic oligonucleotide; TGG chr11 5251140 5251159 5251156 +
gattgaaattattataatat

SEQ ID NO: 11522 - DNA, 20 bp, Artificial Sequence
  Synthetic oligonucleotide; AAG chr11 5251175 5251194 5251191 +
atccttcatgatcctgtgta

SEQ ID NO: 11523 - DNA, 20 bp, Artificial Sequence
  Synthetic oligonucleotide; CAG chr11 5251198 5251217 5251214 +
cttatatctgctcattgata

SEQ ID NO: 11524 - DNA, 20 bp, Artificial Sequence
  Synthetic oligonucleotide; TGG chr11 5251202 5251221 5251218 +
tatctgctcattgatacaga

SEQ ID NO: 11525 - DNA, 20 bp, Artificial Sequence
  Synthetic oligonucleotide; AAG chr11 5251209 5251228 5251225 +
tcattgatacagatggctaa

SEQ ID NO: 11526 - DNA, 20 bp, Artificial Sequence
  Synthetic oligonucleotide; AGG chr11 5251210 5251229 5251226 +
cattgatacagatggctaaa

SEQ ID NO: 11527 - DNA, 20 bp, Artificial Sequence
  Synthetic oligonucleotide; CAG chr11 5251214 5251233 5251230 +
gatacagatggctaaaaggc

SEQ ID NO: 11528 - DNA, 20 bp, Artificial Sequence
  Synthetic oligonucleotide; AAG chr11 5251218 5251237 5251234 +
cagatggctaaaaggccaga

SEQ ID NO: 11529 - DNA, 20 bp, Artificial Sequence
  Synthetic oligonucleotide; AAG chr11 5251242 5251261 5251258 +
cacacatttacccatgtaac

SEQ ID NO: 11530 - DNA, 20 bp, Artificial Sequence
  Synthetic oligonucleotide; AAG chr11 5251300 5251319 5251316 +
atgaaatgaaataaaattaa

SEQ ID NO: 11531 - DNA, 20 bp, Artificial Sequence
  Synthetic oligonucleotide; AGG chr11 5251301 5251320 5251317 +
tgaaatgaaataaaattaaa

SEQ ID NO: 11532 - DNA, 20 bp, Artificial Sequence
  Synthetic oligonucleotide; TGG chr11 5251316 5251335 5251332 +
ttaaaaggaaaaaaatgcca

SEQ ID NO: 11533 - DNA, 20 bp, Artificial Sequence
  Synthetic oligonucleotide; CAG chr11 5251325 5251344 5251341 +
aaaaaatgccatggcaacat

SEQ ID NO: 11534 - DNA, 20 bp, Artificial Sequence
  Synthetic oligonucleotide; AGG chr11 5251326 5251345 5251342 +
aaaaatgccatggcaacatc

SEQ ID NO: 11535 - DNA, 20 bp, Artificial Sequence
  Synthetic oligonucleotide; AAG chr11 5251329 5251348 5251345 +
aatgccatggcaacatcagg

SEQ ID NO: 11536 - DNA, 20 bp, Artificial Sequence
  Synthetic oligonucleotide; TGG chr11 5251342 5251361 5251358 +
catcaggaagttatctttta

SEQ ID NO: 11537 - DNA, 20 bp, Artificial Sequence
  Synthetic oligonucleotide; TGG chr11 5251353 5251372 5251369 +
tatcttttatggtctaaaaa

SEQ ID NO: 11538 - DNA, 20 bp, Artificial Sequence
  Synthetic oligonucleotide; GGG chr11 5251354 5251373 5251370 +
atcttttatggtctaaaaat

SEQ ID NO: 11539 - DNA, 20 bp, Artificial Sequence
  Synthetic oligonucleotide; CAG chr11 5251357 5251376 5251373 +
ttttatggtctaaaaatggg

SEQ ID NO: 11540 - DNA, 20 bp, Artificial Sequence
  Synthetic oligonucleotide; TAG chr11 5251382 5251401 5251398 +
taaataatctaccccttgtt

SEQ ID NO: 11541 - DNA, 20 bp, Artificial Sequence
  Synthetic oligonucleotide; CGG chr11 5251413 5251432 5251429 +
tgaaaaataacaataaaaat

SEQ ID NO: 11542 - DNA, 20 bp, Artificial Sequence
  Synthetic oligonucleotide; CAG chr11 5251420 5251439 5251436 +
taacaataaaaatcggcaac

SEQ ID NO: 11543 - DNA, 20 bp, Artificial Sequence
  Synthetic oligonucleotide; TAG chr11 5251423 5251442 5251439 +
caataaaaatcggcaaccag

SEQ ID NO: 11544 - DNA, 20 bp, Artificial Sequence
  Synthetic oligonucleotide; AAG chr11 5251449 5251468 5251465 +
ttgcgtctactctgcctatg

SEQ ID NO: 11545 - DNA, 20 bp, Artificial Sequence
  Synthetic oligonucleotide; TAG chr11 5251452 5251471 5251468 +
cgtctactctgcctatgaag

SEQ ID NO: 11546 - DNA, 20 bp, Artificial Sequence
  Synthetic oligonucleotide; AAG chr11 5251506 5251525 5251522 +
cttgttttactaaaaaaaaa

SEQ ID NO: 11547 - DNA, 20 bp, Artificial Sequence
  Synthetic oligonucleotide; AGG chr11 5251507 5251526 5251523 +
ttgttttactaaaaaaaaaa

SEQ ID NO: 11548 - DNA, 20 bp, Artificial Sequence
  Synthetic oligonucleotide; AAG chr11 5251513 5251532 5251529 +
tactaaaaaaaaaaaggaca

SEQ ID NO: 11549 - DNA, 20 bp, Artificial Sequence
  Synthetic oligonucleotide; AAG chr11 5251517 5251536 5251533 +
aaaaaaaaaaaggacaaaga

SEQ ID NO: 11550 - DNA, 20 bp, Artificial Sequence
  Synthetic oligonucleotide; AAG chr11 5251521 5251540 5251537 +
aaaaaaaggacaaagaaaga

SEQ ID NO: 11551 - DNA, 20 bp, Artificial Sequence
  Synthetic oligonucleotide; TGG chr11 5251538 5251557 5251554 +
agaaagtgcgaattgtgaaa

SEQ ID NO: 11552 - DNA, 20 bp, Artificial Sequence
  Synthetic oligonucleotide; TAG chr11 5251541 5251560 5251557 +
aagtgcgaattgtgaaatgg

SEQ ID NO: 11553 - DNA, 20 bp, Artificial Sequence
  Synthetic oligonucleotide; GAG chr11 5251545 5251564 5251561 +
gcgaattgtgaaatggtagt

SEQ ID NO: 11554 - DNA, 20 bp, Artificial Sequence
  Synthetic oligonucleotide; TGG chr11 5251551 5251570 5251567 +
tgtgaaatggtagtgagtga

SEQ ID NO: 11555 - DNA, 20 bp, Artificial Sequence
  Synthetic oligonucleotide; AAG chr11 5251560 5251579 5251576 +
gtagtgagtgatggcatttg

SEQ ID NO: 11556 - DNA, 20 bp, Artificial Sequence
  Synthetic oligonucleotide; TGG chr11 5251563 5251582 5251579 +
gtgagtgatggcatttgaag

SEQ ID NO: 11557 - DNA, 20 bp, Artificial Sequence
  Synthetic oligonucleotide; GGG chr11 5251564 5251583 5251580 +
tgagtgatggcatttgaagt

SEQ ID NO: 11558 - DNA, 20 bp, Artificial Sequence
  Synthetic oligonucleotide; TGG chr11 5251582 5251601 5251598 +
gtgggtcctttatgatttga

SEQ ID NO: 11559 - DNA, 20 bp, Artificial Sequence
  Synthetic oligonucleotide; GAG chr11 5251584 5251603 5251600 +
gggtcctttatgatttgatg

SEQ ID NO: 11560 - DNA, 20 bp, Artificial Sequence
  Synthetic oligonucleotide; CAG chr11 5251588 5251607 5251604 +
cctttatgatttgatggagc

SEQ ID NO: 11561 - DNA, 20 bp, Artificial Sequence
  Synthetic oligonucleotide; AGG chr11 5251589 5251608 5251605 +
ctttatgatttgatggagcc

SEQ ID NO: 11562 - DNA, 20 bp, Artificial Sequence
  Synthetic oligonucleotide; CAG chr11 5251592 5251611 5251608 +
tatgatttgatggagccagg

SEQ ID NO: 11563 - DNA, 20 bp, Artificial Sequence
  Synthetic oligonucleotide; AAG chr11 5251595 5251614 5251611 +
gatttgatggagccaggcag

SEQ ID NO: 11564 - DNA, 20 bp, Artificial Sequence
  Synthetic oligonucleotide; TGG chr11 5251603 5251622 5251619 +
ggagccaggcagaagacgtt

SEQ ID NO: 11565 - DNA, 20 bp, Artificial Sequence
  Synthetic oligonucleotide; GAG chr11 5251605 5251624 5251621 +
agccaggcagaagacgtttg

SEQ ID NO: 11566 - DNA, 20 bp, Artificial Sequence
  Synthetic oligonucleotide; AAG chr11 5251609 5251628 5251625 +
aggcagaagacgtttggaga

SEQ ID NO: 11567 - DNA, 20 bp, Artificial Sequence
  Synthetic oligonucleotide; AAG chr11 5251612 5251631 5251628 +
cagaagacgtttggagaaag

SEQ ID NO: 11568 - DNA, 20 bp, Artificial Sequence
  Synthetic oligonucleotide; AAG chr11 5251622 5251641 5251638 +
ttggagaaagaagttcctga

SEQ ID NO: 11569 - DNA, 20 bp, Artificial Sequence
  Synthetic oligonucleotide; TAG chr11 5251625 5251644 5251641 +
gagaaagaagttcctgaaag

SEQ ID NO: 11570 - DNA, 20 bp, Artificial Sequence
  Synthetic oligonucleotide; AGG chr11 5251626 5251645 5251642 +
agaaagaagttcctgaaagt

SEQ ID NO: 11571 - DNA, 20 bp, Artificial Sequence
  Synthetic oligonucleotide; AAG chr11 5251629 5251648 5251645 +
aagaagttcctgaaagtagg

SEQ ID NO: 11572 - DNA, 20 bp, Artificial Sequence
  Synthetic oligonucleotide; AGG chr11 5251630 5251649 5251646 +
agaagttcctgaaagtagga

SEQ ID NO: 11573 - DNA, 20 bp, Artificial Sequence
  Synthetic oligonucleotide; GGG chr11 5251631 5251650 5251647 +
gaagttcctgaaagtaggaa

SEQ ID NO: 11574 - DNA, 20 bp, Artificial Sequence
  Synthetic oligonucleotide; TGG chr11 5251638 5251657 5251654 +
ctgaaagtaggaagggcatg

SEQ ID NO: 11575 - DNA, 20 bp, Artificial Sequence
  Synthetic oligonucleotide; GAG chr11 5251649 5251668 5251665 +
aagggcatgtggaaaactct

SEQ ID NO: 11576 - DNA, 20 bp, Artificial Sequence
  Synthetic oligonucleotide; AGG chr11 5251650 5251669 5251666 +
agggcatgtggaaaactctg

SEQ ID NO: 11577 - DNA, 20 bp, Artificial Sequence
  Synthetic oligonucleotide; GAG chr11 5251655 5251674 5251671 +
atgtggaaaactctgaggct

SEQ ID NO: 11578 - DNA, 20 bp, Artificial Sequence
  Synthetic oligonucleotide; AGG chr11 5251656 5251675 5251672 +
tgtggaaaactctgaggctg

SEQ ID NO: 11579 - DNA, 20 bp, Artificial Sequence
  Synthetic oligonucleotide; AAG chr11 5251665 5251684 5251681 +
ctctgaggctgaggaaaaaa

SEQ ID NO: 11580 - DNA, 20 bp, Artificial Sequence
  Synthetic oligonucleotide; AAG chr11 5251669 5251688 5251685 +
gaggctgaggaaaaaaaaga

SEQ ID NO: 11581 - DNA, 20 bp, Artificial Sequence
  Synthetic oligonucleotide; AAG chr11 5251673 5251692 5251689 +
ctgaggaaaaaaaagaaaga

SEQ ID NO: 11582 - DNA, 20 bp, Artificial Sequence
  Synthetic oligonucleotide; AAG chr11 5251683 5251702 5251699 +
aaaagaaagaaagaaatata

SEQ ID NO: 11583 - DNA, 20 bp, Artificial Sequence
  Synthetic oligonucleotide; AAG chr11 5251687 5251706 5251703 +
gaaagaaagaaatataaaga

SEQ ID NO: 11584 - DNA, 20 bp, Artificial Sequence
  Synthetic oligonucleotide; AAG chr11 5251723 5251742 5251739 +
actgtatataaacacattac

SEQ ID NO: 11585 - DNA, 20 bp, Artificial Sequence
  Synthetic oligonucleotide; AAG chr11 5251730 5251749 5251746 +
ataaacacattacaagccta

SEQ ID NO: 11586 - DNA, 20 bp, Artificial Sequence
  Synthetic oligonucleotide; AAG chr11 5251740 5251759 5251756 +
tacaagcctaaagtacgttg

SEQ ID NO: 11587 - DNA, 20 bp, Artificial Sequence
  Synthetic oligonucleotide; TAG chr11 5251749 5251768 5251765 +
aaagtacgttgaagaaaaaa

SEQ ID NO: 11588 - DNA, 20 bp, Artificial Sequence
  Synthetic oligonucleotide; AAG chr11 5251758 5251777 5251774 +
tgaagaaaaaatagaattca

SEQ ID NO: 11589 - DNA, 20 bp, Artificial Sequence
  Synthetic oligonucleotide; TAG chr11 5251762 5251781 5251778 +
gaaaaaatagaattcaaagt

SEQ ID NO: 11590 - DNA, 20 bp, Artificial Sequence
  Synthetic oligonucleotide; CAG chr11 5251766 5251785 5251782 +
aaatagaattcaaagttaga

SEQ ID NO: 11591 - DNA, 20 bp, Artificial Sequence
  Synthetic oligonucleotide; AAG chr11 5251769 5251788 5251785 +
tagaattcaaagttagacag

SEQ ID NO: 11592 - DNA, 20 bp, Artificial Sequence
  Synthetic oligonucleotide; AGG chr11 5251770 5251789 5251786 +
agaattcaaagttagacaga

SEQ ID NO: 11593 - DNA, 20 bp, Artificial Sequence
  Synthetic oligonucleotide; GGG chr11 5251771 5251790 5251787 +
gaattcaaagttagacagaa

SEQ ID NO: 11594 - DNA, 20 bp, Artificial Sequence
  Synthetic oligonucleotide; CAG chr11 5251776 5251795 5251792 +
caaagttagacagaagggct

SEQ ID NO: 11595 - DNA, 20 bp, Artificial Sequence
  Synthetic oligonucleotide; AGG chr11 5251777 5251796 5251793 +
aaagttagacagaagggctc

SEQ ID NO: 11596 - DNA, 20 bp, Artificial Sequence
  Synthetic oligonucleotide; CAG chr11 5251798 5251817 5251814 +
ggcttactatttgcatctta

SEQ ID NO: 11597 - DNA, 20 bp, Artificial Sequence
  Synthetic oligonucleotide; GAG chr11 5251803 5251822 5251819 +
actatttgcatcttacagat

SEQ ID NO: 11598 - DNA, 20 bp, Artificial Sequence
  Synthetic oligonucleotide; GAG chr11 5251805 5251824 5251821 +
tatttgcatcttacagatga

SEQ ID NO: 11599 - DNA, 20 bp, Artificial Sequence
  Synthetic oligonucleotide; TAG chr11 5251808 5251827 5251824 +
ttgcatcttacagatgagag

SEQ ID NO: 11600 - DNA, 20 bp, Artificial Sequence
  Synthetic oligonucleotide; TAG chr11 5251811 5251830 5251827 +
catcttacagatgagagtag

SEQ ID NO: 11601 - DNA, 20 bp, Artificial Sequence
  Synthetic oligonucleotide; GAG chr11 5251813 5251832 5251829 +
tcttacagatgagagtagta

SEQ ID NO: 11602 - DNA, 20 bp, Artificial Sequence
  Synthetic oligonucleotide; TGG chr11 5251817 5251836 5251833 +
acagatgagagtagtagagt

SEQ ID NO: 11603 - DNA, 20 bp, Artificial Sequence
  Synthetic oligonucleotide; CAG chr11 5251837 5251856 5251853 +
tggtattttattctgaaaca

SEQ ID NO: 11604 - DNA, 20 bp, Artificial Sequence
  Synthetic oligonucleotide; GAG chr11 5251839 5251858 5251855 +
gtattttattctgaaacaca

SEQ ID NO: 11605 - DNA, 20 bp, Artificial Sequence
  Synthetic oligonucleotide; AGG chr11 5251840 5251859 5251856 +
tattttattctgaaacacag

SEQ ID NO: 11606 - DNA, 20 bp, Artificial Sequence
  Synthetic oligonucleotide; AAG chr11 5251845 5251864 5251861 +
tattctgaaacacagaggac

SEQ ID NO: 11607 - DNA, 20 bp, Artificial Sequence
  Synthetic oligonucleotide; TGG chr11 5251848 5251867 5251864 +
tctgaaacacagaggacaag

SEQ ID NO: 11608 - DNA, 20 bp, Artificial Sequence
  Synthetic oligonucleotide; GAG chr11 5251850 5251869 5251866 +
tgaaacacagaggacaagtg

SEQ ID NO: 11609 - DNA, 20 bp, Artificial Sequence
  Synthetic oligonucleotide; GAG chr11 5251865 5251884 5251881 +
aagtggagatttgtaaacct

SEQ ID NO: 11610 - DNA, 20 bp, Artificial Sequence
  Synthetic oligonucleotide; TGG chr11 5251875 5251894 5251891 +
ttgtaaacctgagataaaca

SEQ ID NO: 11611 - DNA, 20 bp, Artificial Sequence
  Synthetic oligonucleotide; AAG chr11 5251899 5251918 5251915 +
ttctaatccactgaacaccg

SEQ ID NO: 11612 - DNA, 20 bp, Artificial Sequence
  Synthetic oligonucleotide; TAG chr11 5251935 5251954 5251951 +
ctttcttcatctgccttact

SEQ ID NO: 11613 - DNA, 20 bp, Artificial Sequence
  Synthetic oligonucleotide; AAG chr11 5251941 5251960 5251957 +
tcatctgccttacttagtgc

SEQ ID NO: 11614 - DNA, 20 bp, Artificial Sequence
  Synthetic oligonucleotide; AGG chr11 5251942 5251961 5251958 +
catctgccttacttagtgca

SEQ ID NO: 11615 - DNA, 20 bp, Artificial Sequence
  Synthetic oligonucleotide; TAG chr11 5251958 5251977 5251974 +
tgcaaggtgctataacaaaa

SEQ ID NO: 11616 - DNA, 20 bp, Artificial Sequence
  Synthetic oligonucleotide; TAG chr11 5251963 5251982 5251979 +
ggtgctataacaaaatagca

SEQ ID NO: 11617 - DNA, 20 bp, Artificial Sequence
  Synthetic oligonucleotide; TGG chr11 5251968 5251987 5251984 +
tataacaaaatagcatagac

SEQ ID NO: 11618 - DNA, 20 bp, Artificial Sequence
  Synthetic oligonucleotide; GGG chr11 5251969 5251988 5251985 +
ataacaaaatagcatagact

SEQ ID NO: 11619 - DNA, 20 bp, Artificial Sequence
  Synthetic oligonucleotide; CAG chr11 5251984 5252003 5252000 +
agactgggtgacttcaacaa

SEQ ID NO: 11620 - DNA, 20 bp, Artificial Sequence
  Synthetic oligonucleotide; AGG chr11 5251985 5252004 5252001 +
gactgggtgacttcaacaac

SEQ ID NO: 11621 - DNA, 20 bp, Artificial Sequence
  Synthetic oligonucleotide; TGG chr11 5252008 5252027 5252024 +
attttttctcacttttctgc

SEQ ID NO: 11622 - DNA, 20 bp, Artificial Sequence
  Synthetic oligonucleotide; TGG chr11 5252015 5252034 5252031 +
ctcacttttctgctggttcc

SEQ ID NO: 11623 - DNA, 20 bp, Artificial Sequence
  Synthetic oligonucleotide; CAG chr11 5252019 5252038 5252035 +
cttttctgctggttcctggt

SEQ ID NO: 11624 - DNA, 20 bp, Artificial Sequence
  Synthetic oligonucleotide; AGG chr11 5252020 5252039 5252036 +
ttttctgctggttcctggtc

SEQ ID NO: 11625 - DNA, 20 bp, Artificial Sequence
  Synthetic oligonucleotide; GGG chr11 5252021 5252040 5252037 +
tttctgctggttcctggtca

SEQ ID NO: 11626 - DNA, 20 bp, Artificial Sequence
  Synthetic oligonucleotide; TGG chr11 5252033 5252052 5252049 +
cctggtcagggctctcttcc

SEQ ID NO: 11627 - DNA, 20 bp, Artificial Sequence
  Synthetic oligonucleotide; GGG chr11 5252034 5252053 5252050 +
ctggtcagggctctcttcct

SEQ ID NO: 11628 - DNA, 20 bp, Artificial Sequence
  Synthetic oligonucleotide; CAG chr11 5252040 5252059 5252056 +
agggctctcttcctgggttg

SEQ ID NO: 11629 - DNA, 20 bp, Artificial Sequence
  Synthetic oligonucleotide; AGG chr11 5252041 5252060 5252057 +
gggctctcttcctgggttgc

SEQ ID NO: 11630 - DNA, 20 bp, Artificial Sequence
  Synthetic oligonucleotide; TGG chr11 5252044 5252063 5252060 +
ctctcttcctgggttgcagg

SEQ ID NO: 11631 - DNA, 20 bp, Artificial Sequence
  Synthetic oligonucleotide; CAG chr11 5252070 5252089 5252086 +
acttcccactgtgtcctcac

SEQ ID NO: 11632 - DNA, 20 bp, Artificial Sequence
  Synthetic oligonucleotide; AAG chr11 5252073 5252092 5252089 +
tcccactgtgtcctcaccag

SEQ ID NO: 11633 - DNA, 20 bp, Artificial Sequence
  Synthetic oligonucleotide; AGG chr11 5252074 5252093 5252090 +
cccactgtgtcctcaccaga

SEQ ID NO: 11634 - DNA, 20 bp, Artificial Sequence
  Synthetic oligonucleotide; AAG chr11 5252077 5252096 5252093 +
actgtgtcctcaccagaagg

SEQ ID NO: 11635 - DNA, 20 bp, Artificial Sequence
  Synthetic oligonucleotide; GAG chr11 5252079 5252098 5252095 +
tgtgtcctcaccagaaggaa

SEQ ID NO: 11636 - DNA, 20 bp, Artificial Sequence
  Synthetic oligonucleotide; TGG chr11 5252085 5252104 5252101 +
ctcaccagaaggaagagaaa

SEQ ID NO: 11637 - DNA, 20 bp, Artificial Sequence
  Synthetic oligonucleotide; GAG chr11 5252108 5252127 5252124 +
ctaatctctctgcttctgat

SEQ ID NO: 11638 - DNA, 20 bp, Artificial Sequence
  Synthetic oligonucleotide; AGG chr11 5252109 5252128 5252125 +
taatctctctgcttctgatg

SEQ ID NO: 11639 - DNA, 20 bp, Artificial Sequence
  Synthetic oligonucleotide; TGG chr11 5252127 5252146 5252143 +
tgaggaaaataattctatga

SEQ ID NO: 11640 - DNA, 20 bp, Artificial Sequence
  Synthetic oligonucleotide; GGG chr11 5252128 5252147 5252144 +
gaggaaaataattctatgat

SEQ ID NO: 11641 - DNA, 20 bp, Artificial Sequence
  Synthetic oligonucleotide; GGG chr11 5252129 5252148 5252145 +
aggaaaataattctatgatg

SEQ ID NO: 11642 - DNA, 20 bp, Artificial Sequence
  Synthetic oligonucleotide; GAG chr11 5252144 5252163 5252160 +
tgatggggatctgctctcat

SEQ ID NO: 11643 - DNA, 20 bp, Artificial Sequence
  Synthetic oligonucleotide; AAG chr11 5252173 5252192 5252189 +
taaacctgattacttttcca

SEQ ID NO: 11644 - DNA, 20 bp, Artificial Sequence
  Synthetic oligonucleotide; TGG chr11 5252189 5252208 5252205 +
tccaaagcctcccccacaaa

SEQ ID NO: 11645 - DNA, 20 bp, Artificial Sequence
  Synthetic oligonucleotide; GAG chr11 5252191 5252210 5252207 +
caaagcctcccccacaaatg

SEQ ID NO: 11646 - DNA, 20 bp, Artificial Sequence
  Synthetic oligonucleotide; TGG chr11 5252199 5252218 5252215 +
cccccacaaatggagccaat

SEQ ID NO: 11647 - DNA, 20 bp, Artificial Sequence
  Synthetic oligonucleotide; GGG chr11 5252200 5252219 5252216 +
ccccacaaatggagccaatt

SEQ ID NO: 11648 - DNA, 20 bp, Artificial Sequence
  Synthetic oligonucleotide; GAG chr11 5252202 5252221 5252218 +
ccacaaatggagccaattgg

SEQ ID NO: 11649 - DNA, 20 bp, Artificial Sequence
  Synthetic oligonucleotide; TGG chr11 5252206 5252225 5252222 +
aaatggagccaattgggagt

SEQ ID NO: 11650 - DNA, 20 bp, Artificial Sequence
  Synthetic oligonucleotide; GGG chr11 5252207 5252226 5252223 +
aatggagccaattgggagtt

SEQ ID NO: 11651 - DNA, 20 bp, Artificial Sequence
  Synthetic oligonucleotide; GGG chr11 5252208 5252227 5252224 +
atggagccaattgggagttg

SEQ ID NO: 11652 - DNA, 20 bp, Artificial Sequence
  Synthetic oligonucleotide; CAG chr11 5252214 5252233 5252230 +
ccaattgggagttggggatt

SEQ ID NO: 11653 - DNA, 20 bp, Artificial Sequence
  Synthetic oligonucleotide; TGG chr11 5252230 5252249 5252246 +
gattcagcatgtgaattttc

SEQ ID NO: 11654 - DNA, 20 bp, Artificial Sequence
  Synthetic oligonucleotide; GAG chr11 5252232 5252251 5252248 +
ttcagcatgtgaattttctg

SEQ ID NO: 11655 - DNA, 20 bp, Artificial Sequence
  Synthetic oligonucleotide; AAG chr11 5252239 5252258 5252255 +
tgtgaattttctggagacac

SEQ ID NO: 11656 - DNA, 20 bp, Artificial Sequence
  Synthetic oligonucleotide; AAG chr11 5252246 5252265 5252262 +
tttctggagacacaagcgtt

SEQ ID NO: 11657 - DNA, 20 bp, Artificial Sequence
  Synthetic oligonucleotide; AAG chr11 5252313 5252332 5252329 +
gcattaactttcaattatat

SEQ ID NO: 11658 - DNA, 20 bp, Artificial Sequence
  Synthetic oligonucleotide; CAG chr11 5252321 5252340 5252337 +
tttcaattatataagaactc

SEQ ID NO: 11659 - DNA, 20 bp, Artificial Sequence
  Synthetic oligonucleotide; GAG chr11 5252399 5252418 5252415 +
gaccgtgctgttctgctgct

SEQ ID NO: 11660 - DNA, 20 bp, Artificial Sequence
  Synthetic oligonucleotide; GAG chr11 5252427 5252446 5252443 +
acacgctgatgctgacttgt

SEQ ID NO: 11661 - DNA, 20 bp, Artificial Sequence
  Synthetic oligonucleotide; TGG chr11 5252437 5252456 5252453 +
gctgacttgtgagcttctgc

SEQ ID NO: 11662 - DNA, 20 bp, Artificial Sequence
  Synthetic oligonucleotide; AAG chr11 5252456 5252475 5252472 +
ctggctcatttccttcacct

SEQ ID NO: 11663 - DNA, 20 bp, Artificial Sequence
  Synthetic oligonucleotide; TAG chr11 5252471 5252490 5252487 +
cacctaagtccccacctccc

SEQ ID NO: 11664 - DNA, 20 bp, Artificial Sequence
  Synthetic oligonucleotide; AAG chr11 5252474 5252493 5252490 +
ctaagtccccacctccctag

SEQ ID NO: 11665 - DNA, 20 bp, Artificial Sequence
  Synthetic oligonucleotide; GAG chr11 5252485 5252504 5252501 +
cctccctagaagcttacaat

SEQ ID NO: 11666 - DNA, 20 bp, Artificial Sequence
  Synthetic oligonucleotide; AGG chr11 5252486 5252505 5252502 +
ctccctagaagcttacaatg

SEQ ID NO: 11667 - DNA, 20 bp, Artificial Sequence
  Synthetic oligonucleotide; CAG chr11 5252512 5252531 5252528 +
cctccttgaaatgctgtgac

SEQ ID NO: 11668 - DNA, 20 bp, Artificial Sequence
  Synthetic oligonucleotide; TAG chr11 5252519 5252538 5252535 +
gaaatgctgtgaccagtctg

SEQ ID NO: 11669 - DNA, 20 bp, Artificial Sequence
  Synthetic oligonucleotide; AAG chr11 5252526 5252545 5252542 +
tgtgaccagtctgtagactt

SEQ ID NO: 11670 - DNA, 20 bp, Artificial Sequence
  Synthetic oligonucleotide; AGG chr11 5252527 5252546 5252543 +
gtgaccagtctgtagactta

SEQ ID NO: 11671 - DNA, 20 bp, Artificial Sequence
  Synthetic oligonucleotide; GGG chr11 5252528 5252547 5252544 +
tgaccagtctgtagacttaa

SEQ ID NO: 11672 - DNA, 20 bp, Artificial Sequence
  Synthetic oligonucleotide; TGG chr11 5252533 5252552 5252549 +
agtctgtagacttaagggta

SEQ ID NO: 11673 - DNA, 20 bp, Artificial Sequence
  Synthetic oligonucleotide; GGG chr11 5252534 5252553 5252550 +
gtctgtagacttaagggtat

SEQ ID NO: 11674 - DNA, 20 bp, Artificial Sequence
  Synthetic oligonucleotide; TAG chr11 5252553 5252572 5252569 +
tgggattaatttcacctctt

SEQ ID NO: 11675 - DNA, 20 bp, Artificial Sequence
  Synthetic oligonucleotide; AGG chr11 5252554 5252573 5252570 +
gggattaatttcacctcttt

SEQ ID NO: 11676 - DNA, 20 bp, Artificial Sequence
  Synthetic oligonucleotide; AAG chr11 5252580 5252599 5252596 +
gcgtcaacacttaaaatgaa

SEQ ID NO: 11677 - DNA, 20 bp, Artificial Sequence
  Synthetic oligonucleotide; TAG chr11 5252588 5252607 5252604 +
acttaaaatgaaaagttcct

SEQ ID NO: 11678 - DNA, 20 bp, Artificial Sequence
  Synthetic oligonucleotide; AAG chr11 5252593 5252612 5252609 +
aaatgaaaagttccttagta

SEQ ID NO: 11679 - DNA, 20 bp, Artificial Sequence
  Synthetic oligonucleotide; AAG chr11 5252597 5252616 5252613 +
gaaaagttccttagtaaagt

SEQ ID NO: 11680 - DNA, 20 bp, Artificial Sequence
  Synthetic oligonucleotide; AGG chr11 5252598 5252617 5252614 +
aaaagttccttagtaaagta

SEQ ID NO: 11681 - DNA, 20 bp, Artificial Sequence
  Synthetic oligonucleotide; TAG chr11 5252613 5252632 5252629 +
aagtaaggatcacttcattg

SEQ ID NO: 11682 - DNA, 20 bp, Artificial Sequence
  Synthetic oligonucleotide; TGG chr11 5252622 5252641 5252638 +
tcacttcattgtagttaccg

SEQ ID NO: 11683 - DNA, 20 bp, Artificial Sequence
  Synthetic oligonucleotide; AAG chr11 5252626 5252645 5252642 +
ttcattgtagttaccgtgga

SEQ ID NO: 11684 - DNA, 20 bp, Artificial Sequence
  Synthetic oligonucleotide; TAG chr11 5252674 5252693 5252690 +
ctaacacctcaacctccctg

SEQ ID NO: 11685 - DNA, 20 bp, Artificial Sequence
  Synthetic oligonucleotide; GAG chr11 5252676 5252695 5252692 +
aacacctcaacctccctgta

SEQ ID NO: 11686 - DNA, 20 bp, Artificial Sequence
  Synthetic oligonucleotide; AAG chr11 5252685 5252704 5252701 +
acctccctgtagagcctcac

SEQ ID NO: 11687 - DNA, 20 bp, Artificial Sequence
  Synthetic oligonucleotide; AGG chr11 5252686 5252705 5252702 +
cctccctgtagagcctcaca

SEQ ID NO: 11688 - DNA, 20 bp, Artificial Sequence
  Synthetic oligonucleotide; GGG chr11 5252687 5252706 5252703 +
ctccctgtagagcctcacaa

SEQ ID NO: 11689 - DNA, 20 bp, Artificial Sequence
  Synthetic oligonucleotide; GAG chr11 5252692 5252711 5252708 +
tgtagagcctcacaagggct

SEQ ID NO: 11690 - DNA, 20 bp, Artificial Sequence
  Synthetic oligonucleotide; AAG chr11 5252697 5252716 5252713 +
agcctcacaagggctgagaa

SEQ ID NO: 11691 - DNA, 20 bp, Artificial Sequence
  Synthetic oligonucleotide; CAG chr11 5252701 5252720 5252717 +
tcacaagggctgagaaaagc

SEQ ID NO: 11692 - DNA, 20 bp, Artificial Sequence
  Synthetic oligonucleotide; TGG chr11 5252711 5252730 5252727 +
tgagaaaagccagatgccgt

SEQ ID NO: 11693 - DNA, 20 bp, Artificial Sequence
  Synthetic oligonucleotide; TAG chr11 5252717 5252736 5252733 +
aagccagatgccgttggaaa

SEQ ID NO: 11694 - DNA, 20 bp, Artificial Sequence
  Synthetic oligonucleotide; TAG chr11 5252737 5252756 5252753 +
tagtattgcccctaataaaa

SEQ ID NO: 11695 - DNA, 20 bp, Artificial Sequence
  Synthetic oligonucleotide; TGG chr11 5252742 5252761 5252758 +
ttgcccctaataaaatagaa

SEQ ID NO: 11696 - DNA, 20 bp, Artificial Sequence
  Synthetic oligonucleotide; AAG chr11 5252773 5252792 5252789 +
gcctaaaccttgacttccta

SEQ ID NO: 11697 - DNA, 20 bp, Artificial Sequence
  Synthetic oligonucleotide; TGG chr11 5252778 5252797 5252794 +
aaccttgacttcctaaagct

SEQ ID NO: 11698 - DNA, 20 bp, Artificial Sequence
  Synthetic oligonucleotide; GAG chr11 5252798 5252817 5252814 +
tggaacactttttcttcgtt

SEQ ID NO: 11699 - DNA, 20 bp, Artificial Sequence
  Synthetic oligonucleotide; CAG chr11 5252828 5252847 5252844 +
ctcgctgctgtgctgcaatc

SEQ ID NO: 11700 - DNA, 20 bp, Artificial Sequence
  Synthetic oligonucleotide; AGG chr11 5252829 5252848 5252845 +
tcgctgctgtgctgcaatcc

SEQ ID NO: 11701 - DNA, 20 bp, Artificial Sequence
  Synthetic oligonucleotide; GGG chr11 5252830 5252849 5252846 +
cgctgctgtgctgcaatcca

SEQ ID NO: 11702 - DNA, 20 bp, Artificial Sequence
  Synthetic oligonucleotide; AAG chr11 5252833 5252852 5252849 +
tgctgtgctgcaatccaggg

SEQ ID NO: 11703 - DNA, 20 bp, Artificial Sequence
  Synthetic oligonucleotide; AGG chr11 5252834 5252853 5252850 +
gctgtgctgcaatccaggga

SEQ ID NO: 11704 - DNA, 20 bp, Artificial Sequence
  Synthetic oligonucleotide; GGG chr11 5252835 5252854 5252851 +
ctgtgctgcaatccagggaa

SEQ ID NO: 11705 - DNA, 20 bp, Artificial Sequence
  Synthetic oligonucleotide; GGG chr11 5252836 5252855 5252852 +
tgtgctgcaatccagggaag

SEQ ID NO: 11706 - DNA, 20 bp, Artificial Sequence
  Synthetic oligonucleotide; GGG chr11 5252837 5252856 5252853 +
gtgctgcaatccagggaagg

SEQ ID NO: 11707 - DNA, 20 bp, Artificial Sequence
  Synthetic oligonucleotide; CAG chr11 5252842 5252861 5252858 +
gcaatccagggaagggggtt

SEQ ID NO: 11708 - DNA, 20 bp, Artificial Sequence
  Synthetic oligonucleotide; GAG chr11 5252892 5252911 5252908 +
cttccaaaacatctgtttct

SEQ ID NO: 11709 - DNA, 20 bp, Artificial Sequence
  Synthetic oligonucleotide; AGG chr11 5252893 5252912 5252909 +
ttccaaaacatctgtttctg

SEQ ID NO: 11710 - DNA, 20 bp, Artificial Sequence
  Synthetic oligonucleotide; GAG chr11 5252895 5252914 5252911 +
ccaaaacatctgtttctgag

SEQ ID NO: 11711 - DNA, 20 bp, Artificial Sequence
  Synthetic oligonucleotide; TAG chr11 5252908 5252927 5252924 +
ttctgaggagtcctgtccta

SEQ ID NO: 11712 - DNA, 20 bp, Artificial Sequence
  Synthetic oligonucleotide; GAG chr11 5252910 5252929 5252926 +
ctgaggagtcctgtcctata

SEQ ID NO: 11713 - DNA, 20 bp, Artificial Sequence
  Synthetic oligonucleotide; AGG chr11 5252911 5252930 5252927 +
tgaggagtcctgtcctatag

SEQ ID NO: 11714 - DNA, 20 bp, Artificial Sequence
  Synthetic oligonucleotide; CAG chr11 5252927 5252946 5252943 +
atagaggtctttcttccaac

SEQ ID NO: 11715 - DNA, 20 bp, Artificial Sequence
  Synthetic oligonucleotide; CAG chr11 5252959 5252978 5252975 +
gcaccttttactcccacttg

SEQ ID NO: 11716 - DNA, 20 bp, Artificial Sequence
  Synthetic oligonucleotide; AAG chr11 5252975 5252994 5252991 +
cttgcagaactcccatgtac

SEQ ID NO: 11717 - DNA, 20 bp, Artificial Sequence
  Synthetic oligonucleotide; TAG chr11 5252991 5253010 5253007 +
gtacaagtttctttattgcc

SEQ ID NO: 11718 - DNA, 20 bp, Artificial Sequence
  Synthetic oligonucleotide; AAG chr11 5253038 5253057 5253054 +
cacatctaacgtaaacaaaa

SEQ ID NO: 11719 - DNA, 20 bp, Artificial Sequence
  Synthetic oligonucleotide; TGG chr11 5253043 5253062 5253059 +
ctaacgtaaacaaaaaagtg

SEQ ID NO: 11720 - DNA, 20 bp, Artificial Sequence
  Synthetic oligonucleotide; GAG chr11 5253045 5253064 5253061 +
aacgtaaacaaaaaagtgtg

SEQ ID NO: 11721 - DNA, 20 bp, Artificial Sequence
  Synthetic oligonucleotide; TAG chr11 5253071 5253090 5253087 +
gcacatgacacaaacacaca

SEQ ID NO: 11722 - DNA, 20 bp, Artificial Sequence
  Synthetic oligonucleotide; TGG chr11 5253121 5253140 5253137 +
cctcaacataaaaccctttg

SEQ ID NO: 11723 - DNA, 20 bp, Artificial Sequence
  Synthetic oligonucleotide; AAG chr11 5253138 5253157 5253154 +
ttgtggctcatatatttaaa

SEQ ID NO: 11724 - DNA, 20 bp, Artificial Sequence
  Synthetic oligonucleotide; AAG chr11 5253150 5253169 5253166 +
tatttaaaaagacataaaaa

SEQ ID NO: 11725 - DNA, 20 bp, Artificial Sequence
  Synthetic oligonucleotide; AAG chr11 5253158 5253177 5253174 +
aagacataaaaaaagaactg

SEQ ID NO: 11726 - DNA, 20 bp, Artificial Sequence
  Synthetic oligonucleotide; TAG chr11 5253180 5253199 5253196 +
gacaaccatgtgtgatctct

SEQ ID NO: 11727 - DNA, 20 bp, Artificial Sequence
  Synthetic oligonucleotide; CAG chr11 5253183 5253202 5253199 +
aaccatgtgtgatctcttag

SEQ ID NO: 11728 - DNA, 20 bp, Artificial Sequence
  Synthetic oligonucleotide; TAG chr11 5253188 5253207 5253204 +
tgtgtgatctcttagcagaa

SEQ ID NO: 11729 - DNA, 20 bp, Artificial Sequence
  Synthetic oligonucleotide; CAG chr11 5253211 5253230 5253227 +
atttattatttgattgcttg

SEQ ID NO: 11730 - DNA, 20 bp, Artificial Sequence
  Synthetic oligonucleotide; AAG chr11 5253218 5253237 5253234 +
atttgattgcttgcagaata

SEQ ID NO: 11731 - DNA, 20 bp, Artificial Sequence
  Synthetic oligonucleotide; AAG chr11 5253232 5253251 5253248 +
agaataaagcctatccttga

SEQ ID NO: 11732 - DNA, 20 bp, Artificial Sequence
  Synthetic oligonucleotide; TGG chr11 5253245 5253264 5253261 +
tccttgaaagctctgcatca

SEQ ID NO: 11733 - DNA, 20 bp, Artificial Sequence
  Synthetic oligonucleotide; GGG chr11 5253246 5253265 5253262 +
ccttgaaagctctgcatcat

SEQ ID NO: 11734 - DNA, 20 bp, Artificial Sequence
  Synthetic oligonucleotide; CAG chr11 5253249 5253268 5253265 +
tgaaagctctgcatcatggg

SEQ ID NO: 11735 - DNA, 20 bp, Artificial Sequence
  Synthetic oligonucleotide; GAG chr11 5253253 5253272 5253269 +
agctctgcatcatgggcagt

SEQ ID NO: 11736 - DNA, 20 bp, Artificial Sequence
  Synthetic oligonucleotide; CAG chr11 5253258 5253277 5253274 +
tgcatcatgggcagtgagct

SEQ ID NO: 11737 - DNA, 20 bp, Artificial Sequence
  Synthetic oligonucleotide; TGG chr11 5253261 5253280 5253277 +
atcatgggcagtgagctcag

SEQ ID NO: 11738 - DNA, 20 bp, Artificial Sequence
  Synthetic oligonucleotide; TGG chr11 5253268 5253287 5253284 +
gcagtgagctcagtggtatc

SEQ ID NO: 11739 - DNA, 20 bp, Artificial Sequence
  Synthetic oligonucleotide; GAG chr11 5253270 5253289 5253286 +
agtgagctcagtggtatctg

SEQ ID NO: 11740 - DNA, 20 bp, Artificial Sequence
  Synthetic oligonucleotide; AGG chr11 5253271 5253290 5253287 +
gtgagctcagtggtatctgg

SEQ ID NO: 11741 - DNA, 20 bp, Artificial Sequence
  Synthetic oligonucleotide; CAG chr11 5253275 5253294 5253291 +
gctcagtggtatctggagga

SEQ ID NO: 11742 - DNA, 20 bp, Artificial Sequence
  Synthetic oligonucleotide; AGG chr11 5253276 5253295 5253292 +
ctcagtggtatctggaggac

SEQ ID NO: 11743 - DNA, 20 bp, Artificial Sequence
  Synthetic oligonucleotide; GGG chr11 5253277 5253296 5253293 +
tcagtggtatctggaggaca

SEQ ID NO: 11744 - DNA, 20 bp, Artificial Sequence
  Synthetic oligonucleotide; TGG chr11 5253283 5253302 5253299 +
gtatctggaggacagggcac

SEQ ID NO: 11745 - DNA, 20 bp, Artificial Sequence
  Synthetic oligonucleotide; CAG chr11 5253292 5253311 5253308 +
ggacagggcactggccactc

SEQ ID NO: 11746 - DNA, 20 bp, Artificial Sequence
  Synthetic oligonucleotide; CAG chr11 5253309 5253328 5253325 +
ctccagtcaccatcttctgc

SEQ ID NO: 11747 - DNA, 20 bp, Artificial Sequence
  Synthetic oligonucleotide; AGG chr11 5253310 5253329 5253326 +
tccagtcaccatcttctgcc

SEQ ID NO: 11748 - DNA, 20 bp, Artificial Sequence
  Synthetic oligonucleotide; AAG chr11 5253313 5253332 5253329 +
agtcaccatcttctgccagg

SEQ ID NO: 11749 - DNA, 20 bp, Artificial Sequence
  Synthetic oligonucleotide; CAG chr11 5253325 5253344 5253341 +
ctgccaggaagcctgcacct

SEQ ID NO: 11750 - DNA, 20 bp, Artificial Sequence
  Synthetic oligonucleotide; AGG chr11 5253326 5253345 5253342 +
tgccaggaagcctgcacctc

SEQ ID NO: 11751 - DNA, 20 bp, Artificial Sequence
  Synthetic oligonucleotide; GGG chr11 5253327 5253346 5253343 +
gccaggaagcctgcacctca

SEQ ID NO: 11752 - DNA, 20 bp, Artificial Sequence
  Synthetic oligonucleotide; GGG chr11 5253328 5253347 5253344 +
ccaggaagcctgcacctcag

SEQ ID NO: 11753 - DNA, 20 bp, Artificial Sequence
  Synthetic oligonucleotide; TGG chr11 5253348 5253367 5253364 +
gggtgaattctttgccgaaa

SEQ ID NO: 11754 - DNA, 20 bp, Artificial Sequence
  Synthetic oligonucleotide; CGG chr11 5253361 5253380 5253377 +
gccgaaatggattgccaaaa

SEQ ID NO: 11755 - DNA, 20 bp, Artificial Sequence
  Synthetic oligonucleotide; CAG chr11 5253368 5253387 5253384 +
tggattgccaaaacggtcac

SEQ ID NO: 11756 - DNA, 20 bp, Artificial Sequence
  Synthetic oligonucleotide; CAG chr11 5253380 5253399 5253396 +
acggtcaccagcacatttcc

SEQ ID NO: 11757 - DNA, 20 bp, Artificial Sequence
  Synthetic oligonucleotide; AGG chr11 5253381 5253400 5253397 +
cggtcaccagcacatttccc

SEQ ID NO: 11758 - DNA, 20 bp, Artificial Sequence
  Synthetic oligonucleotide; GAG chr11 5253383 5253402 5253399 +
gtcaccagcacatttcccag

SEQ ID NO: 11759 - DNA, 20 bp, Artificial Sequence
  Synthetic oligonucleotide; GAG chr11 5253391 5253410 5253407 +
cacatttcccaggagctgtt

SEQ ID NO: 11760 - DNA, 20 bp, Artificial Sequence
  Synthetic oligonucleotide; AAG chr11 5253398 5253417 5253414 +
cccaggagctgttgagatga

SEQ ID NO: 11761 - DNA, 20 bp, Artificial Sequence
  Synthetic oligonucleotide; AGG chr11 5253399 5253418 5253415 +
ccaggagctgttgagatgaa

SEQ ID NO: 11762 - DNA, 20 bp, Artificial Sequence
  Synthetic oligonucleotide; GAG chr11 5253401 5253420 5253417 +
aggagctgttgagatgaaag

SEQ ID NO: 11763 - DNA, 20 bp, Artificial Sequence
  Synthetic oligonucleotide; AAG chr11 5253410 5253429 5253426 +
tgagatgaaaggagacaata

SEQ ID NO: 11764 - DNA, 20 bp, Artificial Sequence
  Synthetic oligonucleotide; TAG chr11 5253422 5253441 5253438 +
agacaataaagatgaaccca

SEQ ID NO: 11765 - DNA, 20 bp, Artificial Sequence
  Synthetic oligonucleotide; GAG chr11 5253426 5253445 5253442 +
aataaagatgaacccatagt

SEQ ID NO: 11766 - DNA, 20 bp, Artificial Sequence
  Synthetic oligonucleotide; GAG chr11 5253431 5253450 5253447 +
agatgaacccatagtgagct

SEQ ID NO: 11767 - DNA, 20 bp, Artificial Sequence
  Synthetic oligonucleotide; GAG chr11 5253433 5253452 5253449 +
atgaacccatagtgagctga

SEQ ID NO: 11768 - DNA, 20 bp, Artificial Sequence
  Synthetic oligonucleotide; CAG chr11 5253439 5253458 5253455 +
ccatagtgagctgagagctc

SEQ ID NO: 11769 - DNA, 20 bp, Artificial Sequence
  Synthetic oligonucleotide; TGG chr11 5253444 5253463 5253460 +
gtgagctgagagctccagcc

SEQ ID NO: 11770 - DNA, 20 bp, Artificial Sequence
  Synthetic oligonucleotide; CAG chr11 5253451 5253470 5253467 +
gagagctccagcctggcctc

SEQ ID NO: 11771 - DNA, 20 bp, Artificial Sequence
  Synthetic oligonucleotide; AAG chr11 5253467 5253486 5253483 +
cctccagataactacacacc

SEQ ID NO: 11772 - DNA, 20 bp, Artificial Sequence
  Synthetic oligonucleotide; CAG chr11 5253478 5253497 5253494 +
ctacacaccaagcttccacc

SEQ ID NO: 11773 - DNA, 20 bp, Artificial Sequence
  Synthetic oligonucleotide; AAG chr11 5253485 5253504 5253501 +
ccaagcttccacccagaatc

SEQ ID NO: 11774 - DNA, 20 bp, Artificial Sequence
  Synthetic oligonucleotide; AAG chr11 5253507 5253526 5253523 +
gcctatgttaacttccctca

SEQ ID NO: 11775 - DNA, 20 bp, Artificial Sequence
  Synthetic oligonucleotide; GAG chr11 5253513 5253532 5253529 +
gttaacttccctcaaagcct

SEQ ID NO: 11776 - DNA, 20 bp, Artificial Sequence
  Synthetic oligonucleotide; CAG chr11 5253537 5253556 5253553 +
ttttgctttcccattaaatg

SEQ ID NO: 11777 - DNA, 20 bp, Artificial Sequence
  Synthetic oligonucleotide; AGG chr11 5253538 5253557 5253554 +
tttgctttcccattaaatgc

SEQ ID NO: 11778 - DNA, 20 bp, Artificial Sequence
  Synthetic oligonucleotide; TAG chr11 5253541 5253560 5253557 +
gctttcccattaaatgcagg

SEQ ID NO: 11779 - DNA, 20 bp, Artificial Sequence
  Synthetic oligonucleotide; CAG chr11 5253556 5253575 5253572 +
gcaggtagttgttcttcttg

SEQ ID NO: 11780 - DNA, 20 bp, Artificial Sequence
  Synthetic oligonucleotide; TAG chr11 5253562 5253581 5253578 +
agttgttcttcttgcagcac

SEQ ID NO: 11781 - DNA, 20 bp, Artificial Sequence
  Synthetic oligonucleotide; TGG chr11 5253569 5253588 5253585 +
cttcttgcagcactagtcac

SEQ ID NO: 11782 - DNA, 20 bp, Artificial Sequence
  Synthetic oligonucleotide; TAG chr11 5253622 5253641 5253638 +
accatgaaccctgtatgctg

SEQ ID NO: 11783 - DNA, 20 bp, Artificial Sequence
  Synthetic oligonucleotide; AGG chr11 5253623 5253642 5253639 +
ccatgaaccctgtatgctgt

SEQ ID NO: 11784 - DNA, 20 bp, Artificial Sequence
  Synthetic oligonucleotide; AAG chr11 5253639 5253658 5253655 +
ctgtaggctgaaaacgttaa

SEQ ID NO: 11785 - DNA, 20 bp, Artificial Sequence
  Synthetic oligonucleotide; CAG chr11 5253699 5253718 5253715 +
cacacacacacacacacaca

SEQ ID NO: 11786 - DNA, 20 bp, Artificial Sequence
  Synthetic oligonucleotide; GAG chr11 5253701 5253720 5253717 +
cacacacacacacacacaca

SEQ ID NO: 11787 - DNA, 20 bp, Artificial Sequence
  Synthetic oligonucleotide; CAG chr11 5253724 5253743 5253740 +
ctgactttcaaaatctactc

SEQ ID NO: 11788 - DNA, 20 bp, Artificial Sequence
  Synthetic oligonucleotide; TGG chr11 5253755 5253774 5253771 +
tttcaattgttcctcacccc

SEQ ID NO: 11789 - DNA, 20 bp, Artificial Sequence
  Synthetic oligonucleotide; TGG chr11 5253776 5253795 5253792 +
ggacatactttgcccccatc

SEQ ID NO: 11790 - DNA, 20 bp, Artificial Sequence
  Synthetic oligonucleotide; AAG chr11 5253784 5253803 5253800 +
tttgcccccatctggaatta

SEQ ID NO: 11791 - DNA, 20 bp, Artificial Sequence
  Synthetic oligonucleotide; AGG chr11 5253785 5253804 5253801 +
ttgcccccatctggaattaa

SEQ ID NO: 11792 - DNA, 20 bp, Artificial Sequence
  Synthetic oligonucleotide; AAG chr11 5253792 5253811 5253808 +
catctggaattaaaggatat

SEQ ID NO: 11793 - DNA, 20 bp, Artificial Sequence
  Synthetic oligonucleotide; AAG chr11 5253804 5253823 5253820 +
aaggatataagtttgtaatg

SEQ ID NO: 11794 - DNA, 20 bp, Artificial Sequence
  Synthetic oligonucleotide; TAG chr11 5253810 5253829 5253826 +
ataagtttgtaatgaagcat

SEQ ID NO: 11795 - DNA, 20 bp, Artificial Sequence
  Synthetic oligonucleotide; CAG chr11 5253813 5253832 5253829 +
agtttgtaatgaagcattag

SEQ ID NO: 11796 - DNA, 20 bp, Artificial Sequence
  Synthetic oligonucleotide; CAG chr11 5253831 5253850 5253847 +
agcagcattttatatgtgtc

SEQ ID NO: 11797 - DNA, 20 bp, Artificial Sequence
  Synthetic oligonucleotide; TAG chr11 5253840 5253859 5253856 +
ttatatgtgtccagctgata

SEQ ID NO: 11798 - DNA, 20 bp, Artificial Sequence
  Synthetic oligonucleotide; AGG chr11 5253841 5253860 5253857 +
tatatgtgtccagctgatat

SEQ ID NO: 11799 - DNA, 20 bp, Artificial Sequence
  Synthetic oligonucleotide; TAG chr11 5253846 5253865 5253862 +
gtgtccagctgatataggaa

SEQ ID NO: 11800 - DNA, 20 bp, Artificial Sequence
  Synthetic oligonucleotide; TAG chr11 5253852 5253871 5253868 +
agctgatataggaatagcct

SEQ ID NO: 11801 - DNA, 20 bp, Artificial Sequence
  Synthetic oligonucleotide; TGG chr11 5253866 5253885 5253882 +
tagccttagcaatgtatgtt

SEQ ID NO: 11802 - DNA, 20 bp, Artificial Sequence
  Synthetic oligonucleotide; AAG chr11 5253875 5253894 5253891 +
caatgtatgtttggccacca

SEQ ID NO: 11803 - DNA, 20 bp, Artificial Sequence
  Synthetic oligonucleotide; GAG chr11 5253893 5253912 5253909 +
caaagttccccactttgact

SEQ ID NO: 11804 - DNA, 20 bp, Artificial Sequence
  Synthetic oligonucleotide; CAG chr11 5253949 5253968 5253965 +
gaccatacttgtcctgcctc

SEQ ID NO: 11805 - DNA, 20 bp, Artificial Sequence
  Synthetic oligonucleotide; TAG chr11 5253953 5253972 5253969 +
atacttgtcctgcctccaga

SEQ ID NO: 11806 - DNA, 20 bp, Artificial Sequence
  Synthetic oligonucleotide; TAG chr11 5253980 5253999 5253996 +
tttaaaacgaataacaaaaa

SEQ ID NO: 11807 - DNA, 20 bp, Artificial Sequence
  Synthetic oligonucleotide; AGG chr11 5253981 5254000 5253997 +
ttaaaacgaataacaaaaat

SEQ ID NO: 11808 - DNA, 20 bp, Artificial Sequence
  Synthetic oligonucleotide; GGG chr11 5253982 5254001 5253998 +
taaaacgaataacaaaaata

SEQ ID NO: 11809 - DNA, 20 bp, Artificial Sequence
  Synthetic oligonucleotide; GGG chr11 5253983 5254002 5253999 +
aaaacgaataacaaaaatag

SEQ ID NO: 11810 - DNA, 20 bp, Artificial Sequence
  Synthetic oligonucleotide; AAG chr11 5253987 5254006 5254003 +
cgaataacaaaaatagggga

SEQ ID NO: 11811 - DNA, 20 bp, Artificial Sequence
  Synthetic oligonucleotide; AGG chr11 5253988 5254007 5254004 +
gaataacaaaaataggggaa

SEQ ID NO: 11812 - DNA, 20 bp, Artificial Sequence
  Synthetic oligonucleotide; AAG chr11 5253994 5254013 5254010 +
caaaaataggggaaaggtga

SEQ ID NO: 11813 - DNA, 20 bp, Artificial Sequence
  Synthetic oligonucleotide; AAG chr11 5254019 5254038 5254035 +
ctttctaccgaaatctaata

SEQ ID NO: 11814 - DNA, 20 bp, Artificial Sequence
  Synthetic oligonucleotide; AAG chr11 5254024 5254043 5254040 +
taccgaaatctaataaagaa

SEQ ID NO: 11815 - DNA, 20 bp, Artificial Sequence
  Synthetic oligonucleotide; AAG chr11 5254059 5254078 5254075 +
tttccacctctcttttctca

SEQ ID NO: 11816 - DNA, 20 bp, Artificial Sequence
  Synthetic oligonucleotide; AAG chr11 5254065 5254084 5254081 +
cctctcttttctcaaagtca

SEQ ID NO: 11817 - DNA, 20 bp, Artificial Sequence
  Synthetic oligonucleotide; TAG chr11 5254077 5254096 5254093 +
caaagtcaaagttgtccatc

SEQ ID NO: 11818 - DNA, 20 bp, Artificial Sequence
  Synthetic oligonucleotide; CAG chr11 5254085 5254104 5254101 +
aagttgtccatctagatttt

SEQ ID NO: 11819 - DNA, 20 bp, Artificial Sequence
  Synthetic oligonucleotide; GAG chr11 5254087 5254106 5254103 +
gttgtccatctagattttca

SEQ ID NO: 11820 - DNA, 20 bp, Artificial Sequence
  Synthetic oligonucleotide; AGG chr11 5254088 5254107 5254104 +
ttgtccatctagattttcag

SEQ ID NO: 11821 - DNA, 20 bp, Artificial Sequence
  Synthetic oligonucleotide; TAG chr11 5254098 5254117 5254114 +
agattttcagaggcactcct

SEQ ID NO: 11822 - DNA, 20 bp, Artificial Sequence
  Synthetic oligonucleotide; AGG chr11 5254099 5254118 5254115 +
gattttcagaggcactcctt

SEQ ID NO: 11823 - DNA, 20 bp, Artificial Sequence
  Synthetic oligonucleotide; TGG chr11 5254119 5254138 5254135 +
aggccctaaaacattgccac

SEQ ID NO: 11824 - DNA, 20 bp, Artificial Sequence
  Synthetic oligonucleotide; GGG chr11 5254120 5254139 5254136 +
ggccctaaaacattgccact

SEQ ID NO: 11825 - DNA, 20 bp, Artificial Sequence
  Synthetic oligonucleotide; CAG chr11 5254126 5254145 5254142 +
aaaacattgccactgggtct

SEQ ID NO: 11826 - DNA, 20 bp, Artificial Sequence
  Synthetic oligonucleotide; CAG chr11 5254131 5254150 5254147 +
attgccactgggtctcagcc

SEQ ID NO: 11827 - DNA, 20 bp, Artificial Sequence
  Synthetic oligonucleotide; TAG chr11 5254135 5254154 5254151 +
ccactgggtctcagcccagt

SEQ ID NO: 11828 - DNA, 20 bp, Artificial Sequence
  Synthetic oligonucleotide; CAG chr11 5254145 5254164 5254161 +
tcagcccagttagtcctctg

SEQ ID NO: 11829 - DNA, 20 bp, Artificial Sequence
  Synthetic oligonucleotide; CAG chr11 5254166 5254185 5254182 +
agtttcttcactcccaaccc

SEQ ID NO: 11830 - DNA, 20 bp, Artificial Sequence
  Synthetic oligonucleotide; CAG chr11 5254179 5254198 5254195 +
ccaaccccagtatcttcaaa

SEQ ID NO: 11831 - DNA, 20 bp, Artificial Sequence
  Synthetic oligonucleotide; CAG chr11 5254200 5254219 5254216 +
agctcacaccctgctgtgct

SEQ ID NO: 11832 - DNA, 20 bp, Artificial Sequence
  Synthetic oligonucleotide; CAG chr11 5254212 5254231 5254228 +
gctgtgctcagatcaatact

SEQ ID NO: 11833 - DNA, 20 bp, Artificial Sequence
  Synthetic oligonucleotide; AAG chr11 5254221 5254240 5254237 +
agatcaatactcagttgtct

SEQ ID NO: 11834 - DNA, 20 bp, Artificial Sequence
  Synthetic oligonucleotide; GAG chr11 5254231 5254250 5254247 +
tcagttgtctaagttgcctc

SEQ ID NO: 11835 - DNA, 20 bp, Artificial Sequence
  Synthetic oligonucleotide; AAG chr11 5254238 5254257 5254254 +
tctaagttgcctcgagacta

SEQ ID NO: 11836 - DNA, 20 bp, Artificial Sequence
  Synthetic oligonucleotide; AGG chr11 5254239 5254258 5254255 +
ctaagttgcctcgagactaa

SEQ ID NO: 11837 - DNA, 20 bp, Artificial Sequence
  Synthetic oligonucleotide; CAG chr11 5254245 5254264 5254261 +
tgcctcgagactaaaggcaa

SEQ ID NO: 11838 - DNA, 20 bp, Artificial Sequence
  Synthetic oligonucleotide; TGG chr11 5254263 5254282 5254279 +
aacagtgctgaaacatctcc

SEQ ID NO: 11839 - DNA, 20 bp, Artificial Sequence
  Synthetic oligonucleotide; AAG chr11 5254276 5254295 5254292 +
catctcctggactcaccttg

SEQ ID NO: 11840 - DNA, 20 bp, Artificial Sequence
  Synthetic oligonucleotide; CAG chr11 5254283 5254302 5254299 +
tggactcaccttgaagttct

SEQ ID NO: 11841 - DNA, 20 bp, Artificial Sequence
  Synthetic oligonucleotide; AGG chr11 5254284 5254303 5254300 +
ggactcaccttgaagttctc

SEQ ID NO: 11842 - DNA, 20 bp, Artificial Sequence
  Synthetic oligonucleotide; CAG chr11 5254296 5254315 5254312 +
aagttctcaggatccacatg

SEQ ID NO: 11843 - DNA, 20 bp, Artificial Sequence
  Synthetic oligonucleotide; CAG chr11 5254306 5254325 5254322 +
gatccacatgcagcttgtca

SEQ ID NO: 11844 - DNA, 20 bp, Artificial Sequence
  Synthetic oligonucleotide; CAG chr11 5254311 5254330 5254327 +
acatgcagcttgtcacagtg

SEQ ID NO: 11845 - DNA, 20 bp, Artificial Sequence
  Synthetic oligonucleotide; CAG chr11 5254320 5254339 5254336 +
ttgtcacagtgcagttcact

SEQ ID NO: 11846 - DNA, 20 bp, Artificial Sequence
  Synthetic oligonucleotide; TGG chr11 5254324 5254343 5254340 +
cacagtgcagttcactcagc

SEQ ID NO: 11847 - DNA, 20 bp, Artificial Sequence
  Synthetic oligonucleotide; GGG chr11 5254325 5254344 5254341 +
acagtgcagttcactcagct

SEQ ID NO: 11848 - DNA, 20 bp, Artificial Sequence
  Synthetic oligonucleotide; AAG chr11 5254330 5254349 5254346 +
gcagttcactcagctgggca

SEQ ID NO: 11849 - DNA, 20 bp, Artificial Sequence
  Synthetic oligonucleotide; AGG chr11 5254331 5254350 5254347 +
cagttcactcagctgggcaa

SEQ ID NO: 11850 - DNA, 20 bp, Artificial Sequence
  Synthetic oligonucleotide; GAG chr11 5254341 5254360 5254357 +
agctgggcaaaggtgccctt

SEQ ID NO: 11851 - DNA, 20 bp, Artificial Sequence
  Synthetic oligonucleotide; CAG chr11 5254350 5254369 5254366 +
aaggtgcccttgagatcatc

SEQ ID NO: 11852 - DNA, 20 bp, Artificial Sequence
  Synthetic oligonucleotide; AGG chr11 5254351 5254370 5254367 +
aggtgcccttgagatcatcc

SEQ ID NO: 11853 - DNA, 20 bp, Artificial Sequence
  Synthetic oligonucleotide; TGG chr11 5254361 5254380 5254377 +
gagatcatccaggtgcttta

SEQ ID NO: 11854 - DNA, 20 bp, Artificial Sequence
  Synthetic oligonucleotide; AAG chr11 5254372 5254391 5254388 +
ggtgctttatggcatctccc

SEQ ID NO: 11855 - DNA, 20 bp, Artificial Sequence
  Synthetic oligonucleotide; AGG chr11 5254373 5254392 5254389 +
gtgctttatggcatctccca

SEQ ID NO: 11856 - DNA, 20 bp, Artificial Sequence
  Synthetic oligonucleotide; AAG chr11 5254376 5254395 5254392 +
ctttatggcatctcccaagg

SEQ ID NO: 11857 - DNA, 20 bp, Artificial Sequence
  Synthetic oligonucleotide; CAG chr11 5254380 5254399 5254396 +
atggcatctcccaaggaagt

SEQ ID NO: 11858 - DNA, 20 bp, Artificial Sequence
  Synthetic oligonucleotide; TGG chr11 5254409 5254428 5254425 +
cttgccatgtgccttgactt

SEQ ID NO: 11859 - DNA, 20 bp, Artificial Sequence
  Synthetic oligonucleotide; GGG chr11 5254410 5254429 5254426 +
ttgccatgtgccttgacttt

SEQ ID NO: 11860 - DNA, 20 bp, Artificial Sequence
  Synthetic oligonucleotide; GGG chr11 5254411 5254430 5254427 +
tgccatgtgccttgactttg

SEQ ID NO: 11861 - DNA, 20 bp, Artificial Sequence
  Synthetic oligonucleotide; TGG chr11 5254424 5254443 5254440 +
gactttggggttgcccatga

SEQ ID NO: 11862 - DNA, 20 bp, Artificial Sequence
  Synthetic oligonucleotide; CAG chr11 5254427 5254446 5254443 +
tttggggttgcccatgatgg

SEQ ID NO: 11863 - DNA, 20 bp, Artificial Sequence
  Synthetic oligonucleotide; GAG chr11 5254429 5254448 5254445 +
tggggttgcccatgatggca

SEQ ID NO: 11864 - DNA, 20 bp, Artificial Sequence
  Synthetic oligonucleotide; AGG chr11 5254430 5254449 5254446 +
ggggttgcccatgatggcag

SEQ ID NO: 11865 - DNA, 20 bp, Artificial Sequence
  Synthetic oligonucleotide; CAG chr11 5254433 5254452 5254449 +
gttgcccatgatggcagagg

SEQ ID NO: 11866 - DNA, 20 bp, Artificial Sequence
  Synthetic oligonucleotide; GAG chr11 5254435 5254454 5254451 +
tgcccatgatggcagaggca

SEQ ID NO: 11867 - DNA, 20 bp, Artificial Sequence
  Synthetic oligonucleotide; AGG chr11 5254436 5254455 5254452 +
gcccatgatggcagaggcag

SEQ ID NO: 11868 - DNA, 20 bp, Artificial Sequence
  Synthetic oligonucleotide; CAG chr11 5254440 5254459 5254456 +
atgatggcagaggcagagga

SEQ ID NO: 11869 - DNA, 20 bp, Artificial Sequence
  Synthetic oligonucleotide; AGG chr11 5254441 5254460 5254457 +
tgatggcagaggcagaggac

SEQ ID NO: 11870 - DNA, 20 bp, Artificial Sequence
  Synthetic oligonucleotide; AAG chr11 5254450 5254469 5254466 +
aggcagaggacaggttgcca

SEQ ID NO: 11871 - DNA, 20 bp, Artificial Sequence
  Synthetic oligonucleotide; AAG chr11 5254459 5254478 5254475 +
acaggttgccaaagctgtca

SEQ ID NO: 11872 - DNA, 20 bp, Artificial Sequence
  Synthetic oligonucleotide; TGG chr11 5254468 5254487 5254484 +
caaagctgtcaaagaacctc

SEQ ID NO: 11873 - DNA, 20 bp, Artificial Sequence
  Synthetic oligonucleotide; GGG chr11 5254469 5254488 5254485 +
aaagctgtcaaagaacctct

SEQ ID NO: 11874 - DNA, 20 bp, Artificial Sequence
  Synthetic oligonucleotide; TGG chr11 5254476 5254495 5254492 +
tcaaagaacctctgggtcca

SEQ ID NO: 11875 - DNA, 20 bp, Artificial Sequence
  Synthetic oligonucleotide; GGG chr11 5254477 5254496 5254493 +
caaagaacctctgggtccat

SEQ ID NO: 11876 - DNA, 20 bp, Artificial Sequence
  Synthetic oligonucleotide; TAG chr11 5254480 5254499 5254496 +
agaacctctgggtccatggg

SEQ ID NO: 11877 - DNA, 20 bp, Artificial Sequence
  Synthetic oligonucleotide; CAG chr11 5254488 5254507 5254504 +
tgggtccatgggtagacaac

SEQ ID NO: 11878 - DNA, 20 bp, Artificial Sequence
  Synthetic oligonucleotide; AGG chr11 5254489 5254508 5254505 +
gggtccatgggtagacaacc

SEQ ID NO: 11879 - DNA, 20 bp, Artificial Sequence
  Synthetic oligonucleotide; GAG chr11 5254491 5254510 5254507 +
gtccatgggtagacaaccag

SEQ ID NO: 11880 - DNA, 20 bp, Artificial Sequence
  Synthetic oligonucleotide; GAG chr11 5254499 5254518 5254515 +
gtagacaaccaggagcctgt

SEQ ID NO: 11881 - DNA, 20 bp, Artificial Sequence
  Synthetic oligonucleotide; AAG chr11 5254508 5254527 5254524 +
caggagcctgtgagattgac

SEQ ID NO: 11882 - DNA, 20 bp, Artificial Sequence
  Synthetic oligonucleotide; CAG chr11 5254513 5254532 5254529 +
gcctgtgagattgacaagaa

SEQ ID NO: 11883 - DNA, 20 bp, Artificial Sequence
  Synthetic oligonucleotide; CAG chr11 5254521 5254540 5254537 +
gattgacaagaacagtttga

SEQ ID NO: 11884 - DNA, 20 bp, Artificial Sequence
  Synthetic oligonucleotide; CAG chr11 5254525 5254544 5254541 +
gacaagaacagtttgacagt

SEQ ID NO: 11885 - DNA, 20 bp, Artificial Sequence
  Synthetic oligonucleotide; AAG chr11 5254528 5254547 5254544 +
aagaacagtttgacagtcag

SEQ ID NO: 11886 - DNA, 20 bp, Artificial Sequence
  Synthetic oligonucleotide; AGG chr11 5254529 5254548 5254545 +
agaacagtttgacagtcaga

SEQ ID NO: 11887 - DNA, 20 bp, Artificial Sequence
  Synthetic oligonucleotide; GAG chr11 5254545 5254564 5254561 +
cagaaggtgccacaaatcct

SEQ ID NO: 11888 - DNA, 20 bp, Artificial Sequence
  Synthetic oligonucleotide; AAG chr11 5254548 5254567 5254564 +
aaggtgccacaaatcctgag

SEQ ID NO: 11889 - DNA, 20 bp, Artificial Sequence
  Synthetic oligonucleotide; TGG chr11 5254556 5254575 5254572 +
acaaatcctgagaagcgacc

SEQ ID NO: 11890 - DNA, 20 bp, Artificial Sequence
  Synthetic oligonucleotide; CAG chr11 5254567 5254586 5254583 +
gaagcgacctggacttttgc

SEQ ID NO: 11891 - DNA, 20 bp, Artificial Sequence
  Synthetic oligonucleotide; AGG chr11 5254568 5254587 5254584 +
aagcgacctggacttttgcc

SEQ ID NO: 11892 - DNA, 20 bp, Artificial Sequence
  Synthetic oligonucleotide; CAG chr11 5254573 5254592 5254589 +
acctggacttttgccaggca

SEQ ID NO: 11893 - DNA, 20 bp, Artificial Sequence
  Synthetic oligonucleotide; AGG chr11 5254574 5254593 5254590 +
cctggacttttgccaggcac

SEQ ID NO: 11894 - DNA, 20 bp, Artificial Sequence
  Synthetic oligonucleotide; GGG chr11 5254575 5254594 5254591 +
ctggacttttgccaggcaca

SEQ ID NO: 11895 - DNA, 20 bp, Artificial Sequence
  Synthetic oligonucleotide; TGG chr11 5254600 5254619 5254616 +
cttccttccctcccttgtcc

SEQ ID NO: 11896 - DNA, 20 bp, Artificial Sequence
  Synthetic oligonucleotide; CAG chr11 5254607 5254626 5254623 +
ccctcccttgtcctggtcac

SEQ ID NO: 11897 - DNA, 20 bp, Artificial Sequence
  Synthetic oligonucleotide; GAG chr11 5254609 5254628 5254625 +
ctcccttgtcctggtcacca

SEQ ID NO: 11898 - DNA, 20 bp, Artificial Sequence
  Synthetic oligonucleotide; CAG chr11 5254622 5254641 5254638 +
gtcaccagagcctaccttcc

SEQ ID NO: 11899 - DNA, 20 bp, Artificial Sequence
  Synthetic oligonucleotide; AGG chr11 5254623 5254642 5254639 +
tcaccagagcctaccttccc

SEQ ID NO: 11900 - DNA, 20 bp, Artificial Sequence
  Synthetic oligonucleotide; GGG chr11 5254624 5254643 5254640 +
caccagagcctaccttccca

SEQ ID NO: 11901 - DNA, 20 bp, Artificial Sequence
  Synthetic oligonucleotide; CAG chr11 5254636 5254655 5254652 +
ccttcccagggtttctcctc

SEQ ID NO: 11902 - DNA, 20 bp, Artificial Sequence
  Synthetic oligonucleotide; CAG chr11 5254664 5254683 5254680 +
tccacattcaccttgcccca

SEQ ID NO: 11903 - DNA, 20 bp, Artificial Sequence
  Synthetic oligonucleotide; AGG chr11 5254665 5254684 5254681 +
ccacattcaccttgccccac

SEQ ID NO: 11904 - DNA, 20 bp, Artificial Sequence
  Synthetic oligonucleotide; TAG chr11 5254675 5254694 5254691 +
cttgccccacaggcttgtga

SEQ ID NO: 11905 - DNA, 20 bp, Artificial Sequence
  Synthetic oligonucleotide; TAG chr11 5254678 5254697 5254694 +
gccccacaggcttgtgatag

SEQ ID NO: 11906 - DNA, 20 bp, Artificial Sequence
  Synthetic oligonucleotide; TGG chr11 5254708 5254727 5254724 +
ctcctctgtgaaatgaccca

SEQ ID NO: 11907 - DNA, 20 bp, Artificial Sequence
  Synthetic oligonucleotide; TGG chr11 5254715 5254734 5254731 +
gtgaaatgacccatggcgtc

SEQ ID NO: 11908 - DNA, 20 bp, Artificial Sequence
  Synthetic oligonucleotide; TAG chr11 5254720 5254739 5254736 +
atgacccatggcgtctggac

SEQ ID NO: 11909 - DNA, 20 bp, Artificial Sequence
  Synthetic oligonucleotide; AGG chr11 5254721 5254740 5254737 +
tgacccatggcgtctggact

SEQ ID NO: 11910 - DNA, 20 bp, Artificial Sequence
  Synthetic oligonucleotide; GAG chr11 5254723 5254742 5254739 +
acccatggcgtctggactag

SEQ ID NO: 11911 - DNA, 20 bp, Artificial Sequence
  Synthetic oligonucleotide; CAG chr11 5254740 5254759 5254756 +
taggagcttattgataacct

SEQ ID NO: 11912 - DNA, 20 bp, Artificial Sequence
  Synthetic oligonucleotide; CAG chr11 5254749 5254768 5254765 +
attgataacctcagacgttc

SEQ ID NO: 11913 - DNA, 20 bp, Artificial Sequence
  Synthetic oligonucleotide; AAG chr11 5254752 5254771 5254768 +
gataacctcagacgttccag

SEQ ID NO: 11914 - DNA, 20 bp, Artificial Sequence
  Synthetic oligonucleotide; GAG chr11 5254756 5254775 5254772 +
acctcagacgttccagaagc

SEQ ID NO: 11915 - DNA, 20 bp, Artificial Sequence
  Synthetic oligonucleotide; TGG chr11 5254763 5254782 5254779 +
acgttccagaagcgagtgtg

SEQ ID NO: 11916 - DNA, 20 bp, Artificial Sequence
  Synthetic oligonucleotide; AAG chr11 5254774 5254793 5254790 +
gcgagtgtgtggaactgctg

SEQ ID NO: 11917 - DNA, 20 bp, Artificial Sequence
  Synthetic oligonucleotide; AGG chr11 5254775 5254794 5254791 +
cgagtgtgtggaactgctga

SEQ ID NO: 11918 - DNA, 20 bp, Artificial Sequence
  Synthetic oligonucleotide; GGG chr11 5254776 5254795 5254792 +
gagtgtgtggaactgctgaa

SEQ ID NO: 11919 - DNA, 20 bp, Artificial Sequence
  Synthetic oligonucleotide; TAG chr11 5254802 5254821 5254818 +
ttccttttattcttcatccc

SEQ ID NO: 11920 - DNA, 20 bp, Artificial Sequence
  Synthetic oligonucleotide; CAG chr11 5254806 5254825 5254822 +
ttttattcttcatccctagc

SEQ ID NO: 11921 - DNA, 20 bp, Artificial Sequence
  Synthetic oligonucleotide; CGG chr11 5254813 5254832 5254829 +
cttcatccctagccagccgc

SEQ ID NO: 11922 - DNA, 20 bp, Artificial Sequence
  Synthetic oligonucleotide; TGG chr11 5254820 5254839 5254836 +
cctagccagccgccggcccc

SEQ ID NO: 11923 - DNA, 20 bp, Artificial Sequence
  Synthetic oligonucleotide; TGG chr11 5254829 5254848 5254845 +
ccgccggcccctggcctcac

SEQ ID NO: 11924 - DNA, 20 bp, Artificial Sequence
  Synthetic oligonucleotide; AAG chr11 5254839 5254858 5254855 +
ctggcctcactggatactct

SEQ ID NO: 11925 - DNA, 20 bp, Artificial Sequence
  Synthetic oligonucleotide; TGG chr11 5254847 5254866 5254863 +
actggatactctaagactat

SEQ ID NO: 11926 - DNA, 20 bp, Artificial Sequence
  Synthetic oligonucleotide; AAG chr11 5254852 5254871 5254868 +
atactctaagactattggtc

SEQ ID NO: 11927 - DNA, 20 bp, Artificial Sequence
  Synthetic oligonucleotide; AAG chr11 5254866 5254885 5254882 +
ttggtcaagtttgccttgtc

SEQ ID NO: 11928 - DNA, 20 bp, Artificial Sequence
  Synthetic oligonucleotide; AGG chr11 5254867 5254886 5254883 +
tggtcaagtttgccttgtca

SEQ ID NO: 11929 - DNA, 20 bp, Artificial Sequence
  Synthetic oligonucleotide; TGG chr11 5254874 5254893 5254890 +
gtttgccttgtcaaggctat

SEQ ID NO: 11930 - DNA, 20 bp, Artificial Sequence
  Synthetic oligonucleotide; AAG chr11 5254879 5254898 5254895 +
ccttgtcaaggctattggtc

SEQ ID NO: 11931 - DNA, 20 bp, Artificial Sequence
  Synthetic oligonucleotide; AGG chr11 5254880 5254899 5254896 +
cttgtcaaggctattggtca

SEQ ID NO: 11932 - DNA, 20 bp, Artificial Sequence
  Synthetic oligonucleotide; AAG chr11 5254884 5254903 5254900 +
tcaaggctattggtcaaggc

SEQ ID NO: 11933 - DNA, 20 bp, Artificial Sequence
  Synthetic oligonucleotide; AGG chr11 5254885 5254904 5254901 +
caaggctattggtcaaggca

SEQ ID NO: 11934 - DNA, 20 bp, Artificial Sequence
  Synthetic oligonucleotide; TGG chr11 5254889 5254908 5254905 +
gctattggtcaaggcaaggc

SEQ ID NO: 11935 - DNA, 20 bp, Artificial Sequence
  Synthetic oligonucleotide; TGG chr11 5254900 5254919 5254916 +
aggcaaggctggccaaccca

SEQ ID NO: 11936 - DNA, 20 bp, Artificial Sequence
  Synthetic oligonucleotide; GGG chr11 5254901 5254920 5254917 +
ggcaaggctggccaacccat

SEQ ID NO: 11937 - DNA, 20 bp, Artificial Sequence
  Synthetic oligonucleotide; TGG chr11 5254904 5254923 5254920 +
aaggctggccaacccatggg

SEQ ID NO: 11938 - DNA, 20 bp, Artificial Sequence
  Synthetic oligonucleotide; GAG chr11 5254906 5254925 5254922 +
ggctggccaacccatgggtg

SEQ ID NO: 11939 - DNA, 20 bp, Artificial Sequence
  Synthetic oligonucleotide; TAG chr11 5254911 5254930 5254927 +
gccaacccatgggtggagtt

SEQ ID NO: 11940 - DNA, 20 bp, Artificial Sequence
  Synthetic oligonucleotide; CAG chr11 5254915 5254934 5254931 +
acccatgggtggagtttagc

SEQ ID NO: 11941 - DNA, 20 bp, Artificial Sequence
  Synthetic oligonucleotide; AGG chr11 5254916 5254935 5254932 +
cccatgggtggagtttagcc

SEQ ID NO: 11942 - DNA, 20 bp, Artificial Sequence
  Synthetic oligonucleotide; GGG chr11 5254917 5254936 5254933 +
ccatgggtggagtttagcca

SEQ ID NO: 11943 - DNA, 20 bp, Artificial Sequence
  Synthetic oligonucleotide; CAG chr11 5254927 5254946 5254943 +
agtttagccagggaccgttt

SEQ ID NO: 11944 - DNA, 20 bp, Artificial Sequence
  Synthetic oligonucleotide; CAG chr11 5254931 5254950 5254947 +
tagccagggaccgtttcaga

SEQ ID NO: 11945 - DNA, 20 bp, Artificial Sequence
  Synthetic oligonucleotide; GAG chr11 5254945 5254964 5254961 +
ttcagacagatatttgcatt

SEQ ID NO: 11946 - DNA, 20 bp, Artificial Sequence
  Synthetic oligonucleotide; TAG chr11 5254949 5254968 5254965 +
gacagatatttgcattgaga

SEQ ID NO: 11947 - DNA, 20 bp, Artificial Sequence
  Synthetic oligonucleotide; TGG chr11 5254954 5254973 5254970 +
atatttgcattgagatagtg

SEQ ID NO: 11948 - DNA, 20 bp, Artificial Sequence
  Synthetic oligonucleotide; GGG chr11 5254955 5254974 5254971 +
tatttgcattgagatagtgt

SEQ ID NO: 11949 - DNA, 20 bp, Artificial Sequence
  Synthetic oligonucleotide; GGG chr11 5254956 5254975 5254972 +
atttgcattgagatagtgtg

SEQ ID NO: 11950 - DNA, 20 bp, Artificial Sequence
  Synthetic oligonucleotide; AAG chr11 5254959 5254978 5254975 +
tgcattgagatagtgtgggg

SEQ ID NO: 11951 - DNA, 20 bp, Artificial Sequence
  Synthetic oligonucleotide; AGG chr11 5254960 5254979 5254976 +
gcattgagatagtgtgggga

SEQ ID NO: 11952 - DNA, 20 bp, Artificial Sequence
  Synthetic oligonucleotide; GGG chr11 5254961 5254980 5254977 +
cattgagatagtgtggggaa

SEQ ID NO: 11953 - DNA, 20 bp, Artificial Sequence
  Synthetic oligonucleotide; GGG chr11 5254962 5254981 5254978 +
attgagatagtgtggggaag

SEQ ID NO: 11954 - DNA, 20 bp, Artificial Sequence
  Synthetic oligonucleotide; AAG chr11 5254970 5254989 5254986 +
agtgtggggaaggggccccc

SEQ ID NO: 11955 - DNA, 20 bp, Artificial Sequence
  Synthetic oligonucleotide; GAG chr11 5254972 5254991 5254988 +
tgtggggaaggggcccccaa

SEQ ID NO: 11956 - DNA, 20 bp, Artificial Sequence
  Synthetic oligonucleotide; AGG chr11 5254973 5254992 5254989 +
gtggggaaggggcccccaag

SEQ ID NO: 11957 - DNA, 20 bp, Artificial Sequence
  Synthetic oligonucleotide; TAG chr11 5254999 5255018 5255015 +
ctgctgcttaatttttttta

SEQ ID NO: 11958 - DNA, 20 bp, Artificial Sequence
  Synthetic oligonucleotide; CAG chr11 5255021 5255040 5255037 +
gcctttgccttgttccgatt

SEQ ID NO: 11959 - DNA, 20 bp, Artificial Sequence
  Synthetic oligonucleotide; TAG chr11 5255058 5255077 5255074 +
ctctaatttattcttccctt

SEQ ID NO: 11960 - DNA, 20 bp, Artificial Sequence
  Synthetic oligonucleotide; TAG chr11 5255062 5255081 5255078 +
aatttattcttccctttagc

SEQ ID NO: 11961 - DNA, 20 bp, Artificial Sequence
  Synthetic oligonucleotide; TAG chr11 5255081 5255100 5255097 +
ctagttttcttctcccacca

SEQ ID NO: 11962 - DNA, 20 bp, Artificial Sequence
  Synthetic oligonucleotide; AAG chr11 5255084 5255103 5255100 +
gttttcttctcccaccatag

SEQ ID NO: 11963 - DNA, 20 bp, Artificial Sequence
  Synthetic oligonucleotide; CAG chr11 5255091 5255110 5255107 +
tctcccaccatagaagatac

SEQ ID NO: 11964 - DNA, 20 bp, Artificial Sequence
  Synthetic oligonucleotide; AGG chr11 5255092 5255111 5255108 +
ctcccaccatagaagatacc

SEQ ID NO: 11965 - DNA, 20 bp, Artificial Sequence
  Synthetic oligonucleotide; CAG chr11 5255106 5255125 5255122 +
gataccaggacttcttttgt

SEQ ID NO: 11966 - DNA, 20 bp, Artificial Sequence
  Synthetic oligonucleotide; TAG chr11 5255131 5255150 5255147 +
gtttttcaccttcttgtctg

SEQ ID NO: 11967 - DNA, 20 bp, Artificial Sequence
  Synthetic oligonucleotide; CAG chr11 5255137 5255156 5255153 +
caccttcttgtctgtagctc

SEQ ID NO: 11968 - DNA, 20 bp, Artificial Sequence
  Synthetic oligonucleotide; GAG chr11 5255141 5255160 5255157 +
ttcttgtctgtagctccagt

SEQ ID NO: 11969 - DNA, 20 bp, Artificial Sequence
  Synthetic oligonucleotide; AGG chr11 5255142 5255161 5255158 +
tcttgtctgtagctccagtg

SEQ ID NO: 11970 - DNA, 20 bp, Artificial Sequence
  Synthetic oligonucleotide; TAG chr11 5255149 5255168 5255165 +
tgtagctccagtgaggcctg

SEQ ID NO: 11971 - DNA, 20 bp, Artificial Sequence
  Synthetic oligonucleotide; AAG chr11 5255156 5255175 5255172 +
ccagtgaggcctgtagttta

SEQ ID NO: 11972 - DNA, 20 bp, Artificial Sequence
  Synthetic oligonucleotide; AAG chr11 5255162 5255181 5255178 +
aggcctgtagtttaaagtta

SEQ ID NO: 11973 - DNA, 20 bp, Artificial Sequence
  Synthetic oligonucleotide; AAG chr11 5255183 5255202 5255199 +
agcatgtaccaatttttgaa

SEQ ID NO: 11974 - DNA, 20 bp, Artificial Sequence
  Synthetic oligonucleotide; CAG chr11 5255188 5255207 5255204 +
gtaccaatttttgaaaagtt

SEQ ID NO: 11975 - DNA, 20 bp, Artificial Sequence
  Synthetic oligonucleotide; AGG chr11 5255189 5255208 5255205 +
taccaatttttgaaaagttc

SEQ ID NO: 11976 - DNA, 20 bp, Artificial Sequence
  Synthetic oligonucleotide; GGG chr11 5255190 5255209 5255206 +
accaatttttgaaaagttca

SEQ ID NO: 11977 - DNA, 20 bp, Artificial Sequence
  Synthetic oligonucleotide; TAG chr11 5255209 5255228 5255225 +
agggattgtgaaatgtgttt

SEQ ID NO: 11978 - DNA, 20 bp, Artificial Sequence
  Synthetic oligonucleotide; AGG chr11 5255210 5255229 5255226 +
gggattgtgaaatgtgtttt

SEQ ID NO: 11979 - DNA, 20 bp, Artificial Sequence
  Synthetic oligonucleotide; TAG chr11 5255215 5255234 5255231 +
tgtgaaatgtgttttaggca

SEQ ID NO: 11980 - DNA, 20 bp, Artificial Sequence
  Synthetic oligonucleotide; AGG chr11 5255216 5255235 5255232 +
gtgaaatgtgttttaggcat

SEQ ID NO: 11981 - DNA, 20 bp, Artificial Sequence
  Synthetic oligonucleotide; CAG chr11 5255221 5255240 5255237 +
atgtgttttaggcataggtc

SEQ ID NO: 11982 - DNA, 20 bp, Artificial Sequence
  Synthetic oligonucleotide; AGG chr11 5255222 5255241 5255238 +
tgtgttttaggcataggtcc

SEQ ID NO: 11983 - DNA, 20 bp, Artificial Sequence
  Synthetic oligonucleotide; TGG chr11 5255233 5255252 5255249 +
cataggtccaggatttttga

SEQ ID NO: 11984 - DNA, 20 bp, Artificial Sequence
  Synthetic oligonucleotide; GGG chr11 5255234 5255253 5255250 +
ataggtccaggatttttgat

SEQ ID NO: 11985 - DNA, 20 bp, Artificial Sequence
  Synthetic oligonucleotide; TAG chr11 5255245 5255264 5255261 +
atttttgatgggacacgtct

SEQ ID NO: 11986 - DNA, 20 bp, Artificial Sequence
  Synthetic oligonucleotide; TAG chr11 5255255 5255274 5255271 +
ggacacgtcttagtctcatt

SEQ ID NO: 11987 - DNA, 20 bp, Artificial Sequence
  Synthetic oligonucleotide; AAG chr11 5255259 5255278 5255275 +
acgtcttagtctcatttagt

SEQ ID NO: 11988 - DNA, 20 bp, Artificial Sequence
  Synthetic oligonucleotide; TGG chr11 5255265 5255284 5255281 +
tagtctcatttagtaagcat

SEQ ID NO: 11989 - DNA, 20 bp, Artificial Sequence
  Synthetic oligonucleotide; AAG chr11 5255277 5255296 5255293 +
gtaagcattggtttccaaat

SEQ ID NO: 11990 - DNA, 20 bp, Artificial Sequence
  Synthetic oligonucleotide; AAG chr11 5255280 5255299 5255296 +
agcattggtttccaaataag

SEQ ID NO: 11991 - DNA, 20 bp, Artificial Sequence
  Synthetic oligonucleotide; TGG chr11 5255313 5255332 5255329 +
atctttgaatatactctctg

SEQ ID NO: 11992 - DNA, 20 bp, Artificial Sequence
  Synthetic oligonucleotide; TAG chr11 5255319 5255338 5255335 +
gaatatactctctgtggttt

SEQ ID NO: 11993 - DNA, 20 bp, Artificial Sequence
  Synthetic oligonucleotide; AGG chr11 5255320 5255339 5255336 +
aatatactctctgtggtttt

SEQ ID NO: 11994 - DNA, 20 bp, Artificial Sequence
  Synthetic oligonucleotide; AAG chr11 5255335 5255354 5255351 +
gttttaggccattatctctt

SEQ ID NO: 11995 - DNA, 20 bp, Artificial Sequence
  Synthetic oligonucleotide; TAG chr11 5255345 5255364 5255361 +
attatctcttaagttctcat

SEQ ID NO: 11996 - DNA, 20 bp, Artificial Sequence
  Synthetic oligonucleotide; TAG chr11 5255350 5255369 5255366 +
ctcttaagttctcattagtg

SEQ ID NO: 11997 - DNA, 20 bp, Artificial Sequence
  Synthetic oligonucleotide; AAG chr11 5255367 5255386 5255383 +
gtgtagtgaaaaatcctata

SEQ ID NO: 11998 - DNA, 20 bp, Artificial Sequence
  Synthetic oligonucleotide; CAG chr11 5255373 5255392 5255389 +
tgaaaaatcctataaagcaa

SEQ ID NO: 11999 - DNA, 20 bp, Artificial Sequence
  Synthetic oligonucleotide; CAG chr11 5255379 5255398 5255395 +
atcctataaagcaacagttt

SEQ ID NO: 12000 - DNA, 20 bp, Artificial Sequence
  Synthetic oligonucleotide; CAG chr11 5255384 5255403 5255400 +
ataaagcaacagtttcagtg

SEQ ID NO: 12001 - DNA, 20 bp, Artificial Sequence
  Synthetic oligonucleotide; AGG chr11 5255385 5255404 5255401 +
taaagcaacagtttcagtgc

SEQ ID NO: 12002 - DNA, 20 bp, Artificial Sequence
  Synthetic oligonucleotide; TAG chr11 5255390 5255409 5255406 +
caacagtttcagtgcaggaa

SEQ ID NO: 12003 - DNA, 20 bp, Artificial Sequence
  Synthetic oligonucleotide; AAG chr11 5255416 5255435 5255432 +
aatgttatgtaatataatat

SEQ ID NO: 12004 - DNA, 20 bp, Artificial Sequence
  Synthetic oligonucleotide; CAG chr11 5255485 5255504 5255501 +
aaatcacgcctgtttcatct

SEQ ID NO: 12005 - DNA, 20 bp, Artificial Sequence
  Synthetic oligonucleotide; AAG chr11 5255491 5255510 5255507 +
cgcctgtttcatctcagcaa

SEQ ID NO: 12006 - DNA, 20 bp, Artificial Sequence
  Synthetic oligonucleotide; CAG chr11 5255509 5255528 5255525 +
aaaagtattttttttatatt

SEQ ID NO: 12007 - DNA, 20 bp, Artificial Sequence
  Synthetic oligonucleotide; AGG chr11 5255510 5255529 5255526 +
aaagtattttttttatattc

SEQ ID NO: 12008 - DNA, 20 bp, Artificial Sequence
  Synthetic oligonucleotide; TAG chr11 5255521 5255540 5255537 +
tttatattcaggtatgtatg

SEQ ID NO: 12009 - DNA, 20 bp, Artificial Sequence
  Synthetic oligonucleotide; AGG chr11 5255522 5255541 5255538 +
ttatattcaggtatgtatgt

SEQ ID NO: 12010 - DNA, 20 bp, Artificial Sequence
  Synthetic oligonucleotide; TGG chr11 5255549 5255568 5255565 +
cgatgatgtgtatttatcac

SEQ ID NO: 12011 - DNA, 20 bp, Artificial Sequence
  Synthetic oligonucleotide; AAG chr11 5255554 5255573 5255570 +
atgtgtatttatcactggat

SEQ ID NO: 12012 - DNA, 20 bp, Artificial Sequence
  Synthetic oligonucleotide; TGG chr11 5255566 5255585 5255582 +
cactggataagtgtatgtgc

SEQ ID NO: 12013 - DNA, 20 bp, Artificial Sequence
  Synthetic oligonucleotide; CAG chr11 5255578 5255597 5255594 +
gtatgtgctggctgatgacc

SEQ ID NO: 12014 - DNA, 20 bp, Artificial Sequence
  Synthetic oligonucleotide; AGG chr11 5255579 5255598 5255595 +
tatgtgctggctgatgaccc

SEQ ID NO: 12015 - DNA, 20 bp, Artificial Sequence
  Synthetic oligonucleotide; GGG chr11 5255580 5255599 5255596 +
atgtgctggctgatgaccca

SEQ ID NO: 12016 - DNA, 20 bp, Artificial Sequence
  Synthetic oligonucleotide; TGG chr11 5255586 5255605 5255602 +
tggctgatgacccagggttt

SEQ ID NO: 12017 - DNA, 20 bp, Artificial Sequence
  Synthetic oligonucleotide; TAG chr11 5255591 5255610 5255607 +
gatgacccagggttttggtg

SEQ ID NO: 12018 - DNA, 20 bp, Artificial Sequence
  Synthetic oligonucleotide; CGG chr11 5255606 5255625 5255622 +
tggtgtagctcttctatgct

SEQ ID NO: 12019 - DNA, 20 bp, Artificial Sequence
  Synthetic oligonucleotide; AAG chr11 5255611 5255630 5255627 +
tagctcttctatgctcggta

SEQ ID NO: 12020 - DNA, 20 bp, Artificial Sequence
  Synthetic oligonucleotide; TGG chr11 5255618 5255637 5255634 +
tctatgctcggtaaagatga

SEQ ID NO: 12021 - DNA, 20 bp, Artificial Sequence
  Synthetic oligonucleotide; TAG chr11 5255621 5255640 5255637 +
atgctcggtaaagatgatgg

SEQ ID NO: 12022 - DNA, 20 bp, Artificial Sequence
  Synthetic oligonucleotide; CAG chr11 5255636 5255655 5255652 +
gatggtagaatgctctttac

SEQ ID NO: 12023 - DNA, 20 bp, Artificial Sequence
  Synthetic oligonucleotide; TGG chr11 5255645 5255664 5255661 +
atgctctttaccagatacta

SEQ ID NO: 12024 - DNA, 20 bp, Artificial Sequence
  Synthetic oligonucleotide; TAG chr11 5255650 5255669 5255666 +
ctttaccagatactatggat

SEQ ID NO: 12025 - DNA, 20 bp, Artificial Sequence
  Synthetic oligonucleotide; TAG chr11 5255676 5255695 5255692 +
taattatcttgtataaatgc

SEQ ID NO: 12026 - DNA, 20 bp, Artificial Sequence
  Synthetic oligonucleotide; AGG chr11 5255677 5255696 5255693 +
aattatcttgtataaatgct

SEQ ID NO: 12027 - DNA, 20 bp, Artificial Sequence
  Synthetic oligonucleotide; TAG chr11 5255689 5255708 5255705 +
taaatgctaggttcacttct

SEQ ID NO: 12028 - DNA, 20 bp, Artificial Sequence
  Synthetic oligonucleotide; AGG chr11 5255690 5255709 5255706 +
aaatgctaggttcacttctt

SEQ ID NO: 12029 - DNA, 20 bp, Artificial Sequence
  Synthetic oligonucleotide; GGG chr11 5255691 5255710 5255707 +
aatgctaggttcacttctta

SEQ ID NO: 12030 - DNA, 20 bp, Artificial Sequence
  Synthetic oligonucleotide; AAG chr11 5255705 5255724 5255721 +
ttcttagggaatcttattct

SEQ ID NO: 12031 - DNA, 20 bp, Artificial Sequence
  Synthetic oligonucleotide; AAG chr11 5255712 5255731 5255728 +
ggaatcttattctaagacat

SEQ ID NO: 12032 - DNA, 20 bp, Artificial Sequence
  Synthetic oligonucleotide; TGG chr11 5255728 5255747 5255744 +
acataagacatgtatttgca

SEQ ID NO: 12033 - DNA, 20 bp, Artificial Sequence
  Synthetic oligonucleotide; AAG chr11 5255743 5255762 5255759 +
ttgcatggaaaacaactctt

SEQ ID NO: 12034 - DNA, 20 bp, Artificial Sequence
  Synthetic oligonucleotide; GAG chr11 5255745 5255764 5255761 +
gcatggaaaacaactcttaa

SEQ ID NO: 12035 - DNA, 20 bp, Artificial Sequence
  Synthetic oligonucleotide; AGG chr11 5255746 5255765 5255762 +
catggaaaacaactcttaag

SEQ ID NO: 12036 - DNA, 20 bp, Artificial Sequence
  Synthetic oligonucleotide; CAG chr11 5255749 5255768 5255765 +
ggaaaacaactcttaagagg

SEQ ID NO: 12037 - DNA, 20 bp, Artificial Sequence
  Synthetic oligonucleotide; AGG chr11 5255750 5255769 5255766 +
gaaaacaactcttaagaggc

SEQ ID NO: 12038 - DNA, 20 bp, Artificial Sequence
  Synthetic oligonucleotide; GGG chr11 5255751 5255770 5255767 +
aaaacaactcttaagaggca

SEQ ID NO: 12039 - DNA, 20 bp, Artificial Sequence
  Synthetic oligonucleotide; TAG chr11 5255771 5255790 5255787 +
gggactgttttattgactaa

SEQ ID NO: 12040 - DNA, 20 bp, Artificial Sequence
  Synthetic oligonucleotide; CAG chr11 5255788 5255807 5255804 +
taatagtccacacactgtga

SEQ ID NO: 12041 - DNA, 20 bp, Artificial Sequence
  Synthetic oligonucleotide; TGG chr11 5255792 5255811 5255808 +
agtccacacactgtgacagc

SEQ ID NO: 12042 - DNA, 20 bp, Artificial Sequence
  Synthetic oligonucleotide; GGG chr11 5255793 5255812 5255809 +
gtccacacactgtgacagct

SEQ ID NO: 12043 - DNA, 20 bp, Artificial Sequence
  Synthetic oligonucleotide; TAG chr11 5255805 5255824 5255821 +
tgacagctgggatgtcactg

SEQ ID NO: 12044 - DNA, 20 bp, Artificial Sequence
  Synthetic oligonucleotide; TAG chr11 5255810 5255829 5255826 +
gctgggatgtcactgtagtt

SEQ ID NO: 12045 - DNA, 20 bp, Artificial Sequence
  Synthetic oligonucleotide; CAG chr11 5255831 5255850 5255847 +
agacatctttatctgtaact

SEQ ID NO: 12046 - DNA, 20 bp, Artificial Sequence
  Synthetic oligonucleotide; TGG chr11 5255851 5255870 5255867 +
cagtgctgtttctgacatat

SEQ ID NO: 12047 - DNA, 20 bp, Artificial Sequence
  Synthetic oligonucleotide; TGG chr11 5255864 5255883 5255880 +
gacatattggccacttaaca

SEQ ID NO: 12048 - DNA, 20 bp, Artificial Sequence
  Synthetic oligonucleotide; CAG chr11 5255867 5255886 5255883 +
atattggccacttaacatgg

SEQ ID NO: 12049 - DNA, 20 bp, Artificial Sequence
  Synthetic oligonucleotide; AGG chr11 5255868 5255887 5255884 +
tattggccacttaacatggc

SEQ ID NO: 12050 - DNA, 20 bp, Artificial Sequence
  Synthetic oligonucleotide; AAG chr11 5255871 5255890 5255887 +
tggccacttaacatggcagg

SEQ ID NO: 12051 - DNA, 20 bp, Artificial Sequence
  Synthetic oligonucleotide; TGG chr11 5255906 5255925 5255922 +
ttttttctttattttttctt

SEQ ID NO: 12052 - DNA, 20 bp, Artificial Sequence
  Synthetic oligonucleotide; GGG chr11 5255907 5255926 5255923 +
tttttctttattttttcttt

SEQ ID NO: 12053 - DNA, 20 bp, Artificial Sequence
  Synthetic oligonucleotide; TGG chr11 5255922 5255941 5255938 +
tctttgggatttttattttt

SEQ ID NO: 12054 - DNA, 20 bp, Artificial Sequence
  Synthetic oligonucleotide; TAG chr11 5255925 5255944 5255941 +
ttgggatttttattttttgg

SEQ ID NO: 12055 - DNA, 20 bp, Artificial Sequence
  Synthetic oligonucleotide; AGG chr11 5255926 5255945 5255942 +
tgggatttttattttttggt

SEQ ID NO: 12056 - DNA, 20 bp, Artificial Sequence
  Synthetic oligonucleotide; TGG chr11 5255931 5255950 5255947 +
tttttattttttggtaggtt

SEQ ID NO: 12057 - DNA, 20 bp, Artificial Sequence
  Synthetic oligonucleotide; TGG chr11 5255973 5255992 5255989 +
ctgaactcgatccatgacct

SEQ ID NO: 12058 - DNA, 20 bp, Artificial Sequence
  Synthetic oligonucleotide; TAG chr11 5255976 5255995 5255992 +
aactcgatccatgaccttgg

SEQ ID NO: 12059 - DNA, 20 bp, Artificial Sequence
  Synthetic oligonucleotide; CAG chr11 5255989 5256008 5256005 +
accttggtagattatgacgt

SEQ ID NO: 12060 - DNA, 20 bp, Artificial Sequence
  Synthetic oligonucleotide; TGG chr11 5255998 5256017 5256014 +
gattatgacgtcagaaactc

SEQ ID NO: 12061 - DNA, 20 bp, Artificial Sequence
  Synthetic oligonucleotide; TGG chr11 5256006 5256025 5256022 +
cgtcagaaactctggaaatc

SEQ ID NO: 12062 - DNA, 20 bp, Artificial Sequence
  Synthetic oligonucleotide; TGG chr11 5256014 5256033 5256030 +
actctggaaatctggcttat

SEQ ID NO: 12063 - DNA, 20 bp, Artificial Sequence
  Synthetic oligonucleotide; GAG chr11 5256016 5256035 5256032 +
tctggaaatctggcttattg

SEQ ID NO: 12064 - DNA, 20 bp, Artificial Sequence
  Synthetic oligonucleotide; AGG chr11 5256017 5256036 5256033 +
ctggaaatctggcttattgg

SEQ ID NO: 12065 - DNA, 20 bp, Artificial Sequence
  Synthetic oligonucleotide; GAG chr11 5256019 5256038 5256035 +
ggaaatctggcttattggag

SEQ ID NO: 12066 - DNA, 20 bp, Artificial Sequence
  Synthetic oligonucleotide; GAG chr11 5256021 5256040 5256037 +
aaatctggcttattggagga

SEQ ID NO: 12067 - DNA, 20 bp, Artificial Sequence
  Synthetic oligonucleotide; CAG chr11 5256045 5256064 5256061 +
tctaccttcccctaacctat

SEQ ID NO: 12068 - DNA, 20 bp, Artificial Sequence
  Synthetic oligonucleotide; AGG chr11 5256046 5256065 5256062 +
ctaccttcccctaacctatc

SEQ ID NO: 12069 - DNA, 20 bp, Artificial Sequence
  Synthetic oligonucleotide; TAG chr11 5256053 5256072 5256069 +
cccctaacctatcaggttga

SEQ ID NO: 12070 - DNA, 20 bp, Artificial Sequence
  Synthetic oligonucleotide; AGG chr11 5256054 5256073 5256070 +
ccctaacctatcaggttgat

SEQ ID NO: 12071 - DNA, 20 bp, Artificial Sequence
  Synthetic oligonucleotide; TGG chr11 5256071 5256090 5256087 +
gataggaattataataatat

SEQ ID NO: 12072 - DNA, 20 bp, Artificial Sequence
  Synthetic oligonucleotide; TGG chr11 5256074 5256093 5256090 +
aggaattataataatattgg

SEQ ID NO: 12073 - DNA, 20 bp, Artificial Sequence
  Synthetic oligonucleotide; CAG chr11 5256085 5256104 5256101 +
taatattggtggaatccttt

SEQ ID NO: 12074 - DNA, 20 bp, Artificial Sequence
  Synthetic oligonucleotide; AAG chr11 5256105 5256124 5256121 +
cagacttcataatcctgtgt

SEQ ID NO: 12075 - DNA, 20 bp, Artificial Sequence
  Synthetic oligonucleotide; AGG chr11 5256106 5256125 5256122 +
agacttcataatcctgtgta

SEQ ID NO: 12076 - DNA, 20 bp, Artificial Sequence
  Synthetic oligonucleotide; AAG chr11 5256123 5256142 5256139 +
gtaaggcttatatctgctca

SEQ ID NO: 12077 - DNA, 20 bp, Artificial Sequence
  Synthetic oligonucleotide; TAG chr11 5256129 5256148 5256145 +
cttatatctgctcaaagtgt

SEQ ID NO: 12078 - DNA, 20 bp, Artificial Sequence
  Synthetic oligonucleotide; AGG chr11 5256130 5256149 5256146 +
ttatatctgctcaaagtgtt

SEQ ID NO: 12079 - DNA, 20 bp, Artificial Sequence
  Synthetic oligonucleotide; CGG chr11 5256133 5256152 5256149 +
tatctgctcaaagtgttagg

SEQ ID NO: 12080 - DNA, 20 bp, Artificial Sequence
  Synthetic oligonucleotide; AAG chr11 5256140 5256159 5256156 +
tcaaagtgttaggcggctaa

SEQ ID NO: 12081 - DNA, 20 bp, Artificial Sequence
  Synthetic oligonucleotide; CAG chr11 5256145 5256164 5256161 +
gtgttaggcggctaaaagac

SEQ ID NO: 12082 - DNA, 20 bp, Artificial Sequence
  Synthetic oligonucleotide; AAG chr11 5256149 5256168 5256165 +
taggcggctaaaagaccaga

SEQ ID NO: 12083 - DNA, 20 bp, Artificial Sequence
  Synthetic oligonucleotide; AAG chr11 5256174 5256193 5256190 +
acatgttgacctgcgcaaca

SEQ ID NO: 12084 - DNA, 20 bp, Artificial Sequence
  Synthetic oligonucleotide; TGG chr11 5256200 5256219 5256216 +
cacatattgcacttgttctt

SEQ ID NO: 12085 - DNA, 20 bp, Artificial Sequence
  Synthetic oligonucleotide; AAG chr11 5256203 5256222 5256219 +
atattgcacttgttctttgg

SEQ ID NO: 12086 - DNA, 20 bp, Artificial Sequence
  Synthetic oligonucleotide; AAG chr11 5256215 5256234 5256231 +
ttctttggaagttaaaataa

SEQ ID NO: 12087 - DNA, 20 bp, Artificial Sequence
  Synthetic oligonucleotide; AAG chr11 5256224 5256243 5256240 +
agttaaaataaaagttgaat

SEQ ID NO: 12088 - DNA, 20 bp, Artificial Sequence
  Synthetic oligonucleotide; AAG chr11 5256228 5256247 5256244 +
aaaataaaagttgaataaga

SEQ ID NO: 12089 - DNA, 20 bp, Artificial Sequence
  Synthetic oligonucleotide; AGG chr11 5256229 5256248 5256245 +
aaataaaagttgaataagaa

SEQ ID NO: 12090 - DNA, 20 bp, Artificial Sequence
  Synthetic oligonucleotide; AAG chr11 5256233 5256252 5256249 +
aaaagttgaataagaaagga

SEQ ID NO: 12091 - DNA, 20 bp, Artificial Sequence
  Synthetic oligonucleotide; AAG chr11 5256239 5256258 5256255 +
tgaataagaaaggaaagaaa

SEQ ID NO: 12092 - DNA, 20 bp, Artificial Sequence
  Synthetic oligonucleotide; CAG chr11 5256256 5256275 5256272 +
aaaaagatttgtcaacttat

SEQ ID NO: 12093 - DNA, 20 bp, Artificial Sequence
  Synthetic oligonucleotide; CAG chr11 5256266 5256285 5256282 +
gtcaacttatcagtatcttc

SEQ ID NO: 12094 - DNA, 20 bp, Artificial Sequence
  Synthetic oligonucleotide; AAG chr11 5256285 5256304 5256301 +
ccagttactcacataataat

SEQ ID NO: 12095 - DNA, 20 bp, Artificial Sequence
  Synthetic oligonucleotide; AAG chr11 5256304 5256323 5256320 +
taagtgacttctctcaatct

SEQ ID NO: 12096 - DNA, 20 bp, Artificial Sequence
  Synthetic oligonucleotide; AGG chr11 5256305 5256324 5256321 +
aagtgacttctctcaatcta

SEQ ID NO: 12097 - DNA, 20 bp, Artificial Sequence
  Synthetic oligonucleotide; TGG chr11 5256309 5256328 5256325 +
gacttctctcaatctaagga

SEQ ID NO: 12098 - DNA, 20 bp, Artificial Sequence
  Synthetic oligonucleotide; GGG chr11 5256310 5256329 5256326 +
acttctctcaatctaaggat

SEQ ID NO: 12099 - DNA, 20 bp, Artificial Sequence
  Synthetic oligonucleotide; GAG chr11 5256314 5256333 5256330 +
ctctcaatctaaggatgggt

SEQ ID NO: 12100 - DNA, 20 bp, Artificial Sequence
  Synthetic oligonucleotide; AAG chr11 5256318 5256337 5256334 +
caatctaaggatgggtgaga

SEQ ID NO: 12101 - DNA, 20 bp, Artificial Sequence
  Synthetic oligonucleotide; TGG chr11 5256329 5256348 5256345 +
tgggtgagaaagatttttat

SEQ ID NO: 12102 - DNA, 20 bp, Artificial Sequence
  Synthetic oligonucleotide; TGG chr11 5256337 5256356 5256353 +
aaagatttttattggtatgc

SEQ ID NO: 12103 - DNA, 20 bp, Artificial Sequence
  Synthetic oligonucleotide; CAG chr11 5256342 5256361 5256358 +
tttttattggtatgctggta

SEQ ID NO: 12104 - DNA, 20 bp, Artificial Sequence
  Synthetic oligonucleotide; TAG chr11 5256349 5256368 5256365 +
tggtatgctggtacagatta

SEQ ID NO: 12105 - DNA, 20 bp, Artificial Sequence
  Synthetic oligonucleotide; GAG chr11 5256351 5256370 5256367 +
gtatgctggtacagattata

SEQ ID NO: 12106 - DNA, 20 bp, Artificial Sequence
  Synthetic oligonucleotide; GAG chr11 5256357 5256376 5256373 +
tggtacagattatagagact

SEQ ID NO: 12107 - DNA, 20 bp, Artificial Sequence
  Synthetic oligonucleotide; AGG chr11 5256358 5256377 5256374 +
ggtacagattatagagactg

SEQ ID NO: 12108 - DNA, 20 bp, Artificial Sequence
  Synthetic oligonucleotide; TAG chr11 5256372 5256391 5256388 +
agactgaggtgaacccaaat

SEQ ID NO: 12109 - DNA, 20 bp, Artificial Sequence
  Synthetic oligonucleotide; AGG chr11 5256373 5256392 5256389 +
gactgaggtgaacccaaatt

SEQ ID NO: 12110 - DNA, 20 bp, Artificial Sequence
  Synthetic oligonucleotide; GGG chr11 5256374 5256393 5256390 +
actgaggtgaacccaaatta

SEQ ID NO: 12111 - DNA, 20 bp, Artificial Sequence
  Synthetic oligonucleotide; AAG chr11 5256384 5256403 5256400 +
acccaaattagggtctcttt

SEQ ID NO: 12112 - DNA, 20 bp, Artificial Sequence
  Synthetic oligonucleotide; TAG chr11 5256388 5256407 5256404 +
aaattagggtctctttaaga

SEQ ID NO: 12113 - DNA, 20 bp, Artificial Sequence
  Synthetic oligonucleotide; AGG chr11 5256389 5256408 5256405 +
aattagggtctctttaagat

SEQ ID NO: 12114 - DNA, 20 bp, Artificial Sequence
  Synthetic oligonucleotide; GGG chr11 5256390 5256409 5256406 +
attagggtctctttaagata

SEQ ID NO: 12115 - DNA, 20 bp, Artificial Sequence
  Synthetic oligonucleotide; GGG chr11 5256391 5256410 5256407 +
ttagggtctctttaagatag

SEQ ID NO: 12116 - DNA, 20 bp, Artificial Sequence
  Synthetic oligonucleotide; GAG chr11 5256400 5256419 5256416 +
ctttaagataggggatctgt

SEQ ID NO: 12117 - DNA, 20 bp, Artificial Sequence
  Synthetic oligonucleotide; TGG chr11 5256404 5256423 5256420 +
aagataggggatctgtgaga

SEQ ID NO: 12118 - DNA, 20 bp, Artificial Sequence
  Synthetic oligonucleotide; GGG chr11 5256405 5256424 5256421 +
agataggggatctgtgagat

SEQ ID NO: 12119 - DNA, 20 bp, Artificial Sequence
  Synthetic oligonucleotide; TAG chr11 5256414 5256433 5256430 +
atctgtgagatgggtgtgta

SEQ ID NO: 12120 - DNA, 20 bp, Artificial Sequence
  Synthetic oligonucleotide; TGG chr11 5256422 5256441 5256438 +
gatgggtgtgtatagatctt

SEQ ID NO: 12121 - DNA, 20 bp, Artificial Sequence
  Synthetic oligonucleotide; GAG chr11 5256433 5256452 5256449 +
atagatctttggccatatct

SEQ ID NO: 12122 - DNA, 20 bp, Artificial Sequence
  Synthetic oligonucleotide; GAG chr11 5256435 5256454 5256451 +
agatctttggccatatctga

SEQ ID NO: 12123 - DNA, 20 bp, Artificial Sequence
  Synthetic oligonucleotide; TGG chr11 5256440 5256459 5256456 +
tttggccatatctgagagtc

SEQ ID NO: 12124 - DNA, 20 bp, Artificial Sequence
  Synthetic oligonucleotide; TGG chr11 5256444 5256463 5256460 +
gccatatctgagagtctggt

SEQ ID NO: 12125 - DNA, 20 bp, Artificial Sequence
  Synthetic oligonucleotide; GGG chr11 5256445 5256464 5256461 +
ccatatctgagagtctggtt

SEQ ID NO: 12126 - DNA, 20 bp, Artificial Sequence
  Synthetic oligonucleotide; TAG chr11 5256457 5256476 5256473 +
gtctggttgggttccatttg

SEQ ID NO: 12127 - DNA, 20 bp, Artificial Sequence
  Synthetic oligonucleotide; GAG chr11 5256459 5256478 5256475 +
ctggttgggttccatttgta

SEQ ID NO: 12128 - DNA, 20 bp, Artificial Sequence
  Synthetic oligonucleotide; AAG chr11 5256472 5256491 5256488 +
atttgtagagcctgaccttt

SEQ ID NO: 12129 - DNA, 20 bp, Artificial Sequence
  Synthetic oligonucleotide; CAG chr11 5256482 5256501 5256498 +
cctgacctttaagaatgtgt

SEQ ID NO: 12130 - DNA, 20 bp, Artificial Sequence
  Synthetic oligonucleotide; GAG chr11 5256484 5256503 5256500 +
tgacctttaagaatgtgtca

SEQ ID NO: 12131 - DNA, 20 bp, Artificial Sequence
  Synthetic oligonucleotide; TGG chr11 5256489 5256508 5256505 +
tttaagaatgtgtcagagac

SEQ ID NO: 12132 - DNA, 20 bp, Artificial Sequence
  Synthetic oligonucleotide; AAG chr11 5256497 5256516 5256513 +
tgtgtcagagactggtgtct

SEQ ID NO: 12133 - DNA, 20 bp, Artificial Sequence
  Synthetic oligonucleotide; AAG chr11 5256506 5256525 5256522 +
gactggtgtctaagcccgct

SEQ ID NO: 12134 - DNA, 20 bp, Artificial Sequence
  Synthetic oligonucleotide; AGG chr11 5256507 5256526 5256523 +
actggtgtctaagcccgcta

SEQ ID NO: 12135 - DNA, 20 bp, Artificial Sequence
  Synthetic oligonucleotide; AAG chr11 5256517 5256536 5256533 +
aagcccgctaaggcctaaac

SEQ ID NO: 12136 - DNA, 20 bp, Artificial Sequence
  Synthetic oligonucleotide; GAG chr11 5256551 5256570 5256567 +
aatctctctttttttttttt

SEQ ID NO: 12137 - DNA, 20 bp, Artificial Sequence
  Synthetic oligonucleotide; CAG chr11 5256555 5256574 5256571 +
tctcttttttttttttgaga

SEQ ID NO: 12138 - DNA, 20 bp, Artificial Sequence
  Synthetic oligonucleotide; GAG chr11 5256557 5256576 5256573 +
tcttttttttttttgagaca

SEQ ID NO: 12139 - DNA, 20 bp, Artificial Sequence
  Synthetic oligonucleotide; CAG chr11 5256575 5256594 5256591 +
cagagtcttgttctgtcacc

SEQ ID NO: 12140 - DNA, 20 bp, Artificial Sequence
  Synthetic oligonucleotide; AGG chr11 5256576 5256595 5256592 +
agagtcttgttctgtcaccc

SEQ ID NO: 12141 - DNA, 20 bp, Artificial Sequence
  Synthetic oligonucleotide; TGG chr11 5256580 5256599 5256596 +
tcttgttctgtcacccaggc

SEQ ID NO: 12142 - DNA, 20 bp, Artificial Sequence
  Synthetic oligonucleotide; GAG chr11 5256582 5256601 5256598 +
ttgttctgtcacccaggctg

SEQ ID NO: 12143 - DNA, 20 bp, Artificial Sequence
  Synthetic oligonucleotide; CAG chr11 5256587 5256606 5256603 +
ctgtcacccaggctggagtg

SEQ ID NO: 12144 - DNA, 20 bp, Artificial Sequence
  Synthetic oligonucleotide; TGG chr11 5256590 5256609 5256606 +
tcacccaggctggagtgcag

SEQ ID NO: 12145 - DNA, 20 bp, Artificial Sequence
  Synthetic oligonucleotide; CGG chr11 5256601 5256620 5256617 +
ggagtgcagtggtatgatct

SEQ ID NO: 12146 - DNA, 20 bp, Artificial Sequence
  Synthetic oligonucleotide; CAG chr11 5256625 5256644 5256641 +
tcactgcaactcctgccttc

SEQ ID NO: 12147 - DNA, 20 bp, Artificial Sequence
  Synthetic oligonucleotide; AGG chr11 5256626 5256645 5256642 +
cactgcaactcctgccttcc

SEQ ID NO: 12148 - DNA, 20 bp, Artificial Sequence
  Synthetic oligonucleotide; AAG chr11 5256632 5256651 5256648 +
aactcctgccttccaggttc

SEQ ID NO: 12149 - DNA, 20 bp, Artificial Sequence
  Synthetic oligonucleotide; CAG chr11 5256649 5256668 5256665 +
ttcaagcaattctccttcct

SEQ ID NO: 12150 - DNA, 20 bp, Artificial Sequence
  Synthetic oligonucleotide; AAG chr11 5256658 5256677 5256674 +
ttctccttcctcagcctccc

SEQ ID NO: 12151 - DNA, 20 bp, Artificial Sequence
  Synthetic oligonucleotide; TAG chr11 5256661 5256680 5256677 +
tccttcctcagcctcccaag

SEQ ID NO: 12152 - DNA, 20 bp, Artificial Sequence
  Synthetic oligonucleotide; TGG chr11 5256665 5256684 5256681 +
tcctcagcctcccaagtagc

SEQ ID NO: 12153 - DNA, 20 bp, Artificial Sequence
  Synthetic oligonucleotide; GGG chr11 5256666 5256685 5256682 +
cctcagcctcccaagtagct

SEQ ID NO: 12154 - DNA, 20 bp, Artificial Sequence
  Synthetic oligonucleotide; CAG chr11 5256673 5256692 5256689 +
ctcccaagtagctgggatta

SEQ ID NO: 12155 - DNA, 20 bp, Artificial Sequence
  Synthetic oligonucleotide; AGG chr11 5256674 5256693 5256690 +
tcccaagtagctgggattac

SEQ ID NO: 12156 - DNA, 20 bp, Artificial Sequence
  Synthetic oligonucleotide; TAG chr11 5256714 5256733 5256730 +
gtctaatttttgtatttttg

SEQ ID NO: 12157 - DNA, 20 bp, Artificial Sequence
  Synthetic oligonucleotide; GAG chr11 5256716 5256735 5256732 +
ctaatttttgtatttttgta

SEQ ID NO: 12158 - DNA, 20 bp, Artificial Sequence
  Synthetic oligonucleotide; TGG chr11 5256720 5256739 5256736 +
tttttgtatttttgtagaga

SEQ ID NO: 12159 - DNA, 20 bp, Artificial Sequence
  Synthetic oligonucleotide; GGG chr11 5256721 5256740 5256737 +
ttttgtatttttgtagagat

SEQ ID NO: 12160 - DNA, 20 bp, Artificial Sequence
  Synthetic oligonucleotide; TGG chr11 5256736 5256755 5256752 +
gagatgggatttcaccatgt

SEQ ID NO: 12161 - DNA, 20 bp, Artificial Sequence
  Synthetic oligonucleotide; CAG chr11 5256740 5256759 5256756 +
tgggatttcaccatgttggc

SEQ ID NO: 12162 - DNA, 20 bp, Artificial Sequence
  Synthetic oligonucleotide; AGG chr11 5256741 5256760 5256757 +
gggatttcaccatgttggcc

SEQ ID NO: 12163 - DNA, 20 bp, Artificial Sequence
  Synthetic oligonucleotide; TGG chr11 5256745 5256764 5256761 +
tttcaccatgttggccaggt

SEQ ID NO: 12164 - DNA, 20 bp, Artificial Sequence
  Synthetic oligonucleotide; CAG chr11 5256765 5256784 5256781 +
tggtcttgaactcttgacct

SEQ ID NO: 12165 - DNA, 20 bp, Artificial Sequence
  Synthetic oligonucleotide; AGG chr11 5256766 5256785 5256782 +
ggtcttgaactcttgacctc

SEQ ID NO: 12166 - DNA, 20 bp, Artificial Sequence
  Synthetic oligonucleotide; TGG chr11 5256783 5256802 5256799 +
ctcaggtgatctgcctgcct

SEQ ID NO: 12167 - DNA, 20 bp, Artificial Sequence
  Synthetic oligonucleotide; TGG chr11 5256799 5256818 5256815 +
gccttggcctcccaaaattc

SEQ ID NO: 12168 - DNA, 20 bp, Artificial Sequence
  Synthetic oligonucleotide; GGG chr11 5256800 5256819 5256816 +
ccttggcctcccaaaattct

SEQ ID NO: 12169 - DNA, 20 bp, Artificial Sequence
  Synthetic oligonucleotide; CAG chr11 5256807 5256826 5256823 +
ctcccaaaattctgggatta

SEQ ID NO: 12170 - DNA, 20 bp, Artificial Sequence
  Synthetic oligonucleotide; AGG chr11 5256808 5256827 5256824 +
tcccaaaattctgggattac

SEQ ID NO: 12171 - DNA, 20 bp, Artificial Sequence
  Synthetic oligonucleotide; GAG chr11 5256814 5256833 5256830 +
aattctgggattacaggcgt

SEQ ID NO: 12172 - DNA, 20 bp, Artificial Sequence
  Synthetic oligonucleotide; CAG chr11 5256827 5256846 5256843 +
caggcgtgagccaccactcc

SEQ ID NO: 12173 - DNA, 20 bp, Artificial Sequence
  Synthetic oligonucleotide; AAG chr11 5256839 5256858 5256855 +
accactcccagcctctaaac

SEQ ID NO: 12174 - DNA, 20 bp, Artificial Sequence
  Synthetic oligonucleotide; CAG chr11 5256863 5256882 5256879 +
gaatcttaattgctcctcct

SEQ ID NO: 12175 - DNA, 20 bp, Artificial Sequence
  Synthetic oligonucleotide; AAG chr11 5256869 5256888 5256885 +
taattgctcctcctcagact

SEQ ID NO: 12176 - DNA, 20 bp, Artificial Sequence
  Synthetic oligonucleotide; AGG chr11 5256870 5256889 5256886 +
aattgctcctcctcagacta

SEQ ID NO: 12177 - DNA, 20 bp, Artificial Sequence
  Synthetic oligonucleotide; TAG chr11 5256879 5256898 5256895 +
tcctcagactaaggaatatc

SEQ ID NO: 12178 - DNA, 20 bp, Artificial Sequence
  Synthetic oligonucleotide; AGG chr11 5256880 5256899 5256896 +
cctcagactaaggaatatct

SEQ ID NO: 12179 - DNA, 20 bp, Artificial Sequence
  Synthetic oligonucleotide; AAG chr11 5256926 5256945 5256942 +
tccccatttatccaaaaacc

SEQ ID NO: 12180 - DNA, 20 bp, Artificial Sequence
  Synthetic oligonucleotide; AGG chr11 5256927 5256946 5256943 +
ccccatttatccaaaaacca

SEQ ID NO: 12181 - DNA, 20 bp, Artificial Sequence
  Synthetic oligonucleotide; CAG chr11 5256930 5256949 5256946 +
catttatccaaaaaccaagg

SEQ ID NO: 12182 - DNA, 20 bp, Artificial Sequence
  Synthetic oligonucleotide; AAG chr11 5256941 5256960 5256957 +
aaaccaaggcagtgttctaa

SEQ ID NO: 12183 - DNA, 20 bp, Artificial Sequence
  Synthetic oligonucleotide; GAG chr11 5256978 5256997 5256994 +
ttatttcctcttatgctttt

SEQ ID NO: 12184 - DNA, 20 bp, Artificial Sequence
  Synthetic oligonucleotide; AGG chr11 5256979 5256998 5256995 +
tatttcctcttatgcttttg

SEQ ID NO: 12185 - DNA, 20 bp, Artificial Sequence
  Synthetic oligonucleotide; AAG chr11 5256993 5257012 5257009 +
cttttgaggcaatatctttt

SEQ ID NO: 12186 - DNA, 20 bp, Artificial Sequence
  Synthetic oligonucleotide; GAG chr11 5256995 5257014 5257011 +
tttgaggcaatatcttttaa

SEQ ID NO: 12187 - DNA, 20 bp, Artificial Sequence
  Synthetic oligonucleotide; AAG chr11 5257103 5257122 5257119 +
ataaaactgtttctttacac

SEQ ID NO: 12188 - DNA, 20 bp, Artificial Sequence
  Synthetic oligonucleotide; AAG chr11 5257113 5257132 5257129 +
ttctttacacaagcaatttc

SEQ ID NO: 12189 - DNA, 20 bp, Artificial Sequence
  Synthetic oligonucleotide; AAG chr11 5257123 5257142 5257139 +
aagcaatttcaagtgttttc

SEQ ID NO: 12190 - DNA, 20 bp, Artificial Sequence
  Synthetic oligonucleotide; CAG chr11 5257158 5257177 5257174 +
tgtattttcaaacatttgtt

SEQ ID NO: 12191 - DNA, 20 bp, Artificial Sequence
  Synthetic oligonucleotide; AAG chr11 5257194 5257213 5257210 +
aataaatgtcataattttta

SEQ ID NO: 12192 - DNA, 20 bp, Artificial Sequence
  Synthetic oligonucleotide; TAG chr11 5257197 5257216 5257213 +
aaatgtcataatttttaaag

SEQ ID NO: 12193 - DNA, 20 bp, Artificial Sequence
  Synthetic oligonucleotide; TGG chr11 5257200 5257219 5257216 +
tgtcataatttttaaagtag

SEQ ID NO: 12194 - DNA, 20 bp, Artificial Sequence
  Synthetic oligonucleotide; GGG chr11 5257201 5257220 5257217 +
gtcataatttttaaagtagt

SEQ ID NO: 12195 - DNA, 20 bp, Artificial Sequence
  Synthetic oligonucleotide; AAG chr11 5257209 5257228 5257225 +
ttttaaagtagtgggcattt

SEQ ID NO: 12196 - DNA, 20 bp, Artificial Sequence
  Synthetic oligonucleotide; AAG chr11 5257218 5257237 5257234 +
agtgggcatttaagttaaat

SEQ ID NO: 12197 - DNA, 20 bp, Artificial Sequence
  Synthetic oligonucleotide; CAG chr11 5257222 5257241 5257238 +
ggcatttaagttaaataagt

SEQ ID NO: 12198 - DNA, 20 bp, Artificial Sequence
  Synthetic oligonucleotide; GAG chr11 5257224 5257243 5257240 +
catttaagttaaataagtca

SEQ ID NO: 12199 - DNA, 20 bp, Artificial Sequence
  Synthetic oligonucleotide; AAG chr11 5257244 5257263 5257260 +
gagaataaaactttcctctg

SEQ ID NO: 12200 - DNA, 20 bp, Artificial Sequence
  Synthetic oligonucleotide; TAG chr11 5257256 5257275 5257272 +
ttcctctgaagattataatc

SEQ ID NO: 12201 - DNA, 20 bp, Artificial Sequence
  Synthetic oligonucleotide; AGG chr11 5257257 5257276 5257273 +
tcctctgaagattataatct

SEQ ID NO: 12202 - DNA, 20 bp, Artificial Sequence
  Synthetic oligonucleotide; TAG chr11 5257260 5257279 5257276 +
tctgaagattataatctagg

SEQ ID NO: 12203 - DNA, 20 bp, Artificial Sequence
  Synthetic oligonucleotide; AAG chr11 5257285 5257304 5257301 +
catacataaaattaataatt

SEQ ID NO: 12204 - DNA, 20 bp, Artificial Sequence
  Synthetic oligonucleotide; CAG chr11 5257307 5257326 5257323 +
gttaaacaacaaaataattt

SEQ ID NO: 12205 - DNA, 20 bp, Artificial Sequence
  Synthetic oligonucleotide; AAG chr11 5257322 5257341 5257338 +
aatttcagatattattaact

SEQ ID NO: 12206 - DNA, 20 bp, Artificial Sequence
  Synthetic oligonucleotide; AAG chr11 5257334 5257353 5257350 +
tattaactaagaatgaaatt

SEQ ID NO: 12207 - DNA, 20 bp, Artificial Sequence
  Synthetic oligonucleotide; AGG chr11 5257335 5257354 5257351 +
attaactaagaatgaaatta

SEQ ID NO: 12208 - DNA, 20 bp, Artificial Sequence
  Synthetic oligonucleotide; GAG chr11 5257337 5257356 5257353 +
taactaagaatgaaattaag

SEQ ID NO: 12209 - DNA, 20 bp, Artificial Sequence
  Synthetic oligonucleotide; AAG chr11 5257341 5257360 5257357 +
taagaatgaaattaaggaga

SEQ ID NO: 12210 - DNA, 20 bp, Artificial Sequence
  Synthetic oligonucleotide; CAG chr11 5257352 5257371 5257368 +
ttaaggagaaagtattcgaa

SEQ ID NO: 12211 - DNA, 20 bp, Artificial Sequence
  Synthetic oligonucleotide; GAG chr11 5257354 5257373 5257370 +
aaggagaaagtattcgaaca

SEQ ID NO: 12212 - DNA, 20 bp, Artificial Sequence
  Synthetic oligonucleotide; AGG chr11 5257355 5257374 5257371 +
aggagaaagtattcgaacag

SEQ ID NO: 12213 - DNA, 20 bp, Artificial Sequence
  Synthetic oligonucleotide; CAG chr11 5257366 5257385 5257382 +
ttcgaacagaggcaaaatga

SEQ ID NO: 12214 - DNA, 20 bp, Artificial Sequence
  Synthetic oligonucleotide; AAG chr11 5257369 5257388 5257385 +
gaacagaggcaaaatgacag

SEQ ID NO: 12215 - DNA, 20 bp, Artificial Sequence
  Synthetic oligonucleotide; AGG chr11 5257370 5257389 5257386 +
aacagaggcaaaatgacaga

SEQ ID NO: 12216 - DNA, 20 bp, Artificial Sequence
  Synthetic oligonucleotide; TGG chr11 5257382 5257401 5257398 +
atgacagaaggaatctgcca

SEQ ID NO: 12217 - DNA, 20 bp, Artificial Sequence
  Synthetic oligonucleotide; GGG chr11 5257383 5257402 5257399 +
tgacagaaggaatctgccat

SEQ ID NO: 12218 - DNA, 20 bp, Artificial Sequence
  Synthetic oligonucleotide; AAG chr11 5257386 5257405 5257402 +
cagaaggaatctgccatggg

SEQ ID NO: 12219 - DNA, 20 bp, Artificial Sequence
  Synthetic oligonucleotide; AGG chr11 5257387 5257406 5257403 +
agaaggaatctgccatggga

SEQ ID NO: 12220 - DNA, 20 bp, Artificial Sequence
  Synthetic oligonucleotide; AAG chr11 5257402 5257421 5257418 +
tgggaaggcattgccaaata

SEQ ID NO: 12221 - DNA, 20 bp, Artificial Sequence
  Synthetic oligonucleotide; TAG chr11 5257407 5257426 5257423 +
aggcattgccaaataaagtt

SEQ ID NO: 12222 - DNA, 20 bp, Artificial Sequence
  Synthetic oligonucleotide; AAG chr11 5257410 5257429 5257426 +
cattgccaaataaagtttag

SEQ ID NO: 12223 - DNA, 20 bp, Artificial Sequence
  Synthetic oligonucleotide; TAG chr11 5257419 5257438 5257435 +
ataaagtttagaagctgaaa

SEQ ID NO: 12224 - DNA, 20 bp, Artificial Sequence
  Synthetic oligonucleotide; AAG chr11 5257430 5257449 5257446 +
aagctgaaatagtaaattca

SEQ ID NO: 12225 - DNA, 20 bp, Artificial Sequence
  Synthetic oligonucleotide; AAG chr11 5257438 5257457 5257454 +
atagtaaattcaaagctctg

SEQ ID NO: 12226 - DNA, 20 bp, Artificial Sequence
  Synthetic oligonucleotide; CAG chr11 5257441 5257460 5257457 +
gtaaattcaaagctctgaag

SEQ ID NO: 12227 - DNA, 20 bp, Artificial Sequence
  Synthetic oligonucleotide; AAG chr11 5257444 5257463 5257460 +
aattcaaagctctgaagcag

SEQ ID NO: 12228 - DNA, 20 bp, Artificial Sequence
  Synthetic oligonucleotide; CAG chr11 5257467 5257486 5257483 +
aaaacaaactcctgctgtgc

SEQ ID NO: 12229 - DNA, 20 bp, Artificial Sequence
  Synthetic oligonucleotide; GAG chr11 5257469 5257488 5257485 +
aacaaactcctgctgtgcca

SEQ ID NO: 12230 - DNA, 20 bp, Artificial Sequence
  Synthetic oligonucleotide; GAG chr11 5257471 5257490 5257487 +
caaactcctgctgtgccaga

SEQ ID NO: 12231 - DNA, 20 bp, Artificial Sequence
  Synthetic oligonucleotide; TAG chr11 5257475 5257494 5257491 +
ctcctgctgtgccagagagt

SEQ ID NO: 12232 - DNA, 20 bp, Artificial Sequence
  Synthetic oligonucleotide; AAG chr11 5257481 5257500 5257497 +
ctgtgccagagagttagata

SEQ ID NO: 12233 - DNA, 20 bp, Artificial Sequence
  Synthetic oligonucleotide; CAG chr11 5257487 5257506 5257503 +
cagagagttagataaagaac

SEQ ID NO: 12234 - DNA, 20 bp, Artificial Sequence
  Synthetic oligonucleotide; AAG chr11 5257505 5257524 5257521 +
accagtgccgttgatatgta

SEQ ID NO: 12235 - DNA, 20 bp, Artificial Sequence
  Synthetic oligonucleotide; TGG chr11 5257508 5257527 5257524 +
agtgccgttgatatgtaaag

SEQ ID NO: 12236 - DNA, 20 bp, Artificial Sequence
  Synthetic oligonucleotide; GAG chr11 5257510 5257529 5257526 +
tgccgttgatatgtaaagtg

SEQ ID NO: 12237 - DNA, 20 bp, Artificial Sequence
  Synthetic oligonucleotide; TAG chr11 5257515 5257534 5257531 +
ttgatatgtaaagtggagaa

SEQ ID NO: 12238 - DNA, 20 bp, Artificial Sequence
  Synthetic oligonucleotide; CAG chr11 5257518 5257537 5257534 +
atatgtaaagtggagaatag

SEQ ID NO: 12239 - DNA, 20 bp, Artificial Sequence
  Synthetic oligonucleotide; AGG chr11 5257519 5257538 5257535 +
tatgtaaagtggagaatagc

SEQ ID NO: 12240 - DNA, 20 bp, Artificial Sequence
  Synthetic oligonucleotide; TGG chr11 5257522 5257541 5257538 +
gtaaagtggagaatagcagg

SEQ ID NO: 12241 - DNA, 20 bp, Artificial Sequence
  Synthetic oligonucleotide; CAG chr11 5257533 5257552 5257549 +
aatagcaggtggtattgttt

SEQ ID NO: 12242 - DNA, 20 bp, Artificial Sequence
  Synthetic oligonucleotide; AGG chr11 5257534 5257553 5257550 +
atagcaggtggtattgtttc

SEQ ID NO: 12243 - DNA, 20 bp, Artificial Sequence
  Synthetic oligonucleotide; GGG chr11 5257535 5257554 5257551 +
tagcaggtggtattgtttca

SEQ ID NO: 12244 - DNA, 20 bp, Artificial Sequence
  Synthetic oligonucleotide; AAG chr11 5257538 5257557 5257554 +
caggtggtattgtttcaggg

SEQ ID NO: 12245 - DNA, 20 bp, Artificial Sequence
  Synthetic oligonucleotide; AAG chr11 5257550 5257569 5257566 +
tttcagggaagcataaacct

SEQ ID NO: 12246 - DNA, 20 bp, Artificial Sequence
  Synthetic oligonucleotide; AGG chr11 5257551 5257570 5257567 +
ttcagggaagcataaaccta

SEQ ID NO: 12247 - DNA, 20 bp, Artificial Sequence
  Synthetic oligonucleotide; CAG chr11 5257569 5257588 5257585 +
taaggacataaacttgtcct

SEQ ID NO: 12248 - DNA, 20 bp, Artificial Sequence
  Synthetic oligonucleotide; TGG chr11 5257572 5257591 5257588 +
ggacataaacttgtcctcag

SEQ ID NO: 12249 - DNA, 20 bp, Artificial Sequence
  Synthetic oligonucleotide; TAG chr11 5257575 5257594 5257591 +
cataaacttgtcctcagtgg

SEQ ID NO: 12250 - DNA, 20 bp, Artificial Sequence
  Synthetic oligonucleotide; AGG chr11 5257576 5257595 5257592 +
ataaacttgtcctcagtggt

SEQ ID NO: 12251 - DNA, 20 bp, Artificial Sequence
  Synthetic oligonucleotide; GGG chr11 5257577 5257596 5257593 +
taaacttgtcctcagtggta

SEQ ID NO: 12252 - DNA, 20 bp, Artificial Sequence
  Synthetic oligonucleotide; GAG chr11 5257579 5257598 5257595 +
aacttgtcctcagtggtagg

SEQ ID NO: 12253 - DNA, 20 bp, Artificial Sequence
  Synthetic oligonucleotide; GAG chr11 5257583 5257602 5257599 +
tgtcctcagtggtagggagt

SEQ ID NO: 12254 - DNA, 20 bp, Artificial Sequence
  Synthetic oligonucleotide; AAG chr11 5257586 5257605 5257602 +
cctcagtggtagggagtgag

SEQ ID NO: 12255 - DNA, 20 bp, Artificial Sequence
  Synthetic oligonucleotide; TAG chr11 5257595 5257614 5257611 +
tagggagtgagaagccatta

SEQ ID NO: 12256 - DNA, 20 bp, Artificial Sequence
  Synthetic oligonucleotide; TGG chr11 5257609 5257628 5257625 +
ccattatagaattttaactc

SEQ ID NO: 12257 - DNA, 20 bp, Artificial Sequence
  Synthetic oligonucleotide; AAG chr11 5257628 5257647 5257644 +
ctggtaatgacataatctct

SEQ ID NO: 12258 - DNA, 20 bp, Artificial Sequence
  Synthetic oligonucleotide; TGG chr11 5257644 5257663 5257660 +
ctctaagcaacctgtactat

SEQ ID NO: 12259 - DNA, 20 bp, Artificial Sequence
  Synthetic oligonucleotide; TGG chr11 5257648 5257667 5257664 +
aagcaacctgtactattggc

SEQ ID NO: 12260 - DNA, 20 bp, Artificial Sequence
  Synthetic oligonucleotide; AAG chr11 5257662 5257681 5257678 +
attggctggattactattct

SEQ ID NO: 12261 - DNA, 20 bp, Artificial Sequence
  Synthetic oligonucleotide; AAG chr11 5257698 5257717 5257714 +
tcacaactgttttgcttaaa

SEQ ID NO: 12262 - DNA, 20 bp, Artificial Sequence
  Synthetic oligonucleotide; TGG chr11 5257714 5257733 5257730 +
taaaaagcccttattgcctg

SEQ ID NO: 12263 - DNA, 20 bp, Artificial Sequence
  Synthetic oligonucleotide; TAG chr11 5257725 5257744 5257741 +
tattgcctgtggacaattat

SEQ ID NO: 12264 - DNA, 20 bp, Artificial Sequence
  Synthetic oligonucleotide; CAG chr11 5257760 5257779 5257776 +
ctattaaaaatcttgtcatg

SEQ ID NO: 12265 - DNA, 20 bp, Artificial Sequence
  Synthetic oligonucleotide; AAG chr11 5257808 5257827 5257824 +
ttatgaatttgctttcaatt

SEQ ID NO: 12266 - DNA, 20 bp, Artificial Sequence
  Synthetic oligonucleotide; TGG chr11 5257822 5257841 5257838 +
tcaattaagttatcttgaat

SEQ ID NO: 12267 - DNA, 20 bp, Artificial Sequence
  Synthetic oligonucleotide; TAG chr11 5257838 5257857 5257854 +
gaattggcaatatctaaatc

SEQ ID NO: 12268 - DNA, 20 bp, Artificial Sequence
  Synthetic oligonucleotide; TAG chr11 5257844 5257863 5257860 +
gcaatatctaaatctagata

SEQ ID NO: 12269 - DNA, 20 bp, Artificial Sequence
  Synthetic oligonucleotide; AAG chr11 5257853 5257872 5257869 +
aaatctagatatagctccct

SEQ ID NO: 12270 - DNA, 20 bp, Artificial Sequence
  Synthetic oligonucleotide; AGG chr11 5257854 5257873 5257870 +
aatctagatatagctcccta

SEQ ID NO: 12271 - DNA, 20 bp, Artificial Sequence
  Synthetic oligonucleotide; GGG chr11 5257855 5257874 5257871 +
atctagatatagctccctaa

SEQ ID NO: 12272 - DNA, 20 bp, Artificial Sequence
  Synthetic oligonucleotide; GGG chr11 5257856 5257875 5257872 +
tctagatatagctccctaag

SEQ ID NO: 12273 - DNA, 20 bp, Artificial Sequence
  Synthetic oligonucleotide; AAG chr11 5257861 5257880 5257877 +
atatagctccctaaggggta

SEQ ID NO: 12274 - DNA, 20 bp, Artificial Sequence
  Synthetic oligonucleotide; GAG chr11 5257863 5257882 5257879 +
atagctccctaaggggtaaa

SEQ ID NO: 12275 - DNA, 20 bp, Artificial Sequence
  Synthetic oligonucleotide; AAG chr11 5257916 5257935 5257932 +
tccttgattccttgatatca

SEQ ID NO: 12276 - DNA, 20 bp, Artificial Sequence
  Synthetic oligonucleotide; AGG chr11 5257917 5257936 5257933 +
ccttgattccttgatatcaa

SEQ ID NO: 12277 - DNA, 20 bp, Artificial Sequence
  Synthetic oligonucleotide; GGG chr11 5257918 5257937 5257934 +
cttgattccttgatatcaaa

SEQ ID NO: 12278 - DNA, 20 bp, Artificial Sequence
  Synthetic oligonucleotide; CAG chr11 5257921 5257940 5257937 +
gattccttgatatcaaaggg

SEQ ID NO: 12279 - DNA, 20 bp, Artificial Sequence
  Synthetic oligonucleotide; TAG chr11 5257926 5257945 5257942 +
cttgatatcaaagggcagta

SEQ ID NO: 12280 - DNA, 20 bp, Artificial Sequence
  Synthetic oligonucleotide; TGG chr11 5257932 5257951 5257948 +
atcaaagggcagtatagttt

SEQ ID NO: 12281 - DNA, 20 bp, Artificial Sequence
  Synthetic oligonucleotide; GGG chr11 5257933 5257952 5257949 +
tcaaagggcagtatagtttt

SEQ ID NO: 12282 - DNA, 20 bp, Artificial Sequence
  Synthetic oligonucleotide; GGG chr11 5257934 5257953 5257950 +
caaagggcagtatagttttg

SEQ ID NO: 12283 - DNA, 20 bp, Artificial Sequence
  Synthetic oligonucleotide; GGG chr11 5257935 5257954 5257951 +
aaagggcagtatagttttgg

SEQ ID NO: 12284 - DNA, 20 bp, Artificial Sequence
  Synthetic oligonucleotide; GAG chr11 5257937 5257956 5257953 +
agggcagtatagttttgggg

SEQ ID NO: 12285 - DNA, 20 bp, Artificial Sequence
  Synthetic oligonucleotide; AAG chr11 5257940 5257959 5257956 +
gcagtatagttttgggggag

SEQ ID NO: 12286 - DNA, 20 bp, Artificial Sequence
  Synthetic oligonucleotide; AAG chr11 5257946 5257965 5257962 +
tagttttgggggagaagaaa

SEQ ID NO: 12287 - DNA, 20 bp, Artificial Sequence
  Synthetic oligonucleotide; GAG chr11 5257948 5257967 5257964 +
gttttgggggagaagaaaaa

SEQ ID NO: 12288 - DNA, 20 bp, Artificial Sequence
  Synthetic oligonucleotide; GAG chr11 5257950 5257969 5257966 +
tttgggggagaagaaaaaga

SEQ ID NO: 12289 - DNA, 20 bp, Artificial Sequence
  Synthetic oligonucleotide; GAG chr11 5257952 5257971 5257968 +
tgggggagaagaaaaagaga

SEQ ID NO: 12290 - DNA, 20 bp, Artificial Sequence
  Synthetic oligonucleotide; GAG chr11 5257954 5257973 5257970 +
ggggagaagaaaaagagaga

SEQ ID NO: 12291 - DNA, 20 bp, Artificial Sequence
  Synthetic oligonucleotide; GAG chr11 5257956 5257975 5257972 +
ggagaagaaaaagagagaga

SEQ ID NO: 12292 - DNA, 20 bp, Artificial Sequence
  Synthetic oligonucleotide; AAG chr11 5257964 5257983 5257980 +
aaaagagagagagagaaaaa

SEQ ID NO: 12293 - DNA, 20 bp, Artificial Sequence
  Synthetic oligonucleotide; TAG chr11 5257997 5258016 5258013 +
aatgcatattaccgacaaat

SEQ ID NO: 12294 - DNA, 20 bp, Artificial Sequence
  Synthetic oligonucleotide; GAG chr11 5257999 5258018 5258015 +
tgcatattaccgacaaatta

SEQ ID NO: 12295 - DNA, 20 bp, Artificial Sequence
  Synthetic oligonucleotide; AGG chr11 5258000 5258019 5258016 +
gcatattaccgacaaattag

SEQ ID NO: 12296 - DNA, 20 bp, Artificial Sequence
  Synthetic oligonucleotide; GGG chr11 5258001 5258020 5258017 +
catattaccgacaaattaga

SEQ ID NO: 12297 - DNA, 20 bp, Artificial Sequence
  Synthetic oligonucleotide; TGG chr11 5258007 5258026 5258023 +
accgacaaattagagggtga

SEQ ID NO: 12298 - DNA, 20 bp, Artificial Sequence
  Synthetic oligonucleotide; CAG chr11 5258010 5258029 5258026 +
gacaaattagagggtgatgg

SEQ ID NO: 12299 - DNA, 20 bp, Artificial Sequence
  Synthetic oligonucleotide; TGG chr11 5258014 5258033 5258030 +
aattagagggtgatggcaga

SEQ ID NO: 12300 - DNA, 20 bp, Artificial Sequence
  Synthetic oligonucleotide; GGG chr11 5258015 5258034 5258031 +
attagagggtgatggcagat

SEQ ID NO: 12301 - DNA, 20 bp, Artificial Sequence
  Synthetic oligonucleotide; GAG chr11 5258017 5258036 5258033 +
tagagggtgatggcagatgg

SEQ ID NO: 12302 - DNA, 20 bp, Artificial Sequence
  Synthetic oligonucleotide; AGG chr11 5258018 5258037 5258034 +
agagggtgatggcagatggg

SEQ ID NO: 12303 - DNA, 20 bp, Artificial Sequence
  Synthetic oligonucleotide; CAG chr11 5258021 5258040 5258037 +
gggtgatggcagatgggagg

SEQ ID NO: 12304 - DNA, 20 bp, Artificial Sequence
  Synthetic oligonucleotide; CAG chr11 5258024 5258043 5258040 +
tgatggcagatgggaggcag

SEQ ID NO: 12305 - DNA, 20 bp, Artificial Sequence
  Synthetic oligonucleotide; AAG chr11 5258027 5258046 5258043 +
tggcagatgggaggcagcag

SEQ ID NO: 12306 - DNA, 20 bp, Artificial Sequence
  Synthetic oligonucleotide; CAG chr11 5258037 5258056 5258053 +
gaggcagcagaagtacattg

SEQ ID NO: 12307 - DNA, 20 bp, Artificial Sequence
  Synthetic oligonucleotide; CGG chr11 5258048 5258067 5258064 +
agtacattgcagctcccact

SEQ ID NO: 12308 - DNA, 20 bp, Artificial Sequence
  Synthetic oligonucleotide; CAG chr11 5258056 5258075 5258072 +
gcagctcccactcggatgca

SEQ ID NO: 12309 - DNA, 20 bp, Artificial Sequence
  Synthetic oligonucleotide; GAG chr11 5258058 5258077 5258074 +
agctcccactcggatgcaca

SEQ ID NO: 12310 - DNA, 20 bp, Artificial Sequence
  Synthetic oligonucleotide; CAG chr11 5258061 5258080 5258077 +
tcccactcggatgcacagag

SEQ ID NO: 12311 - DNA, 20 bp, Artificial Sequence
  Synthetic oligonucleotide; AAG chr11 5258070 5258089 5258086 +
gatgcacagagcagcatgtg

SEQ ID NO: 12312 - DNA, 20 bp, Artificial Sequence
  Synthetic oligonucleotide; CAG chr11 5258081 5258100 5258097 +
cagcatgtgaagtctcccat

SEQ ID NO: 12313 - DNA, 20 bp, Artificial Sequence
  Synthetic oligonucleotide; AGG chr11 5258082 5258101 5258098 +
agcatgtgaagtctcccatc

SEQ ID NO: 12314 - DNA, 20 bp, Artificial Sequence
  Synthetic oligonucleotide; CAG chr11 5258096 5258115 5258112 +
cccatcaggaattttttttg

SEQ ID NO: 12315 - DNA, 20 bp, Artificial Sequence
  Synthetic oligonucleotide; CAG chr11 5258108 5258127 5258124 +
tttttttgcagaaccacctg

SEQ ID NO: 12316 - DNA, 20 bp, Artificial Sequence
  Synthetic oligonucleotide; AAG chr11 5258120 5258139 5258136 +
accacctgcagaaataaatc

SEQ ID NO: 12317 - DNA, 20 bp, Artificial Sequence
  Synthetic oligonucleotide; AAG chr11 5258124 5258143 5258140 +
cctgcagaaataaatcaaga

SEQ ID NO: 12318 - DNA, 20 bp, Artificial Sequence
  Synthetic oligonucleotide; GAG chr11 5258129 5258148 5258145 +
agaaataaatcaagaaagct

SEQ ID NO: 12319 - DNA, 20 bp, Artificial Sequence
  Synthetic oligonucleotide; GAG chr11 5258131 5258150 5258147 +
aaataaatcaagaaagctga

SEQ ID NO: 12320 - DNA, 20 bp, Artificial Sequence
  Synthetic oligonucleotide; AAG chr11 5258152 5258171 5258168 +
agaacgcacacaccctctga

SEQ ID NO: 12321 - DNA, 20 bp, Artificial Sequence
  Synthetic oligonucleotide; AAG chr11 5258155 5258174 5258171 +
acgcacacaccctctgaaag

SEQ ID NO: 12322 - DNA, 20 bp, Artificial Sequence
  Synthetic oligonucleotide; CAG chr11 5258158 5258177 5258174 +
cacacaccctctgaaagaag

SEQ ID NO: 12323 - DNA, 20 bp, Artificial Sequence
  Synthetic oligonucleotide; CAG chr11 5258171 5258190 5258187 +
aaagaagcagattgctcctg

SEQ ID NO: 12324 - DNA, 20 bp, Artificial Sequence
  Synthetic oligonucleotide; AGG chr11 5258172 5258191 5258188 +
aagaagcagattgctcctgc

SEQ ID NO: 12325 - DNA, 20 bp, Artificial Sequence
  Synthetic oligonucleotide; CGG chr11 5258178 5258197 5258194 +
cagattgctcctgcaggacc

SEQ ID NO: 12326 - DNA, 20 bp, Artificial Sequence
  Synthetic oligonucleotide; GGG chr11 5258179 5258198 5258195 +
agattgctcctgcaggaccc

SEQ ID NO: 12327 - DNA, 20 bp, Artificial Sequence
  Synthetic oligonucleotide; GAG chr11 5258200 5258219 5258216 +
ggaaacaccccaaatattgt

SEQ ID NO: 12328 - DNA, 20 bp, Artificial Sequence
  Synthetic oligonucleotide; TGG chr11 5258214 5258233 5258230 +
tattgtgagtgcccaaactg

SEQ ID NO: 12329 - DNA, 20 bp, Artificial Sequence
  Synthetic oligonucleotide; AAG chr11 5258217 5258236 5258233 +
tgtgagtgcccaaactgtgg

SEQ ID NO: 12330 - DNA, 20 bp, Artificial Sequence
  Synthetic oligonucleotide; TGG chr11 5258220 5258239 5258236 +
gagtgcccaaactgtggaag

SEQ ID NO: 12331 - DNA, 20 bp, Artificial Sequence
  Synthetic oligonucleotide; AAG chr11 5258225 5258244 5258241 +
cccaaactgtggaagtggaa

SEQ ID NO: 12332 - DNA, 20 bp, Artificial Sequence
  Synthetic oligonucleotide; AGG chr11 5258226 5258245 5258242 +
ccaaactgtggaagtggaaa

SEQ ID NO: 12333 - DNA, 20 bp, Artificial Sequence
  Synthetic oligonucleotide; GGG chr11 5258227 5258246 5258243 +
caaactgtggaagtggaaaa

SEQ ID NO: 12334 - DNA, 20 bp, Artificial Sequence
  Synthetic oligonucleotide; GGG chr11 5258228 5258247 5258244 +
aaactgtggaagtggaaaag

SEQ ID NO: 12335 - DNA, 20 bp, Artificial Sequence
  Synthetic oligonucleotide; GGG chr11 5258229 5258248 5258245 +
aactgtggaagtggaaaagg

SEQ ID NO: 12336 - DNA, 20 bp, Artificial Sequence
  Synthetic oligonucleotide; TGG chr11 5258261 5258280 5258277 +
ccccaaacacacatcctcac

SEQ ID NO: 12337 - DNA, 20 bp, Artificial Sequence
  Synthetic oligonucleotide; GGG chr11 5258262 5258281 5258278 +
cccaaacacacatcctcact

SEQ ID NO: 12338 - DNA, 20 bp, Artificial Sequence
  Synthetic oligonucleotide; GGG chr11 5258263 5258282 5258279 +
ccaaacacacatcctcactg

SEQ ID NO: 12339 - DNA, 20 bp, Artificial Sequence
  Synthetic oligonucleotide; AAG chr11 5258272 5258291 5258288 +
catcctcactggggaacctg

SEQ ID NO: 12340 - DNA, 20 bp, Artificial Sequence
  Synthetic oligonucleotide; TAG chr11 5258278 5258297 5258294 +
cactggggaacctgaagatc

SEQ ID NO: 12341 - DNA, 20 bp, Artificial Sequence
  Synthetic oligonucleotide; CAG chr11 5258285 5258304 5258301 +
gaacctgaagatctagacca

SEQ ID NO: 12342 - DNA, 20 bp, Artificial Sequence
  Synthetic oligonucleotide; AGG chr11 5258286 5258305 5258302 +
aacctgaagatctagaccac

SEQ ID NO: 12343 - DNA, 20 bp, Artificial Sequence
  Synthetic oligonucleotide; GAG chr11 5258288 5258307 5258304 +
cctgaagatctagaccacag

SEQ ID NO: 12344 - DNA, 20 bp, Artificial Sequence
  Synthetic oligonucleotide; AAG chr11 5258291 5258310 5258307 +
gaagatctagaccacaggag

SEQ ID NO: 12345 - DNA, 20 bp, Artificial Sequence
  Synthetic oligonucleotide; TGG chr11 5258308 5258327 5258324 +
gagaagattctgaccttacc

SEQ ID NO: 12346 - DNA, 20 bp, Artificial Sequence
  Synthetic oligonucleotide; GAG chr11 5258310 5258329 5258326 +
gaagattctgaccttacctg

SEQ ID NO: 12347 - DNA, 20 bp, Artificial Sequence
  Synthetic oligonucleotide; GAG chr11 5258315 5258334 5258331 +
ttctgaccttacctggagct

SEQ ID NO: 12348 - DNA, 20 bp, Artificial Sequence
  Synthetic oligonucleotide; TAG chr11 5258324 5258343 5258340 +
tacctggagctgagtcaatt

SEQ ID NO: 12349 - DNA, 20 bp, Artificial Sequence
  Synthetic oligonucleotide; GAG chr11 5258326 5258345 5258342 +
cctggagctgagtcaattta

SEQ ID NO: 12350 - DNA, 20 bp, Artificial Sequence
  Synthetic oligonucleotide; AGG chr11 5258327 5258346 5258343 +
ctggagctgagtcaatttag

SEQ ID NO: 12351 - DNA, 20 bp, Artificial Sequence
  Synthetic oligonucleotide; GGG chr11 5258328 5258347 5258344 +
tggagctgagtcaatttaga

SEQ ID NO: 12352 - DNA, 20 bp, Artificial Sequence
  Synthetic oligonucleotide; AAG chr11 5258333 5258352 5258349 +
ctgagtcaatttagagggcc

SEQ ID NO: 12353 - DNA, 20 bp, Artificial Sequence
  Synthetic oligonucleotide; CAG chr11 5258343 5258362 5258359 +
ttagagggccaagcaaaata

SEQ ID NO: 12354 - DNA, 20 bp, Artificial Sequence
  Synthetic oligonucleotide; AGG chr11 5258344 5258363 5258360 +
tagagggccaagcaaaatac

SEQ ID NO: 12355 - DNA, 20 bp, Artificial Sequence
  Synthetic oligonucleotide; GGG chr11 5258345 5258364 5258361 +
agagggccaagcaaaataca

SEQ ID NO: 12356 - DNA, 20 bp, Artificial Sequence
  Synthetic oligonucleotide; GGG chr11 5258346 5258365 5258362 +
gagggccaagcaaaatacag

SEQ ID NO: 12357 - DNA, 20 bp, Artificial Sequence
  Synthetic oligonucleotide; TAG chr11 5258349 5258368 5258365 +
ggccaagcaaaatacagggg

SEQ ID NO: 12358 - DNA, 20 bp, Artificial Sequence
  Synthetic oligonucleotide; GAG chr11 5258351 5258370 5258367 +
ccaagcaaaatacaggggta

SEQ ID NO: 12359 - DNA, 20 bp, Artificial Sequence
  Synthetic oligonucleotide; AGG chr11 5258352 5258371 5258368 +
caagcaaaatacaggggtag

SEQ ID NO: 12360 - DNA, 20 bp, Artificial Sequence
  Synthetic oligonucleotide; AAG chr11 5258355 5258374 5258371 +
gcaaaatacaggggtagagg

SEQ ID NO: 12361 - DNA, 20 bp, Artificial Sequence
  Synthetic oligonucleotide; CAG chr11 5258358 5258377 5258374 +
aaatacaggggtagaggaag

SEQ ID NO: 12362 - DNA, 20 bp, Artificial Sequence
  Synthetic oligonucleotide; CGG chr11 5258361 5258380 5258377 +
tacaggggtagaggaagcag

SEQ ID NO: 12363 - DNA, 20 bp, Artificial Sequence
  Synthetic oligonucleotide; GGG chr11 5258362 5258381 5258378 +
acaggggtagaggaagcagc

SEQ ID NO: 12364 - DNA, 20 bp, Artificial Sequence
  Synthetic oligonucleotide; AAG chr11 5258367 5258386 5258383 +
ggtagaggaagcagcgggaa

SEQ ID NO: 12365 - DNA, 20 bp, Artificial Sequence
  Synthetic oligonucleotide; TGG chr11 5258375 5258394 5258391 +
aagcagcgggaaaagccctg

SEQ ID NO: 12366 - DNA, 20 bp, Artificial Sequence
  Synthetic oligonucleotide; GGG chr11 5258376 5258395 5258392 +
agcagcgggaaaagccctgt

SEQ ID NO: 12367 - DNA, 20 bp, Artificial Sequence
  Synthetic oligonucleotide; TGG chr11 5258384 5258403 5258400 +
gaaaagccctgtgggctctc

SEQ ID NO: 12368 - DNA, 20 bp, Artificial Sequence
  Synthetic oligonucleotide; GGG chr11 5258385 5258404 5258401 +
aaaagccctgtgggctctct

SEQ ID NO: 12369 - DNA, 20 bp, Artificial Sequence
  Synthetic oligonucleotide; TAG chr11 5258393 5258412 5258409 +
tgtgggctctctgggtcccc

SEQ ID NO: 12370 - DNA, 20 bp, Artificial Sequence
  Synthetic oligonucleotide; AGG chr11 5258394 5258413 5258410 +
gtgggctctctgggtcccct

SEQ ID NO: 12371 - DNA, 20 bp, Artificial Sequence
  Synthetic oligonucleotide; AAG chr11 5258397 5258416 5258413 +
ggctctctgggtcccctagg

SEQ ID NO: 12372 - DNA, 20 bp, Artificial Sequence
  Synthetic oligonucleotide; CAG chr11 5258419 5258438 5258435 +
gccatttctgccttgcctca

SEQ ID NO: 12373 - DNA, 20 bp, Artificial Sequence
  Synthetic oligonucleotide; AGG chr11 5258420 5258439 5258436 +
ccatttctgccttgcctcac

SEQ ID NO: 12374 - DNA, 20 bp, Artificial Sequence
  Synthetic oligonucleotide; GGG chr11 5258421 5258440 5258437 +
catttctgccttgcctcaca

SEQ ID NO: 12375 - DNA, 20 bp, Artificial Sequence
  Synthetic oligonucleotide; GGG chr11 5258422 5258441 5258438 +
atttctgccttgcctcacag

SEQ ID NO: 12376 - DNA, 20 bp, Artificial Sequence
  Synthetic oligonucleotide; TGG chr11 5258430 5258449 5258446 +
cttgcctcacaggggtcatt

SEQ ID NO: 12377 - DNA, 20 bp, Artificial Sequence
  Synthetic oligonucleotide; GGG chr11 5258431 5258450 5258447 +
ttgcctcacaggggtcattt

SEQ ID NO: 12378 - DNA, 20 bp, Artificial Sequence
  Synthetic oligonucleotide; GAG chr11 5258433 5258452 5258449 +
gcctcacaggggtcatttgg

SEQ ID NO: 12379 - DNA, 20 bp, Artificial Sequence
  Synthetic oligonucleotide; AGG chr11 5258434 5258453 5258450 +
cctcacaggggtcatttggg

SEQ ID NO: 12380 - DNA, 20 bp, Artificial Sequence
  Synthetic oligonucleotide; GGG chr11 5258435 5258454 5258451 +
ctcacaggggtcatttggga

SEQ ID NO: 12381 - DNA, 20 bp, Artificial Sequence
  Synthetic oligonucleotide; CAG chr11 5258442 5258461 5258458 +
gggtcatttgggagggctgc

SEQ ID NO: 12382 - DNA, 20 bp, Artificial Sequence
  Synthetic oligonucleotide; GAG chr11 5258444 5258463 5258460 +
gtcatttgggagggctgcca

SEQ ID NO: 12383 - DNA, 20 bp, Artificial Sequence
  Synthetic oligonucleotide; AGG chr11 5258445 5258464 5258461 +
tcatttgggagggctgccag

SEQ ID NO: 12384 - DNA, 20 bp, Artificial Sequence
  Synthetic oligonucleotide; TGG chr11 5258451 5258470 5258467 +
gggagggctgccagaggaac

SEQ ID NO: 12385 - DNA, 20 bp, Artificial Sequence
  Synthetic oligonucleotide; GGG chr11 5258452 5258471 5258468 +
ggagggctgccagaggaact

SEQ ID NO: 12386 - DNA, 20 bp, Artificial Sequence
  Synthetic oligonucleotide; AAG chr11 5258457 5258476 5258473 +
gctgccagaggaactgggaa

SEQ ID NO: 12387 - DNA, 20 bp, Artificial Sequence
  Synthetic oligonucleotide; CAG chr11 5258464 5258483 5258480 +
gaggaactgggaaaagatga

SEQ ID NO: 12388 - DNA, 20 bp, Artificial Sequence
  Synthetic oligonucleotide; AGG chr11 5258465 5258484 5258481 +
aggaactgggaaaagatgac

SEQ ID NO: 12389 - DNA, 20 bp, Artificial Sequence
  Synthetic oligonucleotide; AAG chr11 5258471 5258490 5258487 +
tgggaaaagatgacaggaaa

SEQ ID NO: 12390 - DNA, 20 bp, Artificial Sequence
  Synthetic oligonucleotide; TGG chr11 5258486 5258505 5258502 +
ggaaaaagaaaatctccacc

SEQ ID NO: 12391 - DNA, 20 bp, Artificial Sequence
  Synthetic oligonucleotide; CAG chr11 5258490 5258509 5258506 +
aaagaaaatctccacctggc

SEQ ID NO: 12392 - DNA, 20 bp, Artificial Sequence
  Synthetic oligonucleotide; TAG chr11 5258496 5258515 5258512 +
aatctccacctggccagatc

SEQ ID NO: 12393 - DNA, 20 bp, Artificial Sequence
  Synthetic oligonucleotide; AGG chr11 5258497 5258516 5258513 +
atctccacctggccagatct

SEQ ID NO: 12394 - DNA, 20 bp, Artificial Sequence
  Synthetic oligonucleotide; GGG chr11 5258498 5258517 5258514 +
tctccacctggccagatcta

SEQ ID NO: 12395 - DNA, 20 bp, Artificial Sequence
  Synthetic oligonucleotide; GGG chr11 5258499 5258518 5258515 +
ctccacctggccagatctag

SEQ ID NO: 12396 - DNA, 20 bp, Artificial Sequence
  Synthetic oligonucleotide; TGG chr11 5258503 5258522 5258519 +
acctggccagatctaggggc

SEQ ID NO: 12397 - DNA, 20 bp, Artificial Sequence
  Synthetic oligonucleotide; GGG chr11 5258504 5258523 5258520 +
cctggccagatctaggggct

SEQ ID NO: 12398 - DNA, 20 bp, Artificial Sequence
  Synthetic oligonucleotide; CAG chr11 5258507 5258526 5258523 +
ggccagatctaggggctggg

SEQ ID NO: 12399 - DNA, 20 bp, Artificial Sequence
  Synthetic oligonucleotide; TGG chr11 5258510 5258529 5258526 +
cagatctaggggctgggcag

SEQ ID NO: 12400 - DNA, 20 bp, Artificial Sequence
  Synthetic oligonucleotide; GGG chr11 5258511 5258530 5258527 +
agatctaggggctgggcagt

SEQ ID NO: 12401 - DNA, 20 bp, Artificial Sequence
  Synthetic oligonucleotide; GGG chr11 5258512 5258531 5258528 +
gatctaggggctgggcagtg

SEQ ID NO: 12402 - DNA, 20 bp, Artificial Sequence
  Synthetic oligonucleotide; GGG chr11 5258513 5258532 5258529 +
atctaggggctgggcagtgg

SEQ ID NO: 12403 - DNA, 20 bp, Artificial Sequence
  Synthetic oligonucleotide; GGG chr11 5258514 5258533 5258530 +
tctaggggctgggcagtggg

SEQ ID NO: 12404 - DNA, 20 bp, Artificial Sequence
  Synthetic oligonucleotide; GGG chr11 5258515 5258534 5258531 +
ctaggggctgggcagtgggg

SEQ ID NO: 12405 - DNA, 20 bp, Artificial Sequence
  Synthetic oligonucleotide; TGG chr11 5258519 5258538 5258535 +
gggctgggcagtgggggggt

SEQ ID NO: 12406 - DNA, 20 bp, Artificial Sequence
  Synthetic oligonucleotide; TGG chr11 5258522 5258541 5258538 +
ctgggcagtgggggggttgg

SEQ ID NO: 12407 - DNA, 20 bp, Artificial Sequence
  Synthetic oligonucleotide; GGG chr11 5258523 5258542 5258539 +
tgggcagtgggggggttggt

SEQ ID NO: 12408 - DNA, 20 bp, Artificial Sequence
  Synthetic oligonucleotide; GGG chr11 5258524 5258543 5258540 +
gggcagtgggggggttggtg

SEQ ID NO: 12409 - DNA, 20 bp, Artificial Sequence
  Synthetic oligonucleotide; GGG chr11 5258525 5258544 5258541 +
ggcagtgggggggttggtgg

SEQ ID NO: 12410 - DNA, 20 bp, Artificial Sequence
  Synthetic oligonucleotide; GGG chr11 5258526 5258545 5258542 +
gcagtgggggggttggtggg

SEQ ID NO: 12411 - DNA, 20 bp, Artificial Sequence
  Synthetic oligonucleotide; TGG chr11 5258538 5258557 5258554 +
ttggtggggggacatgaatt

SEQ ID NO: 12412 - DNA, 20 bp, Artificial Sequence
  Synthetic oligonucleotide; CAG chr11 5258545 5258564 5258561 +
ggggacatgaatttggtgtg

SEQ ID NO: 12413 - DNA, 20 bp, Artificial Sequence
  Synthetic oligonucleotide; TGG chr11 5258555 5258574 5258571 +
atttggtgtgcagactccac

SEQ ID NO: 12414 - DNA, 20 bp, Artificial Sequence
  Synthetic oligonucleotide; CAG chr11 5258558 5258577 5258574 +
tggtgtgcagactccactgg

SEQ ID NO: 12415 - DNA, 20 bp, Artificial Sequence
  Synthetic oligonucleotide; AGG chr11 5258559 5258578 5258575 +
ggtgtgcagactccactggc

SEQ ID NO: 12416 - DNA, 20 bp, Artificial Sequence
  Synthetic oligonucleotide; GGG chr11 5258560 5258579 5258576 +
gtgtgcagactccactggca

SEQ ID NO: 12417 - DNA, 20 bp, Artificial Sequence
  Synthetic oligonucleotide; AAG chr11 5258563 5258582 5258579 +
tgcagactccactggcaggg

SEQ ID NO: 12418 - DNA, 20 bp, Artificial Sequence
  Synthetic oligonucleotide; TAG chr11 5258566 5258585 5258582 +
agactccactggcagggaag

SEQ ID NO: 12419 - DNA, 20 bp, Artificial Sequence
  Synthetic oligonucleotide; AGG chr11 5258567 5258586 5258583 +
gactccactggcagggaagt

SEQ ID NO: 12420 - DNA, 20 bp, Artificial Sequence
  Synthetic oligonucleotide; CAG chr11 5258571 5258590 5258587 +
ccactggcagggaagtagga

SEQ ID NO: 12421 - DNA, 20 bp, Artificial Sequence
  Synthetic oligonucleotide; TGG chr11 5258581 5258600 5258597 +
ggaagtaggacagccctact

SEQ ID NO: 12422 - DNA, 20 bp, Artificial Sequence
  Synthetic oligonucleotide; CAG chr11 5258589 5258608 5258605 +
gacagccctacttggtttcg

SEQ ID NO: 12423 - DNA, 20 bp, Artificial Sequence
  Synthetic oligonucleotide; TGG chr11 5258593 5258612 5258609 +
gccctacttggtttcgcagc

SEQ ID NO: 12424 - DNA, 20 bp, Artificial Sequence
  Synthetic oligonucleotide; TAG chr11 5258596 5258615 5258612 +
ctacttggtttcgcagctgg

SEQ ID NO: 12425 - DNA, 20 bp, Artificial Sequence
  Synthetic oligonucleotide; TGG chr11 5258601 5258620 5258617 +
tggtttcgcagctggtagcc

SEQ ID NO: 12426 - DNA, 20 bp, Artificial Sequence
  Synthetic oligonucleotide; GGG chr11 5258602 5258621 5258618 +
ggtttcgcagctggtagcct

SEQ ID NO: 12427 - DNA, 20 bp, Artificial Sequence
  Synthetic oligonucleotide; GGG chr11 5258603 5258622 5258619 +
gtttcgcagctggtagcctg

SEQ ID NO: 12428 - DNA, 20 bp, Artificial Sequence
  Synthetic oligonucleotide; AAG chr11 5258607 5258626 5258623 +
cgcagctggtagcctggggc

SEQ ID NO: 12429 - DNA, 20 bp, Artificial Sequence
  Synthetic oligonucleotide; CAG chr11 5258614 5258633 5258630 +
ggtagcctggggcaagttct

SEQ ID NO: 12430 - DNA, 20 bp, Artificial Sequence
  Synthetic oligonucleotide; TGG chr11 5258635 5258654 5258651 +
agccttgctcactgactgca

SEQ ID NO: 12431 - DNA, 20 bp, Artificial Sequence
  Synthetic oligonucleotide; CAG chr11 5258641 5258660 5258657 +
gctcactgactgcatggaaa

SEQ ID NO: 12432 - DNA, 20 bp, Artificial Sequence
  Synthetic oligonucleotide; CGG chr11 5258647 5258666 5258663 +
tgactgcatggaaacagatt

SEQ ID NO: 12433 - DNA, 20 bp, Artificial Sequence
  Synthetic oligonucleotide; CGG chr11 5258658 5258677 5258674 +
aaacagattcggtgctgttg

SEQ ID NO: 12434 - DNA, 20 bp, Artificial Sequence
  Synthetic oligonucleotide; GGG chr11 5258659 5258678 5258675 +
aacagattcggtgctgttgc

SEQ ID NO: 12435 - DNA, 20 bp, Artificial Sequence
  Synthetic oligonucleotide; GGG chr11 5258660 5258679 5258676 +
acagattcggtgctgttgcg

SEQ ID NO: 12436 - DNA, 20 bp, Artificial Sequence
  Synthetic oligonucleotide; GGG chr11 5258661 5258680 5258677 +
cagattcggtgctgttgcgg

SEQ ID NO: 12437 - DNA, 20 bp, Artificial Sequence
  Synthetic oligonucleotide; GAG chr11 5258663 5258682 5258679 +
gattcggtgctgttgcgggg

SEQ ID NO: 12438 - DNA, 20 bp, Artificial Sequence
  Synthetic oligonucleotide; AGG chr11 5258664 5258683 5258680 +
attcggtgctgttgcggggg

SEQ ID NO: 12439 - DNA, 20 bp, Artificial Sequence
  Synthetic oligonucleotide; GGG chr11 5258665 5258684 5258681 +
ttcggtgctgttgcggggga

SEQ ID NO: 12440 - DNA, 20 bp, Artificial Sequence
  Synthetic oligonucleotide; TGG chr11 5258675 5258694 5258691 +
ttgcgggggagggtgcacgc

SEQ ID NO: 12441 - DNA, 20 bp, Artificial Sequence
  Synthetic oligonucleotide; AAG chr11 5258678 5258697 5258694 +
cgggggagggtgcacgctgg

SEQ ID NO: 12442 - DNA, 20 bp, Artificial Sequence
  Synthetic oligonucleotide; GAG chr11 5258682 5258701 5258698 +
ggagggtgcacgctggaagt

SEQ ID NO: 12443 - DNA, 20 bp, Artificial Sequence
  Synthetic oligonucleotide; GAG chr11 5258696 5258715 5258712 +
ggaagtgagaccaacctttt

SEQ ID NO: 12444 - DNA, 20 bp, Artificial Sequence
  Synthetic oligonucleotide; TGG chr11 5258704 5258723 5258720 +
gaccaaccttttgagttgca

SEQ ID NO: 12445 - DNA, 20 bp, Artificial Sequence
  Synthetic oligonucleotide; GGG chr11 5258705 5258724 5258721 +
accaaccttttgagttgcat

SEQ ID NO: 12446 - DNA, 20 bp, Artificial Sequence
  Synthetic oligonucleotide; GAG chr11 5258707 5258726 5258723 +
caaccttttgagttgcatgg

SEQ ID NO: 12447 - DNA, 20 bp, Artificial Sequence
  Synthetic oligonucleotide; TGG chr11 5258711 5258730 5258727 +
cttttgagttgcatgggagc

SEQ ID NO: 12448 - DNA, 20 bp, Artificial Sequence
  Synthetic oligonucleotide; GGG chr11 5258712 5258731 5258728 +
ttttgagttgcatgggagct

SEQ ID NO: 12449 - DNA, 20 bp, Artificial Sequence
  Synthetic oligonucleotide; AAG chr11 5258716 5258735 5258732 +
gagttgcatgggagctgggc

SEQ ID NO: 12450 - DNA, 20 bp, Artificial Sequence
  Synthetic oligonucleotide; CAG chr11 5258767 5258786 5258783 +
tcctgatgacctgcatgaca

SEQ ID NO: 12451 - DNA, 20 bp, Artificial Sequence
  Synthetic oligonucleotide; CAG chr11 5258770 5258789 5258786 +
tgatgacctgcatgacacag

SEQ ID NO: 12452 - DNA, 20 bp, Artificial Sequence
  Synthetic oligonucleotide; GAG chr11 5258772 5258791 5258788 +
atgacctgcatgacacagca

SEQ ID NO: 12453 - DNA, 20 bp, Artificial Sequence
  Synthetic oligonucleotide; AGG chr11 5258773 5258792 5258789 +
tgacctgcatgacacagcag

SEQ ID NO: 12454 - DNA, 20 bp, Artificial Sequence
  Synthetic oligonucleotide; CAG chr11 5258776 5258795 5258792 +
cctgcatgacacagcagagg

SEQ ID NO: 12455 - DNA, 20 bp, Artificial Sequence
  Synthetic oligonucleotide; TAG chr11 5258791 5258810 5258807 +
agaggcagccataattgtcc

SEQ ID NO: 12456 - DNA, 20 bp, Artificial Sequence
  Synthetic oligonucleotide; AGG chr11 5258792 5258811 5258808 +
gaggcagccataattgtcct

SEQ ID NO: 12457 - DNA, 20 bp, Artificial Sequence
  Synthetic oligonucleotide; TGG chr11 5258813 5258832 5258829 +
ggaacataaatccattgacc

SEQ ID NO: 12458 - DNA, 20 bp, Artificial Sequence
  Synthetic oligonucleotide; CAG chr11 5258838 5258857 5258854 +
actacacccccatcctccca

SEQ ID NO: 12459 - DNA, 20 bp, Artificial Sequence
  Synthetic oligonucleotide; TAG chr11 5258841 5258860 5258857 +
acacccccatcctcccacag

SEQ ID NO: 12460 - DNA, 20 bp, Artificial Sequence
  Synthetic oligonucleotide; CAG chr11 5258847 5258866 5258863 +
ccatcctcccacagtagcca

SEQ ID NO: 12461 - DNA, 20 bp, Artificial Sequence
  Synthetic oligonucleotide; AAG chr11 5258851 5258870 5258867 +
cctcccacagtagccacaga

SEQ ID NO: 12462 - DNA, 20 bp, Artificial Sequence
  Synthetic oligonucleotide; AAG chr11 5258862 5258881 5258878 +
agccacagaaagacctgccc

SEQ ID NO: 12463 - DNA, 20 bp, Artificial Sequence
  Synthetic oligonucleotide; AGG chr11 5258863 5258882 5258879 +
gccacagaaagacctgccca

SEQ ID NO: 12464 - DNA, 20 bp, Artificial Sequence
  Synthetic oligonucleotide; GAG chr11 5258865 5258884 5258881 +
cacagaaagacctgcccaag

SEQ ID NO: 12465 - DNA, 20 bp, Artificial Sequence
  Synthetic oligonucleotide; GAG chr11 5258873 5258892 5258889 +
gacctgcccaaggagactct

SEQ ID NO: 12466 - DNA, 20 bp, Artificial Sequence
  Synthetic oligonucleotide; CAG chr11 5258878 5258897 5258894 +
gcccaaggagactctgagct

SEQ ID NO: 12467 - DNA, 20 bp, Artificial Sequence
  Synthetic oligonucleotide; TAG chr11 5258888 5258907 5258904 +
actctgagctcagacacgac

SEQ ID NO: 12468 - DNA, 20 bp, Artificial Sequence
  Synthetic oligonucleotide; TGG chr11 5258907 5258926 5258923 +
ctagtcctgcccccacctga

SEQ ID NO: 12469 - DNA, 20 bp, Artificial Sequence
  Synthetic oligonucleotide; TGG chr11 5258927 5258946 5258943 +
tggtccttccttactcaccc

SEQ ID NO: 12470 - DNA, 20 bp, Artificial Sequence
  Synthetic oligonucleotide; TAG chr11 5258930 5258949 5258946 +
tccttccttactcaccctgg

SEQ ID NO: 12471 - DNA, 20 bp, Artificial Sequence
  Synthetic oligonucleotide; AAG chr11 5258936 5258955 5258952 +
cttactcaccctggtagctg

SEQ ID NO: 12472 - DNA, 20 bp, Artificial Sequence
  Synthetic oligonucleotide; AAG chr11 5258942 5258961 5258958 +
caccctggtagctgaagaca

SEQ ID NO: 12473 - DNA, 20 bp, Artificial Sequence
  Synthetic oligonucleotide; AGG chr11 5258943 5258962 5258959 +
accctggtagctgaagacaa

SEQ ID NO: 12474 - DNA, 20 bp, Artificial Sequence
  Synthetic oligonucleotide; GGG chr11 5258944 5258963 5258960 +
ccctggtagctgaagacaaa

SEQ ID NO: 12475 - DNA, 20 bp, Artificial Sequence
  Synthetic oligonucleotide; TGG chr11 5258957 5258976 5258973 +
agacaaagggcatatattct

SEQ ID NO: 12476 - DNA, 20 bp, Artificial Sequence
  Synthetic oligonucleotide; GGG chr11 5258958 5258977 5258974 +
gacaaagggcatatattctt

SEQ ID NO: 12477 - DNA, 20 bp, Artificial Sequence
  Synthetic oligonucleotide; GAG chr11 5258960 5258979 5258976 +
caaagggcatatattcttgg

SEQ ID NO: 12478 - DNA, 20 bp, Artificial Sequence
  Synthetic oligonucleotide; TAG chr11 5258966 5258985 5258982 +
gcatatattcttgggagttc

SEQ ID NO: 12479 - DNA, 20 bp, Artificial Sequence
  Synthetic oligonucleotide; AGG chr11 5258967 5258986 5258983 +
catatattcttgggagttct

SEQ ID NO: 12480 - DNA, 20 bp, Artificial Sequence
  Synthetic oligonucleotide; GGG chr11 5258968 5258987 5258984 +
atatattcttgggagttcta

SEQ ID NO: 12481 - DNA, 20 bp, Artificial Sequence
  Synthetic oligonucleotide; CAG chr11 5258976 5258995 5258992 +
ttgggagttctagggtgccc

SEQ ID NO: 12482 - DNA, 20 bp, Artificial Sequence
  Synthetic oligonucleotide; CAG chr11 5258985 5259004 5259001 +
ctagggtgccccagcccccc

SEQ ID NO: 12483 - DNA, 20 bp, Artificial Sequence
  Synthetic oligonucleotide; TAG chr11 5259022 5259041 5259038 +
ctgcctctgctgatgctttc

SEQ ID NO: 12484 - DNA, 20 bp, Artificial Sequence
  Synthetic oligonucleotide; AAG chr11 5259026 5259045 5259042 +
ctctgctgatgctttctaga

SEQ ID NO: 12485 - DNA, 20 bp, Artificial Sequence
  Synthetic oligonucleotide; TGG chr11 5259039 5259058 5259055 +
ttctagaaagtgccacctcc

SEQ ID NO: 12486 - DNA, 20 bp, Artificial Sequence
  Synthetic oligonucleotide; CAG chr11 5259042 5259061 5259058 +
tagaaagtgccacctcctgg

SEQ ID NO: 12487 - DNA, 20 bp, Artificial Sequence
  Synthetic oligonucleotide; AGG chr11 5259043 5259062 5259059 +
agaaagtgccacctcctggc

SEQ ID NO: 12488 - DNA, 20 bp, Artificial Sequence
  Synthetic oligonucleotide; GAG chr11 5259045 5259064 5259061 +
aaagtgccacctcctggcag

SEQ ID NO: 12489 - DNA, 20 bp, Artificial Sequence
  Synthetic oligonucleotide; AGG chr11 5259046 5259065 5259062 +
aagtgccacctcctggcagg

SEQ ID NO: 12490 - DNA, 20 bp, Artificial Sequence
  Synthetic oligonucleotide; CAG chr11 5259054 5259073 5259070 +
cctcctggcaggaggccaac

SEQ ID NO: 12491 - DNA, 20 bp, Artificial Sequence
  Synthetic oligonucleotide; TAG chr11 5259065 5259084 5259081 +
gaggccaaccagcacaaaaa

SEQ ID NO: 12492 - DNA, 20 bp, Artificial Sequence
  Synthetic oligonucleotide; AAG chr11 5259084 5259103 5259100 +
atagtgcattgaacaaccaa

SEQ ID NO: 12493 - DNA, 20 bp, Artificial Sequence
  Synthetic oligonucleotide; AAG chr11 5259088 5259107 5259104 +
tgcattgaacaaccaaaagt

SEQ ID NO: 12494 - DNA, 20 bp, Artificial Sequence
  Synthetic oligonucleotide; AGG chr11 5259089 5259108 5259105 +
gcattgaacaaccaaaagta

SEQ ID NO: 12495 - DNA, 20 bp, Artificial Sequence
  Synthetic oligonucleotide; CAG chr11 5259099 5259118 5259115 +
accaaaagtaaggaccctca

SEQ ID NO: 12496 - DNA, 20 bp, Artificial Sequence
  Synthetic oligonucleotide; GAG chr11 5259101 5259120 5259117 +
caaaagtaaggaccctcaca

SEQ ID NO: 12497 - DNA, 20 bp, Artificial Sequence
  Synthetic oligonucleotide; TGG chr11 5259130 5259149 5259146 +
tcatcctctgccacctccat

SEQ ID NO: 12498 - DNA, 20 bp, Artificial Sequence
  Synthetic oligonucleotide; GAG chr11 5259132 5259151 5259148 +
atcctctgccacctccattg

SEQ ID NO: 12499 - DNA, 20 bp, Artificial Sequence
  Synthetic oligonucleotide; CAG chr11 5259135 5259154 5259151 +
ctctgccacctccattggag

SEQ ID NO: 12500 - DNA, 20 bp, Artificial Sequence
  Synthetic oligonucleotide; AGG chr11 5259136 5259155 5259152 +
tctgccacctccattggagc

SEQ ID NO: 12501 - DNA, 20 bp, Artificial Sequence
  Synthetic oligonucleotide; TGG chr11 5259139 5259158 5259155 +
gccacctccattggagcagg

SEQ ID NO: 12502 - DNA, 20 bp, Artificial Sequence
  Synthetic oligonucleotide; TGG chr11 5259151 5259170 5259167 +
ggagcaggtggttgtatcta

SEQ ID NO: 12503 - DNA, 20 bp, Artificial Sequence
  Synthetic oligonucleotide; GAG chr11 5259156 5259175 5259172 +
aggtggttgtatctatggct

SEQ ID NO: 12504 - DNA, 20 bp, Artificial Sequence
  Synthetic oligonucleotide; GAG chr11 5259158 5259177 5259174 +
gtggttgtatctatggctga

SEQ ID NO: 12505 - DNA, 20 bp, Artificial Sequence
  Synthetic oligonucleotide; CAG chr11 5259166 5259185 5259182 +
atctatggctgagagaccca

SEQ ID NO: 12506 - DNA, 20 bp, Artificial Sequence
  Synthetic oligonucleotide; TGG chr11 5259170 5259189 5259186 +
atggctgagagacccacaga

SEQ ID NO: 12507 - DNA, 20 bp, Artificial Sequence
  Synthetic oligonucleotide; AAG chr11 5259183 5259202 5259199 +
ccacagatggttcacgtcac

SEQ ID NO: 12508 - DNA, 20 bp, Artificial Sequence
  Synthetic oligonucleotide; CAG chr11 5259194 5259213 5259210 +
tcacgtcacaagactctgtg

SEQ ID NO: 12509 - DNA, 20 bp, Artificial Sequence
  Synthetic oligonucleotide; CAG chr11 5259205 5259224 5259221 +
gactctgtgcagacaaaccc

SEQ ID NO: 12510 - DNA, 20 bp, Artificial Sequence
  Synthetic oligonucleotide; CAG chr11 5259211 5259230 5259227 +
gtgcagacaaaccccagtac

SEQ ID NO: 12511 - DNA, 20 bp, Artificial Sequence
  Synthetic oligonucleotide; TGG chr11 5259216 5259235 5259232 +
gacaaaccccagtaccagcc

SEQ ID NO: 12512 - DNA, 20 bp, Artificial Sequence
  Synthetic oligonucleotide; GAG chr11 5259218 5259237 5259234 +
caaaccccagtaccagcctg

SEQ ID NO: 12513 - DNA, 20 bp, Artificial Sequence
  Synthetic oligonucleotide; TGG chr11 5259223 5259242 5259239 +
cccagtaccagcctggagtc

SEQ ID NO: 12514 - DNA, 20 bp, Artificial Sequence
  Synthetic oligonucleotide; TAG chr11 5259226 5259245 5259242 +
agtaccagcctggagtctgg

SEQ ID NO: 12515 - DNA, 20 bp, Artificial Sequence
  Synthetic oligonucleotide; TGG chr11 5259235 5259254 5259251 +
ctggagtctggtagacctga

SEQ ID NO: 12516 - DNA, 20 bp, Artificial Sequence
  Synthetic oligonucleotide; GGG chr11 5259236 5259255 5259252 +
tggagtctggtagacctgat

SEQ ID NO: 12517 - DNA, 20 bp, Artificial Sequence
  Synthetic oligonucleotide; TGG chr11 5259239 5259258 5259255 +
agtctggtagacctgatggg

SEQ ID NO: 12518 - DNA, 20 bp, Artificial Sequence
  Synthetic oligonucleotide; TAG chr11 5259243 5259262 5259259 +
tggtagacctgatgggtggc

SEQ ID NO: 12519 - DNA, 20 bp, Artificial Sequence
  Synthetic oligonucleotide; CAG chr11 5259249 5259268 5259265 +
acctgatgggtggctagatc

SEQ ID NO: 12520 - DNA, 20 bp, Artificial Sequence
  Synthetic oligonucleotide; AAG chr11 5259252 5259271 5259268 +
tgatgggtggctagatccag

SEQ ID NO: 12521 - DNA, 20 bp, Artificial Sequence
  Synthetic oligonucleotide; GAG chr11 5259254 5259273 5259270 +
atgggtggctagatccagaa

SEQ ID NO: 12522 - DNA, 20 bp, Artificial Sequence
  Synthetic oligonucleotide; GAG chr11 5259256 5259275 5259272 +
gggtggctagatccagaaga

SEQ ID NO: 12523 - DNA, 20 bp, Artificial Sequence
  Synthetic oligonucleotide; CAG chr11 5259272 5259291 5259288 +
aagagagataacaatcacta

SEQ ID NO: 12524 - DNA, 20 bp, Artificial Sequence
  Synthetic oligonucleotide; CGG chr11 5259277 5259296 5259293 +
agataacaatcactacagtt

SEQ ID NO: 12525 - DNA, 20 bp, Artificial Sequence
  Synthetic oligonucleotide; CAG chr11 5259284 5259303 5259300 +
aatcactacagttcggctct

SEQ ID NO: 12526 - DNA, 20 bp, Artificial Sequence
  Synthetic oligonucleotide; AGG chr11 5259285 5259304 5259301 +
atcactacagttcggctctc

SEQ ID NO: 12527 - DNA, 20 bp, Artificial Sequence
  Synthetic oligonucleotide; AAG chr11 5259288 5259307 5259304 +
actacagttcggctctcagg

SEQ ID NO: 12528 - DNA, 20 bp, Artificial Sequence
  Synthetic oligonucleotide; TAG chr11 5259300 5259319 5259316 +
ctctcaggaagccccacgcc

SEQ ID NO: 12529 - DNA, 20 bp, Artificial Sequence
  Synthetic oligonucleotide; AGG chr11 5259301 5259320 5259317 +
tctcaggaagccccacgcct

SEQ ID NO: 12530 - DNA, 20 bp, Artificial Sequence
  Synthetic oligonucleotide; AAG chr11 5259306 5259325 5259322 +
ggaagccccacgcctaggaa

SEQ ID NO: 12531 - DNA, 20 bp, Artificial Sequence
  Synthetic oligonucleotide; AGG chr11 5259307 5259326 5259323 +
gaagccccacgcctaggaaa

SEQ ID NO: 12532 - DNA, 20 bp, Artificial Sequence
  Synthetic oligonucleotide; GGG chr11 5259308 5259327 5259324 +
aagccccacgcctaggaaaa

SEQ ID NO: 12533 - DNA, 20 bp, Artificial Sequence
  Synthetic oligonucleotide; GGG chr11 5259309 5259328 5259325 +
agccccacgcctaggaaaag

SEQ ID NO: 12534 - DNA, 20 bp, Artificial Sequence
  Synthetic oligonucleotide; GGG chr11 5259310 5259329 5259326 +
gccccacgcctaggaaaagg

SEQ ID NO: 12535 - DNA, 20 bp, Artificial Sequence
  Synthetic oligonucleotide; AAG chr11 5259326 5259345 5259342 +
aagggggactgtgctacatc

SEQ ID NO: 12536 - DNA, 20 bp, Artificial Sequence
  Synthetic oligonucleotide; AGG chr11 5259327 5259346 5259343 +
agggggactgtgctacatca

SEQ ID NO: 12537 - DNA, 20 bp, Artificial Sequence
  Synthetic oligonucleotide; GGG chr11 5259328 5259347 5259344 +
gggggactgtgctacatcaa

SEQ ID NO: 12538 - DNA, 20 bp, Artificial Sequence
  Synthetic oligonucleotide; TGG chr11 5259340 5259359 5259356 +
tacatcaagggaacacctca

SEQ ID NO: 12539 - DNA, 20 bp, Artificial Sequence
  Synthetic oligonucleotide; GGG chr11 5259341 5259360 5259357 +
acatcaagggaacacctcat

SEQ ID NO: 12540 - DNA, 20 bp, Artificial Sequence
  Synthetic oligonucleotide; AAG chr11 5259348 5259367 5259364 +
gggaacacctcatgggacaa

SEQ ID NO: 12541 - DNA, 20 bp, Artificial Sequence
  Synthetic oligonucleotide; CAG chr11 5259354 5259373 5259370 +
acctcatgggacaaaagtct

SEQ ID NO: 12542 - DNA, 20 bp, Artificial Sequence
  Synthetic oligonucleotide; GAG chr11 5259361 5259380 5259377 +
gggacaaaagtctcagcctt

SEQ ID NO: 12543 - DNA, 20 bp, Artificial Sequence
  Synthetic oligonucleotide; AGG chr11 5259362 5259381 5259378 +
ggacaaaagtctcagccttg

SEQ ID NO: 12544 - DNA, 20 bp, Artificial Sequence
  Synthetic oligonucleotide; TAG chr11 5259367 5259386 5259383 +
aaagtctcagccttgaggcc

SEQ ID NO: 12545 - DNA, 20 bp, Artificial Sequence
  Synthetic oligonucleotide; CAG chr11 5259383 5259402 5259399 +
ggcctagactttccctctga

SEQ ID NO: 12546 - DNA, 20 bp, Artificial Sequence
  Synthetic oligonucleotide; GAG chr11 5259385 5259404 5259401 +
cctagactttccctctgaca

SEQ ID NO: 12547 - DNA, 20 bp, Artificial Sequence
  Synthetic oligonucleotide; AAG chr11 5259395 5259414 5259411 +
ccctctgacagagcctaccc

SEQ ID NO: 12548 - DNA, 20 bp, Artificial Sequence
  Synthetic oligonucleotide; GAG chr11 5259399 5259418 5259415 +
ctgacagagcctacccaagt

SEQ ID NO: 12549 - DNA, 20 bp, Artificial Sequence
  Synthetic oligonucleotide; AAG chr11 5259402 5259421 5259418 +
acagagcctacccaagtgag

SEQ ID NO: 12550 - DNA, 20 bp, Artificial Sequence
  Synthetic oligonucleotide; AGG chr11 5259403 5259422 5259419 +
cagagcctacccaagtgaga

SEQ ID NO: 12551 - DNA, 20 bp, Artificial Sequence
  Synthetic oligonucleotide; CAG chr11 5259409 5259428 5259425 +
ctacccaagtgagaaggaac

SEQ ID NO: 12552 - DNA, 20 bp, Artificial Sequence
  Synthetic oligonucleotide; TGG chr11 5259423 5259442 5259439 +
aggaaccagaaaactaactc

SEQ ID NO: 12553 - DNA, 20 bp, Artificial Sequence
  Synthetic oligonucleotide; AAG chr11 5259439 5259458 5259455 +
actctggtaatatgaaaaac

SEQ ID NO: 12554 - DNA, 20 bp, Artificial Sequence
  Synthetic oligonucleotide; AGG chr11 5259440 5259459 5259456 +
ctctggtaatatgaaaaaca

SEQ ID NO: 12555 - DNA, 20 bp, Artificial Sequence
  Synthetic oligonucleotide; TAG chr11 5259471 5259490 5259487 +
caccccccaaaaaatcatac

SEQ ID NO: 12556 - DNA, 20 bp, Artificial Sequence
  Synthetic oligonucleotide; CAG chr11 5259479 5259498 5259495 +
aaaaaatcatactagctcac

SEQ ID NO: 12557 - DNA, 20 bp, Artificial Sequence
  Synthetic oligonucleotide; AAG chr11 5259497 5259516 5259513 +
accagcaatgcatccaaacc

SEQ ID NO: 12558 - DNA, 20 bp, Artificial Sequence
  Synthetic oligonucleotide; AAG chr11 5259500 5259519 5259516 +
agcaatgcatccaaaccaag

SEQ ID NO: 12559 - DNA, 20 bp, Artificial Sequence
  Synthetic oligonucleotide; CAG chr11 5259531 5259550 5259547 +
gatttacctgaaaaataatt

SEQ ID NO: 12560 - DNA, 20 bp, Artificial Sequence
  Synthetic oligonucleotide; AAG chr11 5259534 5259553 5259550 +
ttacctgaaaaataattcag

SEQ ID NO: 12561 - DNA, 20 bp, Artificial Sequence
  Synthetic oligonucleotide; AGG chr11 5259535 5259554 5259551 +
tacctgaaaaataattcaga

SEQ ID NO: 12562 - DNA, 20 bp, Artificial Sequence
  Synthetic oligonucleotide; CAG chr11 5259539 5259558 5259555 +
tgaaaaataattcagaaggt

SEQ ID NO: 12563 - DNA, 20 bp, Artificial Sequence
  Synthetic oligonucleotide; AAG chr11 5259547 5259566 5259563 +
aattcagaaggtcagttatt

SEQ ID NO: 12564 - DNA, 20 bp, Artificial Sequence
  Synthetic oligonucleotide; AAG chr11 5259556 5259575 5259572 +
ggtcagttattaagctaatc

SEQ ID NO: 12565 - DNA, 20 bp, Artificial Sequence
  Synthetic oligonucleotide; AGG chr11 5259557 5259576 5259573 +
gtcagttattaagctaatca

SEQ ID NO: 12566 - DNA, 20 bp, Artificial Sequence
  Synthetic oligonucleotide; GAG chr11 5259559 5259578 5259575 +
cagttattaagctaatcaag

SEQ ID NO: 12567 - DNA, 20 bp, Artificial Sequence
  Synthetic oligonucleotide; AGG chr11 5259560 5259579 5259576 +
agttattaagctaatcaagg

SEQ ID NO: 12568 - DNA, 20 bp, Artificial Sequence
  Synthetic oligonucleotide; GAG chr11 5259568 5259587 5259584 +
agctaatcaaggaggcatcc

SEQ ID NO: 12569 - DNA, 20 bp, Artificial Sequence
  Synthetic oligonucleotide; AGG chr11 5259569 5259588 5259585 +
gctaatcaaggaggcatccg

SEQ ID NO: 12570 - DNA, 20 bp, Artificial Sequence
  Synthetic oligonucleotide; AAG chr11 5259572 5259591 5259588 +
aatcaaggaggcatccgagg

SEQ ID NO: 12571 - DNA, 20 bp, Artificial Sequence
  Synthetic oligonucleotide; AGG chr11 5259573 5259592 5259589 +
atcaaggaggcatccgagga

SEQ ID NO: 12572 - DNA, 20 bp, Artificial Sequence
  Synthetic oligonucleotide; AAG chr11 5259578 5259597 5259594 +
ggaggcatccgaggaaggtg

SEQ ID NO: 12573 - DNA, 20 bp, Artificial Sequence
  Synthetic oligonucleotide; AAG chr11 5259612 5259631 5259628 +
aaaaaccaaaaatatgatac

SEQ ID NO: 12574 - DNA, 20 bp, Artificial Sequence
  Synthetic oligonucleotide; GAG chr11 5259619 5259638 5259635 +
aaaaatatgatacaagaaat

SEQ ID NO: 12575 - DNA, 20 bp, Artificial Sequence
  Synthetic oligonucleotide; AGG chr11 5259620 5259639 5259636 +
aaaatatgatacaagaaatg

SEQ ID NO: 12576 - DNA, 20 bp, Artificial Sequence
  Synthetic oligonucleotide; GGG chr11 5259621 5259640 5259637 +
aaatatgatacaagaaatga

SEQ ID NO: 12577 - DNA, 20 bp, Artificial Sequence
  Synthetic oligonucleotide; GGG chr11 5259622 5259641 5259638 +
aatatgatacaagaaatgag

SEQ ID NO: 12578 - DNA, 20 bp, Artificial Sequence
  Synthetic oligonucleotide; GAG chr11 5259624 5259643 5259640 +
tatgatacaagaaatgaggg

SEQ ID NO: 12579 - DNA, 20 bp, Artificial Sequence
  Synthetic oligonucleotide; CAG chr11 5259634 5259653 5259650 +
gaaatgaggggagaaatctt

SEQ ID NO: 12580 - DNA, 20 bp, Artificial Sequence
  Synthetic oligonucleotide; AAG chr11 5259640 5259659 5259656 +
aggggagaaatcttcagtta

SEQ ID NO: 12581 - DNA, 20 bp, Artificial Sequence
  Synthetic oligonucleotide; GAG chr11 5259642 5259661 5259658 +
gggagaaatcttcagttaaa

SEQ ID NO: 12582 - DNA, 20 bp, Artificial Sequence
  Synthetic oligonucleotide; TAG chr11 5259646 5259665 5259662 +
gaaatcttcagttaaagaga

SEQ ID NO: 12583 - DNA, 20 bp, Artificial Sequence
  Synthetic oligonucleotide; CAG chr11 5259674 5259693 5259690 +
ataaaaaacattcaaaactt

SEQ ID NO: 12584 - DNA, 20 bp, Artificial Sequence
  Synthetic oligonucleotide; AGG chr11 5259675 5259694 5259691 +
taaaaaacattcaaaacttc

SEQ ID NO: 12585 - DNA, 20 bp, Artificial Sequence
  Synthetic oligonucleotide; TGG chr11 5259684 5259703 5259700 +
ttcaaaacttcaggaaacaa

SEQ ID NO: 12586 - DNA, 20 bp, Artificial Sequence
  Synthetic oligonucleotide; TGG chr11 5259692 5259711 5259708 +
ttcaggaaacaatggatgaa

SEQ ID NO: 12587 - DNA, 20 bp, Artificial Sequence
  Synthetic oligonucleotide; TAG chr11 5259704 5259723 5259720 +
tggatgaatggatgcactta

SEQ ID NO: 12588 - DNA, 20 bp, Artificial Sequence
  Synthetic oligonucleotide; TAG chr11 5259722 5259741 5259738 +
tatagaaatgcaaaatgctc

SEQ ID NO: 12589 - DNA, 20 bp, Artificial Sequence
  Synthetic oligonucleotide; AAG chr11 5259726 5259745 5259742 +
gaaatgcaaaatgctctaga

SEQ ID NO: 12590 - DNA, 20 bp, Artificial Sequence
  Synthetic oligonucleotide; CAG chr11 5259732 5259751 5259748 +
caaaatgctctagaaagtct

SEQ ID NO: 12591 - DNA, 20 bp, Artificial Sequence
  Synthetic oligonucleotide; TAG chr11 5259738 5259757 5259754 +
gctctagaaagtctcagcaa

SEQ ID NO: 12592 - DNA, 20 bp, Artificial Sequence
  Synthetic oligonucleotide; AAG chr11 5259746 5259765 5259762 +
aagtctcagcaatagaatcc

SEQ ID NO: 12593 - DNA, 20 bp, Artificial Sequence
  Synthetic oligonucleotide; CAG chr11 5259749 5259768 5259765 +
tctcagcaatagaatccaag

SEQ ID NO: 12594 - DNA, 20 bp, Artificial Sequence
  Synthetic oligonucleotide; AAG chr11 5259752 5259771 5259768 +
cagcaatagaatccaagcag

SEQ ID NO: 12595 - DNA, 20 bp, Artificial Sequence
  Synthetic oligonucleotide; CAG chr11 5259760 5259779 5259776 +
gaatccaagcagaagaaatt

SEQ ID NO: 12596 - DNA, 20 bp, Artificial Sequence
  Synthetic oligonucleotide; GAG chr11 5259762 5259781 5259778 +
atccaagcagaagaaattca

SEQ ID NO: 12597 - DNA, 20 bp, Artificial Sequence
  Synthetic oligonucleotide; AAG chr11 5259769 5259788 5259785 +
cagaagaaattcagagcttg

SEQ ID NO: 12598 - DNA, 20 bp, Artificial Sequence
  Synthetic oligonucleotide; AAG chr11 5259775 5259794 5259791 +
aaattcagagcttgaagaca

SEQ ID NO: 12599 - DNA, 20 bp, Artificial Sequence
  Synthetic oligonucleotide; AAG chr11 5259802 5259821 5259818 +
tgaattaacccaatccaaca

SEQ ID NO: 12600 - DNA, 20 bp, Artificial Sequence
  Synthetic oligonucleotide; AAG chr11 5259808 5259827 5259824 +
aacccaatccaacaaagaca

SEQ ID NO: 12601 - DNA, 20 bp, Artificial Sequence
  Synthetic oligonucleotide; AAG chr11 5259815 5259834 5259831 +
tccaacaaagacaaagaaaa

SEQ ID NO: 12602 - DNA, 20 bp, Artificial Sequence
  Synthetic oligonucleotide; AAG chr11 5259821 5259840 5259837 +
aaagacaaagaaaaaagaat

SEQ ID NO: 12603 - DNA, 20 bp, Artificial Sequence
  Synthetic oligonucleotide; AAG chr11 5259836 5259855 5259852 +
agaataagaaaatatgaaca

SEQ ID NO: 12604 - DNA, 20 bp, Artificial Sequence
  Synthetic oligonucleotide; AAG chr11 5259844 5259863 5259860 +
aaaatatgaacaaagcctcc

SEQ ID NO: 12605 - DNA, 20 bp, Artificial Sequence
  Synthetic oligonucleotide; TGG chr11 5259852 5259871 5259868 +
aacaaagcctccaagaaatc

SEQ ID NO: 12606 - DNA, 20 bp, Artificial Sequence
  Synthetic oligonucleotide; GGG chr11 5259853 5259872 5259869 +
acaaagcctccaagaaatct

SEQ ID NO: 12607 - DNA, 20 bp, Artificial Sequence
  Synthetic oligonucleotide; AAG chr11 5259878 5259897 5259894 +
tatgttaaacaatcaaacct

SEQ ID NO: 12608 - DNA, 20 bp, Artificial Sequence
  Synthetic oligonucleotide; CAG chr11 5259887 5259906 5259903 +
caatcaaacctaagaataat

SEQ ID NO: 12609 - DNA, 20 bp, Artificial Sequence
  Synthetic oligonucleotide; GAG chr11 5259897 5259916 5259913 +
taagaataatcagcattcct

SEQ ID NO: 12610 - DNA, 20 bp, Artificial Sequence
  Synthetic oligonucleotide; AAG chr11 5259901 5259920 5259917 +
aataatcagcattcctgaga

SEQ ID NO: 12611 - DNA, 20 bp, Artificial Sequence
  Synthetic oligonucleotide; AAG chr11 5259904 5259923 5259920 +
aatcagcattcctgagaaag

SEQ ID NO: 12612 - DNA, 20 bp, Artificial Sequence
  Synthetic oligonucleotide; GAG chr11 5259906 5259925 5259922 +
tcagcattcctgagaaagaa

SEQ ID NO: 12613 - DNA, 20 bp, Artificial Sequence
  Synthetic oligonucleotide; AAG chr11 5259917 5259936 5259933 +
gagaaagaagagaaatctaa

SEQ ID NO: 12614 - DNA, 20 bp, Artificial Sequence
  Synthetic oligonucleotide; TGG chr11 5259922 5259941 5259938 +
agaagagaaatctaaaagtt

SEQ ID NO: 12615 - DNA, 20 bp, Artificial Sequence
  Synthetic oligonucleotide; CAG chr11 5259935 5259954 5259951 +
aaaagtttggaaaacttatc

SEQ ID NO: 12616 - DNA, 20 bp, Artificial Sequence
  Synthetic oligonucleotide; AGG chr11 5259936 5259955 5259952 +
aaagtttggaaaacttatcc

SEQ ID NO: 12617 - DNA, 20 bp, Artificial Sequence
  Synthetic oligonucleotide; GGG chr11 5259937 5259956 5259953 +
aagtttggaaaacttatcca

SEQ ID NO: 12618 - DNA, 20 bp, Artificial Sequence
  Synthetic oligonucleotide; AAG chr11 5259948 5259967 5259964 +
acttatccagggaaataatc

SEQ ID NO: 12619 - DNA, 20 bp, Artificial Sequence
  Synthetic oligonucleotide; AGG chr11 5259949 5259968 5259965 +
cttatccagggaaataatca

SEQ ID NO: 12620 - DNA, 20 bp, Artificial Sequence
  Synthetic oligonucleotide; TAG chr11 5259971 5259990 5259987 +
gaaaacttcccccaccttgc

SEQ ID NO: 12621 - DNA, 20 bp, Artificial Sequence
  Synthetic oligonucleotide; GAG chr11 5259973 5259992 5259989 +
aaacttcccccaccttgcta

SEQ ID NO: 12622 - DNA, 20 bp, Artificial Sequence
  Synthetic oligonucleotide; TAG chr11 5259979 5259998 5259995 +
cccccaccttgctagagacc

SEQ ID NO: 12623 - DNA, 20 bp, Artificial Sequence
  Synthetic oligonucleotide; AAG chr11 5259994 5260013 5260010 +
agacctagatatccaaatac

SEQ ID NO: 12624 - DNA, 20 bp, Artificial Sequence
  Synthetic oligonucleotide; AAG chr11 5259997 5260016 5260013 +
cctagatatccaaatacaag

SEQ ID NO: 12625 - DNA, 20 bp, Artificial Sequence
  Synthetic oligonucleotide; TGG chr11 5260013 5260032 5260029 +
caagaagctcaataaacacc

SEQ ID NO: 12626 - DNA, 20 bp, Artificial Sequence
  Synthetic oligonucleotide; GGG chr11 5260014 5260033 5260030 +
aagaagctcaataaacacct

SEQ ID NO: 12627 - DNA, 20 bp, Artificial Sequence
  Synthetic oligonucleotide; TAG chr11 5260043 5260062 5260059 +
attgcaaaaatatcattgcc

SEQ ID NO: 12628 - DNA, 20 bp, Artificial Sequence
  Synthetic oligonucleotide; AGG chr11 5260044 5260063 5260060 +
ttgcaaaaatatcattgcct

SEQ ID NO: 12629 - DNA, 20 bp, Artificial Sequence
  Synthetic oligonucleotide; CAG chr11 5260058 5260077 5260074 +
ttgcctaggtacattgtcat

SEQ ID NO: 12630 - DNA, 20 bp, Artificial Sequence
  Synthetic oligonucleotide; GAG chr11 5260060 5260079 5260076 +
gcctaggtacattgtcatca

SEQ ID NO: 12631 - DNA, 20 bp, Artificial Sequence
  Synthetic oligonucleotide; AAG chr11 5260069 5260088 5260085 +
cattgtcatcagagtatcca

SEQ ID NO: 12632 - DNA, 20 bp, Artificial Sequence
  Synthetic oligonucleotide; AAG chr11 5260079 5260098 5260095 +
agagtatccaaagttatcta

SEQ ID NO: 12633 - DNA, 20 bp, Artificial Sequence
  Synthetic oligonucleotide; AAG chr11 5260085 5260104 5260101 +
tccaaagttatctaaagaca

SEQ ID NO: 12634 - DNA, 20 bp, Artificial Sequence
  Synthetic oligonucleotide; GAG chr11 5260087 5260106 5260103 +
caaagttatctaaagacaaa

SEQ ID NO: 12635 - DNA, 20 bp, Artificial Sequence
  Synthetic oligonucleotide; AAG chr11 5260096 5260115 5260112 +
ctaaagacaaagagaatctt

SEQ ID NO: 12636 - DNA, 20 bp, Artificial Sequence
  Synthetic oligonucleotide; GAG chr11 5260098 5260117 5260114 +
aaagacaaagagaatcttaa

SEQ ID NO: 12637 - DNA, 20 bp, Artificial Sequence
  Synthetic oligonucleotide; GAG chr11 5260105 5260124 5260121 +
aagagaatcttaagagctgt

SEQ ID NO: 12638 - DNA, 20 bp, Artificial Sequence
  Synthetic oligonucleotide; AGG chr11 5260106 5260125 5260122 +
agagaatcttaagagctgtg

SEQ ID NO: 12639 - DNA, 20 bp, Artificial Sequence
  Synthetic oligonucleotide; CAG chr11 5260118 5260137 5260134 +
gagctgtgaggtgaaactac

SEQ ID NO: 12640 - DNA, 20 bp, Artificial Sequence
  Synthetic oligonucleotide; AGG chr11 5260119 5260138 5260135 +
agctgtgaggtgaaactacc

SEQ ID NO: 12641 - DNA, 20 bp, Artificial Sequence
  Synthetic oligonucleotide; AAG chr11 5260132 5260151 5260148 +
aactaccaggtaacctatga

SEQ ID NO: 12642 - DNA, 20 bp, Artificial Sequence
  Synthetic oligonucleotide; CAG chr11 5260144 5260163 5260160 +
acctatgaaagaaaacctat

SEQ ID NO: 12643 - DNA, 20 bp, Artificial Sequence
  Synthetic oligonucleotide; CAG chr11 5260152 5260171 5260168 +
aagaaaacctatcagattaa

SEQ ID NO: 12644 - DNA, 20 bp, Artificial Sequence
  Synthetic oligonucleotide; CAG chr11 5260155 5260174 5260171 +
aaaacctatcagattaacag

SEQ ID NO: 12645 - DNA, 20 bp, Artificial Sequence
  Synthetic oligonucleotide; CAG chr11 5260164 5260183 5260180 +
cagattaacagcagatttct

SEQ ID NO: 12646 - DNA, 20 bp, Artificial Sequence
  Synthetic oligonucleotide; CAG chr11 5260167 5260186 5260183 +
attaacagcagatttctcag

SEQ ID NO: 12647 - DNA, 20 bp, Artificial Sequence
  Synthetic oligonucleotide; AAG chr11 5260179 5260198 5260195 +
tttctcagcagaaaccgtaa

SEQ ID NO: 12648 - DNA, 20 bp, Artificial Sequence
  Synthetic oligonucleotide; TAG chr11 5260183 5260202 5260199 +
tcagcagaaaccgtaaaagc

SEQ ID NO: 12649 - DNA, 20 bp, Artificial Sequence
  Synthetic oligonucleotide; AAG chr11 5260186 5260205 5260202 +
gcagaaaccgtaaaagctag

SEQ ID NO: 12650 - DNA, 20 bp, Artificial Sequence
  Synthetic oligonucleotide; TGG chr11 5260195 5260214 5260211 +
gtaaaagctagaagtgaata

SEQ ID NO: 12651 - DNA, 20 bp, Artificial Sequence
  Synthetic oligonucleotide; CAG chr11 5260207 5260226 5260223 +
agtgaatatggccctatctt

SEQ ID NO: 12652 - DNA, 20 bp, Artificial Sequence
  Synthetic oligonucleotide; CAG chr11 5260232 5260251 5260248 +
ttcttaaacaaaacaattat

SEQ ID NO: 12653 - DNA, 20 bp, Artificial Sequence
  Synthetic oligonucleotide; AAG chr11 5260237 5260256 5260253 +
aaacaaaacaattatcagcc

SEQ ID NO: 12654 - DNA, 20 bp, Artificial Sequence
  Synthetic oligonucleotide; CAG chr11 5260251 5260270 5260267 +
tcagccaagaattttatatc

SEQ ID NO: 12655 - DNA, 20 bp, Artificial Sequence
  Synthetic oligonucleotide; AAG chr11 5260261 5260280 5260277 +
attttatatccagtgaaact

SEQ ID NO: 12656 - DNA, 20 bp, Artificial Sequence
  Synthetic oligonucleotide; AAG chr11 5260275 5260294 5260291 +
gaaactaagcttcacaaatg

SEQ ID NO: 12657 - DNA, 20 bp, Artificial Sequence
  Synthetic oligonucleotide; CAG chr11 5260286 5260305 5260302 +
tcacaaatgaagaaaataca

SEQ ID NO: 12658 - DNA, 20 bp, Artificial Sequence
  Synthetic oligonucleotide; CAG chr11 5260296 5260315 5260312 +
agaaaatacacagtgttttt

SEQ ID NO: 12659 - DNA, 20 bp, Artificial Sequence
  Synthetic oligonucleotide; GAG chr11 5260312 5260331 5260328 +
ttttcagaaaaacaaatgct

SEQ ID NO: 12660 - DNA, 20 bp, Artificial Sequence
  Synthetic oligonucleotide; GAG chr11 5260314 5260333 5260330 +
ttcagaaaaacaaatgctga

SEQ ID NO: 12661 - DNA, 20 bp, Artificial Sequence
  Synthetic oligonucleotide; CGG chr11 5260321 5260340 5260337 +
aaacaaatgctgagagaatt

SEQ ID NO: 12662 - DNA, 20 bp, Artificial Sequence
  Synthetic oligonucleotide; AAG chr11 5260331 5260350 5260347 +
tgagagaattcggcactacc

SEQ ID NO: 12663 - DNA, 20 bp, Artificial Sequence
  Synthetic oligonucleotide; AAG chr11 5260344 5260363 5260360 +
cactaccaagccaacactac

SEQ ID NO: 12664 - DNA, 20 bp, Artificial Sequence
  Synthetic oligonucleotide; AAG chr11 5260356 5260375 5260372 +
aacactacaagaactgataa

SEQ ID NO: 12665 - DNA, 20 bp, Artificial Sequence
  Synthetic oligonucleotide; AGG chr11 5260357 5260376 5260373 +
acactacaagaactgataaa

SEQ ID NO: 12666 - DNA, 20 bp, Artificial Sequence
  Synthetic oligonucleotide; GAG chr11 5260359 5260378 5260375 +
actacaagaactgataaaag

SEQ ID NO: 12667 - DNA, 20 bp, Artificial Sequence
  Synthetic oligonucleotide; TGG chr11 5260384 5260403 5260400 +
ctaaatcttgaaataaaccc

SEQ ID NO: 12668 - DNA, 20 bp, Artificial Sequence
  Synthetic oligonucleotide; AAG chr11 5260387 5260406 5260403 +
aatcttgaaataaaccctgg

SEQ ID NO: 12669 - DNA, 20 bp, Artificial Sequence
  Synthetic oligonucleotide; CAG chr11 5260400 5260419 5260416 +
accctggaagcacatcaaaa

SEQ ID NO: 12670 - DNA, 20 bp, Artificial Sequence
  Synthetic oligonucleotide; AAG chr11 5260413 5260432 5260429 +
atcaaaacagaacctcttta

SEQ ID NO: 12671 - DNA, 20 bp, Artificial Sequence
  Synthetic oligonucleotide; TAG chr11 5260427 5260446 5260443 +
tctttaaagcataaatccca

SEQ ID NO: 12672 - DNA, 20 bp, Artificial Sequence
  Synthetic oligonucleotide; AGG chr11 5260428 5260447 5260444 +
ctttaaagcataaatcccat

SEQ ID NO: 12673 - DNA, 20 bp, Artificial Sequence
  Synthetic oligonucleotide; CAG chr11 5260449 5260468 5260465 +
ggacatatacaacaaaaata

SEQ ID NO: 12674 - DNA, 20 bp, Artificial Sequence
  Synthetic oligonucleotide; AAG chr11 5260457 5260476 5260473 +
acaacaaaaatacagataaa

SEQ ID NO: 12675 - DNA, 20 bp, Artificial Sequence
  Synthetic oligonucleotide; CAG chr11 5260465 5260484 5260481 +
aatacagataaaaagataca

SEQ ID NO: 12676 - DNA, 20 bp, Artificial Sequence
  Synthetic oligonucleotide; AGG chr11 5260466 5260485 5260482 +
atacagataaaaagatacac

SEQ ID NO: 12677 - DNA, 20 bp, Artificial Sequence
  Synthetic oligonucleotide; AAG chr11 5260483 5260502 5260499 +
cacaggcaacaaataccacg

SEQ ID NO: 12678 - DNA, 20 bp, Artificial Sequence
  Synthetic oligonucleotide; TGG chr11 5260488 5260507 5260504 +
gcaacaaataccacgaagaa

SEQ ID NO: 12679 - DNA, 20 bp, Artificial Sequence
  Synthetic oligonucleotide; TAG chr11 5260493 5260512 5260509 +
aaataccacgaagaatggaa

SEQ ID NO: 12680 - DNA, 20 bp, Artificial Sequence
  Synthetic oligonucleotide; TGG chr11 5260530 5260549 5260546 +
atactgatgttgaatgtaaa

SEQ ID NO: 12681 - DNA, 20 bp, Artificial Sequence
  Synthetic oligonucleotide; AAG chr11 5260551 5260570 5260567 +
ggactaaatgctccacttaa

SEQ ID NO: 12682 - DNA, 20 bp, Artificial Sequence
  Synthetic oligonucleotide; CAG chr11 5260557 5260576 5260573 +
aatgctccacttaaaagata

SEQ ID NO: 12683 - DNA, 20 bp, Artificial Sequence
  Synthetic oligonucleotide; CAG chr11 5260565 5260584 5260581 +
acttaaaagatacagaattg

SEQ ID NO: 12684 - DNA, 20 bp, Artificial Sequence
  Synthetic oligonucleotide; AAG chr11 5260575 5260594 5260591 +
tacagaattgcagaatgaat

SEQ ID NO: 12685 - DNA, 20 bp, Artificial Sequence
  Synthetic oligonucleotide; CAG chr11 5260589 5260608 5260605 +
atgaataagaattcaccaac

SEQ ID NO: 12686 - DNA, 20 bp, Artificial Sequence
  Synthetic oligonucleotide; CAG chr11 5260606 5260625 5260622 +
aaccagttatctgccgcctt

SEQ ID NO: 12687 - DNA, 20 bp, Artificial Sequence
  Synthetic oligonucleotide; AGG chr11 5260607 5260626 5260623 +
accagttatctgccgccttc

SEQ ID NO: 12688 - DNA, 20 bp, Artificial Sequence
  Synthetic oligonucleotide; GAG chr11 5260609 5260628 5260625 +
cagttatctgccgccttcag

SEQ ID NO: 12689 - DNA, 20 bp, Artificial Sequence
  Synthetic oligonucleotide; AAG chr11 5260627 5260646 5260643 +
aggagactcacctaacacat

SEQ ID NO: 12690 - DNA, 20 bp, Artificial Sequence
  Synthetic oligonucleotide; AGG chr11 5260628 5260647 5260644 +
ggagactcacctaacacata

SEQ ID NO: 12691 - DNA, 20 bp, Artificial Sequence
  Synthetic oligonucleotide; AAG chr11 5260645 5260664 5260661 +
ataaggactcacataaactt

SEQ ID NO: 12692 - DNA, 20 bp, Artificial Sequence
  Synthetic oligonucleotide; AGG chr11 5260646 5260665 5260662 +
taaggactcacataaactta

SEQ ID NO: 12693 - DNA, 20 bp, Artificial Sequence
  Synthetic oligonucleotide; AAG chr11 5260651 5260670 5260667 +
actcacataaacttaaggta

SEQ ID NO: 12694 - DNA, 20 bp, Artificial Sequence
  Synthetic oligonucleotide; AGG chr11 5260652 5260671 5260668 +
ctcacataaacttaaggtaa

SEQ ID NO: 12695 - DNA, 20 bp, Artificial Sequence
  Synthetic oligonucleotide; GGG chr11 5260653 5260672 5260669 +
tcacataaacttaaggtaaa

SEQ ID NO: 12696 - DNA, 20 bp, Artificial Sequence
  Synthetic oligonucleotide; GGG chr11 5260654 5260673 5260670 +
cacataaacttaaggtaaag

SEQ ID NO: 12697 - DNA, 20 bp, Artificial Sequence
  Synthetic oligonucleotide; TGG chr11 5260657 5260676 5260673 +
ataaacttaaggtaaagggg

SEQ ID NO: 12698 - DNA, 20 bp, Artificial Sequence
  Synthetic oligonucleotide; TGG chr11 5260680 5260699 5260696 +
aaaatgacattccacacaaa

SEQ ID NO: 12699 - DNA, 20 bp, Artificial Sequence
  Synthetic oligonucleotide; AAG chr11 5260690 5260709 5260706 +
tccacacaaatggacaccaa

SEQ ID NO: 12700 - DNA, 20 bp, Artificial Sequence
  Synthetic oligonucleotide; GAG chr11 5260694 5260713 5260710 +
cacaaatggacaccaaaagc

SEQ ID NO: 12701 - DNA, 20 bp, Artificial Sequence
  Synthetic oligonucleotide; AAG chr11 5260700 5260719 5260716 +
tggacaccaaaagcgagcca

SEQ ID NO: 12702 - DNA, 20 bp, Artificial Sequence
  Synthetic oligonucleotide; CAG chr11 5260703 5260722 5260719 +
acaccaaaagcgagccaaag

SEQ ID NO: 12703 - DNA, 20 bp, Artificial Sequence
  Synthetic oligonucleotide; CAG chr11 5260718 5260737 5260734 +
caaagcagctattcttatgt

SEQ ID NO: 12704 - DNA, 20 bp, Artificial Sequence
  Synthetic oligonucleotide; AAG chr11 5260736 5260755 5260752 +
gtcagacaaaacaaacttta

SEQ ID NO: 12705 - DNA, 20 bp, Artificial Sequence
  Synthetic oligonucleotide; CAG chr11 5260742 5260761 5260758 +
caaaacaaactttaaagaaa

SEQ ID NO: 12706 - DNA, 20 bp, Artificial Sequence
  Synthetic oligonucleotide; CAG chr11 5260745 5260764 5260761 +
aacaaactttaaagaaacag

SEQ ID NO: 12707 - DNA, 20 bp, Artificial Sequence
  Synthetic oligonucleotide; AAG chr11 5260754 5260773 5260770 +
taaagaaacagcagttaaaa

SEQ ID NO: 12708 - DNA, 20 bp, Artificial Sequence
  Synthetic oligonucleotide; AAG chr11 5260760 5260779 5260776 +
aacagcagttaaaaaagaca

SEQ ID NO: 12709 - DNA, 20 bp, Artificial Sequence
  Synthetic oligonucleotide; GAG chr11 5260762 5260781 5260778 +
cagcagttaaaaaagacaaa

SEQ ID NO: 12710 - DNA, 20 bp, Artificial Sequence
  Synthetic oligonucleotide; AGG chr11 5260763 5260782 5260779 +
agcagttaaaaaagacaaag

SEQ ID NO: 12711 - DNA, 20 bp, Artificial Sequence
  Synthetic oligonucleotide; GGG chr11 5260764 5260783 5260780 +
gcagttaaaaaagacaaaga

SEQ ID NO: 12712 - DNA, 20 bp, Artificial Sequence
  Synthetic oligonucleotide; AAG chr11 5260784 5260803 5260800 +
gggacatcatataatgataa

SEQ ID NO: 12713 - DNA, 20 bp, Artificial Sequence
  Synthetic oligonucleotide; TGG chr11 5260798 5260817 5260814 +
tgataaaagcccttgtccaa

SEQ ID NO: 12714 - DNA, 20 bp, Artificial Sequence
  Synthetic oligonucleotide; GGG chr11 5260799 5260818 5260815 +
gataaaagcccttgtccaat

SEQ ID NO: 12715 - DNA, 20 bp, Artificial Sequence
  Synthetic oligonucleotide; GAG chr11 5260801 5260820 5260817 +
taaaagcccttgtccaatgg

SEQ ID NO: 12716 - DNA, 20 bp, Artificial Sequence
  Synthetic oligonucleotide; TGG chr11 5260839 5260858 5260855 +
aatatatatgcatctaatac

SEQ ID NO: 12717 - DNA, 20 bp, Artificial Sequence
  Synthetic oligonucleotide; GAG chr11 5260841 5260860 5260857 +
tatatatgcatctaatactg

SEQ ID NO: 12718 - DNA, 20 bp, Artificial Sequence
  Synthetic oligonucleotide; TAG chr11 5260871 5260890 5260887 +
atttataaaacaattactac

SEQ ID NO: 12719 - DNA, 20 bp, Artificial Sequence
  Synthetic oligonucleotide; TAG chr11 5260876 5260895 5260892 +
taaaacaattactactagac

SEQ ID NO: 12720 - DNA, 20 bp, Artificial Sequence
  Synthetic oligonucleotide; CAG chr11 5260880 5260899 5260896 +
acaattactactagactaga

SEQ ID NO: 12721 - DNA, 20 bp, Artificial Sequence
  Synthetic oligonucleotide; TAG chr11 5260894 5260913 5260910 +
actagacagcaacataataa

SEQ ID NO: 12722 - DNA, 20 bp, Artificial Sequence
  Synthetic oligonucleotide; TGG chr11 5260897 5260916 5260913 +
agacagcaacataataatag

SEQ ID NO: 12723 - DNA, 20 bp, Artificial Sequence
  Synthetic oligonucleotide; GGG chr11 5260898 5260917 5260914 +
gacagcaacataataatagt

SEQ ID NO: 12724 - DNA, 20 bp, Artificial Sequence
  Synthetic oligonucleotide; GGG chr11 5260899 5260918 5260915 +
acagcaacataataatagtg

SEQ ID NO: 12725 - DNA, 20 bp, Artificial Sequence
  Synthetic oligonucleotide; GGG chr11 5260900 5260919 5260916 +
cagcaacataataatagtgg

SEQ ID NO: 12726 - DNA, 20 bp, Artificial Sequence
  Synthetic oligonucleotide; TAG chr11 5260927 5260946 5260943 +
caatactccactgactgcac

SEQ ID NO: 12727 - DNA, 20 bp, Artificial Sequence
  Synthetic oligonucleotide; AGG chr11 5260928 5260947 5260944 +
aatactccactgactgcact

SEQ ID NO: 12728 - DNA, 20 bp, Artificial Sequence
  Synthetic oligonucleotide; CAG chr11 5260931 5260950 5260947 +
actccactgactgcactagg

SEQ ID NO: 12729 - DNA, 20 bp, Artificial Sequence
  Synthetic oligonucleotide; AGG chr11 5260932 5260951 5260948 +
ctccactgactgcactaggc

SEQ ID NO: 12730 - DNA, 20 bp, Artificial Sequence
  Synthetic oligonucleotide; AAG chr11 5260940 5260959 5260956 +
actgcactaggcaggtcatc

SEQ ID NO: 12731 - DNA, 20 bp, Artificial Sequence
  Synthetic oligonucleotide; CAG chr11 5260944 5260963 5260960 +
cactaggcaggtcatcaaga

SEQ ID NO: 12732 - DNA, 20 bp, Artificial Sequence
  Synthetic oligonucleotide; AAG chr11 5260953 5260972 5260969 +
ggtcatcaagacagtctaca

SEQ ID NO: 12733 - DNA, 20 bp, Artificial Sequence
  Synthetic oligonucleotide; TGG chr11 5260962 5260981 5260978 +
gacagtctacaaagaaacaa

SEQ ID NO: 12734 - DNA, 20 bp, Artificial Sequence
  Synthetic oligonucleotide; AAG chr11 5260970 5260989 5260986 +
acaaagaaacaatggattta

SEQ ID NO: 12735 - DNA, 20 bp, Artificial Sequence
  Synthetic oligonucleotide; TGG chr11 5260979 5260998 5260995 +
caatggatttaaagaacaaa

SEQ ID NO: 12736 - DNA, 20 bp, Artificial Sequence
  Synthetic oligonucleotide; CAG chr11 5260988 5261007 5261004 +
taaagaacaaatggacttaa

SEQ ID NO: 12737 - DNA, 20 bp, Artificial Sequence
  Synthetic oligonucleotide; CAG chr11 5260998 5261017 5261014 +
atggacttaacagatattta

SEQ ID NO: 12738 - DNA, 20 bp, Artificial Sequence
  Synthetic oligonucleotide; AGG chr11 5260999 5261018 5261015 +
tggacttaacagatatttac

SEQ ID NO: 12739 - DNA, 20 bp, Artificial Sequence
  Synthetic oligonucleotide; CAG chr11 5261021 5261040 5261037 +
gacattctacccaacaactg

SEQ ID NO: 12740 - DNA, 20 bp, Artificial Sequence
  Synthetic oligonucleotide; CAG chr11 5261042 5261061 5261058 +
agaatacacattctattcat

SEQ ID NO: 12741 - DNA, 20 bp, Artificial Sequence
  Synthetic oligonucleotide; TGG chr11 5261049 5261068 5261065 +
acattctattcatcagcaca

SEQ ID NO: 12742 - DNA, 20 bp, Artificial Sequence
  Synthetic oligonucleotide; AAG chr11 5261062 5261081 5261078 +
cagcacatggaactttctcc

SEQ ID NO: 12743 - DNA, 20 bp, Artificial Sequence
  Synthetic oligonucleotide; TAG chr11 5261066 5261085 5261082 +
acatggaactttctccaaga

SEQ ID NO: 12744 - DNA, 20 bp, Artificial Sequence
  Synthetic oligonucleotide; AGG chr11 5261067 5261086 5261083 +
catggaactttctccaagat

SEQ ID NO: 12745 - DNA, 20 bp, Artificial Sequence
  Synthetic oligonucleotide; AAG chr11 5261091 5261110 5261107 +
catatgatatgccacaaaac

SEQ ID NO: 12746 - DNA, 20 bp, Artificial Sequence
  Synthetic oligonucleotide; AAG chr11 5261127 5261146 5261143 +
ttaaaaattgaaattatatc

SEQ ID NO: 12747 - DNA, 20 bp, Artificial Sequence
  Synthetic oligonucleotide; CAG chr11 5261138 5261157 5261154 +
aattatatcaagcactctct

SEQ ID NO: 12748 - DNA, 20 bp, Artificial Sequence
  Synthetic oligonucleotide; CAG chr11 5261145 5261164 5261161 +
tcaagcactctctcagacca

SEQ ID NO: 12749 - DNA, 20 bp, Artificial Sequence
  Synthetic oligonucleotide; TAG chr11 5261148 5261167 5261164 +
agcactctctcagaccacag

SEQ ID NO: 12750 - DNA, 20 bp, Artificial Sequence
  Synthetic oligonucleotide; TGG chr11 5261159 5261178 5261175 +
agaccacagtagaataaaat

SEQ ID NO: 12751 - DNA, 20 bp, Artificial Sequence
  Synthetic oligonucleotide; AAG chr11 5261175 5261194 5261191 +
aaattggaaatcaactacaa

SEQ ID NO: 12752 - DNA, 20 bp, Artificial Sequence
  Synthetic oligonucleotide; AGG chr11 5261176 5261195 5261192 +
aattggaaatcaactacaaa

SEQ ID NO: 12753 - DNA, 20 bp, Artificial Sequence
  Synthetic oligonucleotide; CAG chr11 5261201 5261220 5261217 +
ccttcaaaaccatgcaaata

SEQ ID NO: 12754 - DNA, 20 bp, Artificial Sequence
  Synthetic oligonucleotide; AGG chr11 5261202 5261221 5261218 +
cttcaaaaccatgcaaatac

SEQ ID NO: 12755 - DNA, 20 bp, Artificial Sequence
  Synthetic oligonucleotide; GGG chr11 5261203 5261222 5261219 +
ttcaaaaccatgcaaataca

SEQ ID NO: 12756 - DNA, 20 bp, Artificial Sequence
  Synthetic oligonucleotide; TGG chr11 5261236 5261255 5261252 +
acctgctcctgaatgatcat

SEQ ID NO: 12757 - DNA, 20 bp, Artificial Sequence
  Synthetic oligonucleotide; GGG chr11 5261237 5261256 5261253 +
cctgctcctgaatgatcatt

SEQ ID NO: 12758 - DNA, 20 bp, Artificial Sequence
  Synthetic oligonucleotide; AAG chr11 5261254 5261273 5261270 +
attgggtcaacaatgaaatc

SEQ ID NO: 12759 - DNA, 20 bp, Artificial Sequence
  Synthetic oligonucleotide; TGG chr11 5261258 5261277 5261274 +
ggtcaacaatgaaatcaaga

SEQ ID NO: 12760 - DNA, 20 bp, Artificial Sequence
  Synthetic oligonucleotide; CGG chr11 5261289 5261308 5261305 +
aaatcatttgctttgaaaac

SEQ ID NO: 12761 - DNA, 20 bp, Artificial Sequence
  Synthetic oligonucleotide; AAG chr11 5261295 5261314 5261311 +
tttgctttgaaaaccggcac

SEQ ID NO: 12762 - DNA, 20 bp, Artificial Sequence
  Synthetic oligonucleotide; AAG chr11 5261300 5261319 5261316 +
tttgaaaaccggcacaagac

SEQ ID NO: 12763 - DNA, 20 bp, Artificial Sequence
  Synthetic oligonucleotide; AGG chr11 5261301 5261320 5261317 +
ttgaaaaccggcacaagaca

SEQ ID NO: 12764 - DNA, 20 bp, Artificial Sequence
  Synthetic oligonucleotide; TAG chr11 5261331 5261350 5261347 +
ctcgccactcttactcaaca

SEQ ID NO: 12765 - DNA, 20 bp, Artificial Sequence
  Synthetic oligonucleotide; TGG chr11 5261337 5261356 5261353 +
actcttactcaacatagtat

SEQ ID NO: 12766 - DNA, 20 bp, Artificial Sequence
  Synthetic oligonucleotide; AAG chr11 5261340 5261359 5261356 +
cttactcaacatagtattgg

SEQ ID NO: 12767 - DNA, 20 bp, Artificial Sequence
  Synthetic oligonucleotide; CAG chr11 5261350 5261369 5261366 +
atagtattggaagttctcgc

SEQ ID NO: 12768 - DNA, 20 bp, Artificial Sequence
  Synthetic oligonucleotide; AGG chr11 5261351 5261370 5261367 +
tagtattggaagttctcgcc

SEQ ID NO: 12769 - DNA, 20 bp, Artificial Sequence
  Synthetic oligonucleotide; CAG chr11 5261359 5261378 5261375 +
gaagttctcgccaggacaat

SEQ ID NO: 12770 - DNA, 20 bp, Artificial Sequence
  Synthetic oligonucleotide; AGG chr11 5261360 5261379 5261376 +
aagttctcgccaggacaatc

SEQ ID NO: 12771 - DNA, 20 bp, Artificial Sequence
  Synthetic oligonucleotide; AAG chr11 5261364 5261383 5261380 +
tctcgccaggacaatcaggc

SEQ ID NO: 12772 - DNA, 20 bp, Artificial Sequence
  Synthetic oligonucleotide; GAG chr11 5261366 5261385 5261382 +
tcgccaggacaatcaggcaa

SEQ ID NO: 12773 - DNA, 20 bp, Artificial Sequence
  Synthetic oligonucleotide; AAG chr11 5261370 5261389 5261386 +
caggacaatcaggcaagaga

SEQ ID NO: 12774 - DNA, 20 bp, Artificial Sequence
  Synthetic oligonucleotide; AAG chr11 5261378 5261397 5261394 +
tcaggcaagagaaagaaata

SEQ ID NO: 12775 - DNA, 20 bp, Artificial Sequence
  Synthetic oligonucleotide; TAG chr11 5261391 5261410 5261407 +
agaaataaagcatattcaaa

SEQ ID NO: 12776 - DNA, 20 bp, Artificial Sequence
  Synthetic oligonucleotide; AGG chr11 5261392 5261411 5261408 +
gaaataaagcatattcaaat

SEQ ID NO: 12777 - DNA, 20 bp, Artificial Sequence
  Synthetic oligonucleotide; AAG chr11 5261395 5261414 5261411 +
ataaagcatattcaaatagg

SEQ ID NO: 12778 - DNA, 20 bp, Artificial Sequence
  Synthetic oligonucleotide; GAG chr11 5261397 5261416 5261413 +
aaagcatattcaaataggaa

SEQ ID NO: 12779 - DNA, 20 bp, Artificial Sequence
  Synthetic oligonucleotide; GAG chr11 5261399 5261418 5261415 +
agcatattcaaataggaaga

SEQ ID NO: 12780 - DNA, 20 bp, Artificial Sequence
  Synthetic oligonucleotide; AGG chr11 5261400 5261419 5261416 +
gcatattcaaataggaagag

SEQ ID NO: 12781 - DNA, 20 bp, Artificial Sequence
  Synthetic oligonucleotide; AAG chr11 5261403 5261422 5261419 +
tattcaaataggaagagagg

SEQ ID NO: 12782 - DNA, 20 bp, Artificial Sequence
  Synthetic oligonucleotide; CAG chr11 5261424 5261443 5261440 +
agtcaaattgtctctgtttg

SEQ ID NO: 12783 - DNA, 20 bp, Artificial Sequence
  Synthetic oligonucleotide; TAG chr11 5261445 5261464 5261461 +
agatgacatgattgtatatt

SEQ ID NO: 12784 - DNA, 20 bp, Artificial Sequence
  Synthetic oligonucleotide; AAG chr11 5261448 5261467 5261464 +
tgacatgattgtatatttag

SEQ ID NO: 12785 - DNA, 20 bp, Artificial Sequence
  Synthetic oligonucleotide; CAG chr11 5261463 5261482 5261479 +
tttagaagaccctgtcatct

SEQ ID NO: 12786 - DNA, 20 bp, Artificial Sequence
  Synthetic oligonucleotide; AAG chr11 5261477 5261496 5261493 +
tcatctcagcccaaaatctt

SEQ ID NO: 12787 - DNA, 20 bp, Artificial Sequence
  Synthetic oligonucleotide; CAG chr11 5261488 5261507 5261504 +
caaaatcttaagctgataaa

SEQ ID NO: 12788 - DNA, 20 bp, Artificial Sequence
  Synthetic oligonucleotide; CAG chr11 5261494 5261513 5261510 +
cttaagctgataaacagctt

SEQ ID NO: 12789 - DNA, 20 bp, Artificial Sequence
  Synthetic oligonucleotide; AAG chr11 5261499 5261518 5261515 +
gctgataaacagcttcagca

SEQ ID NO: 12790 - DNA, 20 bp, Artificial Sequence
  Synthetic oligonucleotide; AAG chr11 5261506 5261525 5261522 +
aacagcttcagcaaagtctc

SEQ ID NO: 12791 - DNA, 20 bp, Artificial Sequence
  Synthetic oligonucleotide; CAG chr11 5261518 5261537 5261534 +
aaagtctcaagatacaaaat

SEQ ID NO: 12792 - DNA, 20 bp, Artificial Sequence
  Synthetic oligonucleotide; CAG chr11 5261525 5261544 5261541 +
caagatacaaaatcagtgtg

SEQ ID NO: 12793 - DNA, 20 bp, Artificial Sequence
  Synthetic oligonucleotide; AAG chr11 5261535 5261554 5261551 +
aatcagtgtgcagaaatcac

SEQ ID NO: 12794 - DNA, 20 bp, Artificial Sequence
  Synthetic oligonucleotide; TAG chr11 5261557 5261576 5261573 +
gcgttcctatacaccaataa

SEQ ID NO: 12795 - DNA, 20 bp, Artificial Sequence
  Synthetic oligonucleotide; AAG chr11 5261562 5261581 5261578 +
cctatacaccaataatagac

SEQ ID NO: 12796 - DNA, 20 bp, Artificial Sequence
  Synthetic oligonucleotide; CAG chr11 5261565 5261584 5261581 +
atacaccaataatagacaag

SEQ ID NO: 12797 - DNA, 20 bp, Artificial Sequence
  Synthetic oligonucleotide; GAG chr11 5261567 5261586 5261583 +
acaccaataatagacaagca

SEQ ID NO: 12798 - DNA, 20 bp, Artificial Sequence
  Synthetic oligonucleotide; GAG chr11 5261569 5261588 5261585 +
accaataatagacaagcaga

SEQ ID NO: 12799 - DNA, 20 bp, Artificial Sequence
  Synthetic oligonucleotide; TGG chr11 5261580 5261599 5261596 +
acaagcagagagccaaatca

SEQ ID NO: 12800 - DNA, 20 bp, Artificial Sequence
  Synthetic oligonucleotide; GGG chr11 5261581 5261600 5261597 +
caagcagagagccaaatcat

SEQ ID NO: 12801 - DNA, 20 bp, Artificial Sequence
  Synthetic oligonucleotide; AAG chr11 5261609 5261628 5261625 +
tcccattcacaattgctgca

SEQ ID NO: 12802 - DNA, 20 bp, Artificial Sequence
  Synthetic oligonucleotide; GAG chr11 5261611 5261630 5261627 +
ccattcacaattgctgcaaa

SEQ ID NO: 12803 - DNA, 20 bp, Artificial Sequence
  Synthetic oligonucleotide; TAG chr11 5261630 5261649 5261646 +
agagaataaaataaaatacc

SEQ ID NO: 12804 - DNA, 20 bp, Artificial Sequence
  Synthetic oligonucleotide; AAG chr11 5261646 5261665 5261662 +
tacctagaaatacaacttct

SEQ ID NO: 12805 - DNA, 20 bp, Artificial Sequence
  Synthetic oligonucleotide; AGG chr11 5261647 5261666 5261663 +
acctagaaatacaacttcta

SEQ ID NO: 12806 - DNA, 20 bp, Artificial Sequence
  Synthetic oligonucleotide; GGG chr11 5261648 5261667 5261664 +
cctagaaatacaacttctaa

SEQ ID NO: 12807 - DNA, 20 bp, Artificial Sequence
  Synthetic oligonucleotide; AAG chr11 5261656 5261675 5261672 +
tacaacttctaagggatgtg

SEQ ID NO: 12808 - DNA, 20 bp, Artificial Sequence
  Synthetic oligonucleotide; AAG chr11 5261668 5261687 5261684 +
gggatgtgaagaacctcttc

SEQ ID NO: 12809 - DNA, 20 bp, Artificial Sequence
  Synthetic oligonucleotide; AGG chr11 5261669 5261688 5261685 +
ggatgtgaagaacctcttca

SEQ ID NO: 12810 - DNA, 20 bp, Artificial Sequence
  Synthetic oligonucleotide; GAG chr11 5261671 5261690 5261687 +
atgtgaagaacctcttcaag

SEQ ID NO: 12811 - DNA, 20 bp, Artificial Sequence
  Synthetic oligonucleotide; GAG chr11 5261673 5261692 5261689 +
gtgaagaacctcttcaagga

SEQ ID NO: 12812 - DNA, 20 bp, Artificial Sequence
  Synthetic oligonucleotide; AAG chr11 5261696 5261715 5261712 +
ctacaaaccactcactgctc

SEQ ID NO: 12813 - DNA, 20 bp, Artificial Sequence
  Synthetic oligonucleotide; AGG chr11 5261697 5261716 5261713 +
tacaaaccactcactgctca

SEQ ID NO: 12814 - DNA, 20 bp, Artificial Sequence
  Synthetic oligonucleotide; AAG chr11 5261704 5261723 5261720 +
cactcactgctcaaggaaat

SEQ ID NO: 12815 - DNA, 20 bp, Artificial Sequence
  Synthetic oligonucleotide; GAG chr11 5261706 5261725 5261722 +
ctcactgctcaaggaaataa

SEQ ID NO: 12816 - DNA, 20 bp, Artificial Sequence
  Synthetic oligonucleotide; GAG chr11 5261708 5261727 5261724 +
cactgctcaaggaaataaga

SEQ ID NO: 12817 - DNA, 20 bp, Artificial Sequence
  Synthetic oligonucleotide; AGG chr11 5261709 5261728 5261725 +
actgctcaaggaaataagag

SEQ ID NO: 12818 - DNA, 20 bp, Artificial Sequence
  Synthetic oligonucleotide; TGG chr11 5261723 5261742 5261739 +
taagagaggacacaaacaaa

SEQ ID NO: 12819 - DNA, 20 bp, Artificial Sequence
  Synthetic oligonucleotide; TAG chr11 5261744 5261763 5261760 +
ggaaaaacattccatgctca

SEQ ID NO: 12820 - DNA, 20 bp, Artificial Sequence
  Synthetic oligonucleotide; TAG chr11 5261748 5261767 5261764 +
aaacattccatgctcataga

SEQ ID NO: 12821 - DNA, 20 bp, Artificial Sequence
  Synthetic oligonucleotide; AAG chr11 5261752 5261771 5261768 +
attccatgctcatagataga

SEQ ID NO: 12822 - DNA, 20 bp, Artificial Sequence
  Synthetic oligonucleotide; TGG chr11 5261772 5261791 5261788 +
aagaatcaatatctttaaaa

SEQ ID NO: 12823 - DNA, 20 bp, Artificial Sequence
  Synthetic oligonucleotide; AAG chr11 5261787 5261806 5261803 +
taaaatggccatactgccca

SEQ ID NO: 12824 - DNA, 20 bp, Artificial Sequence
  Synthetic oligonucleotide; TAG chr11 5261797 5261816 5261813 +
atactgcccaaagtaattta

SEQ ID NO: 12825 - DNA, 20 bp, Artificial Sequence
  Synthetic oligonucleotide; AAG chr11 5261819 5261838 5261835 +
gattcaatgctatccccatc

SEQ ID NO: 12826 - DNA, 20 bp, Artificial Sequence
  Synthetic oligonucleotide; AAG chr11 5261841 5261860 5261857 +
gctaccactgacttttttca

SEQ ID NO: 12827 - DNA, 20 bp, Artificial Sequence
  Synthetic oligonucleotide; TAG chr11 5261847 5261866 5261863 +
actgacttttttcaaagaat

SEQ ID NO: 12828 - DNA, 20 bp, Artificial Sequence
  Synthetic oligonucleotide; TGG chr11 5261873 5261892 5261889 +
aaactactttaaatgtcata

SEQ ID NO: 12829 - DNA, 20 bp, Artificial Sequence
  Synthetic oligonucleotide; AAG chr11 5261884 5261903 5261900 +
aatgtcatatggaatcaaaa

SEQ ID NO: 12830 - DNA, 20 bp, Artificial Sequence
  Synthetic oligonucleotide; GAG chr11 5261886 5261905 5261902 +
tgtcatatggaatcaaaaaa

SEQ ID NO: 12831 - DNA, 20 bp, Artificial Sequence
  Synthetic oligonucleotide; TAG chr11 5261895 5261914 5261911 +
gaatcaaaaaagagcccata

SEQ ID NO: 12832 - DNA, 20 bp, Artificial Sequence
  Synthetic oligonucleotide; AAG chr11 5261900 5261919 5261916 +
aaaaaagagcccatatagcc

SEQ ID NO: 12833 - DNA, 20 bp, Artificial Sequence
  Synthetic oligonucleotide; AAG chr11 5261918 5261937 5261934 +
ccaagacaatcctaaacaaa

SEQ ID NO: 12834 - DNA, 20 bp, Artificial Sequence
  Synthetic oligonucleotide; AAG chr11 5261925 5261944 5261941 +
aatcctaaacaaaaagaaca

SEQ ID NO: 12835 - DNA, 20 bp, Artificial Sequence
  Synthetic oligonucleotide; TGG chr11 5261929 5261948 5261945 +
ctaaacaaaaagaacaaagc

SEQ ID NO: 12836 - DNA, 20 bp, Artificial Sequence
  Synthetic oligonucleotide; GAG chr11 5261931 5261950 5261947 +
aaacaaaaagaacaaagctg

SEQ ID NO: 12837 - DNA, 20 bp, Artificial Sequence
  Synthetic oligonucleotide; AGG chr11 5261932 5261951 5261948 +
aacaaaaagaacaaagctgg

SEQ ID NO: 12838 - DNA, 20 bp, Artificial Sequence
  Synthetic oligonucleotide; AAG chr11 5261966 5261985 5261982 +
ctgacttcaaactatactac

SEQ ID NO: 12839 - DNA, 20 bp, Artificial Sequence
  Synthetic oligonucleotide; AGG chr11 5261967 5261986 5261983 +
tgacttcaaactatactaca

SEQ ID NO: 12840 - DNA, 20 bp, Artificial Sequence
  Synthetic oligonucleotide; CAG chr11 5261973 5261992 5261989 +
caaactatactacaaggcta

SEQ ID NO: 12841 - DNA, 20 bp, Artificial Sequence
  Synthetic oligonucleotide; CAG chr11 5261985 5262004 5262001 +
caaggctacagtaacaaaaa

SEQ ID NO: 12842 - DNA, 20 bp, Artificial Sequence
  Synthetic oligonucleotide; TGG chr11 5261990 5262009 5262006 +
ctacagtaacaaaaacagca

SEQ ID NO: 12843 - DNA, 20 bp, Artificial Sequence
  Synthetic oligonucleotide; TGG chr11 5261996 5262015 5262012 +
taacaaaaacagcatggtac

SEQ ID NO: 12844 - DNA, 20 bp, Artificial Sequence
  Synthetic oligonucleotide; CAG chr11 5262007 5262026 5262023 +
gcatggtactggtaccaaaa

SEQ ID NO: 12845 - DNA, 20 bp, Artificial Sequence
  Synthetic oligonucleotide; TAG chr11 5262015 5262034 5262031 +
ctggtaccaaaacagatata

SEQ ID NO: 12846 - DNA, 20 bp, Artificial Sequence
  Synthetic oligonucleotide; CAG chr11 5262020 5262039 5262036 +
accaaaacagatatatagac

SEQ ID NO: 12847 - DNA, 20 bp, Artificial Sequence
  Synthetic oligonucleotide; TGG chr11 5262023 5262042 5262039 +
aaaacagatatatagaccag

SEQ ID NO: 12848 - DNA, 20 bp, Artificial Sequence
  Synthetic oligonucleotide; CAG chr11 5262028 5262047 5262044 +
agatatatagaccagtggaa

SEQ ID NO: 12849 - DNA, 20 bp, Artificial Sequence
  Synthetic oligonucleotide; CAG chr11 5262033 5262052 5262049 +
tatagaccagtggaacagaa

SEQ ID NO: 12850 - DNA, 20 bp, Artificial Sequence
  Synthetic oligonucleotide; AAG chr11 5262036 5262055 5262052 +
agaccagtggaacagaacag

SEQ ID NO: 12851 - DNA, 20 bp, Artificial Sequence
  Synthetic oligonucleotide; CAG chr11 5262042 5262061 5262058 +
gtggaacagaacagaagcct

SEQ ID NO: 12852 - DNA, 20 bp, Artificial Sequence
  Synthetic oligonucleotide; AAG chr11 5262094 5262113 5262110 +
atctttgacaaacatcacaa

SEQ ID NO: 12853 - DNA, 20 bp, Artificial Sequence
  Synthetic oligonucleotide; TGG chr11 5262100 5262119 5262116 +
gacaaacatcacaaaagcaa

SEQ ID NO: 12854 - DNA, 20 bp, Artificial Sequence
  Synthetic oligonucleotide; GAG chr11 5262102 5262121 5262118 +
caaacatcacaaaagcaatg

SEQ ID NO: 12855 - DNA, 20 bp, Artificial Sequence
  Synthetic oligonucleotide; AAG chr11 5262106 5262125 5262122 +
catcacaaaagcaatggaga

SEQ ID NO: 12856 - DNA, 20 bp, Artificial Sequence
  Synthetic oligonucleotide; TGG chr11 5262127 5262146 5262143 +
agaattccctatttaataaa

SEQ ID NO: 12857 - DNA, 20 bp, Artificial Sequence
  Synthetic oligonucleotide; TGG chr11 5262133 5262152 5262149 +
ccctatttaataaatggtgc

SEQ ID NO: 12858 - DNA, 20 bp, Artificial Sequence
  Synthetic oligonucleotide; TGG chr11 5262142 5262161 5262158 +
ataaatggtgctggaaaaac

SEQ ID NO: 12859 - DNA, 20 bp, Artificial Sequence
  Synthetic oligonucleotide; TAG chr11 5262146 5262165 5262162 +
atggtgctggaaaaactggc

SEQ ID NO: 12860 - DNA, 20 bp, Artificial Sequence
  Synthetic oligonucleotide; AAG chr11 5262207 5262226 5262223 +
ccttatacaaaaattaactc

SEQ ID NO: 12861 - DNA, 20 bp, Artificial Sequence
  Synthetic oligonucleotide; AGG chr11 5262208 5262227 5262224 +
cttatacaaaaattaactca

SEQ ID NO: 12862 - DNA, 20 bp, Artificial Sequence
  Synthetic oligonucleotide; TGG chr11 5262211 5262230 5262227 +
atacaaaaattaactcaagg

SEQ ID NO: 12863 - DNA, 20 bp, Artificial Sequence
  Synthetic oligonucleotide; AAG chr11 5262218 5262237 5262234 +
aattaactcaaggtggatta

SEQ ID NO: 12864 - DNA, 20 bp, Artificial Sequence
  Synthetic oligonucleotide; TAG chr11 5262254 5262273 5262270 +
acctaaaaccataaaaatcc

SEQ ID NO: 12865 - DNA, 20 bp, Artificial Sequence
  Synthetic oligonucleotide; AAG chr11 5262257 5262276 5262273 +
taaaaccataaaaatcctag

SEQ ID NO: 12866 - DNA, 20 bp, Artificial Sequence
  Synthetic oligonucleotide; TAG chr11 5262266 5262285 5262282 +
aaaaatcctagaagataacc

SEQ ID NO: 12867 - DNA, 20 bp, Artificial Sequence
  Synthetic oligonucleotide; AGG chr11 5262267 5262286 5262283 +
aaaatcctagaagataacct

SEQ ID NO: 12868 - DNA, 20 bp, Artificial Sequence
  Synthetic oligonucleotide; CAG chr11 5262280 5262299 5262296 +
ataacctaggcaataccatt

SEQ ID NO: 12869 - DNA, 20 bp, Artificial Sequence
  Synthetic oligonucleotide; AGG chr11 5262281 5262300 5262297 +
taacctaggcaataccattc

SEQ ID NO: 12870 - DNA, 20 bp, Artificial Sequence
  Synthetic oligonucleotide; TAG chr11 5262287 5262306 5262303 +
aggcaataccattcaggaca

SEQ ID NO: 12871 - DNA, 20 bp, Artificial Sequence
  Synthetic oligonucleotide; AGG chr11 5262288 5262307 5262304 +
ggcaataccattcaggacat

SEQ ID NO: 12872 - DNA, 20 bp, Artificial Sequence
  Synthetic oligonucleotide; TGG chr11 5262293 5262312 5262309 +
taccattcaggacataggca

SEQ ID NO: 12873 - DNA, 20 bp, Artificial Sequence
  Synthetic oligonucleotide; GGG chr11 5262294 5262313 5262310 +
accattcaggacataggcat

SEQ ID NO: 12874 - DNA, 20 bp, Artificial Sequence
  Synthetic oligonucleotide; AAG chr11 5262322 5262341 5262338 +
attcacgactaaaacatcaa

SEQ ID NO: 12875 - DNA, 20 bp, Artificial Sequence
  Synthetic oligonucleotide; AAG chr11 5262336 5262355 5262352 +
catcaaaagcaatgacaaca

SEQ ID NO: 12876 - DNA, 20 bp, Artificial Sequence
  Synthetic oligonucleotide; AGG chr11 5262337 5262356 5262353 +
atcaaaagcaatgacaacaa

SEQ ID NO: 12877 - DNA, 20 bp, Artificial Sequence
  Synthetic oligonucleotide; TGG chr11 5262354 5262373 5262370 +
caaaggccaaaattgacata

SEQ ID NO: 12878 - DNA, 20 bp, Artificial Sequence
  Synthetic oligonucleotide; GGG chr11 5262355 5262374 5262371 +
aaaggccaaaattgacatat

SEQ ID NO: 12879 - DNA, 20 bp, Artificial Sequence
  Synthetic oligonucleotide; AAG chr11 5262372 5262391 5262388 +
tatgggatctaattaaacta

SEQ ID NO: 12880 - DNA, 20 bp, Artificial Sequence
  Synthetic oligonucleotide; GAG chr11 5262374 5262393 5262390 +
tgggatctaattaaactaaa

SEQ ID NO: 12881 - DNA, 20 bp, Artificial Sequence
  Synthetic oligonucleotide; CAG chr11 5262385 5262404 5262401 +
taaactaaagagcttctgca

SEQ ID NO: 12882 - DNA, 20 bp, Artificial Sequence
  Synthetic oligonucleotide; AAG chr11 5262391 5262410 5262407 +
aaagagcttctgcacagcaa

SEQ ID NO: 12883 - DNA, 20 bp, Artificial Sequence
  Synthetic oligonucleotide; CAG chr11 5262402 5262421 5262418 +
gcacagcaaaagactatcat

SEQ ID NO: 12884 - DNA, 20 bp, Artificial Sequence
  Synthetic oligonucleotide; GAG chr11 5262404 5262423 5262420 +
acagcaaaagactatcatca

SEQ ID NO: 12885 - DNA, 20 bp, Artificial Sequence
  Synthetic oligonucleotide; CAG chr11 5262411 5262430 5262427 +
aagactatcatcagagtgaa

SEQ ID NO: 12886 - DNA, 20 bp, Artificial Sequence
  Synthetic oligonucleotide; AGG chr11 5262412 5262431 5262428 +
agactatcatcagagtgaac

SEQ ID NO: 12887 - DNA, 20 bp, Artificial Sequence
  Synthetic oligonucleotide; CAG chr11 5262422 5262441 5262438 +
cagagtgaacaggcaaccta

SEQ ID NO: 12888 - DNA, 20 bp, Artificial Sequence
  Synthetic oligonucleotide; TGG chr11 5262427 5262446 5262443 +
tgaacaggcaacctacagaa

SEQ ID NO: 12889 - DNA, 20 bp, Artificial Sequence
  Synthetic oligonucleotide; GGG chr11 5262428 5262447 5262444 +
gaacaggcaacctacagaat

SEQ ID NO: 12890 - DNA, 20 bp, Artificial Sequence
  Synthetic oligonucleotide; GAG chr11 5262430 5262449 5262446 +
acaggcaacctacagaatgg

SEQ ID NO: 12891 - DNA, 20 bp, Artificial Sequence
  Synthetic oligonucleotide; AAG chr11 5262461 5262480 5262477 +
tgcaatctatccatctgaca

SEQ ID NO: 12892 - DNA, 20 bp, Artificial Sequence
  Synthetic oligonucleotide; AGG chr11 5262462 5262481 5262478 +
gcaatctatccatctgacaa

SEQ ID NO: 12893 - DNA, 20 bp, Artificial Sequence
  Synthetic oligonucleotide; GGG chr11 5262463 5262482 5262479 +
caatctatccatctgacaaa

SEQ ID NO: 12894 - DNA, 20 bp, Artificial Sequence
  Synthetic oligonucleotide; AAG chr11 5262485 5262504 5262501 +
gctaacatccaaaatctaca

SEQ ID NO: 12895 - DNA, 20 bp, Artificial Sequence
  Synthetic oligonucleotide; AAG chr11 5262505 5262524 5262521 +
aagaacttcaacaaatttac

SEQ ID NO: 12896 - DNA, 20 bp, Artificial Sequence
  Synthetic oligonucleotide; AAG chr11 5262532 5262551 5262548 +
aacctaacgaccccatcaaa

SEQ ID NO: 12897 - DNA, 20 bp, Artificial Sequence
  Synthetic oligonucleotide; TGG chr11 5262535 5262554 5262551 +
ctaacgaccccatcaaaaag

SEQ ID NO: 12898 - DNA, 20 bp, Artificial Sequence
  Synthetic oligonucleotide; AAG chr11 5262541 5262560 5262557 +
accccatcaaaaagtggaca

SEQ ID NO: 12899 - DNA, 20 bp, Artificial Sequence
  Synthetic oligonucleotide; AGG chr11 5262542 5262561 5262558 +
ccccatcaaaaagtggacaa

SEQ ID NO: 12900 - DNA, 20 bp, Artificial Sequence
  Synthetic oligonucleotide; CAG chr11 5262552 5262571 5262568 +
aagtggacaaaggatatgaa

SEQ ID NO: 12901 - DNA, 20 bp, Artificial Sequence
  Synthetic oligonucleotide; AAG chr11 5262566 5262585 5262582 +
tatgaacagatgcttctcta

SEQ ID NO: 12902 - DNA, 20 bp, Artificial Sequence
  Synthetic oligonucleotide; AAG chr11 5262569 5262588 5262585 +
gaacagatgcttctctaaag

SEQ ID NO: 12903 - DNA, 20 bp, Artificial Sequence
  Synthetic oligonucleotide; TGG chr11 5262581 5262600 5262597 +
ctctaaagaagtcatttatg

SEQ ID NO: 12904 - DNA, 20 bp, Artificial Sequence
  Synthetic oligonucleotide; AAG chr11 5262586 5262605 5262602 +
aagaagtcatttatgtggcc

SEQ ID NO: 12905 - DNA, 20 bp, Artificial Sequence
  Synthetic oligonucleotide; AAG chr11 5262600 5262619 5262616 +
gtggccaagaaacacatgaa

SEQ ID NO: 12906 - DNA, 20 bp, Artificial Sequence
  Synthetic oligonucleotide; AAG chr11 5262603 5262622 5262619 +
gccaagaaacacatgaaaag

SEQ ID NO: 12907 - DNA, 20 bp, Artificial Sequence
  Synthetic oligonucleotide; TGG chr11 5262617 5262636 5262633 +
gaaaagaagctcatcatcac

SEQ ID NO: 12908 - DNA, 20 bp, Artificial Sequence
  Synthetic oligonucleotide; TAG chr11 5262624 5262643 5262640 +
agctcatcatcactggtcat

SEQ ID NO: 12909 - DNA, 20 bp, Artificial Sequence
  Synthetic oligonucleotide; GAG chr11 5262626 5262645 5262642 +
ctcatcatcactggtcatta

SEQ ID NO: 12910 - DNA, 20 bp, Artificial Sequence
  Synthetic oligonucleotide; GAG chr11 5262651 5262670 5262667 +
atgcaaatcaaaaccacaat

SEQ ID NO: 12911 - DNA, 20 bp, Artificial Sequence
  Synthetic oligonucleotide; CAG chr11 5262668 5262687 5262684 +
aatgagataccatctcatgc

SEQ ID NO: 12912 - DNA, 20 bp, Artificial Sequence
  Synthetic oligonucleotide; TAG chr11 5262672 5262691 5262688 +
agataccatctcatgccagt

SEQ ID NO: 12913 - DNA, 20 bp, Artificial Sequence
  Synthetic oligonucleotide; TGG chr11 5262677 5262696 5262693 +
ccatctcatgccagttagaa

SEQ ID NO: 12914 - DNA, 20 bp, Artificial Sequence
  Synthetic oligonucleotide; AAG chr11 5262691 5262710 5262707 +
ttagaatggcaattattaaa

SEQ ID NO: 12915 - DNA, 20 bp, Artificial Sequence
  Synthetic oligonucleotide; CAG chr11 5262695 5262714 5262711 +
aatggcaattattaaaaagt

SEQ ID NO: 12916 - DNA, 20 bp, Artificial Sequence
  Synthetic oligonucleotide; AGG chr11 5262696 5262715 5262712 +
atggcaattattaaaaagtc

SEQ ID NO: 12917 - DNA, 20 bp, Artificial Sequence
  Synthetic oligonucleotide; AAG chr11 5262705 5262724 5262721 +
attaaaaagtcaggaaacaa

SEQ ID NO: 12918 - DNA, 20 bp, Artificial Sequence
  Synthetic oligonucleotide; AGG chr11 5262706 5262725 5262722 +
ttaaaaagtcaggaaacaaa

SEQ ID NO: 12919 - DNA, 20 bp, Artificial Sequence
  Synthetic oligonucleotide; TGG chr11 5262712 5262731 5262728 +
agtcaggaaacaaaaggtgc

SEQ ID NO: 12920 - DNA, 20 bp, Artificial Sequence
  Synthetic oligonucleotide; GAG chr11 5262714 5262733 5262730 +
tcaggaaacaaaaggtgctg

SEQ ID NO: 12921 - DNA, 20 bp, Artificial Sequence
  Synthetic oligonucleotide; GAG chr11 5262716 5262735 5262732 +
aggaaacaaaaggtgctgga

SEQ ID NO: 12922 - DNA, 20 bp, Artificial Sequence
  Synthetic oligonucleotide; AGG chr11 5262717 5262736 5262733 +
ggaaacaaaaggtgctggag

SEQ ID NO: 12923 - DNA, 20 bp, Artificial Sequence
  Synthetic oligonucleotide; TGG chr11 5262723 5262742 5262739 +
aaaaggtgctggagaggatg

SEQ ID NO: 12924 - DNA, 20 bp, Artificial Sequence
  Synthetic oligonucleotide; AAG chr11 5262726 5262745 5262742 +
aggtgctggagaggatgtgg

SEQ ID NO: 12925 - DNA, 20 bp, Artificial Sequence
  Synthetic oligonucleotide; TAG chr11 5262731 5262750 5262747 +
ctggagaggatgtggaagaa

SEQ ID NO: 12926 - DNA, 20 bp, Artificial Sequence
  Synthetic oligonucleotide; AGG chr11 5262732 5262751 5262748 +
tggagaggatgtggaagaat

SEQ ID NO: 12927 - DNA, 20 bp, Artificial Sequence
  Synthetic oligonucleotide; TGG chr11 5262754 5262773 5262770 +
gaaaaattttacactgttga

SEQ ID NO: 12928 - DNA, 20 bp, Artificial Sequence
  Synthetic oligonucleotide; GGG chr11 5262755 5262774 5262771 +
aaaaattttacactgttgat

SEQ ID NO: 12929 - DNA, 20 bp, Artificial Sequence
  Synthetic oligonucleotide; TAG chr11 5262767 5262786 5262783 +
ctgttgatgggtgtgtaaat

SEQ ID NO: 12930 - DNA, 20 bp, Artificial Sequence
  Synthetic oligonucleotide; TGG chr11 5262781 5262800 5262797 +
gtaaattagttcaaccattg

SEQ ID NO: 12931 - DNA, 20 bp, Artificial Sequence
  Synthetic oligonucleotide; AAG chr11 5262784 5262803 5262800 +
aattagttcaaccattgtgg

SEQ ID NO: 12932 - DNA, 20 bp, Artificial Sequence
  Synthetic oligonucleotide; CAG chr11 5262788 5262807 5262804 +
agttcaaccattgtggaaga

SEQ ID NO: 12933 - DNA, 20 bp, Artificial Sequence
  Synthetic oligonucleotide; TGG chr11 5262793 5262812 5262809 +
aaccattgtggaagacagtg

SEQ ID NO: 12934 - DNA, 20 bp, Artificial Sequence
  Synthetic oligonucleotide; AAG chr11 5262805 5262824 5262821 +
agacagtgtggcgattcctc

SEQ ID NO: 12935 - DNA, 20 bp, Artificial Sequence
  Synthetic oligonucleotide; AGG chr11 5262806 5262825 5262822 +
gacagtgtggcgattcctca

SEQ ID NO: 12936 - DNA, 20 bp, Artificial Sequence
  Synthetic oligonucleotide; TAG chr11 5262812 5262831 5262828 +
gtggcgattcctcaaggatc

SEQ ID NO: 12937 - DNA, 20 bp, Artificial Sequence
  Synthetic oligonucleotide; CAG chr11 5262818 5262837 5262834 +
attcctcaaggatctagaac

SEQ ID NO: 12938 - DNA, 20 bp, Artificial Sequence
  Synthetic oligonucleotide; CAG chr11 5262836 5262855 5262852 +
accagaaatactgtttgacc

SEQ ID NO: 12939 - DNA, 20 bp, Artificial Sequence
  Synthetic oligonucleotide; TGG chr11 5262851 5262870 5262867 +
tgacccagcaatcccattac

SEQ ID NO: 12940 - DNA, 20 bp, Artificial Sequence
  Synthetic oligonucleotide; GGG chr11 5262852 5262871 5262868 +
gacccagcaatcccattact

SEQ ID NO: 12941 - DNA, 20 bp, Artificial Sequence
  Synthetic oligonucleotide; AAG chr11 5262865 5262884 5262881 +
cattactgggtatataccca

SEQ ID NO: 12942 - DNA, 20 bp, Artificial Sequence
  Synthetic oligonucleotide; TAG chr11 5262871 5262890 5262887 +
tgggtatatacccaaagaat

SEQ ID NO: 12943 - DNA, 20 bp, Artificial Sequence
  Synthetic oligonucleotide; AAG chr11 5262890 5262909 5262906 +
ttagaaatcattctactata

SEQ ID NO: 12944 - DNA, 20 bp, Artificial Sequence
  Synthetic oligonucleotide; TGG chr11 5262917 5262936 5262933 +
gtgcacacgtatgtttattg

SEQ ID NO: 12945 - DNA, 20 bp, Artificial Sequence
  Synthetic oligonucleotide; TAG chr11 5262932 5262951 5262948 +
tattgtggcactattcacaa

SEQ ID NO: 12946 - DNA, 20 bp, Artificial Sequence
  Synthetic oligonucleotide; AAG chr11 5262937 5262956 5262953 +
tggcactattcacaatagca

SEQ ID NO: 12947 - DNA, 20 bp, Artificial Sequence
  Synthetic oligonucleotide; TGG chr11 5262943 5262962 5262959 +
tattcacaatagcaaagact

SEQ ID NO: 12948 - DNA, 20 bp, Artificial Sequence
  Synthetic oligonucleotide; TGG chr11 5262958 5262977 5262974 +
agacttggaaccaacccaaa

SEQ ID NO: 12949 - DNA, 20 bp, Artificial Sequence
  Synthetic oligonucleotide; CAG chr11 5262965 5262984 5262981 +
gaaccaacccaaatggccat

SEQ ID NO: 12950 - DNA, 20 bp, Artificial Sequence
  Synthetic oligonucleotide; TGG chr11 5262976 5262995 5262992 +
aatggccatcagcgatataa

SEQ ID NO: 12951 - DNA, 20 bp, Artificial Sequence
  Synthetic oligonucleotide; AAG chr11 5262982 5263001 5262998 +
catcagcgatataatggata

SEQ ID NO: 12952 - DNA, 20 bp, Artificial Sequence
  Synthetic oligonucleotide; TGG chr11 5262991 5263010 5263007 +
tataatggataaagaaaatg

SEQ ID NO: 12953 - DNA, 20 bp, Artificial Sequence
  Synthetic oligonucleotide; TGG chr11 5263007 5263026 5263023 +
aatgtggcacatatacacca

SEQ ID NO: 12954 - DNA, 20 bp, Artificial Sequence
  Synthetic oligonucleotide; CAG chr11 5263019 5263038 5263035 +
atacaccatggaatactatg

SEQ ID NO: 12955 - DNA, 20 bp, Artificial Sequence
  Synthetic oligonucleotide; GAG chr11 5263035 5263054 5263051 +
tatgcagccataaaaatgat

SEQ ID NO: 12956 - DNA, 20 bp, Artificial Sequence
  Synthetic oligonucleotide; CAG chr11 5263050 5263069 5263066 +
atgatgagttcatgtctttg

SEQ ID NO: 12957 - DNA, 20 bp, Artificial Sequence
  Synthetic oligonucleotide; AGG chr11 5263051 5263070 5263067 +
tgatgagttcatgtctttgc

SEQ ID NO: 12958 - DNA, 20 bp, Artificial Sequence
  Synthetic oligonucleotide; GGG chr11 5263052 5263071 5263068 +
gatgagttcatgtctttgca

SEQ ID NO: 12959 - DNA, 20 bp, Artificial Sequence
  Synthetic oligonucleotide; TGG chr11 5263058 5263077 5263074 +
ttcatgtctttgcagggaca

SEQ ID NO: 12960 - DNA, 20 bp, Artificial Sequence
  Synthetic oligonucleotide; AAG chr11 5263064 5263083 5263080 +
tctttgcagggacatggatg

SEQ ID NO: 12961 - DNA, 20 bp, Artificial Sequence
  Synthetic oligonucleotide; AGG chr11 5263065 5263084 5263081 +
ctttgcagggacatggatga

SEQ ID NO: 12962 - DNA, 20 bp, Artificial Sequence
  Synthetic oligonucleotide; TGG chr11 5263068 5263087 5263084 +
tgcagggacatggatgaagg

SEQ ID NO: 12963 - DNA, 20 bp, Artificial Sequence
  Synthetic oligonucleotide; GAG chr11 5263084 5263103 5263100 +
aaggtggaaaccatcattct

SEQ ID NO: 12964 - DNA, 20 bp, Artificial Sequence
  Synthetic oligonucleotide; CAG chr11 5263097 5263116 5263113 +
tcattctgagcaaactaaca

SEQ ID NO: 12965 - DNA, 20 bp, Artificial Sequence
  Synthetic oligonucleotide; AGG chr11 5263098 5263117 5263114 +
cattctgagcaaactaacac

SEQ ID NO: 12966 - DNA, 20 bp, Artificial Sequence
  Synthetic oligonucleotide; CAG chr11 5263103 5263122 5263119 +
tgagcaaactaacacaggaa

SEQ ID NO: 12967 - DNA, 20 bp, Artificial Sequence
  Synthetic oligonucleotide; GAG chr11 5263105 5263124 5263121 +
agcaaactaacacaggaaca

SEQ ID NO: 12968 - DNA, 20 bp, Artificial Sequence
  Synthetic oligonucleotide; AAG chr11 5263136 5263155 5263152 +
caccacacgttctcactcat

SEQ ID NO: 12969 - DNA, 20 bp, Artificial Sequence
  Synthetic oligonucleotide; TGG chr11 5263139 5263158 5263155 +
cacacgttctcactcataag

SEQ ID NO: 12970 - DNA, 20 bp, Artificial Sequence
  Synthetic oligonucleotide; GGG chr11 5263140 5263159 5263156 +
acacgttctcactcataagt

SEQ ID NO: 12971 - DNA, 20 bp, Artificial Sequence
  Synthetic oligonucleotide; GAG chr11 5263142 5263161 5263158 +
acgttctcactcataagtgg

SEQ ID NO: 12972 - DNA, 20 bp, Artificial Sequence
  Synthetic oligonucleotide; GAG chr11 5263154 5263173 5263170 +
ataagtgggagttgaacaat

SEQ ID NO: 12973 - DNA, 20 bp, Artificial Sequence
  Synthetic oligonucleotide; TGG chr11 5263163 5263182 5263179 +
agttgaacaatgagaacaca

SEQ ID NO: 12974 - DNA, 20 bp, Artificial Sequence
  Synthetic oligonucleotide; CAG chr11 5263169 5263188 5263185 +
acaatgagaacacatggaca

SEQ ID NO: 12975 - DNA, 20 bp, Artificial Sequence
  Synthetic oligonucleotide; AGG chr11 5263170 5263189 5263186 +
caatgagaacacatggacac

SEQ ID NO: 12976 - DNA, 20 bp, Artificial Sequence
  Synthetic oligonucleotide; GGG chr11 5263171 5263190 5263187 +
aatgagaacacatggacaca

SEQ ID NO: 12977 - DNA, 20 bp, Artificial Sequence
  Synthetic oligonucleotide; GAG chr11 5263173 5263192 5263189 +
tgagaacacatggacacagg

SEQ ID NO: 12978 - DNA, 20 bp, Artificial Sequence
  Synthetic oligonucleotide; AGG chr11 5263174 5263193 5263190 +
gagaacacatggacacaggg

SEQ ID NO: 12979 - DNA, 20 bp, Artificial Sequence
  Synthetic oligonucleotide; GGG chr11 5263175 5263194 5263191 +
agaacacatggacacaggga

SEQ ID NO: 12980 - DNA, 20 bp, Artificial Sequence
  Synthetic oligonucleotide; GGG chr11 5263176 5263195 5263192 +
gaacacatggacacagggag

SEQ ID NO: 12981 - DNA, 20 bp, Artificial Sequence
  Synthetic oligonucleotide; CAG chr11 5263191 5263210 5263207 +
gggaggggaacatcacacac

SEQ ID NO: 12982 - DNA, 20 bp, Artificial Sequence
  Synthetic oligonucleotide; AGG chr11 5263192 5263211 5263208 +
ggaggggaacatcacacacc

SEQ ID NO: 12983 - DNA, 20 bp, Artificial Sequence
  Synthetic oligonucleotide; GGG chr11 5263193 5263212 5263209 +
gaggggaacatcacacacca

SEQ ID NO: 12984 - DNA, 20 bp, Artificial Sequence
  Synthetic oligonucleotide; CGG chr11 5263201 5263220 5263217 +
catcacacaccagggcctgt

SEQ ID NO: 12985 - DNA, 20 bp, Artificial Sequence
  Synthetic oligonucleotide; GGG chr11 5263202 5263221 5263218 +
atcacacaccagggcctgtc

SEQ ID NO: 12986 - DNA, 20 bp, Artificial Sequence
  Synthetic oligonucleotide; GGG chr11 5263203 5263222 5263219 +
tcacacaccagggcctgtcg

SEQ ID NO: 12987 - DNA, 20 bp, Artificial Sequence
  Synthetic oligonucleotide; GGG chr11 5263204 5263223 5263220 +
cacacaccagggcctgtcgg

SEQ ID NO: 12988 - DNA, 20 bp, Artificial Sequence
  Synthetic oligonucleotide; GGG chr11 5263205 5263224 5263221 +
acacaccagggcctgtcggg

SEQ ID NO: 12989 - DNA, 20 bp, Artificial Sequence
  Synthetic oligonucleotide; GAG chr11 5263209 5263228 5263225 +
accagggcctgtcggggggt

SEQ ID NO: 12990 - DNA, 20 bp, Artificial Sequence
  Synthetic oligonucleotide; AGG chr11 5263210 5263229 5263226 +
ccagggcctgtcggggggtg

SEQ ID NO: 12991 - DNA, 20 bp, Artificial Sequence
  Synthetic oligonucleotide; GGG chr11 5263211 5263230 5263227 +
cagggcctgtcggggggtga

SEQ ID NO: 12992 - DNA, 20 bp, Artificial Sequence
  Synthetic oligonucleotide; GGG chr11 5263212 5263231 5263228 +
agggcctgtcggggggtgag

SEQ ID NO: 12993 - DNA, 20 bp, Artificial Sequence
  Synthetic oligonucleotide; GGG chr11 5263213 5263232 5263229 +
gggcctgtcggggggtgagg

SEQ ID NO: 12994 - DNA, 20 bp, Artificial Sequence
  Synthetic oligonucleotide; TAG chr11 5263217 5263236 5263233 +
ctgtcggggggtgagggggt

SEQ ID NO: 12995 - DNA, 20 bp, Artificial Sequence
  Synthetic oligonucleotide; AGG chr11 5263218 5263237 5263234 +
tgtcggggggtgagggggtt

SEQ ID NO: 12996 - DNA, 20 bp, Artificial Sequence
  Synthetic oligonucleotide; GAG chr11 5263220 5263239 5263236 +
tcggggggtgagggggttag

SEQ ID NO: 12997 - DNA, 20 bp, Artificial Sequence
  Synthetic oligonucleotide; GAG chr11 5263222 5263241 5263238 +
ggggggtgagggggttagga

SEQ ID NO: 12998 - DNA, 20 bp, Artificial Sequence
  Synthetic oligonucleotide; AGG chr11 5263223 5263242 5263239 +
gggggtgagggggttaggag

SEQ ID NO: 12999 - DNA, 20 bp, Artificial Sequence
  Synthetic oligonucleotide; GGG chr11 5263224 5263243 5263240 +
ggggtgagggggttaggaga

SEQ ID NO: 13000 - DNA, 20 bp, Artificial Sequence
  Synthetic oligonucleotide; AAG chr11 5263237 5263256 5263253 +
taggagagggataacattaa

SEQ ID NO: 13001 - DNA, 20 bp, Artificial Sequence
  Synthetic oligonucleotide; TAG chr11 5263252 5263271 5263268 +
attaaaagaaatacctaatg

SEQ ID NO: 13002 - DNA, 20 bp, Artificial Sequence
  Synthetic oligonucleotide; CAG chr11 5263259 5263278 5263275 +
gaaatacctaatgtagatga

SEQ ID NO: 13003 - DNA, 20 bp, Artificial Sequence
  Synthetic oligonucleotide; AGG chr11 5263260 5263279 5263276 +
aaatacctaatgtagatgac

SEQ ID NO: 13004 - DNA, 20 bp, Artificial Sequence
  Synthetic oligonucleotide; TGG chr11 5263267 5263286 5263283 +
taatgtagatgacaggttga

SEQ ID NO: 13005 - DNA, 20 bp, Artificial Sequence
  Synthetic oligonucleotide; GGG chr11 5263268 5263287 5263284 +
aatgtagatgacaggttgat

SEQ ID NO: 13006 - DNA, 20 bp, Artificial Sequence
  Synthetic oligonucleotide; CAG chr11 5263273 5263292 5263289 +
agatgacaggttgatgggtg

SEQ ID NO: 13007 - DNA, 20 bp, Artificial Sequence
  Synthetic oligonucleotide; TGG chr11 5263286 5263305 5263302 +
atgggtgcagcaaaccacca

SEQ ID NO: 13008 - DNA, 20 bp, Artificial Sequence
  Synthetic oligonucleotide; CAG chr11 5263336 5263355 5263352 +
cacattctgcacatgtatcc

SEQ ID NO: 13009 - DNA, 20 bp, Artificial Sequence
  Synthetic oligonucleotide; AAG chr11 5263345 5263364 5263361 +
cacatgtatcccagaactta

SEQ ID NO: 13010 - DNA, 20 bp, Artificial Sequence
  Synthetic oligonucleotide; AAG chr11 5263354 5263373 5263370 +
cccagaacttaaagtataat

SEQ ID NO: 13011 - DNA, 20 bp, Artificial Sequence
  Synthetic oligonucleotide; TAG chr11 5263387 5263406 5263403 +
ttacttgaactgaccgacaa

SEQ ID NO: 13012 - DNA, 20 bp, Artificial Sequence
  Synthetic oligonucleotide; TAG chr11 5263412 5263431 5263428 +
acacaacctatcaaaacctc

SEQ ID NO: 13013 - DNA, 20 bp, Artificial Sequence
  Synthetic oligonucleotide; AGG chr11 5263413 5263432 5263429 +
cacaacctatcaaaacctct

SEQ ID NO: 13014 - DNA, 20 bp, Artificial Sequence
  Synthetic oligonucleotide; CAG chr11 5263419 5263438 5263435 +
ctatcaaaacctctaggata

SEQ ID NO: 13015 - DNA, 20 bp, Artificial Sequence
  Synthetic oligonucleotide; AAG chr11 5263424 5263443 5263440 +
aaaacctctaggatacagca

SEQ ID NO: 13016 - DNA, 20 bp, Artificial Sequence
  Synthetic oligonucleotide; TGG chr11 5263428 5263447 5263444 +
cctctaggatacagcaaaga

SEQ ID NO: 13017 - DNA, 20 bp, Artificial Sequence
  Synthetic oligonucleotide; AAG chr11 5263437 5263456 5263453 +
tacagcaaagatggtgctaa

SEQ ID NO: 13018 - DNA, 20 bp, Artificial Sequence
  Synthetic oligonucleotide; AGG chr11 5263438 5263457 5263454 +
acagcaaagatggtgctaaa

SEQ ID NO: 13019 - DNA, 20 bp, Artificial Sequence
  Synthetic oligonucleotide; AAG chr11 5263442 5263461 5263458 +
caaagatggtgctaaaagga

SEQ ID NO: 13020 - DNA, 20 bp, Artificial Sequence
  Synthetic oligonucleotide; CAG chr11 5263449 5263468 5263465 +
ggtgctaaaaggaaagttca

SEQ ID NO: 13021 - DNA, 20 bp, Artificial Sequence
  Synthetic oligonucleotide; AAG chr11 5263470 5263489 5263486 +
agccctaaatgtcgatgtca

SEQ ID NO: 13022 - DNA, 20 bp, Artificial Sequence
  Synthetic oligonucleotide; GAG chr11 5263472 5263491 5263488 +
ccctaaatgtcgatgtcaaa

SEQ ID NO: 13023 - DNA, 20 bp, Artificial Sequence
  Synthetic oligonucleotide; AAG chr11 5263480 5263499 5263496 +
gtcgatgtcaaagagtctga

SEQ ID NO: 13024 - DNA, 20 bp, Artificial Sequence
  Synthetic oligonucleotide; GAG chr11 5263482 5263501 5263498 +
cgatgtcaaagagtctgaaa

SEQ ID NO: 13025 - DNA, 20 bp, Artificial Sequence
  Synthetic oligonucleotide; AGG chr11 5263483 5263502 5263499 +
gatgtcaaagagtctgaaag

SEQ ID NO: 13026 - DNA, 20 bp, Artificial Sequence
  Synthetic oligonucleotide; CAG chr11 5263487 5263506 5263503 +
tcaaagagtctgaaagagga

SEQ ID NO: 13027 - DNA, 20 bp, Artificial Sequence
  Synthetic oligonucleotide; CAG chr11 5263491 5263510 5263507 +
agagtctgaaagaggacaga

SEQ ID NO: 13028 - DNA, 20 bp, Artificial Sequence
  Synthetic oligonucleotide; AAG chr11 5263501 5263520 5263517 +
agaggacagacagacaatat

SEQ ID NO: 13029 - DNA, 20 bp, Artificial Sequence
  Synthetic oligonucleotide; AGG chr11 5263502 5263521 5263518 +
gaggacagacagacaatata

SEQ ID NO: 13030 - DNA, 20 bp, Artificial Sequence
  Synthetic oligonucleotide; AAG chr11 5263514 5263533 5263530 +
acaatataaggtcacaccac

SEQ ID NO: 13031 - DNA, 20 bp, Artificial Sequence
  Synthetic oligonucleotide; TAG chr11 5263521 5263540 5263537 +
aaggtcacaccacaagaaac

SEQ ID NO: 13032 - DNA, 20 bp, Artificial Sequence
  Synthetic oligonucleotide; GAG chr11 5263523 5263542 5263539 +
ggtcacaccacaagaaacta

SEQ ID NO: 13033 - DNA, 20 bp, Artificial Sequence
  Synthetic oligonucleotide; CAG chr11 5263539 5263558 5263555 +
actagagaaacaaaaacaaa

SEQ ID NO: 13034 - DNA, 20 bp, Artificial Sequence
  Synthetic oligonucleotide; CAG chr11 5263552 5263571 5263568 +
aaacaaacagaaccaaaacc

SEQ ID NO: 13035 - DNA, 20 bp, Artificial Sequence
  Synthetic oligonucleotide; AAG chr11 5263558 5263577 5263574 +
acagaaccaaaacccagcaa

SEQ ID NO: 13036 - DNA, 20 bp, Artificial Sequence
  Synthetic oligonucleotide; AAG chr11 5263562 5263581 5263578 +
aaccaaaacccagcaaaaga

SEQ ID NO: 13037 - DNA, 20 bp, Artificial Sequence
  Synthetic oligonucleotide; AGG chr11 5263563 5263582 5263579 +
accaaaacccagcaaaagaa

SEQ ID NO: 13038 - DNA, 20 bp, Artificial Sequence
  Synthetic oligonucleotide; GGG chr11 5263564 5263583 5263580 +
ccaaaacccagcaaaagaaa

SEQ ID NO: 13039 - DNA, 20 bp, Artificial Sequence
  Synthetic oligonucleotide; AAG chr11 5263574 5263593 5263590 +
gcaaaagaaagggaataact

SEQ ID NO: 13040 - DNA, 20 bp, Artificial Sequence
  Synthetic oligonucleotide; AAG chr11 5263579 5263598 5263595 +
agaaagggaataactaagat

SEQ ID NO: 13041 - DNA, 20 bp, Artificial Sequence
  Synthetic oligonucleotide; GAG chr11 5263581 5263600 5263597 +
aaagggaataactaagataa

SEQ ID NO: 13042 - DNA, 20 bp, Artificial Sequence
  Synthetic oligonucleotide; AGG chr11 5263582 5263601 5263598 +
aagggaataactaagataag

SEQ ID NO: 13043 - DNA, 20 bp, Artificial Sequence
  Synthetic oligonucleotide; GAG chr11 5263584 5263603 5263600 +
gggaataactaagataagag

SEQ ID NO: 13044 - DNA, 20 bp, Artificial Sequence
  Synthetic oligonucleotide; AAG chr11 5263624 5263643 5263640 +
acaactgcaaaaaaatacaa

SEQ ID NO: 13045 - DNA, 20 bp, Artificial Sequence
  Synthetic oligonucleotide; AAG chr11 5263641 5263660 5263657 +
caaaagctaaatgaaataaa

SEQ ID NO: 13046 - DNA, 20 bp, Artificial Sequence
  Synthetic oligonucleotide; TGG chr11 5263645 5263664 5263661 +
agctaaatgaaataaaaagc

SEQ ID NO: 13047 - DNA, 20 bp, Artificial Sequence
  Synthetic oligonucleotide; AAG chr11 5263657 5263676 5263673 +
taaaaagctggttctttgaa

SEQ ID NO: 13048 - DNA, 20 bp, Artificial Sequence
  Synthetic oligonucleotide; TAG chr11 5263674 5263693 5263690 +
gaaaagataaataaaactga

SEQ ID NO: 13049 - DNA, 20 bp, Artificial Sequence
  Synthetic oligonucleotide; TAG chr11 5263682 5263701 5263698 +
aaataaaactgatagaccat

SEQ ID NO: 13050 - DNA, 20 bp, Artificial Sequence
  Synthetic oligonucleotide; AAG chr11 5263686 5263705 5263702 +
aaaactgatagaccattagc

SEQ ID NO: 13051 - DNA, 20 bp, Artificial Sequence
  Synthetic oligonucleotide; AAG chr11 5263696 5263715 5263712 +
gaccattagcaagattaacc

SEQ ID NO: 13052 - DNA, 20 bp, Artificial Sequence
  Synthetic oligonucleotide; AAG chr11 5263701 5263720 5263717 +
ttagcaagattaaccaagaa

SEQ ID NO: 13053 - DNA, 20 bp, Artificial Sequence
  Synthetic oligonucleotide; GAG chr11 5263703 5263722 5263719 +
agcaagattaaccaagaaaa

SEQ ID NO: 13054 - DNA, 20 bp, Artificial Sequence
  Synthetic oligonucleotide; AGG chr11 5263704 5263723 5263720 +
gcaagattaaccaagaaaag

SEQ ID NO: 13055 - DNA, 20 bp, Artificial Sequence
  Synthetic oligonucleotide; GAG chr11 5263706 5263725 5263722 +
aagattaaccaagaaaagag

SEQ ID NO: 13056 - DNA, 20 bp, Artificial Sequence
  Synthetic oligonucleotide; GAG chr11 5263708 5263727 5263724 +
gattaaccaagaaaagagga

SEQ ID NO: 13057 - DNA, 20 bp, Artificial Sequence
  Synthetic oligonucleotide; AAG chr11 5263711 5263730 5263727 +
taaccaagaaaagaggagag

SEQ ID NO: 13058 - DNA, 20 bp, Artificial Sequence
  Synthetic oligonucleotide; TAG chr11 5263730 5263749 5263746 +
gaagtgcaaataaactcaat

SEQ ID NO: 13059 - DNA, 20 bp, Artificial Sequence
  Synthetic oligonucleotide; CAG chr11 5263741 5263760 5263757 +
aaactcaattagaaacaaaa

SEQ ID NO: 13060 - DNA, 20 bp, Artificial Sequence
  Synthetic oligonucleotide; AGG chr11 5263742 5263761 5263758 +
aactcaattagaaacaaaac

SEQ ID NO: 13061 - DNA, 20 bp, Artificial Sequence
  Synthetic oligonucleotide; GAG chr11 5263744 5263763 5263760 +
ctcaattagaaacaaaacag

SEQ ID NO: 13062 - DNA, 20 bp, Artificial Sequence
  Synthetic oligonucleotide; CAG chr11 5263765 5263784 5263781 +
agatactattactgatacca

SEQ ID NO: 13063 - DNA, 20 bp, Artificial Sequence
  Synthetic oligonucleotide; AAG chr11 5263776 5263795 5263792 +
ctgataccacagaaatacaa

SEQ ID NO: 13064 - DNA, 20 bp, Artificial Sequence
  Synthetic oligonucleotide; AAG chr11 5263786 5263805 5263802 +
agaaatacaaaagattattc

SEQ ID NO: 13065 - DNA, 20 bp, Artificial Sequence
  Synthetic oligonucleotide; AGG chr11 5263787 5263806 5263803 +
gaaatacaaaagattattca

SEQ ID NO: 13066 - DNA, 20 bp, Artificial Sequence
  Synthetic oligonucleotide; TAG chr11 5263819 5263838 5263835 +
acacctttacatgcataaac

SEQ ID NO: 13067 - DNA, 20 bp, Artificial Sequence
  Synthetic oligonucleotide; AAG chr11 5263830 5263849 5263846 +
tgcataaactagaaaaccta

SEQ ID NO: 13068 - DNA, 20 bp, Artificial Sequence
  Synthetic oligonucleotide; AGG chr11 5263831 5263850 5263847 +
gcataaactagaaaacctaa

SEQ ID NO: 13069 - DNA, 20 bp, Artificial Sequence
  Synthetic oligonucleotide; GAG chr11 5263833 5263852 5263849 +
ataaactagaaaacctaaag

SEQ ID NO: 13070 - DNA, 20 bp, Artificial Sequence
  Synthetic oligonucleotide; TGG chr11 5263849 5263868 5263865 +
aaaggagacgttcgaattcc

SEQ ID NO: 13071 - DNA, 20 bp, Artificial Sequence
  Synthetic oligonucleotide; AAG chr11 5263853 5263872 5263869 +
gagacgttcgaattcctgga

SEQ ID NO: 13072 - DNA, 20 bp, Artificial Sequence
  Synthetic oligonucleotide; CAG chr11 5263859 5263878 5263875 +
ttcgaattcctggaaagata

SEQ ID NO: 13073 - DNA, 20 bp, Artificial Sequence
  Synthetic oligonucleotide; AGG chr11 5263860 5263879 5263876 +
tcgaattcctggaaagatac

SEQ ID NO: 13074 - DNA, 20 bp, Artificial Sequence
  Synthetic oligonucleotide; GGG chr11 5263861 5263880 5263877 +
cgaattcctggaaagataca

SEQ ID NO: 13075 - DNA, 20 bp, Artificial Sequence
  Synthetic oligonucleotide; TAG chr11 5263867 5263886 5263883 +
cctggaaagatacagggctc

SEQ ID NO: 13076 - DNA, 20 bp, Artificial Sequence
  Synthetic oligonucleotide; AAG chr11 5263873 5263892 5263889 +
aagatacagggctctagctt

SEQ ID NO: 13077 - DNA, 20 bp, Artificial Sequence
  Synthetic oligonucleotide; CAG chr11 5263877 5263896 5263893 +
tacagggctctagcttaagt

SEQ ID NO: 13078 - DNA, 20 bp, Artificial Sequence
  Synthetic oligonucleotide; AGG chr11 5263878 5263897 5263894 +
acagggctctagcttaagtc

SEQ ID NO: 13079 - DNA, 20 bp, Artificial Sequence
  Synthetic oligonucleotide; AAG chr11 5263881 5263900 5263897 +
gggctctagcttaagtcagg

SEQ ID NO: 13080 - DNA, 20 bp, Artificial Sequence
  Synthetic oligonucleotide; TAG chr11 5263887 5263906 5263903 +
tagcttaagtcaggaagaat

SEQ ID NO: 13081 - DNA, 20 bp, Artificial Sequence
  Synthetic oligonucleotide; CAG chr11 5263900 5263919 5263916 +
gaagaattagataccctgaa

SEQ ID NO: 13082 - DNA, 20 bp, Artificial Sequence
  Synthetic oligonucleotide; CAG chr11 5263905 5263924 5263921 +
attagataccctgaacagac

SEQ ID NO: 13083 - DNA, 20 bp, Artificial Sequence
  Synthetic oligonucleotide; AAG chr11 5263912 5263931 5263928 +
accctgaacagaccagtaat

SEQ ID NO: 13084 - DNA, 20 bp, Artificial Sequence
  Synthetic oligonucleotide; CAG chr11 5263915 5263934 5263931 +
ctgaacagaccagtaataag

SEQ ID NO: 13085 - DNA, 20 bp, Artificial Sequence
  Synthetic oligonucleotide; AAG chr11 5263919 5263938 5263935 +
acagaccagtaataagcagc

SEQ ID NO: 13086 - DNA, 20 bp, Artificial Sequence
  Synthetic oligonucleotide; AAG chr11 5263957 5263976 5263973 +
aaaatttaccaacaacaaaa

SEQ ID NO: 13087 - DNA, 20 bp, Artificial Sequence
  Synthetic oligonucleotide; CAG chr11 5263962 5263981 5263978 +
ttaccaacaacaaaaaagtc

SEQ ID NO: 13088 - DNA, 20 bp, Artificial Sequence
  Synthetic oligonucleotide; AGG chr11 5263963 5263982 5263979 +
taccaacaacaaaaaagtcc

SEQ ID NO: 13089 - DNA, 20 bp, Artificial Sequence
  Synthetic oligonucleotide; CAG chr11 5263968 5263987 5263984 +
acaacaaaaaagtccaggac

SEQ ID NO: 13090 - DNA, 20 bp, Artificial Sequence
  Synthetic oligonucleotide; TAG chr11 5263972 5263991 5263988 +
caaaaaagtccaggaccaga

SEQ ID NO: 13091 - DNA, 20 bp, Artificial Sequence
  Synthetic oligonucleotide; CAG chr11 5263980 5263999 5263996 +
tccaggaccagatagattca

SEQ ID NO: 13092 - DNA, 20 bp, Artificial Sequence
  Synthetic oligonucleotide; CAG chr11 5263994 5264013 5264010 +
gattcacagctgaattctac

SEQ ID NO: 13093 - DNA, 20 bp, Artificial Sequence
  Synthetic oligonucleotide; AAG chr11 5264004 5264023 5264020 +
tgaattctaccagacattca

SEQ ID NO: 13094 - DNA, 20 bp, Artificial Sequence
  Synthetic oligonucleotide; AAG chr11 5264007 5264026 5264023 +
attctaccagacattcaaag

SEQ ID NO: 13095 - DNA, 20 bp, Artificial Sequence
  Synthetic oligonucleotide; CAG chr11 5264031 5264050 5264047 +
attgataccaatcctattga

SEQ ID NO: 13096 - DNA, 20 bp, Artificial Sequence
  Synthetic oligonucleotide; AAG chr11 5264042 5264061 5264058 +
tcctattgacagtattctac

SEQ ID NO: 13097 - DNA, 20 bp, Artificial Sequence
  Synthetic oligonucleotide; TAG chr11 5264046 5264065 5264062 +
attgacagtattctacaaga

SEQ ID NO: 13098 - DNA, 20 bp, Artificial Sequence
  Synthetic oligonucleotide; GAG chr11 5264048 5264067 5264064 +
tgacagtattctacaagata

SEQ ID NO: 13099 - DNA, 20 bp, Artificial Sequence
  Synthetic oligonucleotide; AAG chr11 5264052 5264071 5264068 +
agtattctacaagatagaga

SEQ ID NO: 13100 - DNA, 20 bp, Artificial Sequence
  Synthetic oligonucleotide; GAG chr11 5264054 5264073 5264070 +
tattctacaagatagagaaa

SEQ ID NO: 13101 - DNA, 20 bp, Artificial Sequence
  Synthetic oligonucleotide; GAG chr11 5264056 5264075 5264072 +
ttctacaagatagagaaaga

SEQ ID NO: 13102 - DNA, 20 bp, Artificial Sequence
  Synthetic oligonucleotide; AAG chr11 5264082 5264101 5264098 +
cctccctaaatcattctatg

SEQ ID NO: 13103 - DNA, 20 bp, Artificial Sequence
  Synthetic oligonucleotide; CAG chr11 5264086 5264105 5264102 +
cctaaatcattctatgaagc

SEQ ID NO: 13104 - DNA, 20 bp, Artificial Sequence
  Synthetic oligonucleotide; TGG chr11 5264109 5264128 5264125 +
tatcaccttaataccaaaac

SEQ ID NO: 13105 - DNA, 20 bp, Artificial Sequence
  Synthetic oligonucleotide; GGG chr11 5264110 5264129 5264126 +
atcaccttaataccaaaact

SEQ ID NO: 13106 - DNA, 20 bp, Artificial Sequence
  Synthetic oligonucleotide; AAG chr11 5264114 5264133 5264130 +
ccttaataccaaaactggga

SEQ ID NO: 13107 - DNA, 20 bp, Artificial Sequence
  Synthetic oligonucleotide; CAG chr11 5264143 5264162 5264159 +
accaaaaaaaaaaaacacta

SEQ ID NO: 13108 - DNA, 20 bp, Artificial Sequence
  Synthetic oligonucleotide; TAG chr11 5264166 5264185 5264182 +
atcaatatccctgatgaaca

SEQ ID NO: 13109 - DNA, 20 bp, Artificial Sequence
  Synthetic oligonucleotide; TAG chr11 5264193 5264212 5264209 +
caacatccttgacaaaatac

SEQ ID NO: 13110 - DNA, 20 bp, Artificial Sequence
  Synthetic oligonucleotide; TAG chr11 5264200 5264219 5264216 +
cttgacaaaatactagctaa

SEQ ID NO: 13111 - DNA, 20 bp, Artificial Sequence
  Synthetic oligonucleotide; CAG chr11 5264210 5264229 5264226 +
tactagctaatagcatccga

SEQ ID NO: 13112 - DNA, 20 bp, Artificial Sequence
  Synthetic oligonucleotide; AAG chr11 5264232 5264251 5264248 +
gcatatcaaaacccatgatc

SEQ ID NO: 13113 - DNA, 20 bp, Artificial Sequence
  Synthetic oligonucleotide; TGG chr11 5264235 5264254 5264251 +
tatcaaaacccatgatcaag

SEQ ID NO: 13114 - DNA, 20 bp, Artificial Sequence
  Synthetic oligonucleotide; GGG chr11 5264236 5264255 5264252 +
atcaaaacccatgatcaagt

SEQ ID NO: 13115 - DNA, 20 bp, Artificial Sequence
  Synthetic oligonucleotide; GAG chr11 5264247 5264266 5264263 +
tgatcaagtgggtttcatgc

SEQ ID NO: 13116 - DNA, 20 bp, Artificial Sequence
  Synthetic oligonucleotide; AGG chr11 5264248 5264267 5264264 +
gatcaagtgggtttcatgcg

SEQ ID NO: 13117 - DNA, 20 bp, Artificial Sequence
  Synthetic oligonucleotide; GGG chr11 5264249 5264268 5264265 +
atcaagtgggtttcatgcga

SEQ ID NO: 13118 - DNA, 20 bp, Artificial Sequence
  Synthetic oligonucleotide; CGG chr11 5264257 5264276 5264273 +
ggtttcatgcgagggatgca

SEQ ID NO: 13119 - DNA, 20 bp, Artificial Sequence
  Synthetic oligonucleotide; TGG chr11 5264261 5264280 5264277 +
tcatgcgagggatgcacgga

SEQ ID NO: 13120 - DNA, 20 bp, Artificial Sequence
  Synthetic oligonucleotide; AAG chr11 5264276 5264295 5264292 +
acggatggtttaacatacgc

SEQ ID NO: 13121 - DNA, 20 bp, Artificial Sequence
  Synthetic oligonucleotide; AAG chr11 5264284 5264303 5264300 +
tttaacatacgcaagtcaat

SEQ ID NO: 13122 - DNA, 20 bp, Artificial Sequence
  Synthetic oligonucleotide; AAG chr11 5264303 5264322 5264319 +
taagtgtgatacacaacata

SEQ ID NO: 13123 - DNA, 20 bp, Artificial Sequence
  Synthetic oligonucleotide; GAG chr11 5264305 5264324 5264321 +
agtgtgatacacaacataaa

SEQ ID NO: 13124 - DNA, 20 bp, Artificial Sequence
  Synthetic oligonucleotide; TGG chr11 5264311 5264330 5264327 +
atacacaacataaagagaat

SEQ ID NO: 13125 - DNA, 20 bp, Artificial Sequence
  Synthetic oligonucleotide; TAG chr11 5264340 5264359 5264356 +
aaatcatgtgattatctcaa

SEQ ID NO: 13126 - DNA, 20 bp, Artificial Sequence
  Synthetic oligonucleotide; CAG chr11 5264346 5264365 5264362 +
tgtgattatctcaatagcca

SEQ ID NO: 13127 - DNA, 20 bp, Artificial Sequence
  Synthetic oligonucleotide; CAG chr11 5264393 5264412 5264409 +
atcactttatgactaaaact

SEQ ID NO: 13128 - DNA, 20 bp, Artificial Sequence
  Synthetic oligonucleotide; CGG chr11 5264402 5264421 5264418 +
tgactaaaactcagcaaaat

SEQ ID NO: 13129 - DNA, 20 bp, Artificial Sequence
  Synthetic oligonucleotide; AAG chr11 5264411 5264430 5264427 +
ctcagcaaaatcggtttaca

SEQ ID NO: 13130 - DNA, 20 bp, Artificial Sequence
  Synthetic oligonucleotide; AGG chr11 5264412 5264431 5264428 +
tcagcaaaatcggtttacaa

SEQ ID NO: 13131 - DNA, 20 bp, Artificial Sequence
  Synthetic oligonucleotide; AAG chr11 5264434 5264453 5264450 +
gacatacctcaatgtaataa

SEQ ID NO: 13132 - DNA, 20 bp, Artificial Sequence
  Synthetic oligonucleotide; CAG chr11 5264438 5264457 5264454 +
tacctcaatgtaataaaagc

SEQ ID NO: 13133 - DNA, 20 bp, Artificial Sequence
  Synthetic oligonucleotide; TGG chr11 5264444 5264463 5264460 +
aatgtaataaaagccagcta

SEQ ID NO: 13134 - DNA, 20 bp, Artificial Sequence
  Synthetic oligonucleotide; CAG chr11 5264455 5264474 5264471 +
agccagctatggtaaacaca

SEQ ID NO: 13135 - DNA, 20 bp, Artificial Sequence
  Synthetic oligonucleotide; TGG chr11 5264474 5264493 5264490 +
acagccaacattatattgaa

SEQ ID NO: 13136 - DNA, 20 bp, Artificial Sequence
  Synthetic oligonucleotide; GGG chr11 5264475 5264494 5264491 +
cagccaacattatattgaat

SEQ ID NO: 13137 - DNA, 20 bp, Artificial Sequence
  Synthetic oligonucleotide; AAG chr11 5264481 5264500 5264497 +
acattatattgaatgggaaa

SEQ ID NO: 13138 - DNA, 20 bp, Artificial Sequence
  Synthetic oligonucleotide; AAG chr11 5264488 5264507 5264504 +
attgaatgggaaaaagttaa

SEQ ID NO: 13139 - DNA, 20 bp, Artificial Sequence
  Synthetic oligonucleotide; TGG chr11 5264507 5264526 5264523 +
aaagcattctgtctgaaaac

SEQ ID NO: 13140 - DNA, 20 bp, Artificial Sequence
  Synthetic oligonucleotide; GAG chr11 5264513 5264532 5264529 +
ttctgtctgaaaactggaat

SEQ ID NO: 13141 - DNA, 20 bp, Artificial Sequence
  Synthetic oligonucleotide; AAG chr11 5264518 5264537 5264534 +
tctgaaaactggaatgagac

SEQ ID NO: 13142 - DNA, 20 bp, Artificial Sequence
  Synthetic oligonucleotide; AGG chr11 5264519 5264538 5264535 +
ctgaaaactggaatgagaca

SEQ ID NO: 13143 - DNA, 20 bp, Artificial Sequence
  Synthetic oligonucleotide; TGG chr11 5264557 5264576 5264573 +
acttctctttaacatattac

SEQ ID NO: 13144 - DNA, 20 bp, Artificial Sequence
  Synthetic oligonucleotide; AAG chr11 5264560 5264579 5264576 +
tctctttaacatattactgg

SEQ ID NO: 13145 - DNA, 20 bp, Artificial Sequence
  Synthetic oligonucleotide; TAG chr11 5264566 5264585 5264582 +
taacatattactggaagtcc

SEQ ID NO: 13146 - DNA, 20 bp, Artificial Sequence
  Synthetic oligonucleotide; AAG chr11 5264570 5264589 5264586 +
atattactggaagtcctagc

SEQ ID NO: 13147 - DNA, 20 bp, Artificial Sequence
  Synthetic oligonucleotide; GAG chr11 5264572 5264591 5264588 +
attactggaagtcctagcaa

SEQ ID NO: 13148 - DNA, 20 bp, Artificial Sequence
  Synthetic oligonucleotide; CAG chr11 5264579 5264598 5264595 +
gaagtcctagcaagagcaat

SEQ ID NO: 13149 - DNA, 20 bp, Artificial Sequence
  Synthetic oligonucleotide; AAG chr11 5264584 5264603 5264600 +
cctagcaagagcaatcagac

SEQ ID NO: 13150 - DNA, 20 bp, Artificial Sequence
  Synthetic oligonucleotide; GAG chr11 5264586 5264605 5264602 +
tagcaagagcaatcagacaa

SEQ ID NO: 13151 - DNA, 20 bp, Artificial Sequence
  Synthetic oligonucleotide; AAG chr11 5264593 5264612 5264609 +
agcaatcagacaagagaaac

SEQ ID NO: 13152 - DNA, 20 bp, Artificial Sequence
  Synthetic oligonucleotide; AAG chr11 5264598 5264617 5264614 +
tcagacaagagaaacaagta

SEQ ID NO: 13153 - DNA, 20 bp, Artificial Sequence
  Synthetic oligonucleotide; AAG chr11 5264617 5264636 5264633 +
aaagcacatccaaattgtta

SEQ ID NO: 13154 - DNA, 20 bp, Artificial Sequence
  Synthetic oligonucleotide; GAG chr11 5264619 5264638 5264635 +
agcacatccaaattgttaaa

SEQ ID NO: 13155 - DNA, 20 bp, Artificial Sequence
  Synthetic oligonucleotide; AAG chr11 5264623 5264642 5264639 +
catccaaattgttaaagaga

SEQ ID NO: 13156 - DNA, 20 bp, Artificial Sequence
  Synthetic oligonucleotide; TAG chr11 5264665 5264684 5264681 +
tgatgatatgattgtgtatg

SEQ ID NO: 13157 - DNA, 20 bp, Artificial Sequence
  Synthetic oligonucleotide; AAG chr11 5264677 5264696 5264693 +
tgtgtatgtagaaaactcta

SEQ ID NO: 13158 - DNA, 20 bp, Artificial Sequence
  Synthetic oligonucleotide; TAG chr11 5264697 5264716 5264713 +
aagactcctccaaaaccccc

SEQ ID NO: 13159 - DNA, 20 bp, Artificial Sequence
  Synthetic oligonucleotide; CAG chr11 5264716 5264735 5264732 +
ctagaactgataaaataatt

SEQ ID NO: 13160 - DNA, 20 bp, Artificial Sequence
  Synthetic oligonucleotide; AAG chr11 5264721 5264740 5264737 +
actgataaaataattcagca

SEQ ID NO: 13161 - DNA, 20 bp, Artificial Sequence
  Synthetic oligonucleotide; TGG chr11 5264728 5264747 5264744 +
aaataattcagcaaagtttc

SEQ ID NO: 13162 - DNA, 20 bp, Artificial Sequence
  Synthetic oligonucleotide; GAG chr11 5264754 5264773 5264770 +
caaaattaacgtacaccaat

SEQ ID NO: 13163 - DNA, 20 bp, Artificial Sequence
  Synthetic oligonucleotide; CAG chr11 5264773 5264792 5264789 +
tgagttgctttcttacatac

SEQ ID NO: 13164 - DNA, 20 bp, Artificial Sequence
  Synthetic oligonucleotide; AAG chr11 5264784 5264803 5264800 +
cttacataccagcaatgacc

SEQ ID NO: 13165 - DNA, 20 bp, Artificial Sequence
  Synthetic oligonucleotide; GAG chr11 5264789 5264808 5264805 +
ataccagcaatgaccaagct

SEQ ID NO: 13166 - DNA, 20 bp, Artificial Sequence
  Synthetic oligonucleotide; AAG chr11 5264801 5264820 5264817 +
accaagctgagaataaaatc

SEQ ID NO: 13167 - DNA, 20 bp, Artificial Sequence
  Synthetic oligonucleotide; TAG chr11 5264823 5264842 5264839 +
gaactcaaccccttttacaa

SEQ ID NO: 13168 - DNA, 20 bp, Artificial Sequence
  Synthetic oligonucleotide; TAG chr11 5264859 5264878 5264875 +
aacaaaacaaaacaaaaact

SEQ ID NO: 13169 - DNA, 20 bp, Artificial Sequence
  Synthetic oligonucleotide; AGG chr11 5264860 5264879 5264876 +
acaaaacaaaacaaaaactt

SEQ ID NO: 13170 - DNA, 20 bp, Artificial Sequence
  Synthetic oligonucleotide; AAG chr11 5264878 5264897 5264894 +
ttaggaatatatacctaacc

SEQ ID NO: 13171 - DNA, 20 bp, Artificial Sequence
  Synthetic oligonucleotide; AGG chr11 5264879 5264898 5264895 +
taggaatatatacctaacca

SEQ ID NO: 13172 - DNA, 20 bp, Artificial Sequence
  Synthetic oligonucleotide; GAG chr11 5264881 5264900 5264897 +
ggaatatatacctaaccaag

SEQ ID NO: 13173 - DNA, 20 bp, Artificial Sequence
  Synthetic oligonucleotide; AGG chr11 5264882 5264901 5264898 +
gaatatatacctaaccaagg

SEQ ID NO: 13174 - DNA, 20 bp, Artificial Sequence
  Synthetic oligonucleotide; AAG chr11 5264888 5264907 5264904 +
atacctaaccaaggaggtga

SEQ ID NO: 13175 - DNA, 20 bp, Artificial Sequence
  Synthetic oligonucleotide; AAG chr11 5264899 5264918 5264915 +
aggaggtgaaagacatctac

SEQ ID NO: 13176 - DNA, 20 bp, Artificial Sequence
  Synthetic oligonucleotide; AGG chr11 5264900 5264919 5264916 +
ggaggtgaaagacatctaca

SEQ ID NO: 13177 - DNA, 20 bp, Artificial Sequence
  Synthetic oligonucleotide; CGG chr11 5264917 5264936 5264933 +
acaaggaaaactacaaaaca

SEQ ID NO: 13178 - DNA, 20 bp, Artificial Sequence
  Synthetic oligonucleotide; AAG chr11 5264924 5264943 5264940 +
aaactacaaaacacggctga

SEQ ID NO: 13179 - DNA, 20 bp, Artificial Sequence
  Synthetic oligonucleotide; AAG chr11 5264936 5264955 5264952 +
acggctgaaagtaatcatat

SEQ ID NO: 13180 - DNA, 20 bp, Artificial Sequence
  Synthetic oligonucleotide; TGG chr11 5264950 5264969 5264966 +
tcatataagacacaaacaaa

SEQ ID NO: 13181 - DNA, 20 bp, Artificial Sequence
  Synthetic oligonucleotide; TAG chr11 5264971 5264990 5264987 +
ggaaacacatgccattctca

SEQ ID NO: 13182 - DNA, 20 bp, Artificial Sequence
  Synthetic oligonucleotide; TGG chr11 5264975 5264994 5264991 +
acacatgccattctcataga

SEQ ID NO: 13183 - DNA, 20 bp, Artificial Sequence
  Synthetic oligonucleotide; GGG chr11 5264976 5264995 5264992 +
cacatgccattctcatagat

SEQ ID NO: 13184 - DNA, 20 bp, Artificial Sequence
  Synthetic oligonucleotide; TAG chr11 5264979 5264998 5264995 +
atgccattctcatagatggg

SEQ ID NO: 13185 - DNA, 20 bp, Artificial Sequence
  Synthetic oligonucleotide; TGG chr11 5264999 5265018 5265015 +
tagaatcaatattgtgaaaa

SEQ ID NO: 13186 - DNA, 20 bp, Artificial Sequence
  Synthetic oligonucleotide; CAG chr11 5265011 5265030 5265027 +
tgtgaaaatggccataatgc

SEQ ID NO: 13187 - DNA, 20 bp, Artificial Sequence
  Synthetic oligonucleotide; AAG chr11 5265014 5265033 5265030 +
gaaaatggccataatgccag

SEQ ID NO: 13188 - DNA, 20 bp, Artificial Sequence
  Synthetic oligonucleotide; TAG chr11 5265059 5265078 5265075 +
tcccatcaaaataccaccat

SEQ ID NO: 13189 - DNA, 20 bp, Artificial Sequence
  Synthetic oligonucleotide; CAG chr11 5265068 5265087 5265084 +
aataccaccattagtcttca

SEQ ID NO: 13190 - DNA, 20 bp, Artificial Sequence
  Synthetic oligonucleotide; TAG chr11 5265074 5265093 5265090 +
accattagtcttcacagaac

SEQ ID NO: 13191 - DNA, 20 bp, Artificial Sequence
  Synthetic oligonucleotide; TGG chr11 5265100 5265119 5265116 +
aaacaatcctaaaattctta

SEQ ID NO: 13192 - DNA, 20 bp, Artificial Sequence
  Synthetic oligonucleotide; AAG chr11 5265111 5265130 5265127 +
aaattcttatggaaccaaaa

SEQ ID NO: 13193 - DNA, 20 bp, Artificial Sequence
  Synthetic oligonucleotide; GAG chr11 5265113 5265132 5265129 +
attcttatggaaccaaaaaa

SEQ ID NO: 13194 - DNA, 20 bp, Artificial Sequence
  Synthetic oligonucleotide; AAG chr11 5265126 5265145 5265142 +
caaaaaagagcccaataaac

SEQ ID NO: 13195 - DNA, 20 bp, Artificial Sequence
  Synthetic oligonucleotide; AAG chr11 5265130 5265149 5265146 +
aaagagcccaataaacaagc

SEQ ID NO: 13196 - DNA, 20 bp, Artificial Sequence
  Synthetic oligonucleotide; AAG chr11 5265142 5265161 5265158 +
aaacaagcaagtctaaaaaa

SEQ ID NO: 13197 - DNA, 20 bp, Artificial Sequence
  Synthetic oligonucleotide; AAG chr11 5265155 5265174 5265171 +
taaaaaaaagaacaaatctg

SEQ ID NO: 13198 - DNA, 20 bp, Artificial Sequence
  Synthetic oligonucleotide; AGG chr11 5265156 5265175 5265172 +
aaaaaaaagaacaaatctga

SEQ ID NO: 13199 - DNA, 20 bp, Artificial Sequence
  Synthetic oligonucleotide; AAG chr11 5265190 5265209 5265206 +
ctcatttcaaactatacaat

SEQ ID NO: 13200 - DNA, 20 bp, Artificial Sequence
  Synthetic oligonucleotide; AGG chr11 5265191 5265210 5265207 +
tcatttcaaactatacaata

SEQ ID NO: 13201 - DNA, 20 bp, Artificial Sequence
  Synthetic oligonucleotide; TAG chr11 5265197 5265216 5265213 +
caaactatacaataaggcca

SEQ ID NO: 13202 - DNA, 20 bp, Artificial Sequence
  Synthetic oligonucleotide; CAG chr11 5265209 5265228 5265225 +
taaggccatagtcaccaaaa

SEQ ID NO: 13203 - DNA, 20 bp, Artificial Sequence
  Synthetic oligonucleotide; TGG chr11 5265220 5265239 5265236 +
tcaccaaaacagcatgatgc

SEQ ID NO: 13204 - DNA, 20 bp, Artificial Sequence
  Synthetic oligonucleotide; TAG chr11 5265231 5265250 5265247 +
gcatgatgctggtgtacaaa

SEQ ID NO: 13205 - DNA, 20 bp, Artificial Sequence
  Synthetic oligonucleotide; AGG chr11 5265232 5265251 5265248 +
catgatgctggtgtacaaat

SEQ ID NO: 13206 - DNA, 20 bp, Artificial Sequence
  Synthetic oligonucleotide; TGG chr11 5265247 5265266 5265263 +
caaataggcacatcgaccaa

SEQ ID NO: 13207 - DNA, 20 bp, Artificial Sequence
  Synthetic oligonucleotide; CAG chr11 5265252 5265271 5265268 +
aggcacatcgaccaatggaa

SEQ ID NO: 13208 - DNA, 20 bp, Artificial Sequence
  Synthetic oligonucleotide; TAG chr11 5265257 5265276 5265273 +
catcgaccaatggaacagaa

SEQ ID NO: 13209 - DNA, 20 bp, Artificial Sequence
  Synthetic oligonucleotide; GAG chr11 5265259 5265278 5265275 +
tcgaccaatggaacagaata

SEQ ID NO: 13210 - DNA, 20 bp, Artificial Sequence
  Synthetic oligonucleotide; CAG chr11 5265266 5265285 5265282 +
atggaacagaatagagaacc

SEQ ID NO: 13211 - DNA, 20 bp, Artificial Sequence
  Synthetic oligonucleotide; AAG chr11 5265308 5265327 5265324 +
catccaactgatctttgaca

SEQ ID NO: 13212 - DNA, 20 bp, Artificial Sequence
  Synthetic oligonucleotide; AAG chr11 5265325 5265344 5265341 +
acaaagcaaacaaaaacata

SEQ ID NO: 13213 - DNA, 20 bp, Artificial Sequence
  Synthetic oligonucleotide; TGG chr11 5265328 5265347 5265344 +
aagcaaacaaaaacataaag

SEQ ID NO: 13214 - DNA, 20 bp, Artificial Sequence
  Synthetic oligonucleotide; GGG chr11 5265329 5265348 5265345 +
agcaaacaaaaacataaagt

SEQ ID NO: 13215 - DNA, 20 bp, Artificial Sequence
  Synthetic oligonucleotide; GGG chr11 5265330 5265349 5265346 +
gcaaacaaaaacataaagtg

SEQ ID NO: 13216 - DNA, 20 bp, Artificial Sequence
  Synthetic oligonucleotide; AAG chr11 5265334 5265353 5265350 +
acaaaaacataaagtgggga

SEQ ID NO: 13217 - DNA, 20 bp, Artificial Sequence
  Synthetic oligonucleotide; AGG chr11 5265335 5265354 5265351 +
caaaaacataaagtggggaa

SEQ ID NO: 13218 - DNA, 20 bp, Artificial Sequence
  Synthetic oligonucleotide; GGG chr11 5265336 5265355 5265352 +
aaaaacataaagtggggaaa

SEQ ID NO: 13219 - DNA, 20 bp, Artificial Sequence
  Synthetic oligonucleotide; TGG chr11 5265355 5265374 5265371 +
agggcaccctattcaacaaa

SEQ ID NO: 13220 - DNA, 20 bp, Artificial Sequence
  Synthetic oligonucleotide; CGG chr11 5265360 5265379 5265376 +
accctattcaacaaatggtg

SEQ ID NO: 13221 - DNA, 20 bp, Artificial Sequence
  Synthetic oligonucleotide; GGG chr11 5265361 5265380 5265377 +
ccctattcaacaaatggtgc

SEQ ID NO: 13222 - DNA, 20 bp, Artificial Sequence
  Synthetic oligonucleotide; GGG chr11 5265362 5265381 5265378 +
cctattcaacaaatggtgcg

SEQ ID NO: 13223 - DNA, 20 bp, Artificial Sequence
  Synthetic oligonucleotide; TAG chr11 5265366 5265385 5265382 +
ttcaacaaatggtgcgggga

SEQ ID NO: 13224 - DNA, 20 bp, Artificial Sequence
  Synthetic oligonucleotide; TGG chr11 5265370 5265389 5265386 +
acaaatggtgcggggatagc

SEQ ID NO: 13225 - DNA, 20 bp, Artificial Sequence
  Synthetic oligonucleotide; AAG chr11 5265374 5265393 5265390 +
atggtgcggggatagctggc

SEQ ID NO: 13226 - DNA, 20 bp, Artificial Sequence
  Synthetic oligonucleotide; TAG chr11 5265384 5265403 5265400 +
gatagctggcaagctacatg

SEQ ID NO: 13227 - DNA, 20 bp, Artificial Sequence
  Synthetic oligonucleotide; AGG chr11 5265385 5265404 5265401 +
atagctggcaagctacatgt

SEQ ID NO: 13228 - DNA, 20 bp, Artificial Sequence
  Synthetic oligonucleotide; GAG chr11 5265387 5265406 5265403 +
agctggcaagctacatgtag

SEQ ID NO: 13229 - DNA, 20 bp, Artificial Sequence
  Synthetic oligonucleotide; TGG chr11 5265398 5265417 5265414 +
tacatgtaggagaatgaaac

SEQ ID NO: 13230 - DNA, 20 bp, Artificial Sequence
  Synthetic oligonucleotide; AAG chr11 5265435 5265454 5265451 +
ccttatacaaaaatcaactc

SEQ ID NO: 13231 - DNA, 20 bp, Artificial Sequence
  Synthetic oligonucleotide; TGG chr11 5265439 5265458 5265455 +
atacaaaaatcaactcaaga

SEQ ID NO: 13232 - DNA, 20 bp, Artificial Sequence
  Synthetic oligonucleotide; AAG chr11 5265445 5265464 5265461 +
aaatcaactcaagatggatc

SEQ ID NO: 13233 - DNA, 20 bp, Artificial Sequence
  Synthetic oligonucleotide; AGG chr11 5265446 5265465 5265462 +
aatcaactcaagatggatca

SEQ ID NO: 13234 - DNA, 20 bp, Artificial Sequence
  Synthetic oligonucleotide; AAG chr11 5265459 5265478 5265475 +
tggatcaaggacttaaatct

SEQ ID NO: 13235 - DNA, 20 bp, Artificial Sequence
  Synthetic oligonucleotide; TAG chr11 5265482 5265501 5265498 +
ccctgaaactgtaacaattc

SEQ ID NO: 13236 - DNA, 20 bp, Artificial Sequence
  Synthetic oligonucleotide; CGG chr11 5265495 5265514 5265511 +
acaattctagaaaataacat

SEQ ID NO: 13237 - DNA, 20 bp, Artificial Sequence
  Synthetic oligonucleotide; TGG chr11 5265516 5265535 5265532 +
ggaaaaacccttctacacat

SEQ ID NO: 13238 - DNA, 20 bp, Artificial Sequence
  Synthetic oligonucleotide; TAG chr11 5265521 5265540 5265537 +
aacccttctacacattggct

SEQ ID NO: 13239 - DNA, 20 bp, Artificial Sequence
  Synthetic oligonucleotide; AGG chr11 5265522 5265541 5265538 +
acccttctacacattggctt

SEQ ID NO: 13240 - DNA, 20 bp, Artificial Sequence
  Synthetic oligonucleotide; AAG chr11 5265526 5265545 5265542 +
ttctacacattggcttagga

SEQ ID NO: 13241 - DNA, 20 bp, Artificial Sequence
  Synthetic oligonucleotide; AGG chr11 5265527 5265546 5265543 +
tctacacattggcttaggaa

SEQ ID NO: 13242 - DNA, 20 bp, Artificial Sequence
  Synthetic oligonucleotide; AAG chr11 5265541 5265560 5265557 +
taggaaaggatttcatgacc

SEQ ID NO: 13243 - DNA, 20 bp, Artificial Sequence
  Synthetic oligonucleotide; AAG chr11 5265570 5265589 5265586 +
aatgcaaatacataaaaaca

SEQ ID NO: 13244 - DNA, 20 bp, Artificial Sequence
  Synthetic oligonucleotide; TGG chr11 5265581 5265600 5265597 +
ataaaaacaaagaaaatatc

SEQ ID NO: 13245 - DNA, 20 bp, Artificial Sequence
  Synthetic oligonucleotide; GGG chr11 5265582 5265601 5265598 +
taaaaacaaagaaaatatct

SEQ ID NO: 13246 - DNA, 20 bp, Artificial Sequence
  Synthetic oligonucleotide; AAG chr11 5265599 5265618 5265615 +
tctgggactaaattaaacta

SEQ ID NO: 13247 - DNA, 20 bp, Artificial Sequence
  Synthetic oligonucleotide; GAG chr11 5265601 5265620 5265617 +
tgggactaaattaaactaaa

SEQ ID NO: 13248 - DNA, 20 bp, Artificial Sequence
  Synthetic oligonucleotide; TGG chr11 5265612 5265631 5265628 +
taaactaaagagcttttgca

SEQ ID NO: 13249 - DNA, 20 bp, Artificial Sequence
  Synthetic oligonucleotide; AAG chr11 5265618 5265637 5265634 +
aaagagcttttgcatggcaa

SEQ ID NO: 13250 - DNA, 20 bp, Artificial Sequence
  Synthetic oligonucleotide; AGG chr11 5265619 5265638 5265635 +
aagagcttttgcatggcaaa

SEQ ID NO: 13251 - DNA, 20 bp, Artificial Sequence
  Synthetic oligonucleotide; AAG chr11 5265622 5265641 5265638 +
agcttttgcatggcaaaagg

SEQ ID NO: 13252 - DNA, 20 bp, Artificial Sequence
  Synthetic oligonucleotide; GAG chr11 5265624 5265643 5265640 +
cttttgcatggcaaaaggaa

SEQ ID NO: 13253 - DNA, 20 bp, Artificial Sequence
  Synthetic oligonucleotide; CAG chr11 5265631 5265650 5265647 +
atggcaaaaggaagagtctg

SEQ ID NO: 13254 - DNA, 20 bp, Artificial Sequence
  Synthetic oligonucleotide; CAG chr11 5265640 5265659 5265656 +
ggaagagtctgcagaataaa

SEQ ID NO: 13255 - DNA, 20 bp, Artificial Sequence
  Synthetic oligonucleotide; CAG chr11 5265651 5265670 5265667 +
cagaataaacagacaaccca

SEQ ID NO: 13256 - DNA, 20 bp, Artificial Sequence
  Synthetic oligonucleotide; GAG chr11 5265653 5265672 5265669 +
gaataaacagacaacccaca

SEQ ID NO: 13257 - DNA, 20 bp, Artificial Sequence
  Synthetic oligonucleotide; TGG chr11 5265656 5265675 5265672 +
taaacagacaacccacagag

SEQ ID NO: 13258 - DNA, 20 bp, Artificial Sequence
  Synthetic oligonucleotide; GGG chr11 5265657 5265676 5265673 +
aaacagacaacccacagagt

SEQ ID NO: 13259 - DNA, 20 bp, Artificial Sequence
  Synthetic oligonucleotide; GAG chr11 5265659 5265678 5265675 +
acagacaacccacagagtgg

SEQ ID NO: 13260 - DNA, 20 bp, Artificial Sequence
  Synthetic oligonucleotide; AAG chr11 5265691 5265710 5265707 +
acaatctatacatctgacaa

SEQ ID NO: 13261 - DNA, 20 bp, Artificial Sequence
  Synthetic oligonucleotide; CAG chr11 5265703 5265722 5265719 +
tctgacaaaagaataatatc

SEQ ID NO: 13262 - DNA, 20 bp, Artificial Sequence
  Synthetic oligonucleotide; AGG chr11 5265704 5265723 5265720 +
ctgacaaaagaataatatcc

SEQ ID NO: 13263 - DNA, 20 bp, Artificial Sequence
  Synthetic oligonucleotide; TAG chr11 5265725 5265744 5265741 +
ggctctaaaatgaacacaaa

SEQ ID NO: 13264 - DNA, 20 bp, Artificial Sequence
  Synthetic oligonucleotide; AAG chr11 5265734 5265753 5265750 +
atgaacacaaatagattatc

SEQ ID NO: 13265 - DNA, 20 bp, Artificial Sequence
  Synthetic oligonucleotide; AAG chr11 5265761 5265780 5265777 +
taacaaacaatcccaataaa

SEQ ID NO: 13266 - DNA, 20 bp, Artificial Sequence
  Synthetic oligonucleotide; TAG chr11 5265764 5265783 5265780 +
caaacaatcccaataaaaag

SEQ ID NO: 13267 - DNA, 20 bp, Artificial Sequence
  Synthetic oligonucleotide; AGG chr11 5265765 5265784 5265781 +
aaacaatcccaataaaaagt

SEQ ID NO: 13268 - DNA, 20 bp, Artificial Sequence
  Synthetic oligonucleotide; AAG chr11 5265770 5265789 5265786 +
atcccaataaaaagtaggct

SEQ ID NO: 13269 - DNA, 20 bp, Artificial Sequence
  Synthetic oligonucleotide; AGG chr11 5265771 5265790 5265787 +
tcccaataaaaagtaggcta

SEQ ID NO: 13270 - DNA, 20 bp, Artificial Sequence
  Synthetic oligonucleotide; CAG chr11 5265781 5265800 5265797 +
aagtaggctaaggacatgaa

SEQ ID NO: 13271 - DNA, 20 bp, Artificial Sequence
  Synthetic oligonucleotide; CAG chr11 5265792 5265811 5265808 +
ggacatgaacagacaattct

SEQ ID NO: 13272 - DNA, 20 bp, Artificial Sequence
  Synthetic oligonucleotide; AAG chr11 5265798 5265817 5265814 +
gaacagacaattctcagaaa

SEQ ID NO: 13273 - DNA, 20 bp, Artificial Sequence
  Synthetic oligonucleotide; CAG chr11 5265853 5265872 5265869 +
ttctcaacatcactaatgat

SEQ ID NO: 13274 - DNA, 20 bp, Artificial Sequence
  Synthetic oligonucleotide; AGG chr11 5265854 5265873 5265870 +
tctcaacatcactaatgatc

SEQ ID NO: 13275 - DNA, 20 bp, Artificial Sequence
  Synthetic oligonucleotide; GGG chr11 5265855 5265874 5265871 +
ctcaacatcactaatgatca

SEQ ID NO: 13276 - DNA, 20 bp, Artificial Sequence
  Synthetic oligonucleotide; GAG chr11 5265880 5265899 5265896 +
atgcaaatcaaaactacaat

SEQ ID NO: 13277 - DNA, 20 bp, Artificial Sequence
  Synthetic oligonucleotide; TAG chr11 5265897 5265916 5265913 +
aatgagatatctacttactc

SEQ ID NO: 13278 - DNA, 20 bp, Artificial Sequence
  Synthetic oligonucleotide; CGG chr11 5265906 5265925 5265922 +
tctacttactctagttaaaa

SEQ ID NO: 13279 - DNA, 20 bp, Artificial Sequence
  Synthetic oligonucleotide; AAG chr11 5265921 5265940 5265937 +
taaaacggctattaacaaaa

SEQ ID NO: 13280 - DNA, 20 bp, Artificial Sequence
  Synthetic oligonucleotide; CAG chr11 5265935 5265954 5265951 +
acaaaaaagacaaaaaataa

SEQ ID NO: 13281 - DNA, 20 bp, Artificial Sequence
  Synthetic oligonucleotide; GAG chr11 5265946 5265965 5265962 +
aaaaaataacagatccttgt

SEQ ID NO: 13282 - DNA, 20 bp, Artificial Sequence
  Synthetic oligonucleotide; AGG chr11 5265947 5265966 5265963 +
aaaaataacagatccttgtg

SEQ ID NO: 13283 - DNA, 20 bp, Artificial Sequence
  Synthetic oligonucleotide; TGG chr11 5265953 5265972 5265969 +
aacagatccttgtgaggata

SEQ ID NO: 13284 - DNA, 20 bp, Artificial Sequence
  Synthetic oligonucleotide; GAG chr11 5265955 5265974 5265971 +
cagatccttgtgaggatatg

SEQ ID NO: 13285 - DNA, 20 bp, Artificial Sequence
  Synthetic oligonucleotide; AAG chr11 5265960 5265979 5265976 +
ccttgtgaggatatggagaa

SEQ ID NO: 13286 - DNA, 20 bp, Artificial Sequence
  Synthetic oligonucleotide; AGG chr11 5265961 5265980 5265977 +
cttgtgaggatatggagaaa

SEQ ID NO: 13287 - DNA, 20 bp, Artificial Sequence
  Synthetic oligonucleotide; GGG chr11 5265962 5265981 5265978 +
ttgtgaggatatggagaaaa

SEQ ID NO: 13288 - DNA, 20 bp, Artificial Sequence
  Synthetic oligonucleotide; TGG chr11 5265985 5266004 5266001 +
aactctttcttacacactgt

SEQ ID NO: 13289 - DNA, 20 bp, Artificial Sequence
  Synthetic oligonucleotide; TGG chr11 5265988 5266007 5266004 +
tctttcttacacactgttgg

SEQ ID NO: 13290 - DNA, 20 bp, Artificial Sequence
  Synthetic oligonucleotide; GGG chr11 5265989 5266008 5266005 +
ctttcttacacactgttggt

SEQ ID NO: 13291 - DNA, 20 bp, Artificial Sequence
  Synthetic oligonucleotide; TAG chr11 5266001 5266020 5266017 +
ctgttggtgggaatgtaaaa

SEQ ID NO: 13292 - DNA, 20 bp, Artificial Sequence
  Synthetic oligonucleotide; TGG chr11 5266015 5266034 5266031 +
gtaaaatagtacaaccatta

SEQ ID NO: 13293 - DNA, 20 bp, Artificial Sequence
  Synthetic oligonucleotide; CAG chr11 5266022 5266041 5266038 +
agtacaaccattatggaaaa

SEQ ID NO: 13294 - DNA, 20 bp, Artificial Sequence
  Synthetic oligonucleotide; AAG chr11 5266029 5266048 5266045 +
ccattatggaaaacagtatg

SEQ ID NO: 13295 - DNA, 20 bp, Artificial Sequence
  Synthetic oligonucleotide; CAG chr11 5266038 5266057 5266054 +
aaaacagtatgaagatttct

SEQ ID NO: 13296 - DNA, 20 bp, Artificial Sequence
  Synthetic oligonucleotide; CAG chr11 5266052 5266071 5266068 +
atttctcagtaaactaaaaa

SEQ ID NO: 13297 - DNA, 20 bp, Artificial Sequence
  Synthetic oligonucleotide; CAG chr11 5266070 5266089 5266086 +
aacagaactatcatacaatc

SEQ ID NO: 13298 - DNA, 20 bp, Artificial Sequence
  Synthetic oligonucleotide; TAG chr11 5266082 5266101 5266098 +
atacaatccagcaatctcac

SEQ ID NO: 13299 - DNA, 20 bp, Artificial Sequence
  Synthetic oligonucleotide; TGG chr11 5266085 5266104 5266101 +
caatccagcaatctcactag

SEQ ID NO: 13300 - DNA, 20 bp, Artificial Sequence
  Synthetic oligonucleotide; AAG chr11 5266100 5266119 5266116 +
actagtggttatttatccaa

SEQ ID NO: 13301 - DNA, 20 bp, Artificial Sequence
  Synthetic oligonucleotide; AAG chr11 5266104 5266123 5266120 +
gtggttatttatccaaaaga

SEQ ID NO: 13302 - DNA, 20 bp, Artificial Sequence
  Synthetic oligonucleotide; AGG chr11 5266105 5266124 5266121 +
tggttatttatccaaaagaa

SEQ ID NO: 13303 - DNA, 20 bp, Artificial Sequence
  Synthetic oligonucleotide; CAG chr11 5266112 5266131 5266128 +
ttatccaaaagaaaggaaat

SEQ ID NO: 13304 - DNA, 20 bp, Artificial Sequence
  Synthetic oligonucleotide; TGG chr11 5266124 5266143 5266140 +
aaggaaatcagtatatccaa

SEQ ID NO: 13305 - DNA, 20 bp, Artificial Sequence
  Synthetic oligonucleotide; AAG chr11 5266150 5266169 5266166 +
cattacactcatgtttattg

SEQ ID NO: 13306 - DNA, 20 bp, Artificial Sequence
  Synthetic oligonucleotide; TAG chr11 5266165 5266184 5266181 +
tattgaagcactattcacaa

SEQ ID NO: 13307 - DNA, 20 bp, Artificial Sequence
  Synthetic oligonucleotide; AAG chr11 5266170 5266189 5266186 +
aagcactattcacaatagtt

SEQ ID NO: 13308 - DNA, 20 bp, Artificial Sequence
  Synthetic oligonucleotide; AGG chr11 5266171 5266190 5266187 +
agcactattcacaatagtta

SEQ ID NO: 13309 - DNA, 20 bp, Artificial Sequence
  Synthetic oligonucleotide; TGG chr11 5266176 5266195 5266192 +
tattcacaatagttaaggtt

SEQ ID NO: 13310 - DNA, 20 bp, Artificial Sequence
  Synthetic oligonucleotide; GGG chr11 5266177 5266196 5266193 +
attcacaatagttaaggttt

SEQ ID NO: 13311 - DNA, 20 bp, Artificial Sequence
  Synthetic oligonucleotide; AAG chr11 5266188 5266207 5266204 +
ttaaggtttgggatcaacct

SEQ ID NO: 13312 - DNA, 20 bp, Artificial Sequence
  Synthetic oligonucleotide; CAG chr11 5266201 5266220 5266217 +
tcaacctaagtgtctatcaa

SEQ ID NO: 13313 - DNA, 20 bp, Artificial Sequence
  Synthetic oligonucleotide; CGG chr11 5266209 5266228 5266225 +
agtgtctatcaacagatgaa

SEQ ID NO: 13314 - DNA, 20 bp, Artificial Sequence
  Synthetic oligonucleotide; CAG chr11 5266234 5266253 5266250 +
taaaaaattgtatttttgca

SEQ ID NO: 13315 - DNA, 20 bp, Artificial Sequence
  Synthetic oligonucleotide; AAG chr11 5266255 5266274 5266271 +
agtactattttgccatgaaa

SEQ ID NO: 13316 - DNA, 20 bp, Artificial Sequence
  Synthetic oligonucleotide; TAG chr11 5266277 5266296 5266293 +
gaatgaaatcttgtcatttg

SEQ ID NO: 13317 - DNA, 20 bp, Artificial Sequence
  Synthetic oligonucleotide; TGG chr11 5266285 5266304 5266301 +
tcttgtcatttgtagcaaca

SEQ ID NO: 13318 - DNA, 20 bp, Artificial Sequence
  Synthetic oligonucleotide; TGG chr11 5266289 5266308 5266305 +
gtcatttgtagcaacatgga

SEQ ID NO: 13319 - DNA, 20 bp, Artificial Sequence
  Synthetic oligonucleotide; CAG chr11 5266295 5266314 5266311 +
tgtagcaacatggatggaac

SEQ ID NO: 13320 - DNA, 20 bp, Artificial Sequence
  Synthetic oligonucleotide; GAG chr11 5266297 5266316 5266313 +
tagcaacatggatggaacca

SEQ ID NO: 13321 - DNA, 20 bp, Artificial Sequence
  Synthetic oligonucleotide; AGG chr11 5266298 5266317 5266314 +
agcaacatggatggaaccag

SEQ ID NO: 13322 - DNA, 20 bp, Artificial Sequence
  Synthetic oligonucleotide; AAG chr11 5266317 5266336 5266333 +
gaggtcattatgttaattga

SEQ ID NO: 13323 - DNA, 20 bp, Artificial Sequence
  Synthetic oligonucleotide; AAG chr11 5266325 5266344 5266341 +
tatgttaattgaaagccctg

SEQ ID NO: 13324 - DNA, 20 bp, Artificial Sequence
  Synthetic oligonucleotide; CAG chr11 5266328 5266347 5266344 +
gttaattgaaagccctgaag

SEQ ID NO: 13325 - DNA, 20 bp, Artificial Sequence
  Synthetic oligonucleotide; TGG chr11 5266347 5266366 5266363 +
gcagaacaaaaacaaactct

SEQ ID NO: 13326 - DNA, 20 bp, Artificial Sequence
  Synthetic oligonucleotide; AAG chr11 5266357 5266376 5266373 +
aacaaactcttggtatgcca

SEQ ID NO: 13327 - DNA, 20 bp, Artificial Sequence
  Synthetic oligonucleotide; GAG chr11 5266359 5266378 5266375 +
caaactcttggtatgccaaa

SEQ ID NO: 13328 - DNA, 20 bp, Artificial Sequence
  Synthetic oligonucleotide; TAG chr11 5266363 5266382 5266379 +
ctcttggtatgccaaagaga

SEQ ID NO: 13329 - DNA, 20 bp, Artificial Sequence
  Synthetic oligonucleotide; AAG chr11 5266376 5266395 5266392 +
aaagagatagataataaaat

SEQ ID NO: 13330 - DNA, 20 bp, Artificial Sequence
  Synthetic oligonucleotide; CAG chr11 5266380 5266399 5266396 +
agatagataataaaataagc

SEQ ID NO: 13331 - DNA, 20 bp, Artificial Sequence
  Synthetic oligonucleotide; CAG chr11 5266386 5266405 5266402 +
ataataaaataagccagata

SEQ ID NO: 13332 - DNA, 20 bp, Artificial Sequence
  Synthetic oligonucleotide; AAG chr11 5266390 5266409 5266406 +
taaaataagccagatacaga

SEQ ID NO: 13333 - DNA, 20 bp, Artificial Sequence
  Synthetic oligonucleotide; TGG chr11 5266421 5266440 5266437 +
cacatgtttttattcatctg

SEQ ID NO: 13334 - DNA, 20 bp, Artificial Sequence
  Synthetic oligonucleotide; GGG chr11 5266422 5266441 5266438 +
acatgtttttattcatctgt

SEQ ID NO: 13335 - DNA, 20 bp, Artificial Sequence
  Synthetic oligonucleotide; GAG chr11 5266424 5266443 5266440 +
atgtttttattcatctgtgg

SEQ ID NO: 13336 - DNA, 20 bp, Artificial Sequence
  Synthetic oligonucleotide; AAG chr11 5266433 5266452 5266449 +
ttcatctgtgggagctaaaa

SEQ ID NO: 13337 - DNA, 20 bp, Artificial Sequence
  Synthetic oligonucleotide; TGG chr11 5266436 5266455 5266452 +
atctgtgggagctaaaaaag

SEQ ID NO: 13338 - DNA, 20 bp, Artificial Sequence
  Synthetic oligonucleotide; GGG chr11 5266437 5266456 5266453 +
tctgtgggagctaaaaaagt

SEQ ID NO: 13339 - DNA, 20 bp, Artificial Sequence
  Synthetic oligonucleotide; TGG chr11 5266445 5266464 5266461 +
agctaaaaaagtgggtctca

SEQ ID NO: 13340 - DNA, 20 bp, Artificial Sequence
  Synthetic oligonucleotide; TGG chr11 5266448 5266467 5266464 +
taaaaaagtgggtctcatgg

SEQ ID NO: 13341 - DNA, 20 bp, Artificial Sequence
  Synthetic oligonucleotide; TAG chr11 5266451 5266470 5266467 +
aaaagtgggtctcatggtgg

SEQ ID NO: 13342 - DNA, 20 bp, Artificial Sequence
  Synthetic oligonucleotide; GAG chr11 5266453 5266472 5266469 +
aagtgggtctcatggtggta

SEQ ID NO: 13343 - DNA, 20 bp, Artificial Sequence
  Synthetic oligonucleotide; GAG chr11 5266455 5266474 5266471 +
gtgggtctcatggtggtaga

SEQ ID NO: 13344 - DNA, 20 bp, Artificial Sequence
  Synthetic oligonucleotide; TAG chr11 5266458 5266477 5266474 +
ggtctcatggtggtagagag

SEQ ID NO: 13345 - DNA, 20 bp, Artificial Sequence
  Synthetic oligonucleotide; TAG chr11 5266466 5266485 5266482 +
ggtggtagagagtagaatga

SEQ ID NO: 13346 - DNA, 20 bp, Artificial Sequence
  Synthetic oligonucleotide; CAG chr11 5266473 5266492 5266489 +
gagagtagaatgatagttat

SEQ ID NO: 13347 - DNA, 20 bp, Artificial Sequence
  Synthetic oligonucleotide; GAG chr11 5266475 5266494 5266491 +
gagtagaatgatagttatca

SEQ ID NO: 13348 - DNA, 20 bp, Artificial Sequence
  Synthetic oligonucleotide; AGG chr11 5266476 5266495 5266492 +
agtagaatgatagttatcag

SEQ ID NO: 13349 - DNA, 20 bp, Artificial Sequence
  Synthetic oligonucleotide; TGG chr11 5266480 5266499 5266496 +
gaatgatagttatcagaggc

SEQ ID NO: 13350 - DNA, 20 bp, Artificial Sequence
  Synthetic oligonucleotide; AAG chr11 5266486 5266505 5266502 +
tagttatcagaggctggaaa

SEQ ID NO: 13351 - DNA, 20 bp, Artificial Sequence
  Synthetic oligonucleotide; GAG chr11 5266492 5266511 5266508 +
tcagaggctggaaaaagtgt

SEQ ID NO: 13352 - DNA, 20 bp, Artificial Sequence
  Synthetic oligonucleotide; TGG chr11 5266501 5266520 5266517 +
ggaaaaagtgtgagtgtgta

SEQ ID NO: 13353 - DNA, 20 bp, Artificial Sequence
  Synthetic oligonucleotide; GGG chr11 5266502 5266521 5266518 +
gaaaaagtgtgagtgtgtat

SEQ ID NO: 13354 - DNA, 20 bp, Artificial Sequence
  Synthetic oligonucleotide; GAG chr11 5266504 5266523 5266520 +
aaaagtgtgagtgtgtatgg

SEQ ID NO: 13355 - DNA, 20 bp, Artificial Sequence
  Synthetic oligonucleotide; AGG chr11 5266505 5266524 5266521 +
aaagtgtgagtgtgtatggg

SEQ ID NO: 13356 - DNA, 20 bp, Artificial Sequence
  Synthetic oligonucleotide; GGG chr11 5266506 5266525 5266522 +
aagtgtgagtgtgtatggga

SEQ ID NO: 13357 - DNA, 20 bp, Artificial Sequence
  Synthetic oligonucleotide; GGG chr11 5266507 5266526 5266523 +
agtgtgagtgtgtatgggag

SEQ ID NO: 13358 - DNA, 20 bp, Artificial Sequence
  Synthetic oligonucleotide; AAG chr11 5266514 5266533 5266530 +
gtgtgtatgggaggggattt

SEQ ID NO: 13359 - DNA, 20 bp, Artificial Sequence
  Synthetic oligonucleotide; GAG chr11 5266516 5266535 5266532 +
gtgtatgggaggggatttaa

SEQ ID NO: 13360 - DNA, 20 bp, Artificial Sequence
  Synthetic oligonucleotide; TGG chr11 5266523 5266542 5266539 +
ggaggggatttaagagatgt

SEQ ID NO: 13361 - DNA, 20 bp, Artificial Sequence
  Synthetic oligonucleotide; TAG chr11 5266530 5266549 5266546 +
atttaagagatgttggttaa

SEQ ID NO: 13362 - DNA, 20 bp, Artificial Sequence
  Synthetic oligonucleotide; AGG chr11 5266531 5266550 5266547 +
tttaagagatgttggttaat

SEQ ID NO: 13363 - DNA, 20 bp, Artificial Sequence
  Synthetic oligonucleotide; CAG chr11 5266542 5266561 5266558 +
ttggttaataggtacaaaca

SEQ ID NO: 13364 - DNA, 20 bp, Artificial Sequence
  Synthetic oligonucleotide; TGG chr11 5266546 5266565 5266562 +
ttaataggtacaaacacagt

SEQ ID NO: 13365 - DNA, 20 bp, Artificial Sequence
  Synthetic oligonucleotide; TAG chr11 5266550 5266569 5266566 +
taggtacaaacacagttgga

SEQ ID NO: 13366 - DNA, 20 bp, Artificial Sequence
  Synthetic oligonucleotide; AAG chr11 5266553 5266572 5266569 +
gtacaaacacagttggatag

SEQ ID NO: 13367 - DNA, 20 bp, Artificial Sequence
  Synthetic oligonucleotide; AGG chr11 5266554 5266573 5266570 +
tacaaacacagttggataga

SEQ ID NO: 13368 - DNA, 20 bp, Artificial Sequence
  Synthetic oligonucleotide; AAG chr11 5266560 5266579 5266576 +
cacagttggatagaaggatt

SEQ ID NO: 13369 - DNA, 20 bp, Artificial Sequence
  Synthetic oligonucleotide; GAG chr11 5266581 5266600 5266597 +
agccataatgtttgatattt

SEQ ID NO: 13370 - DNA, 20 bp, Artificial Sequence
  Synthetic oligonucleotide; TAG chr11 5266584 5266603 5266600 +
cataatgtttgatatttgag

SEQ ID NO: 13371 - DNA, 20 bp, Artificial Sequence
  Synthetic oligonucleotide; AGG chr11 5266585 5266604 5266601 +
ataatgtttgatatttgagt

SEQ ID NO: 13372 - DNA, 20 bp, Artificial Sequence
  Synthetic oligonucleotide; GGG chr11 5266586 5266605 5266602 +
taatgtttgatatttgagta

SEQ ID NO: 13373 - DNA, 20 bp, Artificial Sequence
  Synthetic oligonucleotide; TAG chr11 5266595 5266614 5266611 +
atatttgagtagggtgacta

SEQ ID NO: 13374 - DNA, 20 bp, Artificial Sequence
  Synthetic oligonucleotide; TGG chr11 5266627 5266646 5266643 +
atttattatatatttcaaaa

SEQ ID NO: 13375 - DNA, 20 bp, Artificial Sequence
  Synthetic oligonucleotide; TAG chr11 5266631 5266650 5266647 +
attatatatttcaaaatggc

SEQ ID NO: 13376 - DNA, 20 bp, Artificial Sequence
  Synthetic oligonucleotide; GAG chr11 5266638 5266657 5266654 +
atttcaaaatggctagaaat

SEQ ID NO: 13377 - DNA, 20 bp, Artificial Sequence
  Synthetic oligonucleotide; AGG chr11 5266639 5266658 5266655 +
tttcaaaatggctagaaatg

SEQ ID NO: 13378 - DNA, 20 bp, Artificial Sequence
  Synthetic oligonucleotide; TAG chr11 5266663 5266682 5266679 +
tttgaaattttctcaataca

SEQ ID NO: 13379 - DNA, 20 bp, Artificial Sequence
  Synthetic oligonucleotide; AAG chr11 5266682 5266701 5266698 +
atagaaatgataaatgctca

SEQ ID NO: 13380 - DNA, 20 bp, Artificial Sequence
  Synthetic oligonucleotide; TGG chr11 5266688 5266707 5266704 +
atgataaatgctcaaagcaa

SEQ ID NO: 13381 - DNA, 20 bp, Artificial Sequence
  Synthetic oligonucleotide; TAG chr11 5266705 5266724 5266721 +
caatggatatcctaaatatc

SEQ ID NO: 13382 - DNA, 20 bp, Artificial Sequence
  Synthetic oligonucleotide; TAG chr11 5266727 5266746 5266743 +
gacttaatcatcacatgttc

SEQ ID NO: 13383 - DNA, 20 bp, Artificial Sequence
  Synthetic oligonucleotide; AGG chr11 5266728 5266747 5266744 +
acttaatcatcacatgttct

SEQ ID NO: 13384 - DNA, 20 bp, Artificial Sequence
  Synthetic oligonucleotide; AAG chr11 5266736 5266755 5266752 +
atcacatgttctaggcatgt

SEQ ID NO: 13385 - DNA, 20 bp, Artificial Sequence
  Synthetic oligonucleotide; TAG chr11 5266811 5266830 5266827 +
gctcccatttgttgactgac

SEQ ID NO: 13386 - DNA, 20 bp, Artificial Sequence
  Synthetic oligonucleotide; AGG chr11 5266812 5266831 5266828 +
ctcccatttgttgactgact

SEQ ID NO: 13387 - DNA, 20 bp, Artificial Sequence
  Synthetic oligonucleotide; TAG chr11 5266825 5266844 5266841 +
actgactaggtgaaaatatt

SEQ ID NO: 13388 - DNA, 20 bp, Artificial Sequence
  Synthetic oligonucleotide; TGG chr11 5266859 5266878 5266875 +
atccctgtttactctgttta

SEQ ID NO: 13389 - DNA, 20 bp, Artificial Sequence
  Synthetic oligonucleotide; GGG chr11 5266860 5266879 5266876 +
tccctgtttactctgtttat

SEQ ID NO: 13390 - DNA, 20 bp, Artificial Sequence
  Synthetic oligonucleotide; AAG chr11 5266871 5266890 5266887 +
tctgtttatgggcatattga

SEQ ID NO: 13391 - DNA, 20 bp, Artificial Sequence
  Synthetic oligonucleotide; AGG chr11 5266872 5266891 5266888 +
ctgtttatgggcatattgaa

SEQ ID NO: 13392 - DNA, 20 bp, Artificial Sequence
  Synthetic oligonucleotide; AAG chr11 5266879 5266898 5266895 +
tgggcatattgaaaggttat

SEQ ID NO: 13393 - DNA, 20 bp, Artificial Sequence
  Synthetic oligonucleotide; AGG chr11 5266880 5266899 5266896 +
gggcatattgaaaggttata

SEQ ID NO: 13394 - DNA, 20 bp, Artificial Sequence
  Synthetic oligonucleotide; CAG chr11 5266885 5266904 5266901 +
tattgaaaggttataaggct

SEQ ID NO: 13395 - DNA, 20 bp, Artificial Sequence
  Synthetic oligonucleotide; GAG chr11 5266887 5266906 5266903 +
ttgaaaggttataaggctca

SEQ ID NO: 13396 - DNA, 20 bp, Artificial Sequence
  Synthetic oligonucleotide; GAG chr11 5266889 5266908 5266905 +
gaaaggttataaggctcaga

SEQ ID NO: 13397 - DNA, 20 bp, Artificial Sequence
  Synthetic oligonucleotide; CAG chr11 5266894 5266913 5266910 +
gttataaggctcagagagac

SEQ ID NO: 13398 - DNA, 20 bp, Artificial Sequence
  Synthetic oligonucleotide; TAG chr11 5266906 5266925 5266922 +
agagagaccagtattgttga

SEQ ID NO: 13399 - DNA, 20 bp, Artificial Sequence
  Synthetic oligonucleotide; TGG chr11 5266948 5266967 5266964 +
tttgtctctctcccatattc

SEQ ID NO: 13400 - DNA, 20 bp, Artificial Sequence
  Synthetic oligonucleotide; CAG chr11 5266958 5266977 5266974 +
tcccatattctggatatata

SEQ ID NO: 13401 - DNA, 20 bp, Artificial Sequence
  Synthetic oligonucleotide; AAG chr11 5266971 5266990 5266987 +
atatatacagccaaattcaa

SEQ ID NO: 13402 - DNA, 20 bp, Artificial Sequence
  Synthetic oligonucleotide; CAG chr11 5266981 5267000 5266997 +
ccaaattcaaaagtaattca

SEQ ID NO: 13403 - DNA, 20 bp, Artificial Sequence
  Synthetic oligonucleotide; AGG chr11 5266982 5267001 5266998 +
caaattcaaaagtaattcac

SEQ ID NO: 13404 - DNA, 20 bp, Artificial Sequence
  Synthetic oligonucleotide; AAG chr11 5266988 5267007 5267004 +
caaaagtaattcacaggaaa

SEQ ID NO: 13405 - DNA, 20 bp, Artificial Sequence
  Synthetic oligonucleotide; GAG chr11 5267003 5267022 5267019 +
ggaaaaagtctgatcaatgt

SEQ ID NO: 13406 - DNA, 20 bp, Artificial Sequence
  Synthetic oligonucleotide; GAG chr11 5267005 5267024 5267021 +
aaaaagtctgatcaatgtga

SEQ ID NO: 13407 - DNA, 20 bp, Artificial Sequence
  Synthetic oligonucleotide; AAG chr11 5267027 5267046 5267043 +
gcactataaaattactaata

SEQ ID NO: 13408 - DNA, 20 bp, Artificial Sequence
  Synthetic oligonucleotide; TGG chr11 5267047 5267066 5267063 +
aagttatatttgccaaaata

SEQ ID NO: 13409 - DNA, 20 bp, Artificial Sequence
  Synthetic oligonucleotide; TGG chr11 5267060 5267079 5267076 +
caaaatatggcactctaact

SEQ ID NO: 13410 - DNA, 20 bp, Artificial Sequence
  Synthetic oligonucleotide; AAG chr11 5267071 5267090 5267087 +
actctaacttggaaaatgca

SEQ ID NO: 13411 - DNA, 20 bp, Artificial Sequence
  Synthetic oligonucleotide; AGG chr11 5267072 5267091 5267088 +
ctctaacttggaaaatgcaa

SEQ ID NO: 13412 - DNA, 20 bp, Artificial Sequence
  Synthetic oligonucleotide; AAG chr11 5267088 5267107 5267104 +
gcaaaggttccttgatatga

SEQ ID NO: 13413 - DNA, 20 bp, Artificial Sequence
  Synthetic oligonucleotide; AAG chr11 5267095 5267114 5267111 +
ttccttgatatgaaagacac

SEQ ID NO: 13414 - DNA, 20 bp, Artificial Sequence
  Synthetic oligonucleotide; AAG chr11 5267103 5267122 5267119 +
tatgaaagacacaagacctg

SEQ ID NO: 13415 - DNA, 20 bp, Artificial Sequence
  Synthetic oligonucleotide; AGG chr11 5267104 5267123 5267120 +
atgaaagacacaagacctga

SEQ ID NO: 13416 - DNA, 20 bp, Artificial Sequence
  Synthetic oligonucleotide; TAG chr11 5267127 5267146 5267143 +
tcaaaactccctgaccaatc

SEQ ID NO: 13417 - DNA, 20 bp, Artificial Sequence
  Synthetic oligonucleotide; AAG chr11 5267141 5267160 5267157 +
ccaatctagcacttcctaaa

SEQ ID NO: 13418 - DNA, 20 bp, Artificial Sequence
  Synthetic oligonucleotide; GAG chr11 5267178 5267197 5267194 +
tccctctacccttcacacat

SEQ ID NO: 13419 - DNA, 20 bp, Artificial Sequence
  Synthetic oligonucleotide; GAG chr11 5267180 5267199 5267196 +
cctctacccttcacacatga

SEQ ID NO: 13420 - DNA, 20 bp, Artificial Sequence
  Synthetic oligonucleotide; CAG chr11 5267187 5267206 5267203 +
ccttcacacatgagagtcac

SEQ ID NO: 13421 - DNA, 20 bp, Artificial Sequence
  Synthetic oligonucleotide; AGG chr11 5267188 5267207 5267204 +
cttcacacatgagagtcacc

SEQ ID NO: 13422 - DNA, 20 bp, Artificial Sequence
  Synthetic oligonucleotide; CAG chr11 5267192 5267211 5267208 +
acacatgagagtcaccaggt

SEQ ID NO: 13423 - DNA, 20 bp, Artificial Sequence
  Synthetic oligonucleotide; TGG chr11 5267199 5267218 5267215 +
agagtcaccaggtcagtgca

SEQ ID NO: 13424 - DNA, 20 bp, Artificial Sequence
  Synthetic oligonucleotide; CAG chr11 5267222 5267241 5267238 +
tttcctcctgttatcttcac

SEQ ID NO: 13425 - DNA, 20 bp, Artificial Sequence
  Synthetic oligonucleotide; TGG chr11 5267227 5267246 5267243 +
tcctgttatcttcaccagtc

SEQ ID NO: 13426 - DNA, 20 bp, Artificial Sequence
  Synthetic oligonucleotide; GGG chr11 5267228 5267247 5267244 +
cctgttatcttcaccagtct

SEQ ID NO: 13427 - DNA, 20 bp, Artificial Sequence
  Synthetic oligonucleotide; GAG chr11 5267230 5267249 5267246 +
tgttatcttcaccagtctgg

SEQ ID NO: 13428 - DNA, 20 bp, Artificial Sequence
  Synthetic oligonucleotide; CAG chr11 5267237 5267256 5267253 +
ttcaccagtctgggagcttt

SEQ ID NO: 13429 - DNA, 20 bp, Artificial Sequence
  Synthetic oligonucleotide; CAG chr11 5267275 5267294 5267291 +
ttcttccttctcatctccca

SEQ ID NO: 13430 - DNA, 20 bp, Artificial Sequence
  Synthetic oligonucleotide; CAG chr11 5267279 5267298 5267295 +
tccttctcatctcccacagt

SEQ ID NO: 13431 - DNA, 20 bp, Artificial Sequence
  Synthetic oligonucleotide; CAG chr11 5267332 5267351 5267348 +
tgtccatccttcaaattcca

SEQ ID NO: 13432 - DNA, 20 bp, Artificial Sequence
  Synthetic oligonucleotide; TGG chr11 5267350 5267369 5267366 +
cacagactcactgctcctct

SEQ ID NO: 13433 - DNA, 20 bp, Artificial Sequence
  Synthetic oligonucleotide; GGG chr11 5267351 5267370 5267367 +
acagactcactgctcctctt

SEQ ID NO: 13434 - DNA, 20 bp, Artificial Sequence
  Synthetic oligonucleotide; AAG chr11 5267434 5267453 5267450 +
tgaatccattttgtgcacat

SEQ ID NO: 13435 - DNA, 20 bp, Artificial Sequence
  Synthetic oligonucleotide; CAG chr11 5267437 5267456 5267453 +
atccattttgtgcacataag

SEQ ID NO: 13436 - DNA, 20 bp, Artificial Sequence
  Synthetic oligonucleotide; GAG chr11 5267468 5267487 5267484 +
ttcccaaaatcttatttcct

SEQ ID NO: 13437 - DNA, 20 bp, Artificial Sequence
  Synthetic oligonucleotide; TAG chr11 5267498 5267517 5267514 +
acatcctaatgcttatcgtt

SEQ ID NO: 13438 - DNA, 20 bp, Artificial Sequence
  Synthetic oligonucleotide; TAG chr11 5267509 5267528 5267525 +
cttatcgtttagtattgcaa

SEQ ID NO: 13439 - DNA, 20 bp, Artificial Sequence
  Synthetic oligonucleotide; TAG chr11 5267514 5267533 5267530 +
cgtttagtattgcaatagca

SEQ ID NO: 13440 - DNA, 20 bp, Artificial Sequence
  Synthetic oligonucleotide; AAG chr11 5267520 5267539 5267536 +
gtattgcaatagcatagtaa

SEQ ID NO: 13441 - DNA, 20 bp, Artificial Sequence
  Synthetic oligonucleotide; TAG chr11 5267535 5267554 5267551 +
agtaaaagcttgtatttttg

SEQ ID NO: 13442 - DNA, 20 bp, Artificial Sequence
  Synthetic oligonucleotide; CAG chr11 5267539 5267558 5267555 +
aaagcttgtatttttgtagc

SEQ ID NO: 13443 - DNA, 20 bp, Artificial Sequence
  Synthetic oligonucleotide; AGG chr11 5267540 5267559 5267556 +
aagcttgtatttttgtagcc

SEQ ID NO: 13444 - DNA, 20 bp, Artificial Sequence
  Synthetic oligonucleotide; TGG chr11 5267555 5267574 5267571 +
tagccaggccctgtactatc

SEQ ID NO: 13445 - DNA, 20 bp, Artificial Sequence
  Synthetic oligonucleotide; TAG chr11 5267565 5267584 5267581 +
ctgtactatctggtctttcc

SEQ ID NO: 13446 - DNA, 20 bp, Artificial Sequence
  Synthetic oligonucleotide; CAG chr11 5267602 5267621 5267618 +
cttactctcccttctacttc

SEQ ID NO: 13447 - DNA, 20 bp, Artificial Sequence
  Synthetic oligonucleotide; GAG chr11 5267604 5267623 5267620 +
tactctcccttctacttcca

SEQ ID NO: 13448 - DNA, 20 bp, Artificial Sequence
  Synthetic oligonucleotide; GAG chr11 5267606 5267625 5267622 +
ctctcccttctacttccaga

SEQ ID NO: 13449 - DNA, 20 bp, Artificial Sequence
  Synthetic oligonucleotide; CAG chr11 5267610 5267629 5267626 +
cccttctacttccagagagc

SEQ ID NO: 13450 - DNA, 20 bp, Artificial Sequence
  Synthetic oligonucleotide; AAG chr11 5267621 5267640 5267637 +
ccagagagccagtttcatgc

SEQ ID NO: 13451 - DNA, 20 bp, Artificial Sequence
  Synthetic oligonucleotide; AAG chr11 5267629 5267648 5267645 +
ccagtttcatgcaagtcacg

SEQ ID NO: 13452 - DNA, 20 bp, Artificial Sequence
  Synthetic oligonucleotide; TAG chr11 5267635 5267654 5267651 +
tcatgcaagtcacgaagccc

SEQ ID NO: 13453 - DNA, 20 bp, Artificial Sequence
  Synthetic oligonucleotide; TGG chr11 5267643 5267662 5267659 +
gtcacgaagccctagcttgc

SEQ ID NO: 13454 - DNA, 20 bp, Artificial Sequence
  Synthetic oligonucleotide; TAG chr11 5267649 5267668 5267665 +
aagccctagcttgctggttt

SEQ ID NO: 13455 - DNA, 20 bp, Artificial Sequence
  Synthetic oligonucleotide; AAG chr11 5267657 5267676 5267673 +
gcttgctggttttagaattt

SEQ ID NO: 13456 - DNA, 20 bp, Artificial Sequence
  Synthetic oligonucleotide; TAG chr11 5267667 5267686 5267683 +
tttagaatttaagcctttat

SEQ ID NO: 13457 - DNA, 20 bp, Artificial Sequence
  Synthetic oligonucleotide; CGG chr11 5267684 5267703 5267700 +
tattagtattctatctccca

SEQ ID NO: 13458 - DNA, 20 bp, Artificial Sequence
  Synthetic oligonucleotide; AAG chr11 5267688 5267707 5267704 +
agtattctatctcccacgga

SEQ ID NO: 13459 - DNA, 20 bp, Artificial Sequence
  Synthetic oligonucleotide; CAG chr11 5267723 5267742 5267739 +
tctccaaaaactttcccact

SEQ ID NO: 13460 - DNA, 20 bp, Artificial Sequence
  Synthetic oligonucleotide; AGG chr11 5267724 5267743 5267740 +
ctccaaaaactttcccactc

SEQ ID NO: 13461 - DNA, 20 bp, Artificial Sequence
  Synthetic oligonucleotide; TAG chr11 5267747 5267766 5267763 +
tcctaactctaactttattt

SEQ ID NO: 13462 - DNA, 20 bp, Artificial Sequence
  Synthetic oligonucleotide; CAG chr11 5267767 5267786 5267783 +
tagtgcatgttacattctat

SEQ ID NO: 13463 - DNA, 20 bp, Artificial Sequence
  Synthetic oligonucleotide; AAG chr11 5267770 5267789 5267786 +
tgcatgttacattctatcag

SEQ ID NO: 13464 - DNA, 20 bp, Artificial Sequence
  Synthetic oligonucleotide; TAG chr11 5267799 5267818 5267815 +
cacaatgatatcatgtgtct

SEQ ID NO: 13465 - DNA, 20 bp, Artificial Sequence
  Synthetic oligonucleotide; CAG chr11 5267805 5267824 5267821 +
gatatcatgtgtcttagctt

SEQ ID NO: 13466 - DNA, 20 bp, Artificial Sequence
  Synthetic oligonucleotide; TGG chr11 5267824 5267843 5267840 +
tcagctaacccatgaaataa

SEQ ID NO: 13467 - DNA, 20 bp, Artificial Sequence
  Synthetic oligonucleotide; TGG chr11 5267836 5267855 5267852 +
tgaaataatggaatccttca

SEQ ID NO: 13468 - DNA, 20 bp, Artificial Sequence
  Synthetic oligonucleotide; AAG chr11 5267840 5267859 5267856 +
ataatggaatccttcatgga

SEQ ID NO: 13469 - DNA, 20 bp, Artificial Sequence
  Synthetic oligonucleotide; GAG chr11 5267842 5267861 5267858 +
aatggaatccttcatggaaa

SEQ ID NO: 13470 - DNA, 20 bp, Artificial Sequence
  Synthetic oligonucleotide; CAG chr11 5267845 5267864 5267861 +
ggaatccttcatggaaagag

SEQ ID NO: 13471 - DNA, 20 bp, Artificial Sequence
  Synthetic oligonucleotide; AGG chr11 5267846 5267865 5267862 +
gaatccttcatggaaagagc

SEQ ID NO: 13472 - DNA, 20 bp, Artificial Sequence
  Synthetic oligonucleotide; AAG chr11 5267904 5267923 5267920 +
aatttcataaaacatgtgac

SEQ ID NO: 13473 - DNA, 20 bp, Artificial Sequence
  Synthetic oligonucleotide; TAG chr11 5267908 5267927 5267924 +
tcataaaacatgtgacaagc

SEQ ID NO: 13474 - DNA, 20 bp, Artificial Sequence
  Synthetic oligonucleotide; AAG chr11 5267929 5267948 5267945 +
agctacttcaaaatgtaaat

SEQ ID NO: 13475 - DNA, 20 bp, Artificial Sequence
  Synthetic oligonucleotide; GAG chr11 5267931 5267950 5267947 +
ctacttcaaaatgtaaataa

SEQ ID NO: 13476 - DNA, 20 bp, Artificial Sequence
  Synthetic oligonucleotide; TAG chr11 5267944 5267963 5267960 +
taaataagagtaaattaaaa

SEQ ID NO: 13477 - DNA, 20 bp, Artificial Sequence
  Synthetic oligonucleotide; TAG chr11 5267953 5267972 5267969 +
gtaaattaaaatagtaattc

SEQ ID NO: 13478 - DNA, 20 bp, Artificial Sequence
  Synthetic oligonucleotide; TGG chr11 5267965 5267984 5267981 +
agtaattctagcctatatct

SEQ ID NO: 13479 - DNA, 20 bp, Artificial Sequence
  Synthetic oligonucleotide; AAG chr11 5267977 5267996 5267993 +
ctatatcttggatatctatg

SEQ ID NO: 13480 - DNA, 20 bp, Artificial Sequence
  Synthetic oligonucleotide; AAG chr11 5268012 5268031 5268028 +
ttgtttttgtttttaatgaa

SEQ ID NO: 13481 - DNA, 20 bp, Artificial Sequence
  Synthetic oligonucleotide; CAG chr11 5268041 5268060 5268057 +
gtaccacaaatctgctttct

SEQ ID NO: 13482 - DNA, 20 bp, Artificial Sequence
  Synthetic oligonucleotide; AGG chr11 5268042 5268061 5268058 +
taccacaaatctgctttctc

SEQ ID NO: 13483 - DNA, 20 bp, Artificial Sequence
  Synthetic oligonucleotide; CAG chr11 5268054 5268073 5268070 +
gctttctcaggtaccactaa

SEQ ID NO: 13484 - DNA, 20 bp, Artificial Sequence
  Synthetic oligonucleotide; CGG chr11 5268070 5268089 5268086 +
ctaacagctccttctttccc

SEQ ID NO: 13485 - DNA, 20 bp, Artificial Sequence
  Synthetic oligonucleotide; CAG chr11 5268075 5268094 5268091 +
agctccttctttccccggtg

SEQ ID NO: 13486 - DNA, 20 bp, Artificial Sequence
  Synthetic oligonucleotide; TAG chr11 5268089 5268108 5268105 +
ccggtgcagtaaaaactgcc

SEQ ID NO: 13487 - DNA, 20 bp, Artificial Sequence
  Synthetic oligonucleotide; AGG chr11 5268090 5268109 5268106 +
cggtgcagtaaaaactgcct

SEQ ID NO: 13488 - DNA, 20 bp, Artificial Sequence
  Synthetic oligonucleotide; GAG chr11 5268092 5268111 5268108 +
gtgcagtaaaaactgcctag

SEQ ID NO: 13489 - DNA, 20 bp, Artificial Sequence
  Synthetic oligonucleotide; AAG chr11 5268133 5268152 5268149 +
accattttcccaccccgata

SEQ ID NO: 13490 - DNA, 20 bp, Artificial Sequence
  Synthetic oligonucleotide; TGG chr11 5268162 5268181 5268178 +
ctccatcatatcatcctcct

SEQ ID NO: 13491 - DNA, 20 bp, Artificial Sequence
  Synthetic oligonucleotide; TGG chr11 5268170 5268189 5268186 +
tatcatcctccttggaatcc

SEQ ID NO: 13492 - DNA, 20 bp, Artificial Sequence
  Synthetic oligonucleotide; AAG chr11 5268204 5268223 5268220 +
aacatccacattaattttac

SEQ ID NO: 13493 - DNA, 20 bp, Artificial Sequence
  Synthetic oligonucleotide; AAG chr11 5268223 5268242 5268239 +
caagcccccatacatttctt

SEQ ID NO: 13494 - DNA, 20 bp, Artificial Sequence
  Synthetic oligonucleotide; AGG chr11 5268224 5268243 5268240 +
aagcccccatacatttctta

SEQ ID NO: 13495 - DNA, 20 bp, Artificial Sequence
  Synthetic oligonucleotide; AAG chr11 5268227 5268246 5268243 +
cccccatacatttcttaagg

SEQ ID NO: 13496 - DNA, 20 bp, Artificial Sequence
  Synthetic oligonucleotide; TGG chr11 5268234 5268253 5268250 +
acatttcttaaggaagctct

SEQ ID NO: 13497 - DNA, 20 bp, Artificial Sequence
  Synthetic oligonucleotide; CAG chr11 5268263 5268282 5268279 +
ctatgtttctctccatccct

SEQ ID NO: 13498 - DNA, 20 bp, Artificial Sequence
  Synthetic oligonucleotide; AAG chr11 5268293 5268312 5268309 +
acactttttccttttaacac

SEQ ID NO: 13499 - DNA, 20 bp, Artificial Sequence
  Synthetic oligonucleotide; GAG chr11 5268295 5268314 5268311 +
actttttccttttaacacaa

SEQ ID NO: 13500 - DNA, 20 bp, Artificial Sequence
  Synthetic oligonucleotide; AAG chr11 5268301 5268320 5268317 +
tccttttaacacaagagtaa

SEQ ID NO: 13501 - DNA, 20 bp, Artificial Sequence
  Synthetic oligonucleotide; TGG chr11 5268305 5268324 5268321 +
tttaacacaagagtaaaaga

SEQ ID NO: 13502 - DNA, 20 bp, Artificial Sequence
  Synthetic oligonucleotide; GAG chr11 5268307 5268326 5268323 +
taacacaagagtaaaagatg

SEQ ID NO: 13503 - DNA, 20 bp, Artificial Sequence
  Synthetic oligonucleotide; AAG chr11 5268310 5268329 5268326 +
cacaagagtaaaagatggag

SEQ ID NO: 13504 - DNA, 20 bp, Artificial Sequence
  Synthetic oligonucleotide; AAG chr11 5268338 5268357 5268354 +
attgcaatttttgattactg

SEQ ID NO: 13505 - DNA, 20 bp, Artificial Sequence
  Synthetic oligonucleotide; CAG chr11 5268359 5268378 5268375 +
agaaaatgtactttattaaa

SEQ ID NO: 13506 - DNA, 20 bp, Artificial Sequence
  Synthetic oligonucleotide; AAG chr11 5268362 5268381 5268378 +
aaatgtactttattaaacag

SEQ ID NO: 13507 - DNA, 20 bp, Artificial Sequence
  Synthetic oligonucleotide; AGG chr11 5268363 5268382 5268379 +
aatgtactttattaaacaga

SEQ ID NO: 13508 - DNA, 20 bp, Artificial Sequence
  Synthetic oligonucleotide; AAG chr11 5268375 5268394 5268391 +
taaacagaaggctttctctc

SEQ ID NO: 13509 - DNA, 20 bp, Artificial Sequence
  Synthetic oligonucleotide; AGG chr11 5268376 5268395 5268392 +
aaacagaaggctttctctca

SEQ ID NO: 13510 - DNA, 20 bp, Artificial Sequence
  Synthetic oligonucleotide; AAG chr11 5268381 5268400 5268397 +
gaaggctttctctcaaggcc

SEQ ID NO: 13511 - DNA, 20 bp, Artificial Sequence
  Synthetic oligonucleotide; CAG chr11 5268386 5268405 5268402 +
ctttctctcaaggccaagcc

SEQ ID NO: 13512 - DNA, 20 bp, Artificial Sequence
  Synthetic oligonucleotide; CAG chr11 5268399 5268418 5268415 +
ccaagcccagtccccatgtg

SEQ ID NO: 13513 - DNA, 20 bp, Artificial Sequence
  Synthetic oligonucleotide; AAG chr11 5268402 5268421 5268418 +
agcccagtccccatgtgcag

SEQ ID NO: 13514 - DNA, 20 bp, Artificial Sequence
  Synthetic oligonucleotide; AGG chr11 5268403 5268422 5268419 +
gcccagtccccatgtgcaga

SEQ ID NO: 13515 - DNA, 20 bp, Artificial Sequence
  Synthetic oligonucleotide; GAG chr11 5268405 5268424 5268421 +
ccagtccccatgtgcagaag

SEQ ID NO: 13516 - DNA, 20 bp, Artificial Sequence
  Synthetic oligonucleotide; AGG chr11 5268406 5268425 5268422 +
cagtccccatgtgcagaagg

SEQ ID NO: 13517 - DNA, 20 bp, Artificial Sequence
  Synthetic oligonucleotide; GGG chr11 5268407 5268426 5268423 +
agtccccatgtgcagaagga

SEQ ID NO: 13518 - DNA, 20 bp, Artificial Sequence
  Synthetic oligonucleotide; CAG chr11 5268413 5268432 5268429 +
catgtgcagaaggagggtgt

SEQ ID NO: 13519 - DNA, 20 bp, Artificial Sequence
  Synthetic oligonucleotide; AGG chr11 5268414 5268433 5268430 +
atgtgcagaaggagggtgtc

SEQ ID NO: 13520 - DNA, 20 bp, Artificial Sequence
  Synthetic oligonucleotide; GGG chr11 5268415 5268434 5268431 +
tgtgcagaaggagggtgtca

SEQ ID NO: 13521 - DNA, 20 bp, Artificial Sequence
  Synthetic oligonucleotide; CAG chr11 5268421 5268440 5268437 +
gaaggagggtgtcagggtca

SEQ ID NO: 13522 - DNA, 20 bp, Artificial Sequence
  Synthetic oligonucleotide; AGG chr11 5268422 5268441 5268438 +
aaggagggtgtcagggtcac

SEQ ID NO: 13523 - DNA, 20 bp, Artificial Sequence
  Synthetic oligonucleotide; TGG chr11 5268438 5268457 5268454 +
tcacaggaacacctgcaaac

SEQ ID NO: 13524 - DNA, 20 bp, Artificial Sequence
  Synthetic oligonucleotide; AAG chr11 5268441 5268460 5268457 +
caggaacacctgcaaactgg

SEQ ID NO: 13525 - DNA, 20 bp, Artificial Sequence
  Synthetic oligonucleotide; GAG chr11 5268443 5268462 5268459 +
ggaacacctgcaaactggaa

SEQ ID NO: 13526 - DNA, 20 bp, Artificial Sequence
  Synthetic oligonucleotide; CAG chr11 5268450 5268469 5268466 +
ctgcaaactggaagagaact

SEQ ID NO: 13527 - DNA, 20 bp, Artificial Sequence
  Synthetic oligonucleotide; TGG chr11 5268453 5268472 5268469 +
caaactggaagagaactcag

SEQ ID NO: 13528 - DNA, 20 bp, Artificial Sequence
  Synthetic oligonucleotide; TGG chr11 5268462 5268481 5268478 +
agagaactcagtggtactta

SEQ ID NO: 13529 - DNA, 20 bp, Artificial Sequence
  Synthetic oligonucleotide; GGG chr11 5268463 5268482 5268479 +
gagaactcagtggtacttat

SEQ ID NO: 13530 - DNA, 20 bp, Artificial Sequence
  Synthetic oligonucleotide; CAG chr11 5268467 5268486 5268483 +
actcagtggtacttatgggc

SEQ ID NO: 13531 - DNA, 20 bp, Artificial Sequence
  Synthetic oligonucleotide; AGG chr11 5268468 5268487 5268484 +
ctcagtggtacttatgggcc

SEQ ID NO: 13532 - DNA, 20 bp, Artificial Sequence
  Synthetic oligonucleotide; GGG chr11 5268469 5268488 5268485 +
tcagtggtacttatgggcca

SEQ ID NO: 13533 - DNA, 20 bp, Artificial Sequence
  Synthetic oligonucleotide; TGG chr11 5268475 5268494 5268491 +
gtacttatgggccagggcaa

SEQ ID NO: 13534 - DNA, 20 bp, Artificial Sequence
  Synthetic oligonucleotide; CAG chr11 5268481 5268500 5268497 +
atgggccagggcaatggcga

SEQ ID NO: 13535 - DNA, 20 bp, Artificial Sequence
  Synthetic oligonucleotide; CAG chr11 5268484 5268503 5268500 +
ggccagggcaatggcgacag

SEQ ID NO: 13536 - DNA, 20 bp, Artificial Sequence
  Synthetic oligonucleotide; CAG chr11 5268491 5268510 5268507 +
gcaatggcgacagcagacac

SEQ ID NO: 13537 - DNA, 20 bp, Artificial Sequence
  Synthetic oligonucleotide; CAG chr11 5268501 5268520 5268517 +
cagcagacaccagcttctgc

SEQ ID NO: 13538 - DNA, 20 bp, Artificial Sequence
  Synthetic oligonucleotide; AGG chr11 5268502 5268521 5268518 +
agcagacaccagcttctgcc

SEQ ID NO: 13539 - DNA, 20 bp, Artificial Sequence
  Synthetic oligonucleotide; CAG chr11 5268505 5268524 5268521 +
agacaccagcttctgccagg

SEQ ID NO: 13540 - DNA, 20 bp, Artificial Sequence
  Synthetic oligonucleotide; CAG chr11 5268517 5268536 5268533 +
ctgccaggcagcctgcactt

SEQ ID NO: 13541 - DNA, 20 bp, Artificial Sequence
  Synthetic oligonucleotide; AGG chr11 5268518 5268537 5268534 +
tgccaggcagcctgcacttc

SEQ ID NO: 13542 - DNA, 20 bp, Artificial Sequence
  Synthetic oligonucleotide; GGG chr11 5268519 5268538 5268535 +
gccaggcagcctgcacttca

SEQ ID NO: 13543 - DNA, 20 bp, Artificial Sequence
  Synthetic oligonucleotide; GGG chr11 5268520 5268539 5268536 +
ccaggcagcctgcacttcag

SEQ ID NO: 13544 - DNA, 20 bp, Artificial Sequence
  Synthetic oligonucleotide; AAG chr11 5268537 5268556 5268553 +
caggggtgaactccttgcca

SEQ ID NO: 13545 - DNA, 20 bp, Artificial Sequence
  Synthetic oligonucleotide; GAG chr11 5268541 5268560 5268557 +
ggtgaactccttgccaaagt

SEQ ID NO: 13546 - DNA, 20 bp, Artificial Sequence
  Synthetic oligonucleotide; TAG chr11 5268544 5268563 5268560 +
gaactccttgccaaagtgag

SEQ ID NO: 13547 - DNA, 20 bp, Artificial Sequence
  Synthetic oligonucleotide; CAG chr11 5268548 5268567 5268564 +
tccttgccaaagtgagtagc

SEQ ID NO: 13548 - DNA, 20 bp, Artificial Sequence
  Synthetic oligonucleotide; CAG chr11 5268572 5268591 5268588 +
ataatcaccatcacgttacc

SEQ ID NO: 13549 - DNA, 20 bp, Artificial Sequence
  Synthetic oligonucleotide; AGG chr11 5268573 5268592 5268589 +
taatcaccatcacgttaccc

SEQ ID NO: 13550 - DNA, 20 bp, Artificial Sequence
  Synthetic oligonucleotide; GAG chr11 5268575 5268594 5268591 +
atcaccatcacgttacccag

SEQ ID NO: 13551 - DNA, 20 bp, Artificial Sequence
  Synthetic oligonucleotide; TAG chr11 5268582 5268601 5268598 +
tcacgttacccaggagctgt

SEQ ID NO: 13552 - DNA, 20 bp, Artificial Sequence
  Synthetic oligonucleotide; AGG chr11 5268583 5268602 5268599 +
cacgttacccaggagctgtt

SEQ ID NO: 13553 - DNA, 20 bp, Artificial Sequence
  Synthetic oligonucleotide; AAG chr11 5268589 5268608 5268605 +
acccaggagctgttaggcaa

SEQ ID NO: 13554 - DNA, 20 bp, Artificial Sequence
  Synthetic oligonucleotide; CAG chr11 5268605 5268624 5268621 +
gcaaaagacaaaataacaca

SEQ ID NO: 13555 - DNA, 20 bp, Artificial Sequence
  Synthetic oligonucleotide; AGG chr11 5268606 5268625 5268622 +
caaaagacaaaataacacac

SEQ ID NO: 13556 - DNA, 20 bp, Artificial Sequence
  Synthetic oligonucleotide; GAG chr11 5268615 5268634 5268631 +
aaataacacacaggcatgtt

SEQ ID NO: 13557 - DNA, 20 bp, Artificial Sequence
  Synthetic oligonucleotide; TAG chr11 5268618 5268637 5268634 +
taacacacaggcatgttgag

SEQ ID NO: 13558 - DNA, 20 bp, Artificial Sequence
  Synthetic oligonucleotide; AAG chr11 5268621 5268640 5268637 +
cacacaggcatgttgagtag

SEQ ID NO: 13559 - DNA, 20 bp, Artificial Sequence
  Synthetic oligonucleotide; CGG chr11 5268668 5268687 5268684 +
aacaaacaaacaaacaaaaa

SEQ ID NO: 13560 - DNA, 20 bp, Artificial Sequence
  Synthetic oligonucleotide; TAG chr11 5268688 5268707 5268704 +
cggctttatacctacattcc

SEQ ID NO: 13561 - DNA, 20 bp, Artificial Sequence
  Synthetic oligonucleotide; AAG chr11 5268715 5268734 5268731 +
ccctgacctcaaactgttcc

SEQ ID NO: 13562 - DNA, 20 bp, Artificial Sequence
  Synthetic oligonucleotide; AGG chr11 5268716 5268735 5268732 +
cctgacctcaaactgttcca

SEQ ID NO: 13563 - DNA, 20 bp, Artificial Sequence
  Synthetic oligonucleotide; CAG chr11 5268740 5268759 5268756 +
ttgtgcccacccaaaaaatt

SEQ ID NO: 13564 - DNA, 20 bp, Artificial Sequence
  Synthetic oligonucleotide; GAG chr11 5268745 5268764 5268761 +
cccacccaaaaaattcagat

SEQ ID NO: 13565 - DNA, 20 bp, Artificial Sequence
  Synthetic oligonucleotide; TAG chr11 5268750 5268769 5268766 +
ccaaaaaattcagatgagct

SEQ ID NO: 13566 - DNA, 20 bp, Artificial Sequence
  Synthetic oligonucleotide; AGG chr11 5268751 5268770 5268767 +
caaaaaattcagatgagctt

SEQ ID NO: 13567 - DNA, 20 bp, Artificial Sequence
  Synthetic oligonucleotide; GAG chr11 5268770 5268789 5268786 +
taggttcaattttattctat

SEQ ID NO: 13568 - DNA, 20 bp, Artificial Sequence
  Synthetic oligonucleotide; CAG chr11 5268826 5268845 5268842 +
cacccccttccccattttac

SEQ ID NO: 13569 - DNA, 20 bp, Artificial Sequence
  Synthetic oligonucleotide; TGG chr11 5268835 5268854 5268851 +
ccccattttaccagtattat

SEQ ID NO: 13570 - DNA, 20 bp, Artificial Sequence
  Synthetic oligonucleotide; GGG chr11 5268836 5268855 5268852 +
cccattttaccagtattatt

SEQ ID NO: 13571 - DNA, 20 bp, Artificial Sequence
  Synthetic oligonucleotide; AAG chr11 5268863 5268882 5268879 +
ctctctccctgtttttcttt

SEQ ID NO: 13572 - DNA, 20 bp, Artificial Sequence
  Synthetic oligonucleotide; TAG chr11 5268889 5268908 5268905 +
ttgtctaatttttgtaaatg

SEQ ID NO: 13573 - DNA, 20 bp, Artificial Sequence
  Synthetic oligonucleotide; GAG chr11 5268897 5268916 5268913 +
tttttgtaaatgtagaatgt

SEQ ID NO: 13574 - DNA, 20 bp, Artificial Sequence
  Synthetic oligonucleotide; AAG chr11 5268906 5268925 5268922 +
atgtagaatgtgagtgctgc

SEQ ID NO: 13575 - DNA, 20 bp, Artificial Sequence
  Synthetic oligonucleotide; GAG chr11 5268908 5268927 5268924 +
gtagaatgtgagtgctgcaa

SEQ ID NO: 13576 - DNA, 20 bp, Artificial Sequence
  Synthetic oligonucleotide; CAG chr11 5268915 5268934 5268931 +
gtgagtgctgcaagagttct

SEQ ID NO: 13577 - DNA, 20 bp, Artificial Sequence
  Synthetic oligonucleotide; CGG chr11 5268918 5268937 5268934 +
agtgctgcaagagttctcag

SEQ ID NO: 13578 - DNA, 20 bp, Artificial Sequence
  Synthetic oligonucleotide; GGG chr11 5268919 5268938 5268935 +
gtgctgcaagagttctcagc

SEQ ID NO: 13579 - DNA, 20 bp, Artificial Sequence
  Synthetic oligonucleotide; GAG chr11 5268921 5268940 5268937 +
gctgcaagagttctcagcgg

SEQ ID NO: 13580 - DNA, 20 bp, Artificial Sequence
  Synthetic oligonucleotide; CGG chr11 5268944 5268963 5268960 +
tttaaaatccccaacaaatt

SEQ ID NO: 13581 - DNA, 20 bp, Artificial Sequence
  Synthetic oligonucleotide; AAG chr11 5268951 5268970 5268967 +
tccccaacaaattcggaaac

SEQ ID NO: 13582 - DNA, 20 bp, Artificial Sequence
  Synthetic oligonucleotide; TGG chr11 5268962 5268981 5268978 +
ttcggaaacaagccttcact

SEQ ID NO: 13583 - DNA, 20 bp, Artificial Sequence
  Synthetic oligonucleotide; TGG chr11 5268977 5268996 5268993 +
tcacttggtcacaatactga

SEQ ID NO: 13584 - DNA, 20 bp, Artificial Sequence
  Synthetic oligonucleotide; GGG chr11 5268978 5268997 5268994 +
cacttggtcacaatactgat

SEQ ID NO: 13585 - DNA, 20 bp, Artificial Sequence
  Synthetic oligonucleotide; TAG chr11 5268996 5269015 5269012 +
atgggaaatttaacatattt

SEQ ID NO: 13586 - DNA, 20 bp, Artificial Sequence
  Synthetic oligonucleotide; GAG chr11 5269021 5269040 5269037 +
aatgtgtcttatttttcttt

SEQ ID NO: 13587 - DNA, 20 bp, Artificial Sequence
  Synthetic oligonucleotide; AAG chr11 5269089 5269108 5269105 +
tatcatgacccacataaaat

SEQ ID NO: 13588 - DNA, 20 bp, Artificial Sequence
  Synthetic oligonucleotide; AGG chr11 5269090 5269109 5269106 +
atcatgacccacataaaata

SEQ ID NO: 13589 - DNA, 20 bp, Artificial Sequence
  Synthetic oligonucleotide; TGG chr11 5269112 5269131 5269128 +
gcatttctatttccttgaaa

SEQ ID NO: 13590 - DNA, 20 bp, Artificial Sequence
  Synthetic oligonucleotide; AAG chr11 5269130 5269149 5269146 +
aatggactttcatctaccaa

SEQ ID NO: 13591 - DNA, 20 bp, Artificial Sequence
  Synthetic oligonucleotide; AAG chr11 5269155 5269174 5269171 +
aaatttcattcttctttcac

SEQ ID NO: 13592 - DNA, 20 bp, Artificial Sequence
  Synthetic oligonucleotide; TGG chr11 5269183 5269202 5269199 +
aattctataatacaattctc

SEQ ID NO: 13593 - DNA, 20 bp, Artificial Sequence
  Synthetic oligonucleotide; GGG chr11 5269184 5269203 5269200 +
attctataatacaattctct

SEQ ID NO: 13594 - DNA, 20 bp, Artificial Sequence
  Synthetic oligonucleotide; AAG chr11 5269198 5269217 5269214 +
ttctctgggataaacacatc

SEQ ID NO: 13595 - DNA, 20 bp, Artificial Sequence
  Synthetic oligonucleotide; TGG chr11 5269204 5269223 5269220 +
gggataaacacatcaagttc

SEQ ID NO: 13596 - DNA, 20 bp, Artificial Sequence
  Synthetic oligonucleotide; AAG chr11 5269208 5269227 5269224 +
taaacacatcaagttctggc

SEQ ID NO: 13597 - DNA, 20 bp, Artificial Sequence
  Synthetic oligonucleotide; AAG chr11 5269221 5269240 5269237 +
ttctggcaagatttcctgaa

SEQ ID NO: 13598 - DNA, 20 bp, Artificial Sequence
  Synthetic oligonucleotide; AAG chr11 5269226 5269245 5269242 +
gcaagatttcctgaaaagtt

SEQ ID NO: 13599 - DNA, 20 bp, Artificial Sequence
  Synthetic oligonucleotide; CAG chr11 5269235 5269254 5269251 +
cctgaaaagttaagccaatt

SEQ ID NO: 13600 - DNA, 20 bp, Artificial Sequence
  Synthetic oligonucleotide; AGG chr11 5269236 5269255 5269252 +
ctgaaaagttaagccaattc

SEQ ID NO: 13601 - DNA, 20 bp, Artificial Sequence
  Synthetic oligonucleotide; TAG chr11 5269243 5269262 5269259 +
gttaagccaattcaggctgt

SEQ ID NO: 13602 - DNA, 20 bp, Artificial Sequence
  Synthetic oligonucleotide; TAG chr11 5269246 5269265 5269262 +
aagccaattcaggctgttag

SEQ ID NO: 13603 - DNA, 20 bp, Artificial Sequence
  Synthetic oligonucleotide; TAG chr11 5269263 5269282 5269279 +
tagtagtcctttactgtcac

SEQ ID NO: 13604 - DNA, 20 bp, Artificial Sequence
  Synthetic oligonucleotide; AAG chr11 5269279 5269298 5269295 +
tcactagttctgaatcatgt

SEQ ID NO: 13605 - DNA, 20 bp, Artificial Sequence
  Synthetic oligonucleotide; TGG chr11 5269285 5269304 5269301 +
gttctgaatcatgtaagttt

SEQ ID NO: 13606 - DNA, 20 bp, Artificial Sequence
  Synthetic oligonucleotide; TAG chr11 5269298 5269317 5269314 +
taagttttggttatgctcac

SEQ ID NO: 13607 - DNA, 20 bp, Artificial Sequence
  Synthetic oligonucleotide; AAG chr11 5269301 5269320 5269317 +
gttttggttatgctcactag

SEQ ID NO: 13608 - DNA, 20 bp, Artificial Sequence
  Synthetic oligonucleotide; AAG chr11 5269321 5269340 5269337 +
aagtctgctgttctaacatc

SEQ ID NO: 13609 - DNA, 20 bp, Artificial Sequence
  Synthetic oligonucleotide; GAG chr11 5269341 5269360 5269357 +
aagctcgacccatgatttct

SEQ ID NO: 13610 - DNA, 20 bp, Artificial Sequence
  Synthetic oligonucleotide; TGG chr11 5269352 5269371 5269368 +
atgatttctgagatctttgt

SEQ ID NO: 13611 - DNA, 20 bp, Artificial Sequence
  Synthetic oligonucleotide; AAG chr11 5269365 5269384 5269381 +
tctttgttggtctttccaat

SEQ ID NO: 13612 - DNA, 20 bp, Artificial Sequence
  Synthetic oligonucleotide; GAG chr11 5269373 5269392 5269389 +
ggtctttccaataagattat

SEQ ID NO: 13613 - DNA, 20 bp, Artificial Sequence
  Synthetic oligonucleotide; AAG chr11 5269398 5269417 5269414 +
tcaattaatgtcaaaatata

SEQ ID NO: 13614 - DNA, 20 bp, Artificial Sequence
  Synthetic oligonucleotide; CAG chr11 5269418 5269437 5269434 +
aagccaaaaaatcacatcac

SEQ ID NO: 13615 - DNA, 20 bp, Artificial Sequence
  Synthetic oligonucleotide; AAG chr11 5269438 5269457 5269454 +
cagcacctgaactcaccttg

SEQ ID NO: 13616 - DNA, 20 bp, Artificial Sequence
  Synthetic oligonucleotide; CAG chr11 5269445 5269464 5269461 +
tgaactcaccttgaagttct

SEQ ID NO: 13617 - DNA, 20 bp, Artificial Sequence
  Synthetic oligonucleotide; AGG chr11 5269446 5269465 5269462 +
gaactcaccttgaagttctc

SEQ ID NO: 13618 - DNA, 20 bp, Artificial Sequence
  Synthetic oligonucleotide; CAG chr11 5269458 5269477 5269474 +
aagttctcaggatccacatg

SEQ ID NO: 13619 - DNA, 20 bp, Artificial Sequence
  Synthetic oligonucleotide; CAG chr11 5269468 5269487 5269484 +
gatccacatgcagcttgtca

SEQ ID NO: 13620 - DNA, 20 bp, Artificial Sequence
  Synthetic oligonucleotide; CAG chr11 5269473 5269492 5269489 +
acatgcagcttgtcacagtg

SEQ ID NO: 13621 - DNA, 20 bp, Artificial Sequence
  Synthetic oligonucleotide; CAG chr11 5269482 5269501 5269498 +
ttgtcacagtgcagctcact

SEQ ID NO: 13622 - DNA, 20 bp, Artificial Sequence
  Synthetic oligonucleotide; TAG chr11 5269487 5269506 5269503 +
acagtgcagctcactcagct

SEQ ID NO: 13623 - DNA, 20 bp, Artificial Sequence
  Synthetic oligonucleotide; AAG chr11 5269492 5269511 5269508 +
gcagctcactcagcttagca

SEQ ID NO: 13624 - DNA, 20 bp, Artificial Sequence
  Synthetic oligonucleotide; AGG chr11 5269493 5269512 5269509 +
cagctcactcagcttagcaa

SEQ ID NO: 13625 - DNA, 20 bp, Artificial Sequence
  Synthetic oligonucleotide; CGG chr11 5269496 5269515 5269512 +
ctcactcagcttagcaaagg

SEQ ID NO: 13626 - DNA, 20 bp, Artificial Sequence
  Synthetic oligonucleotide; GGG chr11 5269497 5269516 5269513 +
tcactcagcttagcaaaggc

SEQ ID NO: 13627 - DNA, 20 bp, Artificial Sequence
  Synthetic oligonucleotide; GAG chr11 5269503 5269522 5269519 +
agcttagcaaaggcgggctt

SEQ ID NO: 13628 - DNA, 20 bp, Artificial Sequence
  Synthetic oligonucleotide; AGG chr11 5269504 5269523 5269520 +
gcttagcaaaggcgggcttg

SEQ ID NO: 13629 - DNA, 20 bp, Artificial Sequence
  Synthetic oligonucleotide; TAG chr11 5269523 5269542 5269539 +
gaggttgtccatgtttttaa

SEQ ID NO: 13630 - DNA, 20 bp, Artificial Sequence
  Synthetic oligonucleotide; AAG chr11 5269534 5269553 5269550 +
tgtttttaatagcatctcca

SEQ ID NO: 13631 - DNA, 20 bp, Artificial Sequence
  Synthetic oligonucleotide; AGG chr11 5269535 5269554 5269551 +
gtttttaatagcatctccaa

SEQ ID NO: 13632 - DNA, 20 bp, Artificial Sequence
  Synthetic oligonucleotide; AAG chr11 5269538 5269557 5269554 +
tttaatagcatctccaaagg

SEQ ID NO: 13633 - DNA, 20 bp, Artificial Sequence
  Synthetic oligonucleotide; CAG chr11 5269542 5269561 5269558 +
atagcatctccaaaggaagt

SEQ ID NO: 13634 - DNA, 20 bp, Artificial Sequence
  Synthetic oligonucleotide; TGG chr11 5269558 5269577 5269574 +
aagtcagcaccttcttgcca

SEQ ID NO: 13635 - DNA, 20 bp, Artificial Sequence
  Synthetic oligonucleotide; GGG chr11 5269559 5269578 5269575 +
agtcagcaccttcttgccat

SEQ ID NO: 13636 - DNA, 20 bp, Artificial Sequence
  Synthetic oligonucleotide; TGG chr11 5269571 5269590 5269587 +
cttgccatgggccttgacct

SEQ ID NO: 13637 - DNA, 20 bp, Artificial Sequence
  Synthetic oligonucleotide; GGG chr11 5269572 5269591 5269588 +
ttgccatgggccttgacctt

SEQ ID NO: 13638 - DNA, 20 bp, Artificial Sequence
  Synthetic oligonucleotide; GGG chr11 5269573 5269592 5269589 +
tgccatgggccttgaccttg

SEQ ID NO: 13639 - DNA, 20 bp, Artificial Sequence
  Synthetic oligonucleotide; CAG chr11 5269581 5269600 5269597 +
gccttgaccttggggttgcc

SEQ ID NO: 13640 - DNA, 20 bp, Artificial Sequence
  Synthetic oligonucleotide; AGG chr11 5269582 5269601 5269598 +
ccttgaccttggggttgccc

SEQ ID NO: 13641 - DNA, 20 bp, Artificial Sequence
  Synthetic oligonucleotide; TGG chr11 5269586 5269605 5269602 +
gaccttggggttgcccagga

SEQ ID NO: 13642 - DNA, 20 bp, Artificial Sequence
  Synthetic oligonucleotide; CAG chr11 5269589 5269608 5269605 +
cttggggttgcccaggatgg

SEQ ID NO: 13643 - DNA, 20 bp, Artificial Sequence
  Synthetic oligonucleotide; GAG chr11 5269591 5269610 5269607 +
tggggttgcccaggatggca

SEQ ID NO: 13644 - DNA, 20 bp, Artificial Sequence
  Synthetic oligonucleotide; AGG chr11 5269592 5269611 5269608 +
ggggttgcccaggatggcag

SEQ ID NO: 13645 - DNA, 20 bp, Artificial Sequence
  Synthetic oligonucleotide; GGG chr11 5269593 5269612 5269609 +
gggttgcccaggatggcaga

SEQ ID NO: 13646 - DNA, 20 bp, Artificial Sequence
  Synthetic oligonucleotide; GAG chr11 5269595 5269614 5269611 +
gttgcccaggatggcagagg

SEQ ID NO: 13647 - DNA, 20 bp, Artificial Sequence
  Synthetic oligonucleotide; CAG chr11 5269602 5269621 5269618 +
aggatggcagagggagacga

SEQ ID NO: 13648 - DNA, 20 bp, Artificial Sequence
  Synthetic oligonucleotide; AGG chr11 5269603 5269622 5269619 +
ggatggcagagggagacgac

SEQ ID NO: 13649 - DNA, 20 bp, Artificial Sequence
  Synthetic oligonucleotide; AAG chr11 5269612 5269631 5269628 +
agggagacgacaggtttcca

SEQ ID NO: 13650 - DNA, 20 bp, Artificial Sequence
  Synthetic oligonucleotide; TGG chr11 5269630 5269649 5269646 +
caaagctgtcaaaaaatctc

SEQ ID NO: 13651 - DNA, 20 bp, Artificial Sequence
  Synthetic oligonucleotide; GGG chr11 5269631 5269650 5269647 +
aaagctgtcaaaaaatctct

SEQ ID NO: 13652 - DNA, 20 bp, Artificial Sequence
  Synthetic oligonucleotide; CAG chr11 5269636 5269655 5269652 +
tgtcaaaaaatctctgggtc

SEQ ID NO: 13653 - DNA, 20 bp, Artificial Sequence
  Synthetic oligonucleotide; AGG chr11 5269637 5269656 5269653 +
gtcaaaaaatctctgggtcc

SEQ ID NO: 13654 - DNA, 20 bp, Artificial Sequence
  Synthetic oligonucleotide; GGG chr11 5269638 5269657 5269654 +
tcaaaaaatctctgggtcca

SEQ ID NO: 13655 - DNA, 20 bp, Artificial Sequence
  Synthetic oligonucleotide; GGG chr11 5269639 5269658 5269655 +
caaaaaatctctgggtccag

SEQ ID NO: 13656 - DNA, 20 bp, Artificial Sequence
  Synthetic oligonucleotide; GAG chr11 5269650 5269669 5269666 +
tgggtccaggggtaaacaac

SEQ ID NO: 13657 - DNA, 20 bp, Artificial Sequence
  Synthetic oligonucleotide; AGG chr11 5269651 5269670 5269667 +
gggtccaggggtaaacaacg

SEQ ID NO: 13658 - DNA, 20 bp, Artificial Sequence
  Synthetic oligonucleotide; GAG chr11 5269653 5269672 5269669 +
gtccaggggtaaacaacgag

SEQ ID NO: 13659 - DNA, 20 bp, Artificial Sequence
  Synthetic oligonucleotide; CAG chr11 5269676 5269695 5269692 +
tctatgaaatgacaccatat

SEQ ID NO: 13660 - DNA, 20 bp, Artificial Sequence
  Synthetic oligonucleotide; TAG chr11 5269688 5269707 5269704 +
caccatatcagatacaaaat

SEQ ID NO: 13661 - DNA, 20 bp, Artificial Sequence
  Synthetic oligonucleotide; GAG chr11 5269690 5269709 5269706 +
ccatatcagatacaaaatta

SEQ ID NO: 13662 - DNA, 20 bp, Artificial Sequence
  Synthetic oligonucleotide; GAG chr11 5269707 5269726 5269723 +
ttagagatgcaaaaaatctt

SEQ ID NO: 13663 - DNA, 20 bp, Artificial Sequence
  Synthetic oligonucleotide; AGG chr11 5269708 5269727 5269724 +
tagagatgcaaaaaatcttg

SEQ ID NO: 13664 - DNA, 20 bp, Artificial Sequence
  Synthetic oligonucleotide; TAG chr11 5269730 5269749 5269746 +
gactttcccaatcaacttgc

SEQ ID NO: 13665 - DNA, 20 bp, Artificial Sequence
  Synthetic oligonucleotide; AGG chr11 5269731 5269750 5269747 +
actttcccaatcaacttgct

SEQ ID NO: 13666 - DNA, 20 bp, Artificial Sequence
  Synthetic oligonucleotide; GGG chr11 5269732 5269751 5269748 +
ctttcccaatcaacttgcta

SEQ ID NO: 13667 - DNA, 20 bp, Artificial Sequence
  Synthetic oligonucleotide; GAG chr11 5269763 5269782 5269779 +
acccttcattcccatgcatt

SEQ ID NO: 13668 - DNA, 20 bp, Artificial Sequence
  Synthetic oligonucleotide; AAG chr11 5269785 5269804 5269801 +
gaaccaatgcttacctgccc

SEQ ID NO: 13669 - DNA, 20 bp, Artificial Sequence
  Synthetic oligonucleotide; AGG chr11 5269786 5269805 5269802 +
aaccaatgcttacctgccca

SEQ ID NO: 13670 - DNA, 20 bp, Artificial Sequence
  Synthetic oligonucleotide; CAG chr11 5269798 5269817 5269814 +
cctgcccaaggcttcacctc

SEQ ID NO: 13671 - DNA, 20 bp, Artificial Sequence
  Synthetic oligonucleotide; CAG chr11 5269826 5269845 5269842 +
tccacattcatcttgctcca

SEQ ID NO: 13672 - DNA, 20 bp, Artificial Sequence
  Synthetic oligonucleotide; AGG chr11 5269827 5269846 5269843 +
ccacattcatcttgctccac

SEQ ID NO: 13673 - DNA, 20 bp, Artificial Sequence
  Synthetic oligonucleotide; TAG chr11 5269831 5269850 5269847 +
attcatcttgctccacaggc

SEQ ID NO: 13674 - DNA, 20 bp, Artificial Sequence
  Synthetic oligonucleotide; CGG chr11 5269837 5269856 5269853 +
cttgctccacaggctagtga

SEQ ID NO: 13675 - DNA, 20 bp, Artificial Sequence
  Synthetic oligonucleotide; CAG chr11 5269840 5269859 5269856 +
gctccacaggctagtgacgg

SEQ ID NO: 13676 - DNA, 20 bp, Artificial Sequence
  Synthetic oligonucleotide; CAG chr11 5269852 5269871 5269868 +
agtgacggcagccttctcct

SEQ ID NO: 13677 - DNA, 20 bp, Artificial Sequence
  Synthetic oligonucleotide; CAG chr11 5269855 5269874 5269871 +
gacggcagccttctcctcag

SEQ ID NO: 13678 - DNA, 20 bp, Artificial Sequence
  Synthetic oligonucleotide; CAG chr11 5269876 5269895 5269892 +
agtaaaatgcaccatgatgc

SEQ ID NO: 13679 - DNA, 20 bp, Artificial Sequence
  Synthetic oligonucleotide; AGG chr11 5269877 5269896 5269893 +
gtaaaatgcaccatgatgcc

SEQ ID NO: 13680 - DNA, 20 bp, Artificial Sequence
  Synthetic oligonucleotide; GAG chr11 5269883 5269902 5269899 +
tgcaccatgatgccaggcct

SEQ ID NO: 13681 - DNA, 20 bp, Artificial Sequence
  Synthetic oligonucleotide; GAG chr11 5269885 5269904 5269901 +
caccatgatgccaggcctga

SEQ ID NO: 13682 - DNA, 20 bp, Artificial Sequence
  Synthetic oligonucleotide; TAG chr11 5269893 5269912 5269909 +
tgccaggcctgagagcttgc

SEQ ID NO: 13683 - DNA, 20 bp, Artificial Sequence
  Synthetic oligonucleotide; CAG chr11 5269902 5269921 5269918 +
tgagagcttgctagtgattg

SEQ ID NO: 13684 - DNA, 20 bp, Artificial Sequence
  Synthetic oligonucleotide; CGG chr11 5269911 5269930 5269927 +
gctagtgattgcagctgtgt

SEQ ID NO: 13685 - DNA, 20 bp, Artificial Sequence
  Synthetic oligonucleotide; AAG chr11 5269914 5269933 5269930 +
agtgattgcagctgtgtcgg

SEQ ID NO: 13686 - DNA, 20 bp, Artificial Sequence
  Synthetic oligonucleotide; CAG chr11 5269917 5269936 5269933 +
gattgcagctgtgtcggaag

SEQ ID NO: 13687 - DNA, 20 bp, Artificial Sequence
  Synthetic oligonucleotide; TGG chr11 5269943 5269962 5269959 +
tgtgctgctgcctctctgtc

SEQ ID NO: 13688 - DNA, 20 bp, Artificial Sequence
  Synthetic oligonucleotide; AAG chr11 5269966 5269985 5269982 +
ccttttattctttactgccg

SEQ ID NO: 13689 - DNA, 20 bp, Artificial Sequence
  Synthetic oligonucleotide; TGG chr11 5269972 5269991 5269988 +
attctttactgccgaagttc

SEQ ID NO: 13690 - DNA, 20 bp, Artificial Sequence
  Synthetic oligonucleotide; TGG chr11 5269989 5270008 5270005 +
ttctggccccctgttctcca

SEQ ID NO: 13691 - DNA, 20 bp, Artificial Sequence
  Synthetic oligonucleotide; AAG chr11 5269999 5270018 5270015 +
ctgttctccatggtacttaa

SEQ ID NO: 13692 - DNA, 20 bp, Artificial Sequence
  Synthetic oligonucleotide; TGG chr11 5270006 5270025 5270022 +
ccatggtacttaaaagtcat

SEQ ID NO: 13693 - DNA, 20 bp, Artificial Sequence
  Synthetic oligonucleotide; AAG chr11 5270011 5270030 5270027 +
gtacttaaaagtcattggtc

SEQ ID NO: 13694 - DNA, 20 bp, Artificial Sequence
  Synthetic oligonucleotide; AGG chr11 5270012 5270031 5270028 +
tacttaaaagtcattggtca

SEQ ID NO: 13695 - DNA, 20 bp, Artificial Sequence
  Synthetic oligonucleotide; CAG chr11 5270030 5270049 5270046 +
caaggctgacctgtgtccct

SEQ ID NO: 13696 - DNA, 20 bp, Artificial Sequence
  Synthetic oligonucleotide; AGG chr11 5270031 5270050 5270047 +
aaggctgacctgtgtccctc

SEQ ID NO: 13697 - DNA, 20 bp, Artificial Sequence
  Synthetic oligonucleotide; GGG chr11 5270032 5270051 5270048 +
aggctgacctgtgtccctca

SEQ ID NO: 13698 - DNA, 20 bp, Artificial Sequence
  Synthetic oligonucleotide; GGG chr11 5270033 5270052 5270049 +
ggctgacctgtgtccctcag

SEQ ID NO: 13699 - DNA, 20 bp, Artificial Sequence
  Synthetic oligonucleotide; TGG chr11 5270036 5270055 5270052 +
tgacctgtgtccctcagggg

SEQ ID NO: 13700 - DNA, 20 bp, Artificial Sequence
  Synthetic oligonucleotide; GAG chr11 5270038 5270057 5270054 +
acctgtgtccctcaggggtg

SEQ ID NO: 13701 - DNA, 20 bp, Artificial Sequence
  Synthetic oligonucleotide; CAG chr11 5270042 5270061 5270058 +
gtgtccctcaggggtggagt

SEQ ID NO: 13702 - DNA, 20 bp, Artificial Sequence
  Synthetic oligonucleotide; AGG chr11 5270043 5270062 5270059 +
tgtccctcaggggtggagtc

SEQ ID NO: 13703 - DNA, 20 bp, Artificial Sequence
  Synthetic oligonucleotide; CGG chr11 5270048 5270067 5270064 +
ctcaggggtggagtcaggtc

SEQ ID NO: 13704 - DNA, 20 bp, Artificial Sequence
  Synthetic oligonucleotide; GAG chr11 5270050 5270069 5270066 +
caggggtggagtcaggtccg

SEQ ID NO: 13705 - DNA, 20 bp, Artificial Sequence
  Synthetic oligonucleotide; GAG chr11 5270052 5270071 5270068 +
ggggtggagtcaggtccgga

SEQ ID NO: 13706 - DNA, 20 bp, Artificial Sequence
  Synthetic oligonucleotide; AGG chr11 5270053 5270072 5270069 +
gggtggagtcaggtccggag

SEQ ID NO: 13707 - DNA, 20 bp, Artificial Sequence
  Synthetic oligonucleotide; GGG chr11 5270054 5270073 5270070 +
ggtggagtcaggtccggaga

SEQ ID NO: 13708 - DNA, 20 bp, Artificial Sequence
  Synthetic oligonucleotide; CAG chr11 5270058 5270077 5270074 +
gagtcaggtccggagagggt

SEQ ID NO: 13709 - DNA, 20 bp, Artificial Sequence
  Synthetic oligonucleotide; CAG chr11 5270061 5270080 5270077 +
tcaggtccggagagggtcag

SEQ ID NO: 13710 - DNA, 20 bp, Artificial Sequence
  Synthetic oligonucleotide; TGG chr11 5270067 5270086 5270083 +
ccggagagggtcagcagtga

SEQ ID NO: 13711 - DNA, 20 bp, Artificial Sequence
  Synthetic oligonucleotide; TGG chr11 5270071 5270090 5270087 +
agagggtcagcagtgatgga

SEQ ID NO: 13712 - DNA, 20 bp, Artificial Sequence
  Synthetic oligonucleotide; AAG chr11 5270079 5270098 5270095 +
agcagtgatggatggacact

SEQ ID NO: 13713 - DNA, 20 bp, Artificial Sequence
  Synthetic oligonucleotide; TGG chr11 5270099 5270118 5270115 +
aagtttgtgataatgtgtgc

SEQ ID NO: 13714 - DNA, 20 bp, Artificial Sequence
  Synthetic oligonucleotide; GAG chr11 5270107 5270126 5270123 +
gataatgtgtgctggatcct

SEQ ID NO: 13715 - DNA, 20 bp, Artificial Sequence
  Synthetic oligonucleotide; AGG chr11 5270108 5270127 5270124 +
ataatgtgtgctggatcctg

SEQ ID NO: 13716 - DNA, 20 bp, Artificial Sequence
  Synthetic oligonucleotide; TGG chr11 5270122 5270141 5270138 +
atcctgaggctcttttttgt

SEQ ID NO: 13717 - DNA, 20 bp, Artificial Sequence
  Synthetic oligonucleotide; AAG chr11 5270223 5270242 5270239 +
ctctcccattctccttttcc

SEQ ID NO: 13718 - DNA, 20 bp, Artificial Sequence
  Synthetic oligonucleotide; AAG chr11 5270227 5270246 5270243 +
cccattctccttttccaaga

SEQ ID NO: 13719 - DNA, 20 bp, Artificial Sequence
  Synthetic oligonucleotide; AAG chr11 5270239 5270258 5270255 +
ttccaagaaagcctcatata

SEQ ID NO: 13720 - DNA, 20 bp, Artificial Sequence
  Synthetic oligonucleotide; AGG chr11 5270240 5270259 5270256 +
tccaagaaagcctcatataa

SEQ ID NO: 13721 - DNA, 20 bp, Artificial Sequence
  Synthetic oligonucleotide; GAG chr11 5270242 5270261 5270258 +
caagaaagcctcatataaag

SEQ ID NO: 13722 - DNA, 20 bp, Artificial Sequence
  Synthetic oligonucleotide; TAG chr11 5270257 5270276 5270273 +
taaaggagcaaatctcaaaa

SEQ ID NO: 13723 - DNA, 20 bp, Artificial Sequence
  Synthetic oligonucleotide; AGG chr11 5270258 5270277 5270274 +
aaaggagcaaatctcaaaat

SEQ ID NO: 13724 - DNA, 20 bp, Artificial Sequence
  Synthetic oligonucleotide; AAG chr11 5270266 5270285 5270282 +
aaatctcaaaataggaaaaa

SEQ ID NO: 13725 - DNA, 20 bp, Artificial Sequence
  Synthetic oligonucleotide; CAG chr11 5270272 5270291 5270288 +
caaaataggaaaaaaagttt

SEQ ID NO: 13726 - DNA, 20 bp, Artificial Sequence
  Synthetic oligonucleotide; AAG chr11 5270278 5270297 5270294 +
aggaaaaaaagtttcagcca

SEQ ID NO: 13727 - DNA, 20 bp, Artificial Sequence
  Synthetic oligonucleotide; AAG chr11 5270301 5270320 5270317 +
cgcatttaacatttgcctta

SEQ ID NO: 13728 - DNA, 20 bp, Artificial Sequence
  Synthetic oligonucleotide; AGG chr11 5270302 5270321 5270318 +
gcatttaacatttgccttaa

SEQ ID NO: 13729 - DNA, 20 bp, Artificial Sequence
  Synthetic oligonucleotide; TGG chr11 5270305 5270324 5270321 +
tttaacatttgccttaaagg

SEQ ID NO: 13730 - DNA, 20 bp, Artificial Sequence
  Synthetic oligonucleotide; CAG chr11 5270311 5270330 5270327 +
atttgccttaaaggtggtga

SEQ ID NO: 13731 - DNA, 20 bp, Artificial Sequence
  Synthetic oligonucleotide; CAG chr11 5270323 5270342 5270339 +
ggtggtgacagtgacaaaaa

SEQ ID NO: 13732 - DNA, 20 bp, Artificial Sequence
  Synthetic oligonucleotide; AGG chr11 5270324 5270343 5270340 +
gtggtgacagtgacaaaaac

SEQ ID NO: 13733 - DNA, 20 bp, Artificial Sequence
  Synthetic oligonucleotide; GGG chr11 5270325 5270344 5270341 +
tggtgacagtgacaaaaaca

SEQ ID NO: 13734 - DNA, 20 bp, Artificial Sequence
  Synthetic oligonucleotide; AAG chr11 5270330 5270349 5270346 +
acagtgacaaaaacagggcc

SEQ ID NO: 13735 - DNA, 20 bp, Artificial Sequence
  Synthetic oligonucleotide; AGG chr11 5270331 5270350 5270347 +
cagtgacaaaaacagggcca

SEQ ID NO: 13736 - DNA, 20 bp, Artificial Sequence
  Synthetic oligonucleotide; AAG chr11 5270336 5270355 5270352 +
acaaaaacagggccaaggaa

SEQ ID NO: 13737 - DNA, 20 bp, Artificial Sequence
  Synthetic oligonucleotide; AAG chr11 5270345 5270364 5270361 +
gggccaaggaaaagaaaata

SEQ ID NO: 13738 - DNA, 20 bp, Artificial Sequence
  Synthetic oligonucleotide; CAG chr11 5270357 5270376 5270373 +
agaaaataaagctgttaaaa

SEQ ID NO: 13739 - DNA, 20 bp, Artificial Sequence
  Synthetic oligonucleotide; CAG chr11 5270369 5270388 5270385 +
tgttaaaacagaatctcacc

SEQ ID NO: 13740 - DNA, 20 bp, Artificial Sequence
  Synthetic oligonucleotide; TAG chr11 5270375 5270394 5270391 +
aacagaatctcacccagttc

SEQ ID NO: 13741 - DNA, 20 bp, Artificial Sequence
  Synthetic oligonucleotide; AAG chr11 5270385 5270404 5270401 +
cacccagttctagctctctt

SEQ ID NO: 13742 - DNA, 20 bp, Artificial Sequence
  Synthetic oligonucleotide; AGG chr11 5270386 5270405 5270402 +
acccagttctagctctctta

SEQ ID NO: 13743 - DNA, 20 bp, Artificial Sequence
  Synthetic oligonucleotide; GAG chr11 5270388 5270407 5270404 +
ccagttctagctctcttaag

SEQ ID NO: 13744 - DNA, 20 bp, Artificial Sequence
  Synthetic oligonucleotide; TAG chr11 5270418 5270437 5270434 +
taaacaaaacttctgtacct

SEQ ID NO: 13745 - DNA, 20 bp, Artificial Sequence
  Synthetic oligonucleotide; TAG chr11 5270427 5270446 5270443 +
cttctgtaccttagtttctc

SEQ ID NO: 13746 - DNA, 20 bp, Artificial Sequence
  Synthetic oligonucleotide; AGG chr11 5270428 5270447 5270444 +
ttctgtaccttagtttctct

SEQ ID NO: 13747 - DNA, 20 bp, Artificial Sequence
  Synthetic oligonucleotide; GGG chr11 5270429 5270448 5270445 +
tctgtaccttagtttctcta

SEQ ID NO: 13748 - DNA, 20 bp, Artificial Sequence
  Synthetic oligonucleotide; GAG chr11 5270431 5270450 5270447 +
tgtaccttagtttctctagg

SEQ ID NO: 13749 - DNA, 20 bp, Artificial Sequence
  Synthetic oligonucleotide; TAG chr11 5270448 5270467 5270464 +
agggagacaaaaaccgtaca

SEQ ID NO: 13750 - DNA, 20 bp, Artificial Sequence
  Synthetic oligonucleotide; TAG chr11 5270458 5270477 5270474 +
aaaccgtacatagttccttc

SEQ ID NO: 13751 - DNA, 20 bp, Artificial Sequence
  Synthetic oligonucleotide; CAG chr11 5270469 5270488 5270485 +
agttccttctagaaactgaa

SEQ ID NO: 13752 - DNA, 20 bp, Artificial Sequence
  Synthetic oligonucleotide; TAG chr11 5270474 5270493 5270490 +
cttctagaaactgaacagaa

SEQ ID NO: 13753 - DNA, 20 bp, Artificial Sequence
  Synthetic oligonucleotide; AAG chr11 5270478 5270497 5270494 +
tagaaactgaacagaatagc

SEQ ID NO: 13754 - DNA, 20 bp, Artificial Sequence
  Synthetic oligonucleotide; TAG chr11 5270481 5270500 5270497 +
aaactgaacagaatagcaag

SEQ ID NO: 13755 - DNA, 20 bp, Artificial Sequence
  Synthetic oligonucleotide; CAG chr11 5270488 5270507 5270504 +
acagaatagcaagtagtcca

SEQ ID NO: 13756 - DNA, 20 bp, Artificial Sequence
  Synthetic oligonucleotide; TGG chr11 5270491 5270510 5270507 +
gaatagcaagtagtccacag

SEQ ID NO: 13757 - DNA, 20 bp, Artificial Sequence
  Synthetic oligonucleotide; GGG chr11 5270492 5270511 5270508 +
aatagcaagtagtccacagt

SEQ ID NO: 13758 - DNA, 20 bp, Artificial Sequence
  Synthetic oligonucleotide; AAG chr11 5270499 5270518 5270515 +
agtagtccacagtgggacta

SEQ ID NO: 13759 - DNA, 20 bp, Artificial Sequence
  Synthetic oligonucleotide; AAG chr11 5270513 5270532 5270529 +
ggactaaagccttaatccca

SEQ ID NO: 13760 - DNA, 20 bp, Artificial Sequence
  Synthetic oligonucleotide; CAG chr11 5270518 5270537 5270534 +
aaagccttaatcccaaagta

SEQ ID NO: 13761 - DNA, 20 bp, Artificial Sequence
  Synthetic oligonucleotide; TGG chr11 5270526 5270545 5270542 +
aatcccaaagtacagtacct

SEQ ID NO: 13762 - DNA, 20 bp, Artificial Sequence
  Synthetic oligonucleotide; GGG chr11 5270527 5270546 5270543 +
atcccaaagtacagtacctt

SEQ ID NO: 13763 - DNA, 20 bp, Artificial Sequence
  Synthetic oligonucleotide; GGG chr11 5270528 5270547 5270544 +
tcccaaagtacagtaccttg

SEQ ID NO: 13764 - DNA, 20 bp, Artificial Sequence
  Synthetic oligonucleotide; TAG chr11 5270539 5270558 5270555 +
agtaccttggggtgattccc

SEQ ID NO: 13765 - DNA, 20 bp, Artificial Sequence
  Synthetic oligonucleotide; GAG chr11 5270541 5270560 5270557 +
taccttggggtgattcccta

SEQ ID NO: 13766 - DNA, 20 bp, Artificial Sequence
  Synthetic oligonucleotide; GAG chr11 5270543 5270562 5270559 +
ccttggggtgattccctaga

SEQ ID NO: 13767 - DNA, 20 bp, Artificial Sequence
  Synthetic oligonucleotide; AGG chr11 5270544 5270563 5270560 +
cttggggtgattccctagag

SEQ ID NO: 13768 - DNA, 20 bp, Artificial Sequence
  Synthetic oligonucleotide; CAG chr11 5270548 5270567 5270564 +
gggtgattccctagagagga

SEQ ID NO: 13769 - DNA, 20 bp, Artificial Sequence
  Synthetic oligonucleotide; CAG chr11 5270552 5270571 5270568 +
gattccctagagaggacaga

SEQ ID NO: 13770 - DNA, 20 bp, Artificial Sequence
  Synthetic oligonucleotide; AAG chr11 5270557 5270576 5270573 +
cctagagaggacagacagaa

SEQ ID NO: 13771 - DNA, 20 bp, Artificial Sequence
  Synthetic oligonucleotide; CAG chr11 5270568 5270587 5270584 +
cagacagaaaagattacatc

SEQ ID NO: 13772 - DNA, 20 bp, Artificial Sequence
  Synthetic oligonucleotide; CAG chr11 5270577 5270596 5270593 +
aagattacatccagtgcttc

SEQ ID NO: 13773 - DNA, 20 bp, Artificial Sequence
  Synthetic oligonucleotide; GAG chr11 5270579 5270598 5270595 +
gattacatccagtgcttcca

SEQ ID NO: 13774 - DNA, 20 bp, Artificial Sequence
  Synthetic oligonucleotide; CAG chr11 5270613 5270632 5270629 +
ttttcatttctctatgacca

SEQ ID NO: 13775 - DNA, 20 bp, Artificial Sequence
  Synthetic oligonucleotide; AGG chr11 5270614 5270633 5270630 +
tttcatttctctatgaccac

SEQ ID NO: 13776 - DNA, 20 bp, Artificial Sequence
  Synthetic oligonucleotide; GGG chr11 5270615 5270634 5270631 +
ttcatttctctatgaccaca

SEQ ID NO: 13777 - DNA, 20 bp, Artificial Sequence
  Synthetic oligonucleotide; GGG chr11 5270616 5270635 5270632 +
tcatttctctatgaccacag

SEQ ID NO: 13778 - DNA, 20 bp, Artificial Sequence
  Synthetic oligonucleotide; TGG chr11 5270623 5270642 5270639 +
tctatgaccacaggggacat

SEQ ID NO: 13779 - DNA, 20 bp, Artificial Sequence
  Synthetic oligonucleotide; GAG chr11 5270635 5270654 5270651 +
ggggacattggctactttgt

SEQ ID NO: 13780 - DNA, 20 bp, Artificial Sequence
  Synthetic oligonucleotide; TGG chr11 5270645 5270664 5270661 +
gctactttgtgagtattgcc

SEQ ID NO: 13781 - DNA, 20 bp, Artificial Sequence
  Synthetic oligonucleotide; GGG chr11 5270646 5270665 5270662 +
ctactttgtgagtattgcct

SEQ ID NO: 13782 - DNA, 20 bp, Artificial Sequence
  Synthetic oligonucleotide; GGG chr11 5270647 5270666 5270663 +
tactttgtgagtattgcctg

SEQ ID NO: 13783 - DNA, 20 bp, Artificial Sequence
  Synthetic oligonucleotide; TGG chr11 5270692 5270711 5270708 +
gtcctgcttatacttctcac

SEQ ID NO: 13784 - DNA, 20 bp, Artificial Sequence
  Synthetic oligonucleotide; GGG chr11 5270693 5270712 5270709 +
tcctgcttatacttctcact

SEQ ID NO: 13785 - DNA, 20 bp, Artificial Sequence
  Synthetic oligonucleotide; AAG chr11 5270696 5270715 5270712 +
tgcttatacttctcactggg

SEQ ID NO: 13786 - DNA, 20 bp, Artificial Sequence
  Synthetic oligonucleotide; AGG chr11 5270697 5270716 5270713 +
gcttatacttctcactggga

SEQ ID NO: 13787 - DNA, 20 bp, Artificial Sequence
  Synthetic oligonucleotide; GGG chr11 5270698 5270717 5270714 +
cttatacttctcactgggaa

SEQ ID NO: 13788 - DNA, 20 bp, Artificial Sequence
  Synthetic oligonucleotide; GAG chr11 5270700 5270719 5270716 +
tatacttctcactgggaagg

SEQ ID NO: 13789 - DNA, 20 bp, Artificial Sequence
  Synthetic oligonucleotide; GAG chr11 5270705 5270724 5270721 +
ttctcactgggaagggagct

SEQ ID NO: 13790 - DNA, 20 bp, Artificial Sequence
  Synthetic oligonucleotide; AAG chr11 5270708 5270727 5270724 +
tcactgggaagggagctgag

SEQ ID NO: 13791 - DNA, 20 bp, Artificial Sequence
  Synthetic oligonucleotide; AAG chr11 5270733 5270752 5270749 +
taaaatcctaaaattattta

SEQ ID NO: 13792 - DNA, 20 bp, Artificial Sequence
  Synthetic oligonucleotide; CAG chr11 5270737 5270756 5270753 +
atcctaaaattatttaaagc

SEQ ID NO: 13793 - DNA, 20 bp, Artificial Sequence
  Synthetic oligonucleotide; CAG chr11 5270754 5270773 5270770 +
agccagaatttgtcatcaaa

SEQ ID NO: 13794 - DNA, 20 bp, Artificial Sequence
  Synthetic oligonucleotide; GAG chr11 5270756 5270775 5270772 +
ccagaatttgtcatcaaaca

SEQ ID NO: 13795 - DNA, 20 bp, Artificial Sequence
  Synthetic oligonucleotide; AAG chr11 5270763 5270782 5270779 +
ttgtcatcaaacagagaaaa

SEQ ID NO: 13796 - DNA, 20 bp, Artificial Sequence
  Synthetic oligonucleotide; CAG chr11 5270783 5270802 5270799 +
aagtgaatcgatatattaat

SEQ ID NO: 13797 - DNA, 20 bp, Artificial Sequence
  Synthetic oligonucleotide; AGG chr11 5270784 5270803 5270800 +
agtgaatcgatatattaatc

SEQ ID NO: 13798 - DNA, 20 bp, Artificial Sequence
  Synthetic oligonucleotide; TAG chr11 5270788 5270807 5270804 +
aatcgatatattaatcaggc

SEQ ID NO: 13799 - DNA, 20 bp, Artificial Sequence
  Synthetic oligonucleotide; AGG chr11 5270789 5270808 5270805 +
atcgatatattaatcaggct

SEQ ID NO: 13800 - DNA, 20 bp, Artificial Sequence
  Synthetic oligonucleotide; GAG chr11 5270791 5270810 5270807 +
cgatatattaatcaggctag

SEQ ID NO: 13801 - DNA, 20 bp, Artificial Sequence
  Synthetic oligonucleotide; CAG chr11 5270795 5270814 5270811 +
atattaatcaggctaggagt

SEQ ID NO: 13802 - DNA, 20 bp, Artificial Sequence
  Synthetic oligonucleotide; AGG chr11 5270796 5270815 5270812 +
tattaatcaggctaggagtc

SEQ ID NO: 13803 - DNA, 20 bp, Artificial Sequence
  Synthetic oligonucleotide; GGG chr11 5270797 5270816 5270813 +
attaatcaggctaggagtca

SEQ ID NO: 13804 - DNA, 20 bp, Artificial Sequence
  Synthetic oligonucleotide; TAG chr11 5270813 5270832 5270829 +
gtcagggtatattattcctc

SEQ ID NO: 13805 - DNA, 20 bp, Artificial Sequence
  Synthetic oligonucleotide; TAG chr11 5270858 5270877 5270874 +
tccccattttgatgacttgc

SEQ ID NO: 13806 - DNA, 20 bp, Artificial Sequence
  Synthetic oligonucleotide; TGG chr11 5270870 5270889 5270886 +
tgacttgctagctctttact

SEQ ID NO: 13807 - DNA, 20 bp, Artificial Sequence
  Synthetic oligonucleotide; TAG chr11 5270873 5270892 5270889 +
cttgctagctctttacttgg

SEQ ID NO: 13808 - DNA, 20 bp, Artificial Sequence
  Synthetic oligonucleotide; GAG chr11 5270875 5270894 5270891 +
tgctagctctttacttggta

SEQ ID NO: 13809 - DNA, 20 bp, Artificial Sequence
  Synthetic oligonucleotide; TGG chr11 5270885 5270904 5270901 +
ttacttggtagagctgaaac

SEQ ID NO: 13810 - DNA, 20 bp, Artificial Sequence
  Synthetic oligonucleotide; AAG chr11 5270888 5270907 5270904 +
cttggtagagctgaaactgg

SEQ ID NO: 13811 - DNA, 20 bp, Artificial Sequence
  Synthetic oligonucleotide; TGG chr11 5270892 5270911 5270908 +
gtagagctgaaactggaagt

SEQ ID NO: 13812 - DNA, 20 bp, Artificial Sequence
  Synthetic oligonucleotide; GGG chr11 5270893 5270912 5270909 +
tagagctgaaactggaagtt

SEQ ID NO: 13813 - DNA, 20 bp, Artificial Sequence
  Synthetic oligonucleotide; CAG chr11 5270901 5270920 5270917 +
aaactggaagttgggattta

SEQ ID NO: 13814 - DNA, 20 bp, Artificial Sequence
  Synthetic oligonucleotide; AAG chr11 5270930 5270949 5270946 +
caattcgatccatgtgcctg

SEQ ID NO: 13815 - DNA, 20 bp, Artificial Sequence
  Synthetic oligonucleotide; TAG chr11 5270997 5271016 5271013 +
ttgtcattatcctcatattt

SEQ ID NO: 13816 - DNA, 20 bp, Artificial Sequence
  Synthetic oligonucleotide; AAG chr11 5271004 5271023 5271020 +
tatcctcatattttagaatc

SEQ ID NO: 13817 - DNA, 20 bp, Artificial Sequence
  Synthetic oligonucleotide; AGG chr11 5271005 5271024 5271021 +
atcctcatattttagaatca

SEQ ID NO: 13818 - DNA, 20 bp, Artificial Sequence
  Synthetic oligonucleotide; CAG chr11 5271018 5271037 5271034 +
agaatcaaggaataaattca

SEQ ID NO: 13819 - DNA, 20 bp, Artificial Sequence
  Synthetic oligonucleotide; CAG chr11 5271044 5271063 5271060 +
ttatttaactatcaatgtga

SEQ ID NO: 13820 - DNA, 20 bp, Artificial Sequence
  Synthetic oligonucleotide; AAG chr11 5271047 5271066 5271063 +
tttaactatcaatgtgacag

SEQ ID NO: 13821 - DNA, 20 bp, Artificial Sequence
  Synthetic oligonucleotide; TGG chr11 5271057 5271076 5271073 +
aatgtgacagaagtaatgat

SEQ ID NO: 13822 - DNA, 20 bp, Artificial Sequence
  Synthetic oligonucleotide; GGG chr11 5271058 5271077 5271074 +
atgtgacagaagtaatgatt

SEQ ID NO: 13823 - DNA, 20 bp, Artificial Sequence
  Synthetic oligonucleotide; GGG chr11 5271059 5271078 5271075 +
tgtgacagaagtaatgattg

SEQ ID NO: 13824 - DNA, 20 bp, Artificial Sequence
  Synthetic oligonucleotide; GGG chr11 5271060 5271079 5271076 +
gtgacagaagtaatgattgg

SEQ ID NO: 13825 - DNA, 20 bp, Artificial Sequence
  Synthetic oligonucleotide; TAG chr11 5271068 5271087 5271084 +
agtaatgattgggggaataa

SEQ ID NO: 13826 - DNA, 20 bp, Artificial Sequence
  Synthetic oligonucleotide; AAG chr11 5271071 5271090 5271087 +
aatgattgggggaataatag

SEQ ID NO: 13827 - DNA, 20 bp, Artificial Sequence
  Synthetic oligonucleotide; CAG chr11 5271074 5271093 5271090 +
gattgggggaataatagaag

SEQ ID NO: 13828 - DNA, 20 bp, Artificial Sequence
  Synthetic oligonucleotide; GAG chr11 5271076 5271095 5271092 +
ttgggggaataatagaagca

SEQ ID NO: 13829 - DNA, 20 bp, Artificial Sequence
  Synthetic oligonucleotide; CAG chr11 5271091 5271110 5271107 +
aagcagagttccacaaattc

SEQ ID NO: 13830 - DNA, 20 bp, Artificial Sequence
  Synthetic oligonucleotide; AAG chr11 5271111 5271130 5271127 +
cagcattgttaattctataa

SEQ ID NO: 13831 - DNA, 20 bp, Artificial Sequence
  Synthetic oligonucleotide; CAG chr11 5271143 5271162 5271159 +
tcaccataatctcattgccc

SEQ ID NO: 13832 - DNA, 20 bp, Artificial Sequence
  Synthetic oligonucleotide; CAG chr11 5271148 5271167 5271164 +
ataatctcattgccccagcc

SEQ ID NO: 13833 - DNA, 20 bp, Artificial Sequence
  Synthetic oligonucleotide; TGG chr11 5271161 5271180 5271177 +
cccagcccagttcctccttc

SEQ ID NO: 13834 - DNA, 20 bp, Artificial Sequence
  Synthetic oligonucleotide; GAG chr11 5271232 5271251 5271248 +
tttctttttttttttttttt

SEQ ID NO: 13835 - DNA, 20 bp, Artificial Sequence
  Synthetic oligonucleotide; CGG chr11 5271236 5271255 5271252 +
ttttttttttttttttgaga

SEQ ID NO: 13836 - DNA, 20 bp, Artificial Sequence
  Synthetic oligonucleotide; GAG chr11 5271238 5271257 5271254 +
ttttttttttttttgagacg

SEQ ID NO: 13837 - DNA, 20 bp, Artificial Sequence
  Synthetic oligonucleotide; CAG chr11 5271255 5271274 5271271 +
acggagtctcactctgttgc

SEQ ID NO: 13838 - DNA, 20 bp, Artificial Sequence
  Synthetic oligonucleotide; TGG chr11 5271260 5271279 5271276 +
gtctcactctgttgccagac

SEQ ID NO: 13839 - DNA, 20 bp, Artificial Sequence
  Synthetic oligonucleotide; GAG chr11 5271262 5271281 5271278 +
ctcactctgttgccagactg

SEQ ID NO: 13840 - DNA, 20 bp, Artificial Sequence
  Synthetic oligonucleotide; TGG chr11 5271270 5271289 5271286 +
gttgccagactggagtgcaa

SEQ ID NO: 13841 - DNA, 20 bp, Artificial Sequence
  Synthetic oligonucleotide; CAG chr11 5271281 5271300 5271297 +
ggagtgcaatggcactatct

SEQ ID NO: 13842 - DNA, 20 bp, Artificial Sequence
  Synthetic oligonucleotide; TGG chr11 5271305 5271324 5271321 +
tcactgcaaccttcgcctcc

SEQ ID NO: 13843 - DNA, 20 bp, Artificial Sequence
  Synthetic oligonucleotide; GGG chr11 5271306 5271325 5271322 +
cactgcaaccttcgcctcct

SEQ ID NO: 13844 - DNA, 20 bp, Artificial Sequence
  Synthetic oligonucleotide; CAG chr11 5271329 5271348 5271345 +
ttcaaacgattctcctgcct

SEQ ID NO: 13845 - DNA, 20 bp, Artificial Sequence
  Synthetic oligonucleotide; GAG chr11 5271338 5271357 5271354 +
ttctcctgcctcagcctccc

SEQ ID NO: 13846 - DNA, 20 bp, Artificial Sequence
  Synthetic oligonucleotide; CAG chr11 5271341 5271360 5271357 +
tcctgcctcagcctcccgag

SEQ ID NO: 13847 - DNA, 20 bp, Artificial Sequence
  Synthetic oligonucleotide; TGG chr11 5271345 5271364 5271361 +
gcctcagcctcccgagcagc

SEQ ID NO: 13848 - DNA, 20 bp, Artificial Sequence
  Synthetic oligonucleotide; GGG chr11 5271346 5271365 5271362 +
cctcagcctcccgagcagct

SEQ ID NO: 13849 - DNA, 20 bp, Artificial Sequence
  Synthetic oligonucleotide; CAG chr11 5271353 5271372 5271369 +
ctcccgagcagctgggacta

SEQ ID NO: 13850 - DNA, 20 bp, Artificial Sequence
  Synthetic oligonucleotide; AGG chr11 5271354 5271373 5271370 +
tcccgagcagctgggactac

SEQ ID NO: 13851 - DNA, 20 bp, Artificial Sequence
  Synthetic oligonucleotide; CAG chr11 5271373 5271392 5271389 +
caggcgcatgccaccatgcc

SEQ ID NO: 13852 - DNA, 20 bp, Artificial Sequence
  Synthetic oligonucleotide; TAG chr11 5271392 5271411 5271408 +
ccagctaatttttttatttt

SEQ ID NO: 13853 - DNA, 20 bp, Artificial Sequence
  Synthetic oligonucleotide; TAG chr11 5271395 5271414 5271411 +
gctaatttttttatttttag

SEQ ID NO: 13854 - DNA, 20 bp, Artificial Sequence
  Synthetic oligonucleotide; GAG chr11 5271397 5271416 5271413 +
taatttttttatttttagta

SEQ ID NO: 13855 - DNA, 20 bp, Artificial Sequence
  Synthetic oligonucleotide; CGG chr11 5271401 5271420 5271417 +
ttttttatttttagtagaga

SEQ ID NO: 13856 - DNA, 20 bp, Artificial Sequence
  Synthetic oligonucleotide; GGG chr11 5271402 5271421 5271418 +
tttttatttttagtagagac

SEQ ID NO: 13857 - DNA, 20 bp, Artificial Sequence
  Synthetic oligonucleotide; CAG chr11 5271421 5271440 5271437 +
cgggatttcaccatgtttgc

SEQ ID NO: 13858 - DNA, 20 bp, Artificial Sequence
  Synthetic oligonucleotide; AGG chr11 5271422 5271441 5271438 +
gggatttcaccatgtttgcc

SEQ ID NO: 13859 - DNA, 20 bp, Artificial Sequence
  Synthetic oligonucleotide; TGG chr11 5271426 5271445 5271442 +
tttcaccatgtttgccagga

SEQ ID NO: 13860 - DNA, 20 bp, Artificial Sequence
  Synthetic oligonucleotide; TGG chr11 5271503 5271522 5271519 +
tctaccatttctttctccta

SEQ ID NO: 13861 - DNA, 20 bp, Artificial Sequence
  Synthetic oligonucleotide; CAG chr11 5271521 5271540 5271537 +
tatggctccccttgccccac

SEQ ID NO: 13862 - DNA, 20 bp, Artificial Sequence
  Synthetic oligonucleotide; TAG chr11 5271527 5271546 5271543 +
tccccttgccccaccagatc

SEQ ID NO: 13863 - DNA, 20 bp, Artificial Sequence
  Synthetic oligonucleotide; AGG chr11 5271528 5271547 5271544 +
ccccttgccccaccagatct

SEQ ID NO: 13864 - DNA, 20 bp, Artificial Sequence
  Synthetic oligonucleotide; CAG chr11 5271561 5271580 5271577 +
cctacaatttcctgtatgtt

SEQ ID NO: 13865 - DNA, 20 bp, Artificial Sequence
  Synthetic oligonucleotide; AGG chr11 5271562 5271581 5271578 +
ctacaatttcctgtatgttc

SEQ ID NO: 13866 - DNA, 20 bp, Artificial Sequence
  Synthetic oligonucleotide; TAG chr11 5271568 5271587 5271584 +
tttcctgtatgttcaggccc

SEQ ID NO: 13867 - DNA, 20 bp, Artificial Sequence
  Synthetic oligonucleotide; GAG chr11 5271570 5271589 5271586 +
tcctgtatgttcaggcccta

SEQ ID NO: 13868 - DNA, 20 bp, Artificial Sequence
  Synthetic oligonucleotide; AGG chr11 5271571 5271590 5271587 +
cctgtatgttcaggccctag

SEQ ID NO: 13869 - DNA, 20 bp, Artificial Sequence
  Synthetic oligonucleotide; TAG chr11 5271592 5271611 5271608 +
ggttcttcgtctttttcact

SEQ ID NO: 13870 - DNA, 20 bp, Artificial Sequence
  Synthetic oligonucleotide; CAG chr11 5271595 5271614 5271611 +
tcttcgtctttttcacttag

SEQ ID NO: 13871 - DNA, 20 bp, Artificial Sequence
  Synthetic oligonucleotide; TGG chr11 5271600 5271619 5271616 +
gtctttttcacttagcagta

SEQ ID NO: 13872 - DNA, 20 bp, Artificial Sequence
  Synthetic oligonucleotide; AAG chr11 5271615 5271634 5271631 +
cagtatggctcctgtctccc

SEQ ID NO: 13873 - DNA, 20 bp, Artificial Sequence
  Synthetic oligonucleotide; AAG chr11 5271620 5271639 5271636 +
tggctcctgtctcccaagtc

SEQ ID NO: 13874 - DNA, 20 bp, Artificial Sequence
  Synthetic oligonucleotide; TGG chr11 5271629 5271648 5271645 +
tctcccaagtcaagtgcctt

SEQ ID NO: 13875 - DNA, 20 bp, Artificial Sequence
  Synthetic oligonucleotide; GGG chr11 5271630 5271649 5271646 +
ctcccaagtcaagtgccttt

SEQ ID NO: 13876 - DNA, 20 bp, Artificial Sequence
  Synthetic oligonucleotide; GGG chr11 5271631 5271650 5271647 +
tcccaagtcaagtgcctttg

SEQ ID NO: 13877 - DNA, 20 bp, Artificial Sequence
  Synthetic oligonucleotide; AAG chr11 5271646 5271665 5271662 +
ctttggggattccatattcc

SEQ ID NO: 13878 - DNA, 20 bp, Artificial Sequence
  Synthetic oligonucleotide; AAG chr11 5271655 5271674 5271671 +
ttccatattccaagtttact

SEQ ID NO: 13879 - DNA, 20 bp, Artificial Sequence
  Synthetic oligonucleotide; GAG chr11 5271657 5271676 5271673 +
ccatattccaagtttactaa

SEQ ID NO: 13880 - DNA, 20 bp, Artificial Sequence
  Synthetic oligonucleotide; TGG chr11 5271745 5271764 5271761 +
aaaaaaaaaaaaaacacttg

SEQ ID NO: 13881 - DNA, 20 bp, Artificial Sequence
  Synthetic oligonucleotide; AAG chr11 5271749 5271768 5271765 +
aaaaaaaaaacacttgtggc

SEQ ID NO: 13882 - DNA, 20 bp, Artificial Sequence
  Synthetic oligonucleotide; AAG chr11 5271753 5271772 5271769 +
aaaaaacacttgtggcaagt

SEQ ID NO: 13883 - DNA, 20 bp, Artificial Sequence
  Synthetic oligonucleotide; CAG chr11 5271786 5271805 5271802 +
ttgcttttctcccatgattc

SEQ ID NO: 13884 - DNA, 20 bp, Artificial Sequence
  Synthetic oligonucleotide; AAG chr11 5271789 5271808 5271805 +
cttttctcccatgattccag

SEQ ID NO: 13885 - DNA, 20 bp, Artificial Sequence
  Synthetic oligonucleotide; CAG chr11 5271832 5271851 5271848 +
tgcccaaattgttattattc

SEQ ID NO: 13886 - DNA, 20 bp, Artificial Sequence
  Synthetic oligonucleotide; AGG chr11 5271833 5271852 5271849 +
gcccaaattgttattattcc

SEQ ID NO: 13887 - DNA, 20 bp, Artificial Sequence
  Synthetic oligonucleotide; TAG chr11 5271863 5271882 5271879 +
atttctactccattttcttt

SEQ ID NO: 13888 - DNA, 20 bp, Artificial Sequence
  Synthetic oligonucleotide; TGG chr11 5271877 5271896 5271893 +
ttcttttagctattaaccaa

SEQ ID NO: 13889 - DNA, 20 bp, Artificial Sequence
  Synthetic oligonucleotide; GAG chr11 5271889 5271908 5271905 +
ttaaccaatggtatctttct

SEQ ID NO: 13890 - DNA, 20 bp, Artificial Sequence
  Synthetic oligonucleotide; TGG chr11 5271908 5271927 5271924 +
tgagcatatattctaaccat

SEQ ID NO: 13891 - DNA, 20 bp, Artificial Sequence
  Synthetic oligonucleotide; CAG chr11 5271917 5271936 5271933 +
attctaaccattggctaaca

SEQ ID NO: 13892 - DNA, 20 bp, Artificial Sequence
  Synthetic oligonucleotide; CAG chr11 5271927 5271946 5271943 +
ttggctaacacagacaaaac

SEQ ID NO: 13893 - DNA, 20 bp, Artificial Sequence
  Synthetic oligonucleotide; AGG chr11 5271928 5271947 5271944 +
tggctaacacagacaaaacc

SEQ ID NO: 13894 - DNA, 20 bp, Artificial Sequence
  Synthetic oligonucleotide; CAG chr11 5271955 5271974 5271971 +
cctaaactttttttgtgtca

SEQ ID NO: 13895 - DNA, 20 bp, Artificial Sequence
  Synthetic oligonucleotide; AGG chr11 5271956 5271975 5271972 +
ctaaactttttttgtgtcac

SEQ ID NO: 13896 - DNA, 20 bp, Artificial Sequence
  Synthetic oligonucleotide; CAG chr11 5271960 5271979 5271976 +
actttttttgtgtcacaggc

SEQ ID NO: 13897 - DNA, 20 bp, Artificial Sequence
  Synthetic oligonucleotide; TGG chr11 5271965 5271984 5271981 +
ttttgtgtcacaggccagtt

SEQ ID NO: 13898 - DNA, 20 bp, Artificial Sequence
  Synthetic oligonucleotide; CAG chr11 5271968 5271987 5271984 +
tgtgtcacaggccagtttgg

SEQ ID NO: 13899 - DNA, 20 bp, Artificial Sequence
  Synthetic oligonucleotide; AAG chr11 5271976 5271995 5271992 +
aggccagtttggcagactgt

SEQ ID NO: 13900 - DNA, 20 bp, Artificial Sequence
  Synthetic oligonucleotide; TAG chr11 5272019 5272038 5272035 +
attgcatcaaataatataca

SEQ ID NO: 13901 - DNA, 20 bp, Artificial Sequence
  Synthetic oligonucleotide; AGG chr11 5272020 5272039 5272036 +
ttgcatcaaataatatacat

SEQ ID NO: 13902 - DNA, 20 bp, Artificial Sequence
  Synthetic oligonucleotide; GAG chr11 5272022 5272041 5272038 +
gcatcaaataatatacatag

SEQ ID NO: 13903 - DNA, 20 bp, Artificial Sequence
  Synthetic oligonucleotide; AAG chr11 5272029 5272048 5272045 +
ataatatacataggagtgct

SEQ ID NO: 13904 - DNA, 20 bp, Artificial Sequence
  Synthetic oligonucleotide; CAG chr11 5272057 5272076 5272073 +
ttacactgaaatatcattat

SEQ ID NO: 13905 - DNA, 20 bp, Artificial Sequence
  Synthetic oligonucleotide; TGG chr11 5272079 5272098 5272095 +
gacatcaaacattacatttg

SEQ ID NO: 13906 - DNA, 20 bp, Artificial Sequence
  Synthetic oligonucleotide; TAG chr11 5272084 5272103 5272100 +
caaacattacatttgtggta

SEQ ID NO: 13907 - DNA, 20 bp, Artificial Sequence
  Synthetic oligonucleotide; AAG chr11 5272113 5272132 5272129 +
ttatatttgcttctttatga

SEQ ID NO: 13908 - DNA, 20 bp, Artificial Sequence
  Synthetic oligonucleotide; TAG chr11 5272119 5272138 5272135 +
ttgcttctttatgaaagcat

SEQ ID NO: 13909 - DNA, 20 bp, Artificial Sequence
  Synthetic oligonucleotide; TAG chr11 5272125 5272144 5272141 +
ctttatgaaagcattagatc

SEQ ID NO: 13910 - DNA, 20 bp, Artificial Sequence
  Synthetic oligonucleotide; AGG chr11 5272126 5272145 5272142 +
tttatgaaagcattagatct

SEQ ID NO: 13911 - DNA, 20 bp, Artificial Sequence
  Synthetic oligonucleotide; TGG chr11 5272131 5272150 5272147 +
gaaagcattagatctaggat

SEQ ID NO: 13912 - DNA, 20 bp, Artificial Sequence
  Synthetic oligonucleotide; GGG chr11 5272132 5272151 5272148 +
aaagcattagatctaggatt

SEQ ID NO: 13913 - DNA, 20 bp, Artificial Sequence
  Synthetic oligonucleotide; CAG chr11 5272139 5272158 5272155 +
tagatctaggattgggtcta

SEQ ID NO: 13914 - DNA, 20 bp, Artificial Sequence
  Synthetic oligonucleotide; AAG chr11 5272149 5272168 5272165 +
attgggtctacagctacctt

SEQ ID NO: 13915 - DNA, 20 bp, Artificial Sequence
  Synthetic oligonucleotide; AAG chr11 5272156 5272175 5272172 +
ctacagctaccttaagatcc

SEQ ID NO: 13916 - DNA, 20 bp, Artificial Sequence
  Synthetic oligonucleotide; TAG chr11 5272159 5272178 5272175 +
cagctaccttaagatccaag

SEQ ID NO: 13917 - DNA, 20 bp, Artificial Sequence
  Synthetic oligonucleotide; CAG chr11 5272167 5272186 5272183 +
ttaagatccaagtagtgatg

SEQ ID NO: 13918 - DNA, 20 bp, Artificial Sequence
  Synthetic oligonucleotide; TGG chr11 5272197 5272216 5272213 +
tgaattaaaaatatctgcaa

SEQ ID NO: 13919 - DNA, 20 bp, Artificial Sequence
  Synthetic oligonucleotide; GGG chr11 5272198 5272217 5272214 +
gaattaaaaatatctgcaat

SEQ ID NO: 13920 - DNA, 20 bp, Artificial Sequence
  Synthetic oligonucleotide; CAG chr11 5272202 5272221 5272218 +
taaaaatatctgcaatgggc

SEQ ID NO: 13921 - DNA, 20 bp, Artificial Sequence
  Synthetic oligonucleotide; AGG chr11 5272203 5272222 5272219 +
aaaaatatctgcaatgggcc

SEQ ID NO: 13922 - DNA, 20 bp, Artificial Sequence
  Synthetic oligonucleotide; TGG chr11 5272208 5272227 5272224 +
tatctgcaatgggccaggcg

SEQ ID NO: 13923 - DNA, 20 bp, Artificial Sequence
  Synthetic oligonucleotide; TGG chr11 5272211 5272230 5272227 +
ctgcaatgggccaggcgtgg

SEQ ID NO: 13924 - DNA, 20 bp, Artificial Sequence
  Synthetic oligonucleotide; CAG chr11 5272230 5272249 5272246 +
gtggctcacacctataatcc

SEQ ID NO: 13925 - DNA, 20 bp, Artificial Sequence
  Synthetic oligonucleotide; CAG chr11 5272238 5272257 5272254 +
cacctataatcccagcactt

SEQ ID NO: 13926 - DNA, 20 bp, Artificial Sequence
  Synthetic oligonucleotide; AGG chr11 5272239 5272258 5272255 +
acctataatcccagcacttc

SEQ ID NO: 13927 - DNA, 20 bp, Artificial Sequence
  Synthetic oligonucleotide; GAG chr11 5272241 5272260 5272257 +
ctataatcccagcacttcag

SEQ ID NO: 13928 - DNA, 20 bp, Artificial Sequence
  Synthetic oligonucleotide; AGG chr11 5272242 5272261 5272258 +
tataatcccagcacttcagg

SEQ ID NO: 13929 - DNA, 20 bp, Artificial Sequence
  Synthetic oligonucleotide; AAG chr11 5272247 5272266 5272263 +
tcccagcacttcaggaggcc

SEQ ID NO: 13930 - DNA, 20 bp, Artificial Sequence
  Synthetic oligonucleotide; AGG chr11 5272248 5272267 5272264 +
cccagcacttcaggaggcca

SEQ ID NO: 13931 - DNA, 20 bp, Artificial Sequence
  Synthetic oligonucleotide; CGG chr11 5272251 5272270 5272267 +
agcacttcaggaggccaagg

SEQ ID NO: 13932 - DNA, 20 bp, Artificial Sequence
  Synthetic oligonucleotide; GGG chr11 5272252 5272271 5272268 +
gcacttcaggaggccaaggc

SEQ ID NO: 13933 - DNA, 20 bp, Artificial Sequence
  Synthetic oligonucleotide; CAG chr11 5272255 5272274 5272271 +
cttcaggaggccaaggcggg

SEQ ID NO: 13934 - DNA, 20 bp, Artificial Sequence
  Synthetic oligonucleotide; GAG chr11 5272265 5272284 5272281 +
ccaaggcgggcagatcatct

SEQ ID NO: 13935 - DNA, 20 bp, Artificial Sequence
  Synthetic oligonucleotide; AGG chr11 5272266 5272285 5272282 +
caaggcgggcagatcatctg

SEQ ID NO: 13936 - DNA, 20 bp, Artificial Sequence
  Synthetic oligonucleotide; CAG chr11 5272270 5272289 5272286 +
gcgggcagatcatctgaggt

SEQ ID NO: 13937 - DNA, 20 bp, Artificial Sequence
  Synthetic oligonucleotide; AGG chr11 5272271 5272290 5272287 +
cgggcagatcatctgaggtc

SEQ ID NO: 13938 - DNA, 20 bp, Artificial Sequence
  Synthetic oligonucleotide; GAG chr11 5272273 5272292 5272289 +
ggcagatcatctgaggtcag

SEQ ID NO: 13939 - DNA, 20 bp, Artificial Sequence
  Synthetic oligonucleotide; AAG chr11 5272279 5272298 5272295 +
tcatctgaggtcaggagttc

SEQ ID NO: 13940 - DNA, 20 bp, Artificial Sequence
  Synthetic oligonucleotide; CAG chr11 5272284 5272303 5272300 +
tgaggtcaggagttcaagac

SEQ ID NO: 13941 - DNA, 20 bp, Artificial Sequence
  Synthetic oligonucleotide; TGG chr11 5272289 5272308 5272305 +
tcaggagttcaagaccagcc

SEQ ID NO: 13942 - DNA, 20 bp, Artificial Sequence
  Synthetic oligonucleotide; TGG chr11 5272298 5272317 5272314 +
caagaccagcctggccaaca

SEQ ID NO: 13943 - DNA, 20 bp, Artificial Sequence
  Synthetic oligonucleotide; TAG chr11 5272333 5272352 5272349 +
tctactaaaaatacaaaaat

SEQ ID NO: 13944 - DNA, 20 bp, Artificial Sequence
  Synthetic oligonucleotide; TGG chr11 5272338 5272357 5272354 +
taaaaatacaaaaattagac

SEQ ID NO: 13945 - DNA, 20 bp, Artificial Sequence
  Synthetic oligonucleotide; TGG chr11 5272343 5272362 5272359 +
atacaaaaattagactggca

SEQ ID NO: 13946 - DNA, 20 bp, Artificial Sequence
  Synthetic oligonucleotide; TGG chr11 5272346 5272365 5272362 +
caaaaattagactggcatgg

SEQ ID NO: 13947 - DNA, 20 bp, Artificial Sequence
  Synthetic oligonucleotide; CAG chr11 5272349 5272368 5272365 +
aaattagactggcatggtgg

SEQ ID NO: 13948 - DNA, 20 bp, Artificial Sequence
  Synthetic oligonucleotide; AGG chr11 5272350 5272369 5272366 +
aattagactggcatggtggc

SEQ ID NO: 13949 - DNA, 20 bp, Artificial Sequence
  Synthetic oligonucleotide; CAG chr11 5272366 5272385 5272382 +
tggcaggtgcctgtaatccc

SEQ ID NO: 13950 - DNA, 20 bp, Artificial Sequence
  Synthetic oligonucleotide; CAG chr11 5272374 5272393 5272390 +
gcctgtaatccccagctact

SEQ ID NO: 13951 - DNA, 20 bp, Artificial Sequence
  Synthetic oligonucleotide; AGG chr11 5272375 5272394 5272391 +
cctgtaatccccagctactc

SEQ ID NO: 13952 - DNA, 20 bp, Artificial Sequence
  Synthetic oligonucleotide; GAG chr11 5272377 5272396 5272393 +
tgtaatccccagctactcag

SEQ ID NO: 13953 - DNA, 20 bp, Artificial Sequence
  Synthetic oligonucleotide; AGG chr11 5272378 5272397 5272394 +
gtaatccccagctactcagg

SEQ ID NO: 13954 - DNA, 20 bp, Artificial Sequence
  Synthetic oligonucleotide; AAG chr11 5272383 5272402 5272399 +
ccccagctactcaggaggcc

SEQ ID NO: 13955 - DNA, 20 bp, Artificial Sequence
  Synthetic oligonucleotide; AGG chr11 5272384 5272403 5272400 +
cccagctactcaggaggcca

SEQ ID NO: 13956 - DNA, 20 bp, Artificial Sequence
  Synthetic oligonucleotide; CAG chr11 5272387 5272406 5272403 +
agctactcaggaggccaagg

SEQ ID NO: 13957 - DNA, 20 bp, Artificial Sequence
  Synthetic oligonucleotide; AGG chr11 5272388 5272407 5272404 +
gctactcaggaggccaaggc

SEQ ID NO: 13958 - DNA, 20 bp, Artificial Sequence
  Synthetic oligonucleotide; GAG chr11 5272390 5272409 5272406 +
tactcaggaggccaaggcag

SEQ ID NO: 13959 - DNA, 20 bp, Artificial Sequence
  Synthetic oligonucleotide; CAG chr11 5272406 5272425 5272422 +
gcaggagaattgcttgaatg

SEQ ID NO: 13960 - DNA, 20 bp, Artificial Sequence
  Synthetic oligonucleotide; AGG chr11 5272407 5272426 5272423 +
caggagaattgcttgaatgc

SEQ ID NO: 13961 - DNA, 20 bp, Artificial Sequence
  Synthetic oligonucleotide; AAG chr11 5272410 5272429 5272426 +
gagaattgcttgaatgcagg

SEQ ID NO: 13962 - DNA, 20 bp, Artificial Sequence
  Synthetic oligonucleotide; AGG chr11 5272411 5272430 5272427 +
agaattgcttgaatgcagga

SEQ ID NO: 13963 - DNA, 20 bp, Artificial Sequence
  Synthetic oligonucleotide; GGG chr11 5272412 5272431 5272428 +
gaattgcttgaatgcaggaa

SEQ ID NO: 13964 - DNA, 20 bp, Artificial Sequence
  Synthetic oligonucleotide; GGG chr11 5272413 5272432 5272429 +
aattgcttgaatgcaggaag

SEQ ID NO: 13965 - DNA, 20 bp, Artificial Sequence
  Synthetic oligonucleotide; GAG chr11 5272415 5272434 5272431 +
ttgcttgaatgcaggaaggg

SEQ ID NO: 13966 - DNA, 20 bp, Artificial Sequence
  Synthetic oligonucleotide; AGG chr11 5272416 5272435 5272432 +
tgcttgaatgcaggaagggg

SEQ ID NO: 13967 - DNA, 20 bp, Artificial Sequence
  Synthetic oligonucleotide; CAG chr11 5272422 5272441 5272438 +
aatgcaggaaggggaggttg

SEQ ID NO: 13968 - DNA, 20 bp, Artificial Sequence
  Synthetic oligonucleotide; GAG chr11 5272426 5272445 5272442 +
caggaaggggaggttgcagt

SEQ ID NO: 13969 - DNA, 20 bp, Artificial Sequence
  Synthetic oligonucleotide; CAG chr11 5272451 5272470 5272467 +
gaaatcatgccactgcactc

SEQ ID NO: 13970 - DNA, 20 bp, Artificial Sequence
  Synthetic oligonucleotide; TGG chr11 5272456 5272475 5272472 +
catgccactgcactccagcc

SEQ ID NO: 13971 - DNA, 20 bp, Artificial Sequence
  Synthetic oligonucleotide; GGG chr11 5272457 5272476 5272473 +
atgccactgcactccagcct

SEQ ID NO: 13972 - DNA, 20 bp, Artificial Sequence
  Synthetic oligonucleotide; AAG chr11 5272464 5272483 5272480 +
tgcactccagcctgggcaat

SEQ ID NO: 13973 - DNA, 20 bp, Artificial Sequence
  Synthetic oligonucleotide; GAG chr11 5272466 5272485 5272482 +
cactccagcctgggcaataa

SEQ ID NO: 13974 - DNA, 20 bp, Artificial Sequence
  Synthetic oligonucleotide; AAG chr11 5272502 5272521 5272518 +
caaacaaaaacaaaaacaaa

SEQ ID NO: 13975 - DNA, 20 bp, Artificial Sequence
  Synthetic oligonucleotide; TGG chr11 5272519 5272538 5272535 +
aaaaagatctgcaataccta

SEQ ID NO: 13976 - DNA, 20 bp, Artificial Sequence
  Synthetic oligonucleotide; TAG chr11 5272524 5272543 5272540 +
gatctgcaatacctatggtg

SEQ ID NO: 13977 - DNA, 20 bp, Artificial Sequence
  Synthetic oligonucleotide; TGG chr11 5272541 5272560 5272557 +
gtgtagtatgaaaatatctg

SEQ ID NO: 13978 - DNA, 20 bp, Artificial Sequence
  Synthetic oligonucleotide; TAG chr11 5272565 5272584 5272581 +
ttctctttataactatgcaa

SEQ ID NO: 13979 - DNA, 20 bp, Artificial Sequence
  Synthetic oligonucleotide; AGG chr11 5272566 5272585 5272582 +
tctctttataactatgcaat

SEQ ID NO: 13980 - DNA, 20 bp, Artificial Sequence
  Synthetic oligonucleotide; TAG chr11 5272586 5272605 5272602 +
aggtactgatgatgtcattc

SEQ ID NO: 13981 - DNA, 20 bp, Artificial Sequence
  Synthetic oligonucleotide; AAG chr11 5272606 5272625 5272622 +
tagtttgtcctttgcattca

SEQ ID NO: 13982 - DNA, 20 bp, Artificial Sequence
  Synthetic oligonucleotide; TAG chr11 5272609 5272628 5272625 +
tttgtcctttgcattcaaag

SEQ ID NO: 13983 - DNA, 20 bp, Artificial Sequence
  Synthetic oligonucleotide; AAG chr11 5272612 5272631 5272628 +
gtcctttgcattcaaagtag

SEQ ID NO: 13984 - DNA, 20 bp, Artificial Sequence
  Synthetic oligonucleotide; CAG chr11 5272629 5272648 5272645 +
tagaagaaaatgctaaattt

SEQ ID NO: 13985 - DNA, 20 bp, Artificial Sequence
  Synthetic oligonucleotide; AAG chr11 5272640 5272659 5272656 +
gctaaatttcagttacatgt

SEQ ID NO: 13986 - DNA, 20 bp, Artificial Sequence
  Synthetic oligonucleotide; CAG chr11 5272651 5272670 5272667 +
gttacatgtaagtaaaaata

SEQ ID NO: 13987 - DNA, 20 bp, Artificial Sequence
  Synthetic oligonucleotide; CAG chr11 5272676 5272695 5272692 +
tttttttctataaacttcac

SEQ ID NO: 13988 - DNA, 20 bp, Artificial Sequence
  Synthetic oligonucleotide; TAG chr11 5272684 5272703 5272700 +
tataaacttcaccagccccc

SEQ ID NO: 13989 - DNA, 20 bp, Artificial Sequence
  Synthetic oligonucleotide; TGG chr11 5272694 5272713 5272710 +
accagccccctagtgttctg

SEQ ID NO: 13990 - DNA, 20 bp, Artificial Sequence
  Synthetic oligonucleotide; CAG chr11 5272701 5272720 5272717 +
ccctagtgttctgtggaccc

SEQ ID NO: 13991 - DNA, 20 bp, Artificial Sequence
  Synthetic oligonucleotide; AAG chr11 5272707 5272726 5272723 +
tgttctgtggaccccagatt

SEQ ID NO: 13992 - DNA, 20 bp, Artificial Sequence
  Synthetic oligonucleotide; TGG chr11 5272716 5272735 5272732 +
gaccccagattaagacttcc

SEQ ID NO: 13993 - DNA, 20 bp, Artificial Sequence
  Synthetic oligonucleotide; GGG chr11 5272717 5272736 5272733 +
accccagattaagacttcct

SEQ ID NO: 13994 - DNA, 20 bp, Artificial Sequence
  Synthetic oligonucleotide; TAG chr11 5272730 5272749 5272746 +
acttcctgggacaaaatata

SEQ ID NO: 13995 - DNA, 20 bp, Artificial Sequence
  Synthetic oligonucleotide; TAG chr11 5272735 5272754 5272751 +
ctgggacaaaatatatagcc

SEQ ID NO: 13996 - DNA, 20 bp, Artificial Sequence
  Synthetic oligonucleotide; AGG chr11 5272736 5272755 5272752 +
tgggacaaaatatatagcct

SEQ ID NO: 13997 - DNA, 20 bp, Artificial Sequence
  Synthetic oligonucleotide; AAG chr11 5272739 5272758 5272755 +
gacaaaatatatagcctagg

SEQ ID NO: 13998 - DNA, 20 bp, Artificial Sequence
  Synthetic oligonucleotide; AAG chr11 5272744 5272763 5272760 +
aatatatagcctaggaagac

SEQ ID NO: 13999 - DNA, 20 bp, Artificial Sequence
  Synthetic oligonucleotide; TAG chr11 5272751 5272770 5272767 +
agcctaggaagacaagatcc

SEQ ID NO: 14000 - DNA, 20 bp, Artificial Sequence
  Synthetic oligonucleotide; AGG chr11 5272752 5272771 5272768 +
gcctaggaagacaagatcct

SEQ ID NO: 14001 - DNA, 20 bp, Artificial Sequence
  Synthetic oligonucleotide; TGG chr11 5272757 5272776 5272773 +
ggaagacaagatcctaggtt

SEQ ID NO: 14002 - DNA, 20 bp, Artificial Sequence
  Synthetic oligonucleotide; AAG chr11 5272761 5272780 5272777 +
gacaagatcctaggtttgga

SEQ ID NO: 14003 - DNA, 20 bp, Artificial Sequence
  Synthetic oligonucleotide; AAG chr11 5272788 5272807 5272804 +
tatttgatccactgaaataa

SEQ ID NO: 14004 - DNA, 20 bp, Artificial Sequence
  Synthetic oligonucleotide; TAG chr11 5272800 5272819 5272816 +
tgaaataaaagaacaatgac

SEQ ID NO: 14005 - DNA, 20 bp, Artificial Sequence
  Synthetic oligonucleotide; AAG chr11 5272808 5272827 5272824 +
aagaacaatgactagacaaa

SEQ ID NO: 14006 - DNA, 20 bp, Artificial Sequence
  Synthetic oligonucleotide; CAG chr11 5272811 5272830 5272827 +
aacaatgactagacaaaaag

SEQ ID NO: 14007 - DNA, 20 bp, Artificial Sequence
  Synthetic oligonucleotide; CAG chr11 5272816 5272835 5272832 +
tgactagacaaaaagcagct

SEQ ID NO: 14008 - DNA, 20 bp, Artificial Sequence
  Synthetic oligonucleotide; TAG chr11 5272826 5272845 5272842 +
aaaagcagctcagctgcttg

SEQ ID NO: 14009 - DNA, 20 bp, Artificial Sequence
  Synthetic oligonucleotide; AAG chr11 5272837 5272856 5272853 +
agctgcttgtagcttgaacc

SEQ ID NO: 14010 - DNA, 20 bp, Artificial Sequence
  Synthetic oligonucleotide; GAG chr11 5272842 5272861 5272858 +
cttgtagcttgaaccaagct

SEQ ID NO: 14011 - DNA, 20 bp, Artificial Sequence
  Synthetic oligonucleotide; TGG chr11 5272847 5272866 5272863 +
agcttgaaccaagctgagct

SEQ ID NO: 14012 - DNA, 20 bp, Artificial Sequence
  Synthetic oligonucleotide; CAG chr11 5272855 5272874 5272871 +
ccaagctgagcttggctact

SEQ ID NO: 14013 - DNA, 20 bp, Artificial Sequence
  Synthetic oligonucleotide; GAG chr11 5272857 5272876 5272873 +
aagctgagcttggctactca

SEQ ID NO: 14014 - DNA, 20 bp, Artificial Sequence
  Synthetic oligonucleotide; AAG chr11 5272860 5272879 5272876 +
ctgagcttggctactcagag

SEQ ID NO: 14015 - DNA, 20 bp, Artificial Sequence
  Synthetic oligonucleotide; CAG chr11 5272865 5272884 5272881 +
cttggctactcagagaagaa

SEQ ID NO: 14016 - DNA, 20 bp, Artificial Sequence
  Synthetic oligonucleotide; GAG chr11 5272873 5272892 5272889 +
ctcagagaagaacagtcgtt

SEQ ID NO: 14017 - DNA, 20 bp, Artificial Sequence
  Synthetic oligonucleotide; AAG chr11 5272901 5272920 5272917 +
ataattttttttaaccaatt

SEQ ID NO: 14018 - DNA, 20 bp, Artificial Sequence
  Synthetic oligonucleotide; CAG chr11 5272907 5272926 5272923 +
ttttttaaccaattaagata

SEQ ID NO: 14019 - DNA, 20 bp, Artificial Sequence
  Synthetic oligonucleotide; TGG chr11 5272913 5272932 5272929 +
aaccaattaagatacagctc

SEQ ID NO: 14020 - DNA, 20 bp, Artificial Sequence
  Synthetic oligonucleotide; GGG chr11 5272914 5272933 5272930 +
accaattaagatacagctct

SEQ ID NO: 14021 - DNA, 20 bp, Artificial Sequence
  Synthetic oligonucleotide; CAG chr11 5272921 5272940 5272937 +
aagatacagctctgggtttt

SEQ ID NO: 14022 - DNA, 20 bp, Artificial Sequence
  Synthetic oligonucleotide; AGG chr11 5272922 5272941 5272938 +
agatacagctctgggttttc

SEQ ID NO: 14023 - DNA, 20 bp, Artificial Sequence
  Synthetic oligonucleotide; GGG chr11 5272923 5272942 5272939 +
gatacagctctgggttttca

SEQ ID NO: 14024 - DNA, 20 bp, Artificial Sequence
  Synthetic oligonucleotide; GGG chr11 5272924 5272943 5272940 +
atacagctctgggttttcag

SEQ ID NO: 14025 - DNA, 20 bp, Artificial Sequence
  Synthetic oligonucleotide; GGG chr11 5272925 5272944 5272941 +
tacagctctgggttttcagg

SEQ ID NO: 14026 - DNA, 20 bp, Artificial Sequence
  Synthetic oligonucleotide; CAG chr11 5272937 5272956 5272953 +
ttttcagggggaatttgcta

SEQ ID NO: 14027 - DNA, 20 bp, Artificial Sequence
  Synthetic oligonucleotide; CAG chr11 5272945 5272964 5272961 +
gggaatttgctacagatcca

SEQ ID NO: 14028 - DNA, 20 bp, Artificial Sequence
  Synthetic oligonucleotide; AAG chr11 5272952 5272971 5272968 +
tgctacagatccacagtatg

SEQ ID NO: 14029 - DNA, 20 bp, Artificial Sequence
  Synthetic oligonucleotide; AGG chr11 5272953 5272972 5272969 +
gctacagatccacagtatga

SEQ ID NO: 14030 - DNA, 20 bp, Artificial Sequence
  Synthetic oligonucleotide; CAG chr11 5272956 5272975 5272972 +
acagatccacagtatgaagg

SEQ ID NO: 14031 - DNA, 20 bp, Artificial Sequence
  Synthetic oligonucleotide; TGG chr11 5272959 5272978 5272975 +
gatccacagtatgaaggcag

SEQ ID NO: 14032 - DNA, 20 bp, Artificial Sequence
  Synthetic oligonucleotide; CAG chr11 5272970 5272989 5272986 +
tgaaggcagtggcccttcct

SEQ ID NO: 14033 - DNA, 20 bp, Artificial Sequence
  Synthetic oligonucleotide; GAG chr11 5272984 5273003 5273000 +
cttcctcagaacttgaatgt

SEQ ID NO: 14034 - DNA, 20 bp, Artificial Sequence
  Synthetic oligonucleotide; AGG chr11 5272985 5273004 5273001 +
ttcctcagaacttgaatgtg

SEQ ID NO: 14035 - DNA, 20 bp, Artificial Sequence
  Synthetic oligonucleotide; GGG chr11 5272986 5273005 5273002 +
tcctcagaacttgaatgtga

SEQ ID NO: 14036 - DNA, 20 bp, Artificial Sequence
  Synthetic oligonucleotide; CAG chr11 5272990 5273009 5273006 +
cagaacttgaatgtgagggt

SEQ ID NO: 14037 - DNA, 20 bp, Artificial Sequence
  Synthetic oligonucleotide; AAG chr11 5273002 5273021 5273018 +
gtgagggtcagacattgcca

SEQ ID NO: 14038 - DNA, 20 bp, Artificial Sequence
  Synthetic oligonucleotide; AAG chr11 5273008 5273027 5273024 +
gtcagacattgccaaagtcc

SEQ ID NO: 14039 - DNA, 20 bp, Artificial Sequence
  Synthetic oligonucleotide; AGG chr11 5273009 5273028 5273025 +
tcagacattgccaaagtcca

SEQ ID NO: 14040 - DNA, 20 bp, Artificial Sequence
  Synthetic oligonucleotide; AAG chr11 5273015 5273034 5273031 +
attgccaaagtccaaggaat

SEQ ID NO: 14041 - DNA, 20 bp, Artificial Sequence
  Synthetic oligonucleotide; AGG chr11 5273016 5273035 5273032 +
ttgccaaagtccaaggaata

SEQ ID NO: 14042 - DNA, 20 bp, Artificial Sequence
  Synthetic oligonucleotide; CAG chr11 5273021 5273040 5273037 +
aaagtccaaggaataaggac

SEQ ID NO: 14043 - DNA, 20 bp, Artificial Sequence
  Synthetic oligonucleotide; AGG chr11 5273022 5273041 5273038 +
aagtccaaggaataaggacc

SEQ ID NO: 14044 - DNA, 20 bp, Artificial Sequence
  Synthetic oligonucleotide; AAG chr11 5273031 5273050 5273047 +
gaataaggaccaggtatctc

SEQ ID NO: 14045 - DNA, 20 bp, Artificial Sequence
  Synthetic oligonucleotide; AGG chr11 5273032 5273051 5273048 +
aataaggaccaggtatctca

SEQ ID NO: 14046 - DNA, 20 bp, Artificial Sequence
  Synthetic oligonucleotide; AAG chr11 5273037 5273056 5273053 +
ggaccaggtatctcaaggcc

SEQ ID NO: 14047 - DNA, 20 bp, Artificial Sequence
  Synthetic oligonucleotide; GAG chr11 5273039 5273058 5273055 +
accaggtatctcaaggccaa

SEQ ID NO: 14048 - DNA, 20 bp, Artificial Sequence
  Synthetic oligonucleotide; TGG chr11 5273044 5273063 5273060 +
gtatctcaaggccaagagtt

SEQ ID NO: 14049 - DNA, 20 bp, Artificial Sequence
  Synthetic oligonucleotide; GAG chr11 5273046 5273065 5273062 +
atctcaaggccaagagtttg

SEQ ID NO: 14050 - DNA, 20 bp, Artificial Sequence
  Synthetic oligonucleotide; CAG chr11 5273051 5273070 5273067 +
aaggccaagagtttggagaa

SEQ ID NO: 14051 - DNA, 20 bp, Artificial Sequence
  Synthetic oligonucleotide; AGG chr11 5273052 5273071 5273068 +
aggccaagagtttggagaac

SEQ ID NO: 14052 - DNA, 20 bp, Artificial Sequence
  Synthetic oligonucleotide; AAG chr11 5273069 5273088 5273085 +
aacaggtttctccctaaaac

SEQ ID NO: 14053 - DNA, 20 bp, Artificial Sequence
  Synthetic oligonucleotide; TGG chr11 5273077 5273096 5273093 +
tctccctaaaacaagcccta

SEQ ID NO: 14054 - DNA, 20 bp, Artificial Sequence
  Synthetic oligonucleotide; GGG chr11 5273078 5273097 5273094 +
ctccctaaaacaagccctat

SEQ ID NO: 14055 - DNA, 20 bp, Artificial Sequence
  Synthetic oligonucleotide; CAG chr11 5273103 5273122 5273119 +
atcccatcattcttcccatt

SEQ ID NO: 14056 - DNA, 20 bp, Artificial Sequence
  Synthetic oligonucleotide; GAG chr11 5273105 5273124 5273121 +
cccatcattcttcccattca

SEQ ID NO: 14057 - DNA, 20 bp, Artificial Sequence
  Synthetic oligonucleotide; TGG chr11 5273110 5273129 5273126 +
cattcttcccattcagagta

SEQ ID NO: 14058 - DNA, 20 bp, Artificial Sequence
  Synthetic oligonucleotide; CAG chr11 5273117 5273136 5273133 +
cccattcagagtatggacac

SEQ ID NO: 14059 - DNA, 20 bp, Artificial Sequence
  Synthetic oligonucleotide; TAG chr11 5273128 5273147 5273144 +
tatggacaccagtcttctct

SEQ ID NO: 14060 - DNA, 20 bp, Artificial Sequence
  Synthetic oligonucleotide; CAG chr11 5273134 5273153 5273150 +
caccagtcttctcttagatt

SEQ ID NO: 14061 - DNA, 20 bp, Artificial Sequence
  Synthetic oligonucleotide; GAG chr11 5273136 5273155 5273152 +
ccagtcttctcttagattca

SEQ ID NO: 14062 - DNA, 20 bp, Artificial Sequence
  Synthetic oligonucleotide; TGG chr11 5273141 5273160 5273157 +
cttctcttagattcagagta

SEQ ID NO: 14063 - DNA, 20 bp, Artificial Sequence
  Synthetic oligonucleotide; GGG chr11 5273142 5273161 5273158 +
ttctcttagattcagagtat

SEQ ID NO: 14064 - DNA, 20 bp, Artificial Sequence
  Synthetic oligonucleotide; GGG chr11 5273143 5273162 5273159 +
tctcttagattcagagtatg

SEQ ID NO: 14065 - DNA, 20 bp, Artificial Sequence
  Synthetic oligonucleotide; CGG chr11 5273166 5273185 5273182 +
ttgatcctctcctgctccct

SEQ ID NO: 14066 - DNA, 20 bp, Artificial Sequence
  Synthetic oligonucleotide; GAG chr11 5273168 5273187 5273184 +
gatcctctcctgctccctcg

SEQ ID NO: 14067 - DNA, 20 bp, Artificial Sequence
  Synthetic oligonucleotide; CAG chr11 5273172 5273191 5273188 +
ctctcctgctccctcggagc

SEQ ID NO: 14068 - DNA, 20 bp, Artificial Sequence
  Synthetic oligonucleotide; CAG chr11 5273178 5273197 5273194 +
tgctccctcggagccagttg

SEQ ID NO: 14069 - DNA, 20 bp, Artificial Sequence
  Synthetic oligonucleotide; GAG chr11 5273180 5273199 5273196 +
ctccctcggagccagttgca

SEQ ID NO: 14070 - DNA, 20 bp, Artificial Sequence
  Synthetic oligonucleotide; TGG chr11 5273212 5273231 5273228 +
tcttctctccttactgccta

SEQ ID NO: 14071 - DNA, 20 bp, Artificial Sequence
  Synthetic oligonucleotide; CAG chr11 5273218 5273237 5273234 +
ctccttactgcctatggttc

SEQ ID NO: 14072 - DNA, 20 bp, Artificial Sequence
  Synthetic oligonucleotide; TGG chr11 5273224 5273243 5273240 +
actgcctatggttccagacc

SEQ ID NO: 14073 - DNA, 20 bp, Artificial Sequence
  Synthetic oligonucleotide; CAG chr11 5273235 5273254 5273251 +
ttccagacctggcttgcatc

SEQ ID NO: 14074 - DNA, 20 bp, Artificial Sequence
  Synthetic oligonucleotide; AGG chr11 5273236 5273255 5273252 +
tccagacctggcttgcatcc

SEQ ID NO: 14075 - DNA, 20 bp, Artificial Sequence
  Synthetic oligonucleotide; GGG chr11 5273237 5273256 5273253 +
ccagacctggcttgcatcca

SEQ ID NO: 14076 - DNA, 20 bp, Artificial Sequence
  Synthetic oligonucleotide; TGG chr11 5273265 5273284 5273281 +
acccattccatgtttcctta

SEQ ID NO: 14077 - DNA, 20 bp, Artificial Sequence
  Synthetic oligonucleotide; AAG chr11 5273271 5273290 5273287 +
tccatgtttccttatggcta

SEQ ID NO: 14078 - DNA, 20 bp, Artificial Sequence
  Synthetic oligonucleotide; AGG chr11 5273272 5273291 5273288 +
ccatgtttccttatggctaa

SEQ ID NO: 14079 - DNA, 20 bp, Artificial Sequence
  Synthetic oligonucleotide; TGG chr11 5273275 5273294 5273291 +
tgtttccttatggctaaagg

SEQ ID NO: 14080 - DNA, 20 bp, Artificial Sequence
  Synthetic oligonucleotide; TAG chr11 5273278 5273297 5273294 +
ttccttatggctaaaggtgg

SEQ ID NO: 14081 - DNA, 20 bp, Artificial Sequence
  Synthetic oligonucleotide; AGG chr11 5273279 5273298 5273295 +
tccttatggctaaaggtggt

SEQ ID NO: 14082 - DNA, 20 bp, Artificial Sequence
  Synthetic oligonucleotide; GGG chr11 5273280 5273299 5273296 +
ccttatggctaaaggtggta

SEQ ID NO: 14083 - DNA, 20 bp, Artificial Sequence
  Synthetic oligonucleotide; GAG chr11 5273282 5273301 5273298 +
ttatggctaaaggtggtagg

SEQ ID NO: 14084 - DNA, 20 bp, Artificial Sequence
  Synthetic oligonucleotide; AGG chr11 5273283 5273302 5273299 +
tatggctaaaggtggtaggg

SEQ ID NO: 14085 - DNA, 20 bp, Artificial Sequence
  Synthetic oligonucleotide; GAG chr11 5273285 5273304 5273301 +
tggctaaaggtggtagggag

SEQ ID NO: 14086 - DNA, 20 bp, Artificial Sequence
  Synthetic oligonucleotide; AAG chr11 5273292 5273311 5273308 +
aggtggtagggaggagcttc

SEQ ID NO: 14087 - DNA, 20 bp, Artificial Sequence
  Synthetic oligonucleotide; AAG chr11 5273296 5273315 5273312 +
ggtagggaggagcttcaaga

SEQ ID NO: 14088 - DNA, 20 bp, Artificial Sequence
  Synthetic oligonucleotide; AGG chr11 5273297 5273316 5273313 +
gtagggaggagcttcaagaa

SEQ ID NO: 14089 - DNA, 20 bp, Artificial Sequence
  Synthetic oligonucleotide; TAG chr11 5273303 5273322 5273319 +
aggagcttcaagaaaggtta

SEQ ID NO: 14090 - DNA, 20 bp, Artificial Sequence
  Synthetic oligonucleotide; AAG chr11 5273312 5273331 5273328 +
aagaaaggttatagcattga

SEQ ID NO: 14091 - DNA, 20 bp, Artificial Sequence
  Synthetic oligonucleotide; AGG chr11 5273313 5273332 5273329 +
agaaaggttatagcattgaa

SEQ ID NO: 14092 - DNA, 20 bp, Artificial Sequence
  Synthetic oligonucleotide; CAG chr11 5273318 5273337 5273334 +
ggttatagcattgaaaggcc

SEQ ID NO: 14093 - DNA, 20 bp, Artificial Sequence
  Synthetic oligonucleotide; AGG chr11 5273319 5273338 5273335 +
gttatagcattgaaaggccc

SEQ ID NO: 14094 - DNA, 20 bp, Artificial Sequence
  Synthetic oligonucleotide; CAG chr11 5273331 5273350 5273347 +
aaaggcccaggtttgtgtct

SEQ ID NO: 14095 - DNA, 20 bp, Artificial Sequence
  Synthetic oligonucleotide; AAG chr11 5273338 5273357 5273354 +
caggtttgtgtctcagtaac

SEQ ID NO: 14096 - DNA, 20 bp, Artificial Sequence
  Synthetic oligonucleotide; AGG chr11 5273339 5273358 5273355 +
aggtttgtgtctcagtaaca

SEQ ID NO: 14097 - DNA, 20 bp, Artificial Sequence
  Synthetic oligonucleotide; CAG chr11 5273358 5273377 5273374 +
aaggcttataaatcctgact

SEQ ID NO: 14098 - DNA, 20 bp, Artificial Sequence
  Synthetic oligonucleotide; AAG chr11 5273361 5273380 5273377 +
gcttataaatcctgactcag

SEQ ID NO: 14099 - DNA, 20 bp, Artificial Sequence
  Synthetic oligonucleotide; CAG chr11 5273365 5273384 5273381 +
ataaatcctgactcagaagt

SEQ ID NO: 14100 - DNA, 20 bp, Artificial Sequence
  Synthetic oligonucleotide; AGG chr11 5273366 5273385 5273382 +
taaatcctgactcagaagtc

SEQ ID NO: 14101 - DNA, 20 bp, Artificial Sequence
  Synthetic oligonucleotide; TAG chr11 5273369 5273388 5273385 +
atcctgactcagaagtcagg

SEQ ID NO: 14102 - DNA, 20 bp, Artificial Sequence
  Synthetic oligonucleotide; AGG chr11 5273370 5273389 5273386 +
tcctgactcagaagtcaggt

SEQ ID NO: 14103 - DNA, 20 bp, Artificial Sequence
  Synthetic oligonucleotide; CGG chr11 5273376 5273395 5273392 +
ctcagaagtcaggtaggctg

SEQ ID NO: 14104 - DNA, 20 bp, Artificial Sequence
  Synthetic oligonucleotide; GGG chr11 5273377 5273396 5273393 +
tcagaagtcaggtaggctgc

SEQ ID NO: 14105 - DNA, 20 bp, Artificial Sequence
  Synthetic oligonucleotide; CAG chr11 5273380 5273399 5273396 +
gaagtcaggtaggctgcggg

SEQ ID NO: 14106 - DNA, 20 bp, Artificial Sequence
  Synthetic oligonucleotide; TGG chr11 5273407 5273426 5273423 +
attattgcttcgatgcttgt

SEQ ID NO: 14107 - DNA, 20 bp, Artificial Sequence
  Synthetic oligonucleotide; AAG chr11 5273413 5273432 5273429 +
gcttcgatgcttgttggttc

SEQ ID NO: 14108 - DNA, 20 bp, Artificial Sequence
  Synthetic oligonucleotide; AAG chr11 5273442 5273461 5273458 +
tgcttcacctgctcattttt

SEQ ID NO: 14109 - DNA, 20 bp, Artificial Sequence
  Synthetic oligonucleotide; GAG chr11 5273466 5273485 5273482 +
attttatttgtttatcatat

SEQ ID NO: 14110 - DNA, 20 bp, Artificial Sequence
  Synthetic oligonucleotide; TGG chr11 5273482 5273501 5273498 +
atatgagataccatgaaaaa

SEQ ID NO: 14111 - DNA, 20 bp, Artificial Sequence
  Synthetic oligonucleotide; AAG chr11 5273511 5273530 5273527 +
gcttttctttcctatattaa

SEQ ID NO: 14112 - DNA, 20 bp, Artificial Sequence
  Synthetic oligonucleotide; AAG chr11 5273518 5273537 5273534 +
tttcctatattaaaagccca

SEQ ID NO: 14113 - DNA, 20 bp, Artificial Sequence
  Synthetic oligonucleotide; CAG chr11 5273523 5273542 5273539 +
tatattaaaagcccaaagtt

SEQ ID NO: 14114 - DNA, 20 bp, Artificial Sequence
  Synthetic oligonucleotide; GAG chr11 5273525 5273544 5273541 +
tattaaaagcccaaagttca

SEQ ID NO: 14115 - DNA, 20 bp, Artificial Sequence
  Synthetic oligonucleotide; GAG chr11 5273527 5273546 5273543 +
ttaaaagcccaaagttcaga

SEQ ID NO: 14116 - DNA, 20 bp, Artificial Sequence
  Synthetic oligonucleotide; AAG chr11 5273532 5273551 5273548 +
agcccaaagttcagagagat

SEQ ID NO: 14117 - DNA, 20 bp, Artificial Sequence
  Synthetic oligonucleotide; TGG chr11 5273540 5273559 5273556 +
gttcagagagataagtgtta

SEQ ID NO: 14118 - DNA, 20 bp, Artificial Sequence
  Synthetic oligonucleotide; CAG chr11 5273548 5273567 5273564 +
agataagtgttatggccatc

SEQ ID NO: 14119 - DNA, 20 bp, Artificial Sequence
  Synthetic oligonucleotide; AGG chr11 5273549 5273568 5273565 +
gataagtgttatggccatcc

SEQ ID NO: 14120 - DNA, 20 bp, Artificial Sequence
  Synthetic oligonucleotide; TAG chr11 5273553 5273572 5273569 +
agtgttatggccatccagga

SEQ ID NO: 14121 - DNA, 20 bp, Artificial Sequence
  Synthetic oligonucleotide; CAG chr11 5273558 5273577 5273574 +
tatggccatccaggatagat

SEQ ID NO: 14122 - DNA, 20 bp, Artificial Sequence
  Synthetic oligonucleotide; AAG chr11 5273562 5273581 5273578 +
gccatccaggatagatcaga

SEQ ID NO: 14123 - DNA, 20 bp, Artificial Sequence
  Synthetic oligonucleotide; TAG chr11 5273567 5273586 5273583 +
ccaggatagatcagaaagat

SEQ ID NO: 14124 - DNA, 20 bp, Artificial Sequence
  Synthetic oligonucleotide; CAG chr11 5273571 5273590 5273587 +
gatagatcagaaagattaga

SEQ ID NO: 14125 - DNA, 20 bp, Artificial Sequence
  Synthetic oligonucleotide; CAG chr11 5273575 5273594 5273591 +
gatcagaaagattagacagt

SEQ ID NO: 14126 - DNA, 20 bp, Artificial Sequence
  Synthetic oligonucleotide; AAG chr11 5273581 5273600 5273597 +
aaagattagacagtcagaaa

SEQ ID NO: 14127 - DNA, 20 bp, Artificial Sequence
  Synthetic oligonucleotide; CAG chr11 5273588 5273607 5273604 +
agacagtcagaaaaagtaat

SEQ ID NO: 14128 - DNA, 20 bp, Artificial Sequence
  Synthetic oligonucleotide; AAG chr11 5273592 5273611 5273608 +
agtcagaaaaagtaatcagt

SEQ ID NO: 14129 - DNA, 20 bp, Artificial Sequence
  Synthetic oligonucleotide; TAG chr11 5273626 5273645 5273642 +
attgtctatataattaaaat

SEQ ID NO: 14130 - DNA, 20 bp, Artificial Sequence
  Synthetic oligonucleotide; AAG chr11 5273653 5273672 5273669 +
ataaaatctatgtatgtctt

SEQ ID NO: 14131 - DNA, 20 bp, Artificial Sequence
  Synthetic oligonucleotide; AAG chr11 5273662 5273681 5273678 +
atgtatgtcttaagacattt

SEQ ID NO: 14132 - DNA, 20 bp, Artificial Sequence
  Synthetic oligonucleotide; AAG chr11 5273669 5273688 5273685 +
tcttaagacatttaagtata

SEQ ID NO: 14133 - DNA, 20 bp, Artificial Sequence
  Synthetic oligonucleotide; AGG chr11 5273670 5273689 5273686 +
cttaagacatttaagtataa

SEQ ID NO: 14134 - DNA, 20 bp, Artificial Sequence
  Synthetic oligonucleotide; TAG chr11 5273678 5273697 5273694 +
atttaagtataaaggacttt

SEQ ID NO: 14135 - DNA, 20 bp, Artificial Sequence
  Synthetic oligonucleotide; AAG chr11 5273682 5273701 5273698 +
aagtataaaggacttttaga

SEQ ID NO: 14136 - DNA, 20 bp, Artificial Sequence
  Synthetic oligonucleotide; AAG chr11 5273703 5273722 5273719 +
agaaacacccaaattcgatg

SEQ ID NO: 14137 - DNA, 20 bp, Artificial Sequence
  Synthetic oligonucleotide; TGG chr11 5273723 5273742 5273739 +
aagattaattcctgcctgtt

SEQ ID NO: 14138 - DNA, 20 bp, Artificial Sequence
  Synthetic oligonucleotide; GGG chr11 5273724 5273743 5273740 +
agattaattcctgcctgttt

SEQ ID NO: 14139 - DNA, 20 bp, Artificial Sequence
  Synthetic oligonucleotide; TAG chr11 5273734 5273753 5273750 +
ctgcctgtttgggtttgctt

SEQ ID NO: 14140 - DNA, 20 bp, Artificial Sequence
  Synthetic oligonucleotide; AAG chr11 5273752 5273771 5273768 +
tttagcatttgtaatttctt

SEQ ID NO: 14141 - DNA, 20 bp, Artificial Sequence
  Synthetic oligonucleotide; CAG chr11 5273762 5273781 5273778 +
gtaatttcttaagttctatg

SEQ ID NO: 14142 - DNA, 20 bp, Artificial Sequence
  Synthetic oligonucleotide; AGG chr11 5273763 5273782 5273779 +
taatttcttaagttctatgc

SEQ ID NO: 14143 - DNA, 20 bp, Artificial Sequence
  Synthetic oligonucleotide; AAG chr11 5273780 5273799 5273796 +
tgcaggattctaaaaactgt

SEQ ID NO: 14144 - DNA, 20 bp, Artificial Sequence
  Synthetic oligonucleotide; AAG chr11 5273798 5273817 5273814 +
gtaagatgcctaatttaaac

SEQ ID NO: 14145 - DNA, 20 bp, Artificial Sequence
  Synthetic oligonucleotide; AGG chr11 5273799 5273818 5273815 +
taagatgcctaatttaaaca

SEQ ID NO: 14146 - DNA, 20 bp, Artificial Sequence
  Synthetic oligonucleotide; TGG chr11 5273830 5273849 5273846 +
aatattttcttaaatctttc

SEQ ID NO: 14147 - DNA, 20 bp, Artificial Sequence
  Synthetic oligonucleotide; AAG chr11 5273859 5273878 5273875 +
tatgacatatgtttaacctg

SEQ ID NO: 14148 - DNA, 20 bp, Artificial Sequence
  Synthetic oligonucleotide; GAG chr11 5273861 5273880 5273877 +
tgacatatgtttaacctgaa

SEQ ID NO: 14149 - DNA, 20 bp, Artificial Sequence
  Synthetic oligonucleotide; TAG chr11 5273883 5273902 5273899 +
gtcaaatattgtactgttct

SEQ ID NO: 14150 - DNA, 20 bp, Artificial Sequence
  Synthetic oligonucleotide; TAG chr11 5273893 5273912 5273909 +
gtactgttcttagatgctat

SEQ ID NO: 14151 - DNA, 20 bp, Artificial Sequence
  Synthetic oligonucleotide; TAG chr11 5273915 5273934 5273931 +
gtatgaaaaattatataaat

SEQ ID NO: 14152 - DNA, 20 bp, Artificial Sequence
  Synthetic oligonucleotide; AAG chr11 5273927 5273946 5273943 +
atataaattagattcttgtt

SEQ ID NO: 14153 - DNA, 20 bp, Artificial Sequence
  Synthetic oligonucleotide; AAG chr11 5273932 5273951 5273948 +
aattagattcttgttaagta

SEQ ID NO: 14154 - DNA, 20 bp, Artificial Sequence
  Synthetic oligonucleotide; TAG chr11 5273935 5273954 5273951 +
tagattcttgttaagtaaag

SEQ ID NO: 14155 - DNA, 20 bp, Artificial Sequence
  Synthetic oligonucleotide; AGG chr11 5273936 5273955 5273952 +
agattcttgttaagtaaagt

SEQ ID NO: 14156 - DNA, 20 bp, Artificial Sequence
  Synthetic oligonucleotide; TGG chr11 5273965 5273984 5273981 +
acttcactgaatgtttttca

SEQ ID NO: 14157 - DNA, 20 bp, Artificial Sequence
  Synthetic oligonucleotide; AAG chr11 5273976 5273995 5273992 +
tgtttttcatggtattatct

SEQ ID NO: 14158 - DNA, 20 bp, Artificial Sequence
  Synthetic oligonucleotide; TAG chr11 5274041 5274060 5274057 +
ctttatttttatttttaaaa

SEQ ID NO: 14159 - DNA, 20 bp, Artificial Sequence
  Synthetic oligonucleotide; AGG chr11 5274042 5274061 5274058 +
tttatttttatttttaaaat

SEQ ID NO: 14160 - DNA, 20 bp, Artificial Sequence
  Synthetic oligonucleotide; AAG chr11 5274057 5274076 5274073 +
aaaataggaaaaatataaac

SEQ ID NO: 14161 - DNA, 20 bp, Artificial Sequence
  Synthetic oligonucleotide; AGG chr11 5274058 5274077 5274074 +
aaataggaaaaatataaaca

SEQ ID NO: 14162 - DNA, 20 bp, Artificial Sequence
  Synthetic oligonucleotide; TAG chr11 5274076 5274095 5274092 +
caaggcttgtaaaccactga

SEQ ID NO: 14163 - DNA, 20 bp, Artificial Sequence
  Synthetic oligonucleotide; AGG chr11 5274077 5274096 5274093 +
aaggcttgtaaaccactgat

SEQ ID NO: 14164 - DNA, 20 bp, Artificial Sequence
  Synthetic oligonucleotide; AAG chr11 5274082 5274101 5274098 +
ttgtaaaccactgataggaa

SEQ ID NO: 14165 - DNA, 20 bp, Artificial Sequence
  Synthetic oligonucleotide; GAG chr11 5274084 5274103 5274100 +
gtaaaccactgataggaaaa

SEQ ID NO: 14166 - DNA, 20 bp, Artificial Sequence
  Synthetic oligonucleotide; TAG chr11 5274092 5274111 5274108 +
ctgataggaaaagagctgct

SEQ ID NO: 14167 - DNA, 20 bp, Artificial Sequence
  Synthetic oligonucleotide; AGG chr11 5274093 5274112 5274109 +
tgataggaaaagagctgctt

SEQ ID NO: 14168 - DNA, 20 bp, Artificial Sequence
  Synthetic oligonucleotide; TAG chr11 5274105 5274124 5274121 +
agctgcttaggattctaaat

SEQ ID NO: 14169 - DNA, 20 bp, Artificial Sequence
  Synthetic oligonucleotide; CAG chr11 5274109 5274128 5274125 +
gcttaggattctaaattagc

SEQ ID NO: 14170 - DNA, 20 bp, Artificial Sequence
  Synthetic oligonucleotide; CAG chr11 5274157 5274176 5274173 +
tgtatctaaatctatattct

SEQ ID NO: 14171 - DNA, 20 bp, Artificial Sequence
  Synthetic oligonucleotide; TAG chr11 5274168 5274187 5274184 +
ctatattctcagaacaaaaa

SEQ ID NO: 14172 - DNA, 20 bp, Artificial Sequence
  Synthetic oligonucleotide; AAG chr11 5274175 5274194 5274191 +
ctcagaacaaaaatagatgt

SEQ ID NO: 14173 - DNA, 20 bp, Artificial Sequence
  Synthetic oligonucleotide; TAG chr11 5274191 5274210 5274207 +
atgtaagcaaatgattctac

SEQ ID NO: 14174 - DNA, 20 bp, Artificial Sequence
  Synthetic oligonucleotide; TAG chr11 5274203 5274222 5274219 +
gattctactagattttgtgt

SEQ ID NO: 14175 - DNA, 20 bp, Artificial Sequence
  Synthetic oligonucleotide; CAG chr11 5274219 5274238 5274235 +
gtgttagattttgcattatc

SEQ ID NO: 14176 - DNA, 20 bp, Artificial Sequence
  Synthetic oligonucleotide; AGG chr11 5274220 5274239 5274236 +
tgttagattttgcattatcc

SEQ ID NO: 14177 - DNA, 20 bp, Artificial Sequence
  Synthetic oligonucleotide; TGG chr11 5274230 5274249 5274246 +
tgcattatccaggaatgact

SEQ ID NO: 14178 - DNA, 20 bp, Artificial Sequence
  Synthetic oligonucleotide; AAG chr11 5274240 5274259 5274256 +
aggaatgacttggatatcac

SEQ ID NO: 14179 - DNA, 20 bp, Artificial Sequence
  Synthetic oligonucleotide; TGG chr11 5274255 5274274 5274271 +
atcacaagtcataaattctg

SEQ ID NO: 14180 - DNA, 20 bp, Artificial Sequence
  Synthetic oligonucleotide; CAG chr11 5274266 5274285 5274282 +
taaattctgtggctgccttg

SEQ ID NO: 14181 - DNA, 20 bp, Artificial Sequence
  Synthetic oligonucleotide; AGG chr11 5274267 5274286 5274283 +
aaattctgtggctgccttgc

SEQ ID NO: 14182 - DNA, 20 bp, Artificial Sequence
  Synthetic oligonucleotide; AAG chr11 5274270 5274289 5274286 +
ttctgtggctgccttgcagg

SEQ ID NO: 14183 - DNA, 20 bp, Artificial Sequence
  Synthetic oligonucleotide; TGG chr11 5274277 5274296 5274293 +
gctgccttgcaggaagcctg

SEQ ID NO: 14184 - DNA, 20 bp, Artificial Sequence
  Synthetic oligonucleotide; TAG chr11 5274288 5274307 5274304 +
ggaagcctgtggctattttc

SEQ ID NO: 14185 - DNA, 20 bp, Artificial Sequence
  Synthetic oligonucleotide; AAG chr11 5274301 5274320 5274317 +
tattttctagtgtaattgta

SEQ ID NO: 14186 - DNA, 20 bp, Artificial Sequence
  Synthetic oligonucleotide; GAG chr11 5274307 5274326 5274323 +
ctagtgtaattgtaaagaat

SEQ ID NO: 14187 - DNA, 20 bp, Artificial Sequence
  Synthetic oligonucleotide; GAG chr11 5274309 5274328 5274325 +
agtgtaattgtaaagaatga

SEQ ID NO: 14188 - DNA, 20 bp, Artificial Sequence
  Synthetic oligonucleotide; TAG chr11 5274314 5274333 5274330 +
aattgtaaagaatgagagaa

SEQ ID NO: 14189 - DNA, 20 bp, Artificial Sequence
  Synthetic oligonucleotide; AAG chr11 5274325 5274344 5274341 +
atgagagaatagaccataac

SEQ ID NO: 14190 - DNA, 20 bp, Artificial Sequence
  Synthetic oligonucleotide; AAG chr11 5274367 5274386 5274383 +
ttgttttcaacttttatttt

SEQ ID NO: 14191 - DNA, 20 bp, Artificial Sequence
  Synthetic oligonucleotide; CAG chr11 5274372 5274391 5274388 +
ttcaacttttattttaagtt

SEQ ID NO: 14192 - DNA, 20 bp, Artificial Sequence
  Synthetic oligonucleotide; AGG chr11 5274373 5274392 5274389 +
tcaacttttattttaagttc

SEQ ID NO: 14193 - DNA, 20 bp, Artificial Sequence
  Synthetic oligonucleotide; GGG chr11 5274374 5274393 5274390 +
caacttttattttaagttca

SEQ ID NO: 14194 - DNA, 20 bp, Artificial Sequence
  Synthetic oligonucleotide; GGG chr11 5274375 5274394 5274391 +
aacttttattttaagttcag

SEQ ID NO: 14195 - DNA, 20 bp, Artificial Sequence
  Synthetic oligonucleotide; CAG chr11 5274386 5274405 5274402 +
taagttcaggggtacatgta

SEQ ID NO: 14196 - DNA, 20 bp, Artificial Sequence
  Synthetic oligonucleotide; AGG chr11 5274387 5274406 5274403 +
aagttcaggggtacatgtac

SEQ ID NO: 14197 - DNA, 20 bp, Artificial Sequence
  Synthetic oligonucleotide; CAG chr11 5274395 5274414 5274411 +
gggtacatgtacaggatgtg

SEQ ID NO: 14198 - DNA, 20 bp, Artificial Sequence
  Synthetic oligonucleotide; AGG chr11 5274396 5274415 5274412 +
ggtacatgtacaggatgtgc

SEQ ID NO: 14199 - DNA, 20 bp, Artificial Sequence
  Synthetic oligonucleotide; TAG chr11 5274408 5274427 5274424 +
ggatgtgcaggtttgttaca

SEQ ID NO: 14200 - DNA, 20 bp, Artificial Sequence
  Synthetic oligonucleotide; AAG chr11 5274424 5274443 5274440 +
tacatagataaatgaatgtc

SEQ ID NO: 14201 - DNA, 20 bp, Artificial Sequence
  Synthetic oligonucleotide; AGG chr11 5274425 5274444 5274441 +
acatagataaatgaatgtca

SEQ ID NO: 14202 - DNA, 20 bp, Artificial Sequence
  Synthetic oligonucleotide; GGG chr11 5274426 5274445 5274442 +
catagataaatgaatgtcaa

SEQ ID NO: 14203 - DNA, 20 bp, Artificial Sequence
  Synthetic oligonucleotide; GGG chr11 5274427 5274446 5274443 +
atagataaatgaatgtcaag

SEQ ID NO: 14204 - DNA, 20 bp, Artificial Sequence
  Synthetic oligonucleotide; GGG chr11 5274428 5274447 5274444 +
tagataaatgaatgtcaagg

SEQ ID NO: 14205 - DNA, 20 bp, Artificial Sequence
  Synthetic oligonucleotide; TAG chr11 5274440 5274459 5274456 +
tgtcaagggggtttgttgta

SEQ ID NO: 14206 - DNA, 20 bp, Artificial Sequence
  Synthetic oligonucleotide; CAG chr11 5274457 5274476 5274473 +
gtatagatgatctcatcact

SEQ ID NO: 14207 - DNA, 20 bp, Artificial Sequence
  Synthetic oligonucleotide; AGG chr11 5274458 5274477 5274474 +
tatagatgatctcatcactc

SEQ ID NO: 14208 - DNA, 20 bp, Artificial Sequence
  Synthetic oligonucleotide; TAG chr11 5274470 5274489 5274486 +
catcactcaggtattacgct

SEQ ID NO: 14209 - DNA, 20 bp, Artificial Sequence
  Synthetic oligonucleotide; TAG chr11 5274480 5274499 5274496 +
gtattacgcttagcatccat

SEQ ID NO: 14210 - DNA, 20 bp, Artificial Sequence
  Synthetic oligonucleotide; TAG chr11 5274527 5274546 5274543 +
tctcaccctccaccctctga

SEQ ID NO: 14211 - DNA, 20 bp, Artificial Sequence
  Synthetic oligonucleotide; AGG chr11 5274528 5274547 5274544 +
ctcaccctccaccctctgat

SEQ ID NO: 14212 - DNA, 20 bp, Artificial Sequence
  Synthetic oligonucleotide; CAG chr11 5274534 5274553 5274550 +
ctccaccctctgataggccc

SEQ ID NO: 14213 - DNA, 20 bp, Artificial Sequence
  Synthetic oligonucleotide; GAG chr11 5274557 5274576 5274573 +
tatgcgttgtttccctctat

SEQ ID NO: 14214 - DNA, 20 bp, Artificial Sequence
  Synthetic oligonucleotide; TAG chr11 5274579 5274598 5274595 +
gtccatgtgttctcatcatt

SEQ ID NO: 14215 - DNA, 20 bp, Artificial Sequence
  Synthetic oligonucleotide; TAG chr11 5274601 5274620 5274617 +
gcttctaactgttgctttcg

SEQ ID NO: 14216 - DNA, 20 bp, Artificial Sequence
  Synthetic oligonucleotide; AAG chr11 5274628 5274647 5274644 +
cctctgcctcatctctcacg

SEQ ID NO: 14217 - DNA, 20 bp, Artificial Sequence
  Synthetic oligonucleotide; CAG chr11 5274635 5274654 5274651 +
ctcatctctcacgaagtttg

SEQ ID NO: 14218 - DNA, 20 bp, Artificial Sequence
  Synthetic oligonucleotide; AGG chr11 5274636 5274655 5274652 +
tcatctctcacgaagtttgc

SEQ ID NO: 14219 - DNA, 20 bp, Artificial Sequence
  Synthetic oligonucleotide; GAG chr11 5274640 5274659 5274656 +
ctctcacgaagtttgcaggt

SEQ ID NO: 14220 - DNA, 20 bp, Artificial Sequence
  Synthetic oligonucleotide; GAG chr11 5274646 5274665 5274662 +
cgaagtttgcaggtgagttt

SEQ ID NO: 14221 - DNA, 20 bp, Artificial Sequence
  Synthetic oligonucleotide; CAG chr11 5274650 5274669 5274666 +
gtttgcaggtgagtttgagc

SEQ ID NO: 14222 - DNA, 20 bp, Artificial Sequence
  Synthetic oligonucleotide; AGG chr11 5274651 5274670 5274667 +
tttgcaggtgagtttgagcc

SEQ ID NO: 14223 - DNA, 20 bp, Artificial Sequence
  Synthetic oligonucleotide; GGG chr11 5274652 5274671 5274668 +
ttgcaggtgagtttgagcca

SEQ ID NO: 14224 - DNA, 20 bp, Artificial Sequence
  Synthetic oligonucleotide; GAG chr11 5274657 5274676 5274673 +
ggtgagtttgagccagggct

SEQ ID NO: 14225 - DNA, 20 bp, Artificial Sequence
  Synthetic oligonucleotide; AGG chr11 5274658 5274677 5274674 +
gtgagtttgagccagggctg

SEQ ID NO: 14226 - DNA, 20 bp, Artificial Sequence
  Synthetic oligonucleotide; AAG chr11 5274670 5274689 5274686 +
cagggctgaggctcattctc

SEQ ID NO: 14227 - DNA, 20 bp, Artificial Sequence
  Synthetic oligonucleotide; GAG chr11 5274672 5274691 5274688 +
gggctgaggctcattctcaa

SEQ ID NO: 14228 - DNA, 20 bp, Artificial Sequence
  Synthetic oligonucleotide; TGG chr11 5274688 5274707 5274704 +
tcaagagtaatctctctctc

SEQ ID NO: 14229 - DNA, 20 bp, Artificial Sequence
  Synthetic oligonucleotide; TGG chr11 5274696 5274715 5274712 +
aatctctctctctggcaact

SEQ ID NO: 14230 - DNA, 20 bp, Artificial Sequence
  Synthetic oligonucleotide; GAG chr11 5274698 5274717 5274714 +
tctctctctctggcaacttg

SEQ ID NO: 14231 - DNA, 20 bp, Artificial Sequence
  Synthetic oligonucleotide; CAG chr11 5274703 5274722 5274719 +
ctctctggcaacttggagca

SEQ ID NO: 14232 - DNA, 20 bp, Artificial Sequence
  Synthetic oligonucleotide; CGG chr11 5274729 5274748 5274745 +
tcctattgtgtgactgacct

SEQ ID NO: 14233 - DNA, 20 bp, Artificial Sequence
  Synthetic oligonucleotide; GGG chr11 5274730 5274749 5274746 +
cctattgtgtgactgacctc

SEQ ID NO: 14234 - DNA, 20 bp, Artificial Sequence
  Synthetic oligonucleotide; GAG chr11 5274732 5274751 5274748 +
tattgtgtgactgacctcgg

SEQ ID NO: 14235 - DNA, 20 bp, Artificial Sequence
  Synthetic oligonucleotide; AAG chr11 5274747 5274766 5274763 +
ctcgggagccactgtgccta

SEQ ID NO: 14236 - DNA, 20 bp, Artificial Sequence
  Synthetic oligonucleotide; CAG chr11 5274756 5274775 5274772 +
cactgtgcctaaagtacaac

SEQ ID NO: 14237 - DNA, 20 bp, Artificial Sequence
  Synthetic oligonucleotide; GAG chr11 5274758 5274777 5274774 +
ctgtgcctaaagtacaacca

SEQ ID NO: 14238 - DNA, 20 bp, Artificial Sequence
  Synthetic oligonucleotide; AAG chr11 5274780 5274799 5274796 +
gttacttgtgaatgttaatt

SEQ ID NO: 14239 - DNA, 20 bp, Artificial Sequence
  Synthetic oligonucleotide; CAG chr11 5274783 5274802 5274799 +
acttgtgaatgttaattaag

SEQ ID NO: 14240 - DNA, 20 bp, Artificial Sequence
  Synthetic oligonucleotide; AGG chr11 5274784 5274803 5274800 +
cttgtgaatgttaattaagc

SEQ ID NO: 14241 - DNA, 20 bp, Artificial Sequence
  Synthetic oligonucleotide; GAG chr11 5274786 5274805 5274802 +
tgtgaatgttaattaagcag

SEQ ID NO: 14242 - DNA, 20 bp, Artificial Sequence
  Synthetic oligonucleotide; AGG chr11 5274787 5274806 5274803 +
gtgaatgttaattaagcagg

SEQ ID NO: 14243 - DNA, 20 bp, Artificial Sequence
  Synthetic oligonucleotide; GGG chr11 5274788 5274807 5274804 +
tgaatgttaattaagcagga

SEQ ID NO: 14244 - DNA, 20 bp, Artificial Sequence
  Synthetic oligonucleotide; TGG chr11 5274799 5274818 5274815 +
taagcaggagggatctttaa

SEQ ID NO: 14245 - DNA, 20 bp, Artificial Sequence
  Synthetic oligonucleotide; GGG chr11 5274800 5274819 5274816 +
aagcaggagggatctttaat

SEQ ID NO: 14246 - DNA, 20 bp, Artificial Sequence
  Synthetic oligonucleotide; AAG chr11 5274806 5274825 5274822 +
gagggatctttaatgggaaa

SEQ ID NO: 14247 - DNA, 20 bp, Artificial Sequence
  Synthetic oligonucleotide; AGG chr11 5274807 5274826 5274823 +
agggatctttaatgggaaaa

SEQ ID NO: 14248 - DNA, 20 bp, Artificial Sequence
  Synthetic oligonucleotide; GAG chr11 5274809 5274828 5274825 +
ggatctttaatgggaaaaag

SEQ ID NO: 14249 - DNA, 20 bp, Artificial Sequence
  Synthetic oligonucleotide; TAG chr11 5274812 5274831 5274828 +
tctttaatgggaaaaaggag

SEQ ID NO: 14250 - DNA, 20 bp, Artificial Sequence
  Synthetic oligonucleotide; AAG chr11 5274816 5274835 5274832 +
taatgggaaaaaggagtaga

SEQ ID NO: 14251 - DNA, 20 bp, Artificial Sequence
  Synthetic oligonucleotide; CAG chr11 5274820 5274839 5274836 +
gggaaaaaggagtagaaagc

SEQ ID NO: 14252 - DNA, 20 bp, Artificial Sequence
  Synthetic oligonucleotide; CAG chr11 5274826 5274845 5274842 +
aaggagtagaaagccagaat

SEQ ID NO: 14253 - DNA, 20 bp, Artificial Sequence
  Synthetic oligonucleotide; CAG chr11 5274830 5274849 5274846 +
agtagaaagccagaatcagc

SEQ ID NO: 14254 - DNA, 20 bp, Artificial Sequence
  Synthetic oligonucleotide; TGG chr11 5274856 5274875 5274872 +
tgccacactttcctacatga

SEQ ID NO: 14255 - DNA, 20 bp, Artificial Sequence
  Synthetic oligonucleotide; GGG chr11 5274857 5274876 5274873 +
gccacactttcctacatgat

SEQ ID NO: 14256 - DNA, 20 bp, Artificial Sequence
  Synthetic oligonucleotide; AAG chr11 5274865 5274884 5274881 +
ttcctacatgatgggcactg

SEQ ID NO: 14257 - DNA, 20 bp, Artificial Sequence
  Synthetic oligonucleotide; AGG chr11 5274866 5274885 5274882 +
tcctacatgatgggcactga

SEQ ID NO: 14258 - DNA, 20 bp, Artificial Sequence
  Synthetic oligonucleotide; GAG chr11 5274878 5274897 5274894 +
ggcactgaaggttaaaactt

SEQ ID NO: 14259 - DNA, 20 bp, Artificial Sequence
  Synthetic oligonucleotide; TAG chr11 5274891 5274910 5274907 +
aaaacttgagtctgtcaact

SEQ ID NO: 14260 - DNA, 20 bp, Artificial Sequence
  Synthetic oligonucleotide; TAG chr11 5274928 5274947 5274944 +
tcccattttccgctgaaata

SEQ ID NO: 14261 - DNA, 20 bp, Artificial Sequence
  Synthetic oligonucleotide; TGG chr11 5274942 5274961 5274958 +
gaaatatagctttactttcc

SEQ ID NO: 14262 - DNA, 20 bp, Artificial Sequence
  Synthetic oligonucleotide; TGG chr11 5274959 5274978 5274975 +
tcctggtttctttgaccttt

SEQ ID NO: 14263 - DNA, 20 bp, Artificial Sequence
  Synthetic oligonucleotide; GGG chr11 5274960 5274979 5274976 +
cctggtttctttgacctttt

SEQ ID NO: 14264 - DNA, 20 bp, Artificial Sequence
  Synthetic oligonucleotide; GAG chr11 5274968 5274987 5274984 +
ctttgaccttttgggacctt

SEQ ID NO: 14265 - DNA, 20 bp, Artificial Sequence
  Synthetic oligonucleotide; AAG chr11 5274972 5274991 5274988 +
gaccttttgggaccttgagt

SEQ ID NO: 14266 - DNA, 20 bp, Artificial Sequence
  Synthetic oligonucleotide; AAG chr11 5274977 5274996 5274993 +
tttgggaccttgagtaagta

SEQ ID NO: 14267 - DNA, 20 bp, Artificial Sequence
  Synthetic oligonucleotide; AAG chr11 5275012 5275031 5275028 +
attttcatgattaaaattct

SEQ ID NO: 14268 - DNA, 20 bp, Artificial Sequence
  Synthetic oligonucleotide; TGG chr11 5275022 5275041 5275038 +
ttaaaattctaagaaattct

SEQ ID NO: 14269 - DNA, 20 bp, Artificial Sequence
  Synthetic oligonucleotide; GGG chr11 5275023 5275042 5275039 +
taaaattctaagaaattctt

SEQ ID NO: 14270 - DNA, 20 bp, Artificial Sequence
  Synthetic oligonucleotide; AAG chr11 5275067 5275086 5275083 +
gcctaatgtatttatgaact

SEQ ID NO: 14271 - DNA, 20 bp, Artificial Sequence
  Synthetic oligonucleotide; TAG chr11 5275074 5275093 5275090 +
gtatttatgaactaagaaca

SEQ ID NO: 14272 - DNA, 20 bp, Artificial Sequence
  Synthetic oligonucleotide; AAG chr11 5275095 5275114 5275111 +
agaaataaaacaatactctg

SEQ ID NO: 14273 - DNA, 20 bp, Artificial Sequence
  Synthetic oligonucleotide; TAG chr11 5275098 5275117 5275114 +
aataaaacaatactctgaag

SEQ ID NO: 14274 - DNA, 20 bp, Artificial Sequence
  Synthetic oligonucleotide; CAG chr11 5275103 5275122 5275119 +
aacaatactctgaagtagtt

SEQ ID NO: 14275 - DNA, 20 bp, Artificial Sequence
  Synthetic oligonucleotide; AAG chr11 5275127 5275146 5275143 +
atgtgctttcaatttatata

SEQ ID NO: 14276 - DNA, 20 bp, Artificial Sequence
  Synthetic oligonucleotide; GAG chr11 5275129 5275148 5275145 +
gtgctttcaatttatataaa

SEQ ID NO: 14277 - DNA, 20 bp, Artificial Sequence
  Synthetic oligonucleotide; GAG chr11 5275143 5275162 5275159 +
tataaagagttaattcaaat

SEQ ID NO: 14278 - DNA, 20 bp, Artificial Sequence
  Synthetic oligonucleotide; AAG chr11 5275154 5275173 5275170 +
aattcaaatgagactatttt

SEQ ID NO: 14279 - DNA, 20 bp, Artificial Sequence
  Synthetic oligonucleotide; CAG chr11 5275159 5275178 5275175 +
aaatgagactattttaagtg

SEQ ID NO: 14280 - DNA, 20 bp, Artificial Sequence
  Synthetic oligonucleotide; AGG chr11 5275160 5275179 5275176 +
aatgagactattttaagtgc

SEQ ID NO: 14281 - DNA, 20 bp, Artificial Sequence
  Synthetic oligonucleotide; GGG chr11 5275161 5275180 5275177 +
atgagactattttaagtgca

SEQ ID NO: 14282 - DNA, 20 bp, Artificial Sequence
  Synthetic oligonucleotide; TAG chr11 5275180 5275199 5275196 +
agggctttgaatcttatgtc

SEQ ID NO: 14283 - DNA, 20 bp, Artificial Sequence
  Synthetic oligonucleotide; AAG chr11 5275212 5275231 5275228 +
aaaacctctgattatatgct

SEQ ID NO: 14284 - DNA, 20 bp, Artificial Sequence
  Synthetic oligonucleotide; TAG chr11 5275225 5275244 5275241 +
atatgctaagattccacctc

SEQ ID NO: 14285 - DNA, 20 bp, Artificial Sequence
  Synthetic oligonucleotide; TAG chr11 5275231 5275250 5275247 +
taagattccacctctagtgc

SEQ ID NO: 14286 - DNA, 20 bp, Artificial Sequence
  Synthetic oligonucleotide; GAG chr11 5275238 5275257 5275254 +
ccacctctagtgctagaact

SEQ ID NO: 14287 - DNA, 20 bp, Artificial Sequence
  Synthetic oligonucleotide; AAG chr11 5275241 5275260 5275257 +
cctctagtgctagaactgag

SEQ ID NO: 14288 - DNA, 20 bp, Artificial Sequence
  Synthetic oligonucleotide; TGG chr11 5275253 5275272 5275269 +
gaactgagaagtccttgact

SEQ ID NO: 14289 - DNA, 20 bp, Artificial Sequence
  Synthetic oligonucleotide; CAG chr11 5275281 5275300 5275297 +
ttttttaaattctgaaacaa

SEQ ID NO: 14290 - DNA, 20 bp, Artificial Sequence
  Synthetic oligonucleotide; AAG chr11 5275291 5275310 5275307 +
tctgaaacaacagcaacata

SEQ ID NO: 14291 - DNA, 20 bp, Artificial Sequence
  Synthetic oligonucleotide; AAG chr11 5275296 5275315 5275312 +
aacaacagcaacataaagct

SEQ ID NO: 14292 - DNA, 20 bp, Artificial Sequence
  Synthetic oligonucleotide; AGG chr11 5275297 5275316 5275313 +
acaacagcaacataaagcta

SEQ ID NO: 14293 - DNA, 20 bp, Artificial Sequence
  Synthetic oligonucleotide; CAG chr11 5275328 5275347 5275344 +
ttgcctatgcatgctatctt

SEQ ID NO: 14294 - DNA, 20 bp, Artificial Sequence
  Synthetic oligonucleotide; TAG chr11 5275344 5275363 5275360 +
tcttcagtactttgattatt

SEQ ID NO: 14295 - DNA, 20 bp, Artificial Sequence
  Synthetic oligonucleotide; TAG chr11 5275363 5275382 5275379 +
ttagtattgaaactataaca

SEQ ID NO: 14296 - DNA, 20 bp, Artificial Sequence
  Synthetic oligonucleotide; TGG chr11 5275398 5275417 5275414 +
ataaaaaatgtgtatttctc

SEQ ID NO: 14297 - DNA, 20 bp, Artificial Sequence
  Synthetic oligonucleotide; GAG chr11 5275400 5275419 5275416 +
aaaaaatgtgtatttctctg

SEQ ID NO: 14298 - DNA, 20 bp, Artificial Sequence
  Synthetic oligonucleotide; AAG chr11 5275403 5275422 5275419 +
aaatgtgtatttctctggag

SEQ ID NO: 14299 - DNA, 20 bp, Artificial Sequence
  Synthetic oligonucleotide; AGG chr11 5275404 5275423 5275420 +
aatgtgtatttctctggaga

SEQ ID NO: 14300 - DNA, 20 bp, Artificial Sequence
  Synthetic oligonucleotide; GAG chr11 5275415 5275434 5275431 +
ctctggagaaggttaaaact

SEQ ID NO: 14301 - DNA, 20 bp, Artificial Sequence
  Synthetic oligonucleotide; AGG chr11 5275416 5275435 5275432 +
tctggagaaggttaaaactg

SEQ ID NO: 14302 - DNA, 20 bp, Artificial Sequence
  Synthetic oligonucleotide; TGG chr11 5275421 5275440 5275437 +
agaaggttaaaactgaggat

SEQ ID NO: 14303 - DNA, 20 bp, Artificial Sequence
  Synthetic oligonucleotide; AAG chr11 5275425 5275444 5275441 +
ggttaaaactgaggattggc

SEQ ID NO: 14304 - DNA, 20 bp, Artificial Sequence
  Synthetic oligonucleotide; GAG chr11 5275429 5275448 5275445 +
aaaactgaggattggcaagt

SEQ ID NO: 14305 - DNA, 20 bp, Artificial Sequence
  Synthetic oligonucleotide; AAG chr11 5275433 5275452 5275449 +
ctgaggattggcaagtgagc

SEQ ID NO: 14306 - DNA, 20 bp, Artificial Sequence
  Synthetic oligonucleotide; AGG chr11 5275434 5275453 5275450 +
tgaggattggcaagtgagca

SEQ ID NO: 14307 - DNA, 20 bp, Artificial Sequence
  Synthetic oligonucleotide; TGG chr11 5275443 5275462 5275459 +
gcaagtgagcaaggcttaaa

SEQ ID NO: 14308 - DNA, 20 bp, Artificial Sequence
  Synthetic oligonucleotide; AAG chr11 5275446 5275465 5275462 +
agtgagcaaggcttaaatgg

SEQ ID NO: 14309 - DNA, 20 bp, Artificial Sequence
  Synthetic oligonucleotide; AAG chr11 5275449 5275468 5275465 +
gagcaaggcttaaatggaag

SEQ ID NO: 14310 - DNA, 20 bp, Artificial Sequence
  Synthetic oligonucleotide; CAG chr11 5275464 5275483 5275480 +
ggaagaagcaatgatctcgt

SEQ ID NO: 14311 - DNA, 20 bp, Artificial Sequence
  Synthetic oligonucleotide; GAG chr11 5275482 5275501 5275498 +
gtcagaccaccttcattaac

SEQ ID NO: 14312 - DNA, 20 bp, Artificial Sequence
  Synthetic oligonucleotide; GAG chr11 5275497 5275516 5275513 +
ttaacgagatcatccatcat

SEQ ID NO: 14313 - DNA, 20 bp, Artificial Sequence
  Synthetic oligonucleotide; AGG chr11 5275498 5275517 5275514 +
taacgagatcatccatcatg

SEQ ID NO: 14314 - DNA, 20 bp, Artificial Sequence
  Synthetic oligonucleotide; TGG chr11 5275506 5275525 5275522 +
tcatccatcatgaggaaata

SEQ ID NO: 14315 - DNA, 20 bp, Artificial Sequence
  Synthetic oligonucleotide; CAG chr11 5275514 5275533 5275530 +
catgaggaaatatggaaaac

SEQ ID NO: 14316 - DNA, 20 bp, Artificial Sequence
  Synthetic oligonucleotide; AGG chr11 5275515 5275534 5275531 +
atgaggaaatatggaaaacc

SEQ ID NO: 14317 - DNA, 20 bp, Artificial Sequence
  Synthetic oligonucleotide; AAG chr11 5275539 5275558 5275555 +
cccctctgttttgtgtcact

SEQ ID NO: 14318 - DNA, 20 bp, Artificial Sequence
  Synthetic oligonucleotide; AGG chr11 5275540 5275559 5275556 +
ccctctgttttgtgtcacta

SEQ ID NO: 14319 - DNA, 20 bp, Artificial Sequence
  Synthetic oligonucleotide; GGG chr11 5275541 5275560 5275557 +
cctctgttttgtgtcactaa

SEQ ID NO: 14320 - DNA, 20 bp, Artificial Sequence
  Synthetic oligonucleotide; GAG chr11 5275545 5275564 5275561 +
tgttttgtgtcactaagggt

SEQ ID NO: 14321 - DNA, 20 bp, Artificial Sequence
  Synthetic oligonucleotide; AGG chr11 5275546 5275565 5275562 +
gttttgtgtcactaagggtg

SEQ ID NO: 14322 - DNA, 20 bp, Artificial Sequence
  Synthetic oligonucleotide; CGG chr11 5275573 5275592 5275589 +
tgaatgatttttccctcccc

SEQ ID NO: 14323 - DNA, 20 bp, Artificial Sequence
  Synthetic oligonucleotide; GGG chr11 5275574 5275593 5275590 +
gaatgatttttccctccccc

SEQ ID NO: 14324 - DNA, 20 bp, Artificial Sequence
  Synthetic oligonucleotide; TAG chr11 5275584 5275603 5275600 +
tccctcccccgggcttcttt

SEQ ID NO: 14325 - DNA, 20 bp, Artificial Sequence
  Synthetic oligonucleotide; TAG chr11 5275600 5275619 5275616 +
cttttagccatcaataattc

SEQ ID NO: 14326 - DNA, 20 bp, Artificial Sequence
  Synthetic oligonucleotide; CAG chr11 5275608 5275627 5275624 +
catcaataattctagcccca

SEQ ID NO: 14327 - DNA, 20 bp, Artificial Sequence
  Synthetic oligonucleotide; AGG chr11 5275609 5275628 5275625 +
atcaataattctagccccac

SEQ ID NO: 14328 - DNA, 20 bp, Artificial Sequence
  Synthetic oligonucleotide; GAG chr11 5275611 5275630 5275627 +
caataattctagccccacag

SEQ ID NO: 14329 - DNA, 20 bp, Artificial Sequence
  Synthetic oligonucleotide; AAG chr11 5275624 5275643 5275640 +
cccacaggagtttgttctga

SEQ ID NO: 14330 - DNA, 20 bp, Artificial Sequence
  Synthetic oligonucleotide; AAG chr11 5275644 5275663 5275660 +
aagtaaacttccacaaccgc

SEQ ID NO: 14331 - DNA, 20 bp, Artificial Sequence
  Synthetic oligonucleotide; GAG chr11 5275653 5275672 5275669 +
tccacaaccgcaagcttatt

SEQ ID NO: 14332 - DNA, 20 bp, Artificial Sequence
  Synthetic oligonucleotide; AGG chr11 5275654 5275673 5275670 +
ccacaaccgcaagcttattg

SEQ ID NO: 14333 - DNA, 20 bp, Artificial Sequence
  Synthetic oligonucleotide; AAG chr11 5275659 5275678 5275675 +
accgcaagcttattgaggct

SEQ ID NO: 14334 - DNA, 20 bp, Artificial Sequence
  Synthetic oligonucleotide; AGG chr11 5275660 5275679 5275676 +
ccgcaagcttattgaggcta

SEQ ID NO: 14335 - DNA, 20 bp, Artificial Sequence
  Synthetic oligonucleotide; AAG chr11 5275671 5275690 5275687 +
ttgaggctaaggcatctgtg

SEQ ID NO: 14336 - DNA, 20 bp, Artificial Sequence
  Synthetic oligonucleotide; AGG chr11 5275672 5275691 5275688 +
tgaggctaaggcatctgtga

SEQ ID NO: 14337 - DNA, 20 bp, Artificial Sequence
  Synthetic oligonucleotide; AAG chr11 5275676 5275695 5275692 +
gctaaggcatctgtgaagga

SEQ ID NO: 14338 - DNA, 20 bp, Artificial Sequence
  Synthetic oligonucleotide; TAG chr11 5275707 5275726 5275723 +
cctctaaaccactatgctgc

SEQ ID NO: 14339 - DNA, 20 bp, Artificial Sequence
  Synthetic oligonucleotide; GAG chr11 5275709 5275728 5275725 +
tctaaaccactatgctgcta

SEQ ID NO: 14340 - DNA, 20 bp, Artificial Sequence
  Synthetic oligonucleotide; AAG chr11 5275728 5275747 5275744 +
agagcctcttttctgtactc

SEQ ID NO: 14341 - DNA, 20 bp, Artificial Sequence
  Synthetic oligonucleotide; CAG chr11 5275738 5275757 5275754 +
ttctgtactcaagcctcatt

SEQ ID NO: 14342 - DNA, 20 bp, Artificial Sequence
  Synthetic oligonucleotide; TAG chr11 5275745 5275764 5275761 +
ctcaagcctcattcagacac

SEQ ID NO: 14343 - DNA, 20 bp, Artificial Sequence
  Synthetic oligonucleotide; CAG chr11 5275754 5275773 5275770 +
cattcagacactagtgtcac

SEQ ID NO: 14344 - DNA, 20 bp, Artificial Sequence
  Synthetic oligonucleotide; TGG chr11 5275793 5275812 5275809 +
ttgtattttcttcttcttgc

SEQ ID NO: 14345 - DNA, 20 bp, Artificial Sequence
  Synthetic oligonucleotide; TAG chr11 5275798 5275817 5275814 +
ttttcttcttcttgctggtt

SEQ ID NO: 14346 - DNA, 20 bp, Artificial Sequence
  Synthetic oligonucleotide; TGG chr11 5275811 5275830 5275827 +
gctggtttagtcatgttttc

SEQ ID NO: 14347 - DNA, 20 bp, Artificial Sequence
  Synthetic oligonucleotide; GGG chr11 5275812 5275831 5275828 +
ctggtttagtcatgttttct

SEQ ID NO: 14348 - DNA, 20 bp, Artificial Sequence
  Synthetic oligonucleotide; GAG chr11 5275814 5275833 5275830 +
ggtttagtcatgttttctgg

SEQ ID NO: 14349 - DNA, 20 bp, Artificial Sequence
  Synthetic oligonucleotide; TAG chr11 5275819 5275838 5275835 +
agtcatgttttctgggagct

SEQ ID NO: 14350 - DNA, 20 bp, Artificial Sequence
  Synthetic oligonucleotide; AGG chr11 5275820 5275839 5275836 +
gtcatgttttctgggagctt

SEQ ID NO: 14351 - DNA, 20 bp, Artificial Sequence
  Synthetic oligonucleotide; GGG chr11 5275821 5275840 5275837 +
tcatgttttctgggagctta

SEQ ID NO: 14352 - DNA, 20 bp, Artificial Sequence
  Synthetic oligonucleotide; GGG chr11 5275822 5275841 5275838 +
catgttttctgggagcttag

SEQ ID NO: 14353 - DNA, 20 bp, Artificial Sequence
  Synthetic oligonucleotide; CAG chr11 5275856 5275875 5275872 +
ttgttttgttttctaatcaa

SEQ ID NO: 14354 - DNA, 20 bp, Artificial Sequence
  Synthetic oligonucleotide; GAG chr11 5275858 5275877 5275874 +
gttttgttttctaatcaaca

SEQ ID NO: 14355 - DNA, 20 bp, Artificial Sequence
  Synthetic oligonucleotide; TGG chr11 5275862 5275881 5275878 +
tgttttctaatcaacagaga

SEQ ID NO: 14356 - DNA, 20 bp, Artificial Sequence
  Synthetic oligonucleotide; GGG chr11 5275863 5275882 5275879 +
gttttctaatcaacagagat

SEQ ID NO: 14357 - DNA, 20 bp, Artificial Sequence
  Synthetic oligonucleotide; TAG chr11 5275887 5275906 5275903 +
aaacccattatttttttctt

SEQ ID NO: 14358 - DNA, 20 bp, Artificial Sequence
  Synthetic oligonucleotide; TGG chr11 5275893 5275912 5275909 +
attatttttttctttagact

SEQ ID NO: 14359 - DNA, 20 bp, Artificial Sequence
  Synthetic oligonucleotide; GGG chr11 5275894 5275913 5275910 +
ttatttttttctttagactt

SEQ ID NO: 14360 - DNA, 20 bp, Artificial Sequence
  Synthetic oligonucleotide; TGG chr11 5275898 5275917 5275914 +
ttttttctttagacttggga

SEQ ID NO: 14361 - DNA, 20 bp, Artificial Sequence
  Synthetic oligonucleotide; TAG chr11 5275904 5275923 5275920 +
ctttagacttgggatggtga

SEQ ID NO: 14362 - DNA, 20 bp, Artificial Sequence
  Synthetic oligonucleotide; TGG chr11 5275908 5275927 5275924 +
agacttgggatggtgatagc

SEQ ID NO: 14363 - DNA, 20 bp, Artificial Sequence
  Synthetic oligonucleotide; GGG chr11 5275909 5275928 5275925 +
gacttgggatggtgatagct

SEQ ID NO: 14364 - DNA, 20 bp, Artificial Sequence
  Synthetic oligonucleotide; CAG chr11 5275912 5275931 5275928 +
ttgggatggtgatagctggg

SEQ ID NO: 14365 - DNA, 20 bp, Artificial Sequence
  Synthetic oligonucleotide; CAG chr11 5275918 5275937 5275934 +
tggtgatagctgggcagcgt

SEQ ID NO: 14366 - DNA, 20 bp, Artificial Sequence
  Synthetic oligonucleotide; TGG chr11 5275931 5275950 5275947 +
gcagcgtcagaaactgtgtg

SEQ ID NO: 14367 - DNA, 20 bp, Artificial Sequence
  Synthetic oligonucleotide; TAG chr11 5275937 5275956 5275953 +
tcagaaactgtgtgtggata

SEQ ID NO: 14368 - DNA, 20 bp, Artificial Sequence
  Synthetic oligonucleotide; AAG chr11 5275942 5275961 5275958 +
aactgtgtgtggatatagat

SEQ ID NO: 14369 - DNA, 20 bp, Artificial Sequence
  Synthetic oligonucleotide; GAG chr11 5275944 5275963 5275960 +
ctgtgtgtggatatagataa

SEQ ID NO: 14370 - DNA, 20 bp, Artificial Sequence
  Synthetic oligonucleotide; CAG chr11 5275949 5275968 5275965 +
tgtggatatagataagagct

SEQ ID NO: 14371 - DNA, 20 bp, Artificial Sequence
  Synthetic oligonucleotide; AGG chr11 5275950 5275969 5275966 +
gtggatatagataagagctc

SEQ ID NO: 14372 - DNA, 20 bp, Artificial Sequence
  Synthetic oligonucleotide; GAG chr11 5275961 5275980 5275977 +
taagagctcaggactatgct

SEQ ID NO: 14373 - DNA, 20 bp, Artificial Sequence
  Synthetic oligonucleotide; GAG chr11 5275971 5275990 5275987 +
ggactatgctgagctgtgat

SEQ ID NO: 14374 - DNA, 20 bp, Artificial Sequence
  Synthetic oligonucleotide; AGG chr11 5275972 5275991 5275988 +
gactatgctgagctgtgatg

SEQ ID NO: 14375 - DNA, 20 bp, Artificial Sequence
  Synthetic oligonucleotide; GGG chr11 5275973 5275992 5275989 +
actatgctgagctgtgatga

SEQ ID NO: 14376 - DNA, 20 bp, Artificial Sequence
  Synthetic oligonucleotide; GAG chr11 5275975 5275994 5275991 +
tatgctgagctgtgatgagg

SEQ ID NO: 14377 - DNA, 20 bp, Artificial Sequence
  Synthetic oligonucleotide; AGG chr11 5275976 5275995 5275992 +
atgctgagctgtgatgaggg

SEQ ID NO: 14378 - DNA, 20 bp, Artificial Sequence
  Synthetic oligonucleotide; GGG chr11 5275977 5275996 5275993 +
tgctgagctgtgatgaggga

SEQ ID NO: 14379 - DNA, 20 bp, Artificial Sequence
  Synthetic oligonucleotide; GGG chr11 5275978 5275997 5275994 +
gctgagctgtgatgagggag

SEQ ID NO: 14380 - DNA, 20 bp, Artificial Sequence
  Synthetic oligonucleotide; TAG chr11 5275983 5276002 5275999 +
gctgtgatgagggaggggcc

SEQ ID NO: 14381 - DNA, 20 bp, Artificial Sequence
  Synthetic oligonucleotide; AAG chr11 5275989 5276008 5276005 +
atgagggaggggcctagcta

SEQ ID NO: 14382 - DNA, 20 bp, Artificial Sequence
  Synthetic oligonucleotide; AGG chr11 5275990 5276009 5276006 +
tgagggaggggcctagctaa

SEQ ID NO: 14383 - DNA, 20 bp, Artificial Sequence
  Synthetic oligonucleotide; CAG chr11 5275993 5276012 5276009 +
gggaggggcctagctaaagg

SEQ ID NO: 14384 - DNA, 20 bp, Artificial Sequence
  Synthetic oligonucleotide; GAG chr11 5275997 5276016 5276013 +
ggggcctagctaaaggcagt

SEQ ID NO: 14385 - DNA, 20 bp, Artificial Sequence
  Synthetic oligonucleotide; GAG chr11 5275999 5276018 5276015 +
ggcctagctaaaggcagtga

SEQ ID NO: 14386 - DNA, 20 bp, Artificial Sequence
  Synthetic oligonucleotide; CAG chr11 5276003 5276022 5276019 +
tagctaaaggcagtgagagt

SEQ ID NO: 14387 - DNA, 20 bp, Artificial Sequence
  Synthetic oligonucleotide; CAG chr11 5276028 5276047 5276044 +
tgctcctgctattgccttct

SEQ ID NO: 14388 - DNA, 20 bp, Artificial Sequence
  Synthetic oligonucleotide; TGG chr11 5276041 5276060 5276057 +
gccttctcagtccccacgct

SEQ ID NO: 14389 - DNA, 20 bp, Artificial Sequence
  Synthetic oligonucleotide; AAG chr11 5276053 5276072 5276069 +
cccacgcttggtttctacac

SEQ ID NO: 14390 - DNA, 20 bp, Artificial Sequence
  Synthetic oligonucleotide; TAG chr11 5276056 5276075 5276072 +
acgcttggtttctacacaag

SEQ ID NO: 14391 - DNA, 20 bp, Artificial Sequence
  Synthetic oligonucleotide; TAG chr11 5276064 5276083 5276080 +
tttctacacaagtagataca

SEQ ID NO: 14392 - DNA, 20 bp, Artificial Sequence
  Synthetic oligonucleotide; AAG chr11 5276069 5276088 5276085 +
acacaagtagatacatagaa

SEQ ID NO: 14393 - DNA, 20 bp, Artificial Sequence
  Synthetic oligonucleotide; AGG chr11 5276070 5276089 5276086 +
cacaagtagatacatagaaa

SEQ ID NO: 14394 - DNA, 20 bp, Artificial Sequence
  Synthetic oligonucleotide; TAG chr11 5276076 5276095 5276092 +
tagatacatagaaaaggcta

SEQ ID NO: 14395 - DNA, 20 bp, Artificial Sequence
  Synthetic oligonucleotide; AGG chr11 5276077 5276096 5276093 +
agatacatagaaaaggctat

SEQ ID NO: 14396 - DNA, 20 bp, Artificial Sequence
  Synthetic oligonucleotide; TAG chr11 5276081 5276100 5276097 +
acatagaaaaggctataggt

SEQ ID NO: 14397 - DNA, 20 bp, Artificial Sequence
  Synthetic oligonucleotide; GAG chr11 5276089 5276108 5276105 +
aaggctataggttagtgttt

SEQ ID NO: 14398 - DNA, 20 bp, Artificial Sequence
  Synthetic oligonucleotide; GAG chr11 5276091 5276110 5276107 +
ggctataggttagtgtttga

SEQ ID NO: 14399 - DNA, 20 bp, Artificial Sequence
  Synthetic oligonucleotide; TAG chr11 5276105 5276124 5276121 +
gtttgagagtcctgcatgat

SEQ ID NO: 14400 - DNA, 20 bp, Artificial Sequence
  Synthetic oligonucleotide; CAG chr11 5276113 5276132 5276129 +
gtcctgcatgattagttgct

SEQ ID NO: 14401 - DNA, 20 bp, Artificial Sequence
  Synthetic oligonucleotide; GAG chr11 5276235 5276254 5276251 +
tgtgattatcatcaaaacgt

SEQ ID NO: 14402 - DNA, 20 bp, Artificial Sequence
  Synthetic oligonucleotide; AGG chr11 5276236 5276255 5276252 +
gtgattatcatcaaaacgtg

SEQ ID NO: 14403 - DNA, 20 bp, Artificial Sequence
  Synthetic oligonucleotide; GGG chr11 5276237 5276256 5276253 +
tgattatcatcaaaacgtga

SEQ ID NO: 14404 - DNA, 20 bp, Artificial Sequence
  Synthetic oligonucleotide; AAG chr11 5276243 5276262 5276259 +
tcatcaaaacgtgagggcta

SEQ ID NO: 14405 - DNA, 20 bp, Artificial Sequence
  Synthetic oligonucleotide; CAG chr11 5276250 5276269 5276266 +
aacgtgagggctaaagtgac

SEQ ID NO: 14406 - DNA, 20 bp, Artificial Sequence
  Synthetic oligonucleotide; AAG chr11 5276262 5276281 5276278 +
aaagtgaccagataacttgc

SEQ ID NO: 14407 - DNA, 20 bp, Artificial Sequence
  Synthetic oligonucleotide; TAG chr11 5276268 5276287 5276284 +
accagataacttgcaagtcc

SEQ ID NO: 14408 - DNA, 20 bp, Artificial Sequence
  Synthetic oligonucleotide; AGG chr11 5276269 5276288 5276285 +
ccagataacttgcaagtcct

SEQ ID NO: 14409 - DNA, 20 bp, Artificial Sequence
  Synthetic oligonucleotide; CAG chr11 5276276 5276295 5276292 +
acttgcaagtcctaggatac

SEQ ID NO: 14410 - DNA, 20 bp, Artificial Sequence
  Synthetic oligonucleotide; AGG chr11 5276277 5276296 5276293 +
cttgcaagtcctaggatacc

SEQ ID NO: 14411 - DNA, 20 bp, Artificial Sequence
  Synthetic oligonucleotide; GAG chr11 5276309 5276328 5276325 +
tacattccaaaaatttaact

SEQ ID NO: 14412 - DNA, 20 bp, Artificial Sequence
  Synthetic oligonucleotide; CAG chr11 5276344 5276363 5276360 +
aaaaaaaaacaaaaaaaaac

SEQ ID NO: 14413 - DNA, 20 bp, Artificial Sequence
  Synthetic oligonucleotide; TGG chr11 5276354 5276373 5276370 +
aaaaaaaaaccagtgatcca

SEQ ID NO: 14414 - DNA, 20 bp, Artificial Sequence
  Synthetic oligonucleotide; CAG chr11 5276360 5276379 5276376 +
aaaccagtgatccatggaca

SEQ ID NO: 14415 - DNA, 20 bp, Artificial Sequence
  Synthetic oligonucleotide; AGG chr11 5276361 5276380 5276377 +
aaccagtgatccatggacac

SEQ ID NO: 14416 - DNA, 20 bp, Artificial Sequence
  Synthetic oligonucleotide; GGG chr11 5276362 5276381 5276378 +
accagtgatccatggacaca

SEQ ID NO: 14417 - DNA, 20 bp, Artificial Sequence
  Synthetic oligonucleotide; GAG chr11 5276364 5276383 5276380 +
cagtgatccatggacacagg

SEQ ID NO: 14418 - DNA, 20 bp, Artificial Sequence
  Synthetic oligonucleotide; AGG chr11 5276365 5276384 5276381 +
agtgatccatggacacaggg

SEQ ID NO: 14419 - DNA, 20 bp, Artificial Sequence
  Synthetic oligonucleotide; GGG chr11 5276366 5276385 5276382 +
gtgatccatggacacaggga

SEQ ID NO: 14420 - DNA, 20 bp, Artificial Sequence
  Synthetic oligonucleotide; GGG chr11 5276367 5276386 5276383 +
tgatccatggacacagggag

SEQ ID NO: 14421 - DNA, 20 bp, Artificial Sequence
  Synthetic oligonucleotide; TGG chr11 5276382 5276401 5276398 +
gggaggggaacatcacacac

SEQ ID NO: 14422 - DNA, 20 bp, Artificial Sequence
  Synthetic oligonucleotide; GGG chr11 5276383 5276402 5276399 +
ggaggggaacatcacacact

SEQ ID NO: 14423 - DNA, 20 bp, Artificial Sequence
  Synthetic oligonucleotide; GGG chr11 5276384 5276403 5276400 +
gaggggaacatcacacactg

SEQ ID NO: 14424 - DNA, 20 bp, Artificial Sequence
  Synthetic oligonucleotide; TGG chr11 5276392 5276411 5276408 +
catcacacactggggcctgt

SEQ ID NO: 14425 - DNA, 20 bp, Artificial Sequence
  Synthetic oligonucleotide; GGG chr11 5276393 5276412 5276409 +
atcacacactggggcctgtt

SEQ ID NO: 14426 - DNA, 20 bp, Artificial Sequence
  Synthetic oligonucleotide; GGG chr11 5276394 5276413 5276410 +
tcacacactggggcctgttg

SEQ ID NO: 14427 - DNA, 20 bp, Artificial Sequence
  Synthetic oligonucleotide; GGG chr11 5276395 5276414 5276411 +
cacacactggggcctgttgg

SEQ ID NO: 14428 - DNA, 20 bp, Artificial Sequence
  Synthetic oligonucleotide; TGG chr11 5276398 5276417 5276414 +
acactggggcctgttggggg

SEQ ID NO: 14429 - DNA, 20 bp, Artificial Sequence
  Synthetic oligonucleotide; GGG chr11 5276399 5276418 5276415 +
cactggggcctgttgggggt

SEQ ID NO: 14430 - DNA, 20 bp, Artificial Sequence
  Synthetic oligonucleotide; GGG chr11 5276400 5276419 5276416 +
actggggcctgttgggggtg

SEQ ID NO: 14431 - DNA, 20 bp, Artificial Sequence
  Synthetic oligonucleotide; GGG chr11 5276401 5276420 5276417 +
ctggggcctgttgggggtgg

SEQ ID NO: 14432 - DNA, 20 bp, Artificial Sequence
  Synthetic oligonucleotide; GGG chr11 5276402 5276421 5276418 +
tggggcctgttgggggtggg

SEQ ID NO: 14433 - DNA, 20 bp, Artificial Sequence
  Synthetic oligonucleotide; TAG chr11 5276406 5276425 5276422 +
gcctgttgggggtggggggc

SEQ ID NO: 14434 - DNA, 20 bp, Artificial Sequence
  Synthetic oligonucleotide; AGG chr11 5276407 5276426 5276423 +
cctgttgggggtggggggct

SEQ ID NO: 14435 - DNA, 20 bp, Artificial Sequence
  Synthetic oligonucleotide; GGG chr11 5276408 5276427 5276424 +
ctgttgggggtggggggcta

SEQ ID NO: 14436 - DNA, 20 bp, Artificial Sequence
  Synthetic oligonucleotide; GGG chr11 5276409 5276428 5276425 +
tgttgggggtggggggctag

SEQ ID NO: 14437 - DNA, 20 bp, Artificial Sequence
  Synthetic oligonucleotide; AAG chr11 5276412 5276431 5276428 +
tgggggtggggggctagggg

SEQ ID NO: 14438 - DNA, 20 bp, Artificial Sequence
  Synthetic oligonucleotide; AGG chr11 5276413 5276432 5276429 +
gggggtggggggctagggga

SEQ ID NO: 14439 - DNA, 20 bp, Artificial Sequence
  Synthetic oligonucleotide; TAG chr11 5276417 5276436 5276433 +
gtggggggctaggggaagga

SEQ ID NO: 14440 - DNA, 20 bp, Artificial Sequence
  Synthetic oligonucleotide; TAG chr11 5276423 5276442 5276439 +
ggctaggggaaggatagcat

SEQ ID NO: 14441 - DNA, 20 bp, Artificial Sequence
  Synthetic oligonucleotide; AGG chr11 5276424 5276443 5276440 +
gctaggggaaggatagcatt

SEQ ID NO: 14442 - DNA, 20 bp, Artificial Sequence
  Synthetic oligonucleotide; GAG chr11 5276426 5276445 5276442 +
taggggaaggatagcattag

SEQ ID NO: 14443 - DNA, 20 bp, Artificial Sequence
  Synthetic oligonucleotide; TAG chr11 5276441 5276460 5276457 +
attaggagaaatacctaatg

SEQ ID NO: 14444 - DNA, 20 bp, Artificial Sequence
  Synthetic oligonucleotide; CGG chr11 5276448 5276467 5276464 +
gaaatacctaatgtagatga

SEQ ID NO: 14445 - DNA, 20 bp, Artificial Sequence
  Synthetic oligonucleotide; GGG chr11 5276449 5276468 5276465 +
aaatacctaatgtagatgac

SEQ ID NO: 14446 - DNA, 20 bp, Artificial Sequence
  Synthetic oligonucleotide; TGG chr11 5276456 5276475 5276472 +
taatgtagatgacgggttga

SEQ ID NO: 14447 - DNA, 20 bp, Artificial Sequence
  Synthetic oligonucleotide; GGG chr11 5276457 5276476 5276473 +
aatgtagatgacgggttgat

SEQ ID NO: 14448 - DNA, 20 bp, Artificial Sequence
  Synthetic oligonucleotide; CAG chr11 5276462 5276481 5276478 +
agatgacgggttgatgggtg

SEQ ID NO: 14449 - DNA, 20 bp, Artificial Sequence
  Synthetic oligonucleotide; TGG chr11 5276475 5276494 5276491 +
atgggtgcagcaaaccacca

SEQ ID NO: 14450 - DNA, 20 bp, Artificial Sequence
  Synthetic oligonucleotide; CAG chr11 5276489 5276508 5276505 +
ccaccatggcacatgtaccc

SEQ ID NO: 14451 - DNA, 20 bp, Artificial Sequence
  Synthetic oligonucleotide; AAG chr11 5276498 5276517 5276514 +
cacatgtaccccagaactta

SEQ ID NO: 14452 - DNA, 20 bp, Artificial Sequence
  Synthetic oligonucleotide; CAG chr11 5276514 5276533 5276530 +
cttaaagcatattaaaaaaa

SEQ ID NO: 14453 - DNA, 20 bp, Artificial Sequence
  Synthetic oligonucleotide; AAG chr11 5276526 5276545 5276542 +
taaaaaaacagtgatcataa

SEQ ID NO: 14454 - DNA, 20 bp, Artificial Sequence
  Synthetic oligonucleotide; AAG chr11 5276529 5276548 5276545 +
aaaaacagtgatcataaaag

SEQ ID NO: 14455 - DNA, 20 bp, Artificial Sequence
  Synthetic oligonucleotide; AAG chr11 5276547 5276566 5276563 +
agaagctcaaatttaactat

SEQ ID NO: 14456 - DNA, 20 bp, Artificial Sequence
  Synthetic oligonucleotide; GAG chr11 5276549 5276568 5276565 +
aagctcaaatttaactataa

SEQ ID NO: 14457 - DNA, 20 bp, Artificial Sequence
  Synthetic oligonucleotide; CGG chr11 5276553 5276572 5276569 +
tcaaatttaactataagaga

SEQ ID NO: 14458 - DNA, 20 bp, Artificial Sequence
  Synthetic oligonucleotide; TGG chr11 5276558 5276577 5276574 +
tttaactataagagacggaa

SEQ ID NO: 14459 - DNA, 20 bp, Artificial Sequence
  Synthetic oligonucleotide; CAG chr11 5276588 5276607 5276604 +
aattcttaactataatctta

SEQ ID NO: 14460 - DNA, 20 bp, Artificial Sequence
  Synthetic oligonucleotide; TAG chr11 5276606 5276625 5276622 +
tacagaatattctcattgaa

SEQ ID NO: 14461 - DNA, 20 bp, Artificial Sequence
  Synthetic oligonucleotide; AAG chr11 5276609 5276628 5276625 +
agaatattctcattgaatag

SEQ ID NO: 14462 - DNA, 20 bp, Artificial Sequence
  Synthetic oligonucleotide; TAG chr11 5276624 5276643 5276640 +
aatagaagtatgcttatcat

SEQ ID NO: 14463 - DNA, 20 bp, Artificial Sequence
  Synthetic oligonucleotide; GAG chr11 5276626 5276645 5276642 +
tagaagtatgcttatcatta

SEQ ID NO: 14464 - DNA, 20 bp, Artificial Sequence
  Synthetic oligonucleotide; TGG chr11 5276632 5276651 5276648 +
tatgcttatcattagagatt

SEQ ID NO: 14465 - DNA, 20 bp, Artificial Sequence
  Synthetic oligonucleotide; CAG chr11 5276636 5276655 5276652 +
cttatcattagagatttgga

SEQ ID NO: 14466 - DNA, 20 bp, Artificial Sequence
  Synthetic oligonucleotide; CAG chr11 5276640 5276659 5276656 +
tcattagagatttggacagc

SEQ ID NO: 14467 - DNA, 20 bp, Artificial Sequence
  Synthetic oligonucleotide; AGG chr11 5276641 5276660 5276657 +
cattagagatttggacagcc

SEQ ID NO: 14468 - DNA, 20 bp, Artificial Sequence
  Synthetic oligonucleotide; AAG chr11 5276645 5276664 5276661 +
agagatttggacagccagga

SEQ ID NO: 14469 - DNA, 20 bp, Artificial Sequence
  Synthetic oligonucleotide; CAG chr11 5276650 5276669 5276666 +
tttggacagccaggaaagca

SEQ ID NO: 14470 - DNA, 20 bp, Artificial Sequence
  Synthetic oligonucleotide; AAG chr11 5276663 5276682 5276679 +
gaaagcacagaaaaaaaaaa

SEQ ID NO: 14471 - DNA, 20 bp, Artificial Sequence
  Synthetic oligonucleotide; AGG chr11 5276664 5276683 5276680 +
aaagcacagaaaaaaaaaaa

SEQ ID NO: 14472 - DNA, 20 bp, Artificial Sequence
  Synthetic oligonucleotide; GAG chr11 5276666 5276685 5276682 +
agcacagaaaaaaaaaaaag

SEQ ID NO: 14473 - DNA, 20 bp, Artificial Sequence
  Synthetic oligonucleotide; TAG chr11 5276682 5276701 5276698 +
aaaggagctctgttgcctta

SEQ ID NO: 14474 - DNA, 20 bp, Artificial Sequence
  Synthetic oligonucleotide; TAG chr11 5276687 5276706 5276703 +
agctctgttgccttatagcc

SEQ ID NO: 14475 - DNA, 20 bp, Artificial Sequence
  Synthetic oligonucleotide; GAG chr11 5276689 5276708 5276705 +
ctctgttgccttatagccta

SEQ ID NO: 14476 - DNA, 20 bp, Artificial Sequence
  Synthetic oligonucleotide; AGG chr11 5276690 5276709 5276706 +
tctgttgccttatagcctag

SEQ ID NO: 14477 - DNA, 20 bp, Artificial Sequence
  Synthetic oligonucleotide; CAG chr11 5276722 5276741 5276738 +
cctcacataacactgatgtc

SEQ ID NO: 14478 - DNA, 20 bp, Artificial Sequence
  Synthetic oligonucleotide; AGG chr11 5276723 5276742 5276739 +
ctcacataacactgatgtcc

SEQ ID NO: 14479 - DNA, 20 bp, Artificial Sequence
  Synthetic oligonucleotide; AAG chr11 5276728 5276747 5276744 +
ataacactgatgtccaggcc

SEQ ID NO: 14480 - DNA, 20 bp, Artificial Sequence
  Synthetic oligonucleotide; AGG chr11 5276729 5276748 5276745 +
taacactgatgtccaggcca

SEQ ID NO: 14481 - DNA, 20 bp, Artificial Sequence
  Synthetic oligonucleotide; AAG chr11 5276746 5276765 5276762 +
ccaaggccatccttcccatg

SEQ ID NO: 14482 - DNA, 20 bp, Artificial Sequence
  Synthetic oligonucleotide; TGG chr11 5276750 5276769 5276766 +
ggccatccttcccatgaaga

SEQ ID NO: 14483 - DNA, 20 bp, Artificial Sequence
  Synthetic oligonucleotide; AAG chr11 5276759 5276778 5276775 +
tcccatgaagatggatgaat

SEQ ID NO: 14484 - DNA, 20 bp, Artificial Sequence
  Synthetic oligonucleotide; TAG chr11 5276795 5276814 5276811 +
ctatgaaataatgtttactt

SEQ ID NO: 14485 - DNA, 20 bp, Artificial Sequence
  Synthetic oligonucleotide; TGG chr11 5276798 5276817 5276814 +
tgaaataatgtttactttag

SEQ ID NO: 14486 - DNA, 20 bp, Artificial Sequence
  Synthetic oligonucleotide; TAG chr11 5276811 5276830 5276827 +
actttagtggcatattgcat

SEQ ID NO: 14487 - DNA, 20 bp, Artificial Sequence
  Synthetic oligonucleotide; AGG chr11 5276812 5276831 5276828 +
ctttagtggcatattgcatt

SEQ ID NO: 14488 - DNA, 20 bp, Artificial Sequence
  Synthetic oligonucleotide; TGG chr11 5276825 5276844 5276841 +
ttgcattaggctacctgcct

SEQ ID NO: 14489 - DNA, 20 bp, Artificial Sequence
  Synthetic oligonucleotide; CAG chr11 5276830 5276849 5276846 +
ttaggctacctgccttggca

SEQ ID NO: 14490 - DNA, 20 bp, Artificial Sequence
  Synthetic oligonucleotide; GAG chr11 5276886 5276905 5276902 +
ttaattgcttacataaacat

SEQ ID NO: 14491 - DNA, 20 bp, Artificial Sequence
  Synthetic oligonucleotide; TAG chr11 5276894 5276913 5276910 +
ttacataaacatgagtgctc

SEQ ID NO: 14492 - DNA, 20 bp, Artificial Sequence
  Synthetic oligonucleotide; CAG chr11 5276907 5276926 5276923 +
agtgctctagttataaattc

SEQ ID NO: 14493 - DNA, 20 bp, Artificial Sequence
  Synthetic oligonucleotide; TGG chr11 5276924 5276943 5276940 +
ttccagtgtaaaaaacaccc

SEQ ID NO: 14494 - DNA, 20 bp, Artificial Sequence
  Synthetic oligonucleotide; GAG chr11 5276945 5276964 5276961 +
ggtttcgatattcatctttt

SEQ ID NO: 14495 - DNA, 20 bp, Artificial Sequence
  Synthetic oligonucleotide; TGG chr11 5276958 5276977 5276974 +
atcttttgagccttttattt

SEQ ID NO: 14496 - DNA, 20 bp, Artificial Sequence
  Synthetic oligonucleotide; CAG chr11 5276962 5276981 5276978 +
tttgagccttttattttggt

SEQ ID NO: 14497 - DNA, 20 bp, Artificial Sequence
  Synthetic oligonucleotide; AAG chr11 5276968 5276987 5276984 +
ccttttattttggtcagaac

SEQ ID NO: 14498 - DNA, 20 bp, Artificial Sequence
  Synthetic oligonucleotide; AAG chr11 5276976 5276995 5276992 +
tttggtcagaacaagttttc

SEQ ID NO: 14499 - DNA, 20 bp, Artificial Sequence
  Synthetic oligonucleotide; GAG chr11 5276978 5276997 5276994 +
tggtcagaacaagttttcaa

SEQ ID NO: 14500 - DNA, 20 bp, Artificial Sequence
  Synthetic oligonucleotide; CAG chr11 5276988 5277007 5277004 +
aagttttcaagagcaaatct

SEQ ID NO: 14501 - DNA, 20 bp, Artificial Sequence
  Synthetic oligonucleotide; GAG chr11 5277005 5277024 5277021 +
tctcagcctacaaaacaaat

SEQ ID NO: 14502 - DNA, 20 bp, Artificial Sequence
  Synthetic oligonucleotide; TAG chr11 5277016 5277035 5277032 +
aaaacaaatgagtccaattc

SEQ ID NO: 14503 - DNA, 20 bp, Artificial Sequence
  Synthetic oligonucleotide; CAG chr11 5277023 5277042 5277039 +
atgagtccaattctagaact

SEQ ID NO: 14504 - DNA, 20 bp, Artificial Sequence
  Synthetic oligonucleotide; AAG chr11 5277036 5277055 5277052 +
tagaactcagtaatcccatc

SEQ ID NO: 14505 - DNA, 20 bp, Artificial Sequence
  Synthetic oligonucleotide; AGG chr11 5277037 5277056 5277053 +
agaactcagtaatcccatca

SEQ ID NO: 14506 - DNA, 20 bp, Artificial Sequence
  Synthetic oligonucleotide; CGG chr11 5277049 5277068 5277065 +
tcccatcaaggctctgcctg

SEQ ID NO: 14507 - DNA, 20 bp, Artificial Sequence
  Synthetic oligonucleotide; GAG chr11 5277051 5277070 5277067 +
ccatcaaggctctgcctgcg

SEQ ID NO: 14508 - DNA, 20 bp, Artificial Sequence
  Synthetic oligonucleotide; AGG chr11 5277052 5277071 5277068 +
catcaaggctctgcctgcgg

SEQ ID NO: 14509 - DNA, 20 bp, Artificial Sequence
  Synthetic oligonucleotide; GGG chr11 5277053 5277072 5277069 +
atcaaggctctgcctgcgga

SEQ ID NO: 14510 - DNA, 20 bp, Artificial Sequence
  Synthetic oligonucleotide; TAG chr11 5277061 5277080 5277077 +
tctgcctgcggagggctaac

SEQ ID NO: 14511 - DNA, 20 bp, Artificial Sequence
  Synthetic oligonucleotide; CAG chr11 5277071 5277090 5277087 +
gagggctaactagctctatg

SEQ ID NO: 14512 - DNA, 20 bp, Artificial Sequence
  Synthetic oligonucleotide; AGG chr11 5277072 5277091 5277088 +
agggctaactagctctatgc

SEQ ID NO: 14513 - DNA, 20 bp, Artificial Sequence
  Synthetic oligonucleotide; TAG chr11 5277077 5277096 5277093 +
taactagctctatgcaggct

SEQ ID NO: 14514 - DNA, 20 bp, Artificial Sequence
  Synthetic oligonucleotide; CAG chr11 5277086 5277105 5277102 +
ctatgcaggcttagcacttc

SEQ ID NO: 14515 - DNA, 20 bp, Artificial Sequence
  Synthetic oligonucleotide; TAG chr11 5277119 5277138 5277135 +
ctgatttctttgtgtgtgca

SEQ ID NO: 14516 - DNA, 20 bp, Artificial Sequence
  Synthetic oligonucleotide; CAG chr11 5277122 5277141 5277138 +
atttctttgtgtgtgcatag

SEQ ID NO: 14517 - DNA, 20 bp, Artificial Sequence
  Synthetic oligonucleotide; TGG chr11 5277125 5277144 5277141 +
tctttgtgtgtgcatagcag

SEQ ID NO: 14518 - DNA, 20 bp, Artificial Sequence
  Synthetic oligonucleotide; CAG chr11 5277134 5277153 5277150 +
gtgcatagcagtggatgtgt

SEQ ID NO: 14519 - DNA, 20 bp, Artificial Sequence
  Synthetic oligonucleotide; TAG chr11 5277155 5277174 5277171 +
agcatacatccttttaatta

SEQ ID NO: 14520 - DNA, 20 bp, Artificial Sequence
  Synthetic oligonucleotide; AAG chr11 5277209 5277228 5277225 +
ttcaaaattgtaaaattgct

SEQ ID NO: 14521 - DNA, 20 bp, Artificial Sequence
  Synthetic oligonucleotide; CAG chr11 5277216 5277235 5277232 +
ttgtaaaattgctaagaata

SEQ ID NO: 14522 - DNA, 20 bp, Artificial Sequence
  Synthetic oligonucleotide; CAG chr11 5277227 5277246 5277243 +
ctaagaatacagcacaaaaa

SEQ ID NO: 14523 - DNA, 20 bp, Artificial Sequence
  Synthetic oligonucleotide; TAG chr11 5277232 5277251 5277248 +
aatacagcacaaaaacagaa

SEQ ID NO: 14524 - DNA, 20 bp, Artificial Sequence
  Synthetic oligonucleotide; GAG chr11 5277234 5277253 5277250 +
tacagcacaaaaacagaata

SEQ ID NO: 14525 - DNA, 20 bp, Artificial Sequence
  Synthetic oligonucleotide; AGG chr11 5277235 5277254 5277251 +
acagcacaaaaacagaatag

SEQ ID NO: 14526 - DNA, 20 bp, Artificial Sequence
  Synthetic oligonucleotide; AAG chr11 5277242 5277261 5277258 +
aaaaacagaatagaggaata

SEQ ID NO: 14527 - DNA, 20 bp, Artificial Sequence
  Synthetic oligonucleotide; TGG chr11 5277257 5277276 5277273 +
gaataaagttcctgttttca

SEQ ID NO: 14528 - DNA, 20 bp, Artificial Sequence
  Synthetic oligonucleotide; TAG chr11 5277266 5277285 5277282 +
tcctgttttcatggacttga

SEQ ID NO: 14529 - DNA, 20 bp, Artificial Sequence
  Synthetic oligonucleotide; TGG chr11 5277269 5277288 5277285 +
tgttttcatggacttgatag

SEQ ID NO: 14530 - DNA, 20 bp, Artificial Sequence
  Synthetic oligonucleotide; AAG chr11 5277273 5277292 5277289 +
ttcatggacttgatagtgga

SEQ ID NO: 14531 - DNA, 20 bp, Artificial Sequence
  Synthetic oligonucleotide; GAG chr11 5277275 5277294 5277291 +
catggacttgatagtggaaa

SEQ ID NO: 14532 - DNA, 20 bp, Artificial Sequence
  Synthetic oligonucleotide; AAG chr11 5277291 5277310 5277307 +
gaaagagcttgacattaaat

SEQ ID NO: 14533 - DNA, 20 bp, Artificial Sequence
  Synthetic oligonucleotide; GAG chr11 5277319 5277338 5277335 +
gaaacatgttatataccaat

SEQ ID NO: 14534 - DNA, 20 bp, Artificial Sequence
  Synthetic oligonucleotide; TAG chr11 5277324 5277343 5277340 +
atgttatataccaatgagat

SEQ ID NO: 14535 - DNA, 20 bp, Artificial Sequence
  Synthetic oligonucleotide; AGG chr11 5277325 5277344 5277341 +
tgttatataccaatgagatt

SEQ ID NO: 14536 - DNA, 20 bp, Artificial Sequence
  Synthetic oligonucleotide; TGG chr11 5277333 5277352 5277349 +
accaatgagattaggtgcta

SEQ ID NO: 14537 - DNA, 20 bp, Artificial Sequence
  Synthetic oligonucleotide; GAG chr11 5277335 5277354 5277351 +
caatgagattaggtgctatg

SEQ ID NO: 14538 - DNA, 20 bp, Artificial Sequence
  Synthetic oligonucleotide; AAG chr11 5277358 5277377 5277374 +
aaaaaaaaaaaactgaaatg

SEQ ID NO: 14539 - DNA, 20 bp, Artificial Sequence
  Synthetic oligonucleotide; AGG chr11 5277359 5277378 5277375 +
aaaaaaaaaaactgaaatga

SEQ ID NO: 14540 - DNA, 20 bp, Artificial Sequence
  Synthetic oligonucleotide; CAG chr11 5277363 5277382 5277379 +
aaaaaaactgaaatgaaggc

SEQ ID NO: 14541 - DNA, 20 bp, Artificial Sequence
  Synthetic oligonucleotide; GAG chr11 5277365 5277384 5277381 +
aaaaactgaaatgaaggcca

SEQ ID NO: 14542 - DNA, 20 bp, Artificial Sequence
  Synthetic oligonucleotide; TAG chr11 5277374 5277393 5277390 +
aatgaaggccagagtgtgat

SEQ ID NO: 14543 - DNA, 20 bp, Artificial Sequence
  Synthetic oligonucleotide; AGG chr11 5277375 5277394 5277391 +
atgaaggccagagtgtgatt

SEQ ID NO: 14544 - DNA, 20 bp, Artificial Sequence
  Synthetic oligonucleotide; CAG chr11 5277379 5277398 5277395 +
aggccagagtgtgattagga

SEQ ID NO: 14545 - DNA, 20 bp, Artificial Sequence
  Synthetic oligonucleotide; AGG chr11 5277380 5277399 5277396 +
ggccagagtgtgattaggac

SEQ ID NO: 14546 - DNA, 20 bp, Artificial Sequence
  Synthetic oligonucleotide; GGG chr11 5277381 5277400 5277397 +
gccagagtgtgattaggaca

SEQ ID NO: 14547 - DNA, 20 bp, Artificial Sequence
  Synthetic oligonucleotide; AAG chr11 5277387 5277406 5277403 +
gtgtgattaggacagggtga

SEQ ID NO: 14548 - DNA, 20 bp, Artificial Sequence
  Synthetic oligonucleotide; AGG chr11 5277388 5277407 5277404 +
tgtgattaggacagggtgaa

SEQ ID NO: 14549 - DNA, 20 bp, Artificial Sequence
  Synthetic oligonucleotide; GGG chr11 5277389 5277408 5277405 +
gtgattaggacagggtgaaa

SEQ ID NO: 14550 - DNA, 20 bp, Artificial Sequence
  Synthetic oligonucleotide; AAG chr11 5277404 5277423 5277420 +
tgaaagggtatcgctacttt

SEQ ID NO: 14551 - DNA, 20 bp, Artificial Sequence
  Synthetic oligonucleotide; TAG chr11 5277407 5277426 5277423 +
aagggtatcgctactttaag

SEQ ID NO: 14552 - DNA, 20 bp, Artificial Sequence
  Synthetic oligonucleotide; TGG chr11 5277412 5277431 5277428 +
tatcgctactttaagtagta

SEQ ID NO: 14553 - DNA, 20 bp, Artificial Sequence
  Synthetic oligonucleotide; CAG chr11 5277415 5277434 5277431 +
cgctactttaagtagtatgg

SEQ ID NO: 14554 - DNA, 20 bp, Artificial Sequence
  Synthetic oligonucleotide; AGG chr11 5277416 5277435 5277432 +
gctactttaagtagtatggc

SEQ ID NO: 14555 - DNA, 20 bp, Artificial Sequence
  Synthetic oligonucleotide; AAG chr11 5277420 5277439 5277436 +
ctttaagtagtatggcagga

SEQ ID NO: 14556 - DNA, 20 bp, Artificial Sequence
  Synthetic oligonucleotide; AAG chr11 5277434 5277453 5277450 +
gcaggaaagtcctcactata

SEQ ID NO: 14557 - DNA, 20 bp, Artificial Sequence
  Synthetic oligonucleotide; GAG chr11 5277446 5277465 5277462 +
tcactataaagttaacacct

SEQ ID NO: 14558 - DNA, 20 bp, Artificial Sequence
  Synthetic oligonucleotide; GAG chr11 5277448 5277467 5277464 +
actataaagttaacacctga

SEQ ID NO: 14559 - DNA, 20 bp, Artificial Sequence
  Synthetic oligonucleotide; GAG chr11 5277450 5277469 5277466 +
tataaagttaacacctgaga

SEQ ID NO: 14560 - DNA, 20 bp, Artificial Sequence
  Synthetic oligonucleotide; TAG chr11 5277459 5277478 5277475 +
aacacctgagagagtaccca

SEQ ID NO: 14561 - DNA, 20 bp, Artificial Sequence
  Synthetic oligonucleotide; GAG chr11 5277467 5277486 5277483 +
agagagtacccatagatgat

SEQ ID NO: 14562 - DNA, 20 bp, Artificial Sequence
  Synthetic oligonucleotide; AGG chr11 5277468 5277487 5277484 +
gagagtacccatagatgatg

SEQ ID NO: 14563 - DNA, 20 bp, Artificial Sequence
  Synthetic oligonucleotide; TAG chr11 5277503 5277522 5277519 +
tgaaactatgattaaatatt

SEQ ID NO: 14564 - DNA, 20 bp, Artificial Sequence
  Synthetic oligonucleotide; AGG chr11 5277504 5277523 5277520 +
gaaactatgattaaatattt

SEQ ID NO: 14565 - DNA, 20 bp, Artificial Sequence
  Synthetic oligonucleotide; GGG chr11 5277505 5277524 5277521 +
aaactatgattaaatattta

SEQ ID NO: 14566 - DNA, 20 bp, Artificial Sequence
  Synthetic oligonucleotide; TAG chr11 5277510 5277529 5277526 +
atgattaaatatttagggca

SEQ ID NO: 14567 - DNA, 20 bp, Artificial Sequence
  Synthetic oligonucleotide; AGG chr11 5277511 5277530 5277527 +
tgattaaatatttagggcat

SEQ ID NO: 14568 - DNA, 20 bp, Artificial Sequence
  Synthetic oligonucleotide; GGG chr11 5277512 5277531 5277528 +
gattaaatatttagggcata

SEQ ID NO: 14569 - DNA, 20 bp, Artificial Sequence
  Synthetic oligonucleotide; TGG chr11 5277517 5277536 5277533 +
aatatttagggcatagggaa

SEQ ID NO: 14570 - DNA, 20 bp, Artificial Sequence
  Synthetic oligonucleotide; AAG chr11 5277537 5277556 5277553 +
tggcaaatgtaaatacccta

SEQ ID NO: 14571 - DNA, 20 bp, Artificial Sequence
  Synthetic oligonucleotide; AAG chr11 5277544 5277563 5277560 +
tgtaaataccctaaagatgt

SEQ ID NO: 14572 - DNA, 20 bp, Artificial Sequence
  Synthetic oligonucleotide; TAG chr11 5277552 5277571 5277568 +
ccctaaagatgtaagatgct

SEQ ID NO: 14573 - DNA, 20 bp, Artificial Sequence
  Synthetic oligonucleotide; AAG chr11 5277562 5277581 5277578 +
gtaagatgcttagaattttc

SEQ ID NO: 14574 - DNA, 20 bp, Artificial Sequence
  Synthetic oligonucleotide; AGG chr11 5277563 5277582 5277579 +
taagatgcttagaattttca

SEQ ID NO: 14575 - DNA, 20 bp, Artificial Sequence
  Synthetic oligonucleotide; AAG chr11 5277575 5277594 5277591 +
aattttcaaggaatatcaat

SEQ ID NO: 14576 - DNA, 20 bp, Artificial Sequence
  Synthetic oligonucleotide; AGG chr11 5277576 5277595 5277592 +
attttcaaggaatatcaata

SEQ ID NO: 14577 - DNA, 20 bp, Artificial Sequence
  Synthetic oligonucleotide; TAG chr11 5277585 5277604 5277601 +
gaatatcaataaggccaatg

SEQ ID NO: 14578 - DNA, 20 bp, Artificial Sequence
  Synthetic oligonucleotide; AGG chr11 5277586 5277605 5277602 +
aatatcaataaggccaatgt

SEQ ID NO: 14579 - DNA, 20 bp, Artificial Sequence
  Synthetic oligonucleotide; GAG chr11 5277591 5277610 5277607 +
caataaggccaatgtaggat

SEQ ID NO: 14580 - DNA, 20 bp, Artificial Sequence
  Synthetic oligonucleotide; CGG chr11 5277597 5277616 5277613 +
ggccaatgtaggatgagatt

SEQ ID NO: 14581 - DNA, 20 bp, Artificial Sequence
  Synthetic oligonucleotide; AAG chr11 5277602 5277621 5277618 +
atgtaggatgagattcggtg

SEQ ID NO: 14582 - DNA, 20 bp, Artificial Sequence
  Synthetic oligonucleotide; AGG chr11 5277603 5277622 5277619 +
tgtaggatgagattcggtga

SEQ ID NO: 14583 - DNA, 20 bp, Artificial Sequence
  Synthetic oligonucleotide; GGG chr11 5277604 5277623 5277620 +
gtaggatgagattcggtgaa

SEQ ID NO: 14584 - DNA, 20 bp, Artificial Sequence
  Synthetic oligonucleotide; GGG chr11 5277605 5277624 5277621 +
taggatgagattcggtgaag

SEQ ID NO: 14585 - DNA, 20 bp, Artificial Sequence
  Synthetic oligonucleotide; GAG chr11 5277607 5277626 5277623 +
ggatgagattcggtgaaggg

SEQ ID NO: 14586 - DNA, 20 bp, Artificial Sequence
  Synthetic oligonucleotide; AAG chr11 5277615 5277634 5277631 +
ttcggtgaaggggagaataa

SEQ ID NO: 14587 - DNA, 20 bp, Artificial Sequence
  Synthetic oligonucleotide; GAG chr11 5277620 5277639 5277636 +
tgaaggggagaataaaagat

SEQ ID NO: 14588 - DNA, 20 bp, Artificial Sequence
  Synthetic oligonucleotide; TAG chr11 5277627 5277646 5277643 +
gagaataaaagatgagatca

SEQ ID NO: 14589 - DNA, 20 bp, Artificial Sequence
  Synthetic oligonucleotide; AAG chr11 5277630 5277649 5277646 +
aataaaagatgagatcatag

SEQ ID NO: 14590 - DNA, 20 bp, Artificial Sequence
  Synthetic oligonucleotide; TGG chr11 5277650 5277669 5277666 +
aagtcctaaattataaaatt

SEQ ID NO: 14591 - DNA, 20 bp, Artificial Sequence
  Synthetic oligonucleotide; GGG chr11 5277651 5277670 5277667 +
agtcctaaattataaaattt

SEQ ID NO: 14592 - DNA, 20 bp, Artificial Sequence
  Synthetic oligonucleotide; TAG chr11 5277675 5277694 5277691 +
cactaataatacctacatca

SEQ ID NO: 14593 - DNA, 20 bp, Artificial Sequence
  Synthetic oligonucleotide; GAG chr11 5277677 5277696 5277693 +
ctaataatacctacatcata

SEQ ID NO: 14594 - DNA, 20 bp, Artificial Sequence
  Synthetic oligonucleotide; AAG chr11 5277684 5277703 5277700 +
tacctacatcatagagttgt

SEQ ID NO: 14595 - DNA, 20 bp, Artificial Sequence
  Synthetic oligonucleotide; GAG chr11 5277735 5277754 5277751 +
atatatatatttatttatat

SEQ ID NO: 14596 - DNA, 20 bp, Artificial Sequence
  Synthetic oligonucleotide; GAG chr11 5277737 5277756 5277753 +
atatatatttatttatatga

SEQ ID NO: 14597 - DNA, 20 bp, Artificial Sequence
  Synthetic oligonucleotide; TAG chr11 5277790 5277809 5277806 +
atatgcatgaacaactattg

SEQ ID NO: 14598 - DNA, 20 bp, Artificial Sequence
  Synthetic oligonucleotide; GAG chr11 5277792 5277811 5277808 +
atgcatgaacaactattgta

SEQ ID NO: 14599 - DNA, 20 bp, Artificial Sequence
  Synthetic oligonucleotide; AAG chr11 5277801 5277820 5277817 +
caactattgtagagaattgt

SEQ ID NO: 14600 - DNA, 20 bp, Artificial Sequence
  Synthetic oligonucleotide; AGG chr11 5277802 5277821 5277818 +
aactattgtagagaattgta

SEQ ID NO: 14601 - DNA, 20 bp, Artificial Sequence
  Synthetic oligonucleotide; TGG chr11 5277808 5277827 5277824 +
tgtagagaattgtaaggatt

SEQ ID NO: 14602 - DNA, 20 bp, Artificial Sequence
  Synthetic oligonucleotide; TAG chr11 5277828 5277847 5277844 +
tggttttattataaatgata

SEQ ID NO: 14603 - DNA, 20 bp, Artificial Sequence
  Synthetic oligonucleotide; AGG chr11 5277829 5277848 5277845 +
ggttttattataaatgatat

SEQ ID NO: 14604 - DNA, 20 bp, Artificial Sequence
  Synthetic oligonucleotide; CAG chr11 5277839 5277858 5277855 +
taaatgatataggaaactat

SEQ ID NO: 14605 - DNA, 20 bp, Artificial Sequence
  Synthetic oligonucleotide; AAG chr11 5277842 5277861 5277858 +
atgatataggaaactatcag

SEQ ID NO: 14606 - DNA, 20 bp, Artificial Sequence
  Synthetic oligonucleotide; AAG chr11 5277855 5277874 5277871 +
ctatcagaagactttgaaca

SEQ ID NO: 14607 - DNA, 20 bp, Artificial Sequence
  Synthetic oligonucleotide; GAG chr11 5277857 5277876 5277873 +
atcagaagactttgaacaaa

SEQ ID NO: 14608 - DNA, 20 bp, Artificial Sequence
  Synthetic oligonucleotide; AGG chr11 5277858 5277877 5277874 +
tcagaagactttgaacaaag

SEQ ID NO: 14609 - DNA, 20 bp, Artificial Sequence
  Synthetic oligonucleotide; AAG chr11 5277887 5277906 5277903 +
tatatgacttacattttgaa

SEQ ID NO: 14610 - DNA, 20 bp, Artificial Sequence
  Synthetic oligonucleotide; TGG chr11 5277897 5277916 5277913 +
acattttgaaaagactaatt

SEQ ID NO: 14611 - DNA, 20 bp, Artificial Sequence
  Synthetic oligonucleotide; TAG chr11 5277901 5277920 5277917 +
tttgaaaagactaatttgga

SEQ ID NO: 14612 - DNA, 20 bp, Artificial Sequence
  Synthetic oligonucleotide; TGG chr11 5277909 5277928 5277925 +
gactaatttggatagtatat

SEQ ID NO: 14613 - DNA, 20 bp, Artificial Sequence
  Synthetic oligonucleotide; GGG chr11 5277910 5277929 5277926 +
actaatttggatagtatatt

SEQ ID NO: 14614 - DNA, 20 bp, Artificial Sequence
  Synthetic oligonucleotide; AAG chr11 5277913 5277932 5277929 +
aatttggatagtatattggg

SEQ ID NO: 14615 - DNA, 20 bp, Artificial Sequence
  Synthetic oligonucleotide; TAG chr11 5277922 5277941 5277938 +
agtatattgggaagaaattg

SEQ ID NO: 14616 - DNA, 20 bp, Artificial Sequence
  Synthetic oligonucleotide; TGG chr11 5277925 5277944 5277941 +
atattgggaagaaattgtag

SEQ ID NO: 14617 - DNA, 20 bp, Artificial Sequence
  Synthetic oligonucleotide; GGG chr11 5277926 5277945 5277942 +
tattgggaagaaattgtagt

SEQ ID NO: 14618 - DNA, 20 bp, Artificial Sequence
  Synthetic oligonucleotide; GGG chr11 5277927 5277946 5277943 +
attgggaagaaattgtagtg

SEQ ID NO: 14619 - DNA, 20 bp, Artificial Sequence
  Synthetic oligonucleotide; CAG chr11 5277930 5277949 5277946 +
gggaagaaattgtagtgggg

SEQ ID NO: 14620 - DNA, 20 bp, Artificial Sequence
  Synthetic oligonucleotide; TGG chr11 5277933 5277952 5277949 +
aagaaattgtagtggggcag

SEQ ID NO: 14621 - DNA, 20 bp, Artificial Sequence
  Synthetic oligonucleotide; TAG chr11 5277936 5277955 5277952 +
aaattgtagtggggcagtgg

SEQ ID NO: 14622 - DNA, 20 bp, Artificial Sequence
  Synthetic oligonucleotide; AAG chr11 5277939 5277958 5277955 +
ttgtagtggggcagtggtag

SEQ ID NO: 14623 - DNA, 20 bp, Artificial Sequence
  Synthetic oligonucleotide; CAG chr11 5277942 5277961 5277958 +
tagtggggcagtggtagaag

SEQ ID NO: 14624 - DNA, 20 bp, Artificial Sequence
  Synthetic oligonucleotide; AGG chr11 5277943 5277962 5277959 +
agtggggcagtggtagaagc

SEQ ID NO: 14625 - DNA, 20 bp, Artificial Sequence
  Synthetic oligonucleotide; AAG chr11 5277946 5277965 5277962 +
ggggcagtggtagaagcagg

SEQ ID NO: 14626 - DNA, 20 bp, Artificial Sequence
  Synthetic oligonucleotide; GAG chr11 5277957 5277976 5277973 +
agaagcaggaagattgttat

SEQ ID NO: 14627 - DNA, 20 bp, Artificial Sequence
  Synthetic oligonucleotide; CAG chr11 5277964 5277983 5277980 +
ggaagattgttatgagtcaa

SEQ ID NO: 14628 - DNA, 20 bp, Artificial Sequence
  Synthetic oligonucleotide; TAG chr11 5277975 5277994 5277991 +
atgagtcaacagctataatt

SEQ ID NO: 14629 - DNA, 20 bp, Artificial Sequence
  Synthetic oligonucleotide; AGG chr11 5277976 5277995 5277992 +
tgagtcaacagctataattt

SEQ ID NO: 14630 - DNA, 20 bp, Artificial Sequence
  Synthetic oligonucleotide; TGG chr11 5277979 5277998 5277995 +
gtcaacagctataatttagg

SEQ ID NO: 14631 - DNA, 20 bp, Artificial Sequence
  Synthetic oligonucleotide; TGG chr11 5277982 5278001 5277998 +
aacagctataatttaggtgg

SEQ ID NO: 14632 - DNA, 20 bp, Artificial Sequence
  Synthetic oligonucleotide; CAG chr11 5277988 5278007 5278004 +
tataatttaggtggtggtga

SEQ ID NO: 14633 - DNA, 20 bp, Artificial Sequence
  Synthetic oligonucleotide; TAG chr11 5277996 5278015 5278012 +
aggtggtggtgacagtgact

SEQ ID NO: 14634 - DNA, 20 bp, Artificial Sequence
  Synthetic oligonucleotide; CAG chr11 5278001 5278020 5278017 +
gtggtgacagtgacttagac

SEQ ID NO: 14635 - DNA, 20 bp, Artificial Sequence
  Synthetic oligonucleotide; GAG chr11 5278003 5278022 5278019 +
ggtgacagtgacttagacca

SEQ ID NO: 14636 - DNA, 20 bp, Artificial Sequence
  Synthetic oligonucleotide; TGG chr11 5278006 5278025 5278022 +
gacagtgacttagaccagag

SEQ ID NO: 14637 - DNA, 20 bp, Artificial Sequence
  Synthetic oligonucleotide; TAG chr11 5278009 5278028 5278025 +
agtgacttagaccagagtgg

SEQ ID NO: 14638 - DNA, 20 bp, Artificial Sequence
  Synthetic oligonucleotide; TGG chr11 5278015 5278034 5278031 +
ttagaccagagtggtagcat

SEQ ID NO: 14639 - DNA, 20 bp, Artificial Sequence
  Synthetic oligonucleotide; GAG chr11 5278017 5278036 5278033 +
agaccagagtggtagcattg

SEQ ID NO: 14640 - DNA, 20 bp, Artificial Sequence
  Synthetic oligonucleotide; AGG chr11 5278018 5278037 5278034 +
gaccagagtggtagcattgg

SEQ ID NO: 14641 - DNA, 20 bp, Artificial Sequence
  Synthetic oligonucleotide; AAG chr11 5278023 5278042 5278039 +
gagtggtagcattggaggtg

SEQ ID NO: 14642 - DNA, 20 bp, Artificial Sequence
  Synthetic oligonucleotide; AGG chr11 5278024 5278043 5278040 +
agtggtagcattggaggtga

SEQ ID NO: 14643 - DNA, 20 bp, Artificial Sequence
  Synthetic oligonucleotide; AAG chr11 5278028 5278047 5278044 +
gtagcattggaggtgaaggc

SEQ ID NO: 14644 - DNA, 20 bp, Artificial Sequence
  Synthetic oligonucleotide; AGG chr11 5278029 5278048 5278045 +
tagcattggaggtgaaggca

SEQ ID NO: 14645 - DNA, 20 bp, Artificial Sequence
  Synthetic oligonucleotide; GGG chr11 5278030 5278049 5278046 +
agcattggaggtgaaggcaa

SEQ ID NO: 14646 - DNA, 20 bp, Artificial Sequence
  Synthetic oligonucleotide; GGG chr11 5278031 5278050 5278047 +
gcattggaggtgaaggcaag

SEQ ID NO: 14647 - DNA, 20 bp, Artificial Sequence
  Synthetic oligonucleotide; CAG chr11 5278035 5278054 5278051 +
tggaggtgaaggcaaggggt

SEQ ID NO: 14648 - DNA, 20 bp, Artificial Sequence
  Synthetic oligonucleotide; CAG chr11 5278069 5278088 5278085 +
atcctttcacgaaaaaccaa

SEQ ID NO: 14649 - DNA, 20 bp, Artificial Sequence
  Synthetic oligonucleotide; AGG chr11 5278070 5278089 5278086 +
tcctttcacgaaaaaccaac

SEQ ID NO: 14650 - DNA, 20 bp, Artificial Sequence
  Synthetic oligonucleotide; CAG chr11 5278082 5278101 5278098 +
aaaccaacaggattttctga

SEQ ID NO: 14651 - DNA, 20 bp, Artificial Sequence
  Synthetic oligonucleotide; GAG chr11 5278084 5278103 5278100 +
accaacaggattttctgaca

SEQ ID NO: 14652 - DNA, 20 bp, Artificial Sequence
  Synthetic oligonucleotide; TGG chr11 5278091 5278110 5278107 +
ggattttctgacagagaata

SEQ ID NO: 14653 - DNA, 20 bp, Artificial Sequence
  Synthetic oligonucleotide; TGG chr11 5278097 5278116 5278113 +
tctgacagagaatatggaat

SEQ ID NO: 14654 - DNA, 20 bp, Artificial Sequence
  Synthetic oligonucleotide; TAG chr11 5278130 5278149 5278146 +
tgttgcactcatgcacactc

SEQ ID NO: 14655 - DNA, 20 bp, Artificial Sequence
  Synthetic oligonucleotide; TGG chr11 5278147 5278166 5278163 +
ctctagtgcatgctaatttc

SEQ ID NO: 14656 - DNA, 20 bp, Artificial Sequence
  Synthetic oligonucleotide; GAG chr11 5278154 5278173 5278170 +
gcatgctaatttctggctgt

SEQ ID NO: 14657 - DNA, 20 bp, Artificial Sequence
  Synthetic oligonucleotide; CAG chr11 5278164 5278183 5278180 +
ttctggctgtgagtatatgt

SEQ ID NO: 14658 - DNA, 20 bp, Artificial Sequence
  Synthetic oligonucleotide; GAG chr11 5278166 5278185 5278182 +
ctggctgtgagtatatgtca

SEQ ID NO: 14659 - DNA, 20 bp, Artificial Sequence
  Synthetic oligonucleotide; AAG chr11 5278170 5278189 5278186 +
ctgtgagtatatgtcagagt

SEQ ID NO: 14660 - DNA, 20 bp, Artificial Sequence
  Synthetic oligonucleotide; AGG chr11 5278171 5278190 5278187 +
tgtgagtatatgtcagagta

SEQ ID NO: 14661 - DNA, 20 bp, Artificial Sequence
  Synthetic oligonucleotide; AAG chr11 5278180 5278199 5278196 +
atgtcagagtaaggattttg

SEQ ID NO: 14662 - DNA, 20 bp, Artificial Sequence
  Synthetic oligonucleotide; TAG chr11 5278184 5278203 5278200 +
cagagtaaggattttgaagc

SEQ ID NO: 14663 - DNA, 20 bp, Artificial Sequence
  Synthetic oligonucleotide; AGG chr11 5278185 5278204 5278201 +
agagtaaggattttgaagct

SEQ ID NO: 14664 - DNA, 20 bp, Artificial Sequence
  Synthetic oligonucleotide; AAG chr11 5278190 5278209 5278206 +
aaggattttgaagctaggca

SEQ ID NO: 14665 - DNA, 20 bp, Artificial Sequence
  Synthetic oligonucleotide; GAG chr11 5278194 5278213 5278210 +
attttgaagctaggcaaagt

SEQ ID NO: 14666 - DNA, 20 bp, Artificial Sequence
  Synthetic oligonucleotide; TGG chr11 5278201 5278220 5278217 +
agctaggcaaagtgagtctt

SEQ ID NO: 14667 - DNA, 20 bp, Artificial Sequence
  Synthetic oligonucleotide; GGG chr11 5278202 5278221 5278218 +
gctaggcaaagtgagtcttt

SEQ ID NO: 14668 - DNA, 20 bp, Artificial Sequence
  Synthetic oligonucleotide; AAG chr11 5278217 5278236 5278233 +
tctttgggttgaattttgtc

SEQ ID NO: 14669 - DNA, 20 bp, Artificial Sequence
  Synthetic oligonucleotide; AGG chr11 5278218 5278237 5278234 +
ctttgggttgaattttgtca

SEQ ID NO: 14670 - DNA, 20 bp, Artificial Sequence
  Synthetic oligonucleotide; CAG chr11 5278234 5278253 5278250 +
gtcaaggtgtttgttcatca

SEQ ID NO: 14671 - DNA, 20 bp, Artificial Sequence
  Synthetic oligonucleotide; CAG chr11 5278246 5278265 5278262 +
gttcatcacagtctctacct

SEQ ID NO: 14672 - DNA, 20 bp, Artificial Sequence
  Synthetic oligonucleotide; TGG chr11 5278252 5278271 5278268 +
cacagtctctacctcagaat

SEQ ID NO: 14673 - DNA, 20 bp, Artificial Sequence
  Synthetic oligonucleotide; TGG chr11 5278264 5278283 5278280 +
ctcagaattggctttaaaat

SEQ ID NO: 14674 - DNA, 20 bp, Artificial Sequence
  Synthetic oligonucleotide; AAG chr11 5278268 5278287 5278284 +
gaattggctttaaaattgga

SEQ ID NO: 14675 - DNA, 20 bp, Artificial Sequence
  Synthetic oligonucleotide; TGG chr11 5278272 5278291 5278288 +
tggctttaaaattggaaagc

SEQ ID NO: 14676 - DNA, 20 bp, Artificial Sequence
  Synthetic oligonucleotide; GGG chr11 5278273 5278292 5278289 +
ggctttaaaattggaaagct

SEQ ID NO: 14677 - DNA, 20 bp, Artificial Sequence
  Synthetic oligonucleotide; TGG chr11 5278276 5278295 5278292 +
tttaaaattggaaagctggg

SEQ ID NO: 14678 - DNA, 20 bp, Artificial Sequence
  Synthetic oligonucleotide; GGG chr11 5278277 5278296 5278293 +
ttaaaattggaaagctgggt

SEQ ID NO: 14679 - DNA, 20 bp, Artificial Sequence
  Synthetic oligonucleotide; TGG chr11 5278280 5278299 5278296 +
aaattggaaagctgggtggg

SEQ ID NO: 14680 - DNA, 20 bp, Artificial Sequence
  Synthetic oligonucleotide; TGG chr11 5278286 5278305 5278302 +
gaaagctgggtgggtggata

SEQ ID NO: 14681 - DNA, 20 bp, Artificial Sequence
  Synthetic oligonucleotide; GAG chr11 5278293 5278312 5278309 +
gggtgggtggatatggaaat

SEQ ID NO: 14682 - DNA, 20 bp, Artificial Sequence
  Synthetic oligonucleotide; TGG chr11 5278306 5278325 5278322 +
tggaaatgagaaaccatctc

SEQ ID NO: 14683 - DNA, 20 bp, Artificial Sequence
  Synthetic oligonucleotide; GAG chr11 5278308 5278327 5278324 +
gaaatgagaaaccatctctg

SEQ ID NO: 14684 - DNA, 20 bp, Artificial Sequence
  Synthetic oligonucleotide; TAG chr11 5278332 5278351 5278348 +
ttgtctacacatcatacctt

SEQ ID NO: 14685 - DNA, 20 bp, Artificial Sequence
  Synthetic oligonucleotide; AAG chr11 5278338 5278357 5278354 +
acacatcatacctttagcca

SEQ ID NO: 14686 - DNA, 20 bp, Artificial Sequence
  Synthetic oligonucleotide; AAG chr11 5278348 5278367 5278364 +
cctttagccaaagtgacatc

SEQ ID NO: 14687 - DNA, 20 bp, Artificial Sequence
  Synthetic oligonucleotide; TGG chr11 5278358 5278377 5278374 +
aagtgacatcaagtatttct

SEQ ID NO: 14688 - DNA, 20 bp, Artificial Sequence
  Synthetic oligonucleotide; CAG chr11 5278369 5278388 5278385 +
agtatttcttggatgctgac

SEQ ID NO: 14689 - DNA, 20 bp, Artificial Sequence
  Synthetic oligonucleotide; GAG chr11 5278371 5278390 5278387 +
tatttcttggatgctgacca

SEQ ID NO: 14690 - DNA, 20 bp, Artificial Sequence
  Synthetic oligonucleotide; AGG chr11 5278372 5278391 5278388 +
atttcttggatgctgaccag

SEQ ID NO: 14691 - DNA, 20 bp, Artificial Sequence
  Synthetic oligonucleotide; GAG chr11 5278380 5278399 5278396 +
gatgctgaccagaggcttct

SEQ ID NO: 14692 - DNA, 20 bp, Artificial Sequence
  Synthetic oligonucleotide; CAG chr11 5278384 5278403 5278400 +
ctgaccagaggcttctgagc

SEQ ID NO: 14693 - DNA, 20 bp, Artificial Sequence
  Synthetic oligonucleotide; AGG chr11 5278385 5278404 5278401 +
tgaccagaggcttctgagcc

SEQ ID NO: 14694 - DNA, 20 bp, Artificial Sequence
  Synthetic oligonucleotide; TAG chr11 5278394 5278413 5278410 +
gcttctgagccaggcccctc

SEQ ID NO: 14695 - DNA, 20 bp, Artificial Sequence
  Synthetic oligonucleotide; AAG chr11 5278400 5278419 5278416 +
gagccaggcccctctagctg

SEQ ID NO: 14696 - DNA, 20 bp, Artificial Sequence
  Synthetic oligonucleotide; AGG chr11 5278401 5278420 5278417 +
agccaggcccctctagctga

SEQ ID NO: 14697 - DNA, 20 bp, Artificial Sequence
  Synthetic oligonucleotide; AAG chr11 5278404 5278423 5278420 +
caggcccctctagctgaagg

SEQ ID NO: 14698 - DNA, 20 bp, Artificial Sequence
  Synthetic oligonucleotide; CAG chr11 5278411 5278430 5278427 +
ctctagctgaaggaagttca

SEQ ID NO: 14699 - DNA, 20 bp, Artificial Sequence
  Synthetic oligonucleotide; AAG chr11 5278421 5278440 5278437 +
aggaagttcacagtttcttt

SEQ ID NO: 14700 - DNA, 20 bp, Artificial Sequence
  Synthetic oligonucleotide; AGG chr11 5278422 5278441 5278438 +
ggaagttcacagtttcttta

SEQ ID NO: 14701 - DNA, 20 bp, Artificial Sequence
  Synthetic oligonucleotide; GAG chr11 5278424 5278443 5278440 +
aagttcacagtttctttaag

SEQ ID NO: 14702 - DNA, 20 bp, Artificial Sequence
  Synthetic oligonucleotide; AGG chr11 5278425 5278444 5278441 +
agttcacagtttctttaagg

SEQ ID NO: 14703 - DNA, 20 bp, Artificial Sequence
  Synthetic oligonucleotide; GGG chr11 5278426 5278445 5278442 +
gttcacagtttctttaagga

SEQ ID NO: 14704 - DNA, 20 bp, Artificial Sequence
  Synthetic oligonucleotide; TGG chr11 5278433 5278452 5278449 +
gtttctttaaggagggaaaa

SEQ ID NO: 14705 - DNA, 20 bp, Artificial Sequence
  Synthetic oligonucleotide; TAG chr11 5278436 5278455 5278452 +
tctttaaggagggaaaatgg

SEQ ID NO: 14706 - DNA, 20 bp, Artificial Sequence
  Synthetic oligonucleotide; AAG chr11 5278441 5278460 5278457 +
aaggagggaaaatggtagat

SEQ ID NO: 14707 - DNA, 20 bp, Artificial Sequence
  Synthetic oligonucleotide; CAG chr11 5278445 5278464 5278461 +
agggaaaatggtagataagt

SEQ ID NO: 14708 - DNA, 20 bp, Artificial Sequence
  Synthetic oligonucleotide; GAG chr11 5278447 5278466 5278463 +
ggaaaatggtagataagtca

SEQ ID NO: 14709 - DNA, 20 bp, Artificial Sequence
  Synthetic oligonucleotide; CAG chr11 5278456 5278475 5278472 +
tagataagtcagagaacaat

SEQ ID NO: 14710 - DNA, 20 bp, Artificial Sequence
  Synthetic oligonucleotide; CAG chr11 5278460 5278479 5278476 +
taagtcagagaacaatcaga

SEQ ID NO: 14711 - DNA, 20 bp, Artificial Sequence
  Synthetic oligonucleotide; CGG chr11 5278472 5278491 5278488 +
caatcagacagaattctgtt

SEQ ID NO: 14712 - DNA, 20 bp, Artificial Sequence
  Synthetic oligonucleotide; CAG chr11 5278476 5278495 5278492 +
cagacagaattctgttcggt

SEQ ID NO: 14713 - DNA, 20 bp, Artificial Sequence
  Synthetic oligonucleotide; AGG chr11 5278477 5278496 5278493 +
agacagaattctgttcggtc

SEQ ID NO: 14714 - DNA, 20 bp, Artificial Sequence
  Synthetic oligonucleotide; GGG chr11 5278478 5278497 5278494 +
gacagaattctgttcggtca

SEQ ID NO: 14715 - DNA, 20 bp, Artificial Sequence
  Synthetic oligonucleotide; TGG chr11 5278488 5278507 5278504 +
tgttcggtcagggaatttga

SEQ ID NO: 14716 - DNA, 20 bp, Artificial Sequence
  Synthetic oligonucleotide; GGG chr11 5278489 5278508 5278505 +
gttcggtcagggaatttgat

SEQ ID NO: 14717 - DNA, 20 bp, Artificial Sequence
  Synthetic oligonucleotide; TAG chr11 5278531 5278550 5278547 +
tgtttgttttcgtttttctt

SEQ ID NO: 14718 - DNA, 20 bp, Artificial Sequence
  Synthetic oligonucleotide; CAG chr11 5278535 5278554 5278551 +
tgttttcgtttttctttaga

SEQ ID NO: 14719 - DNA, 20 bp, Artificial Sequence
  Synthetic oligonucleotide; GAG chr11 5278537 5278556 5278553 +
ttttcgtttttctttagaca

SEQ ID NO: 14720 - DNA, 20 bp, Artificial Sequence
  Synthetic oligonucleotide; TGG chr11 5278548 5278567 5278564 +
ctttagacagagtctcgctc

SEQ ID NO: 14721 - DNA, 20 bp, Artificial Sequence
  Synthetic oligonucleotide; GAG chr11 5278550 5278569 5278566 +
ttagacagagtctcgctctg

SEQ ID NO: 14722 - DNA, 20 bp, Artificial Sequence
  Synthetic oligonucleotide; AGG chr11 5278551 5278570 5278567 +
tagacagagtctcgctctgg

SEQ ID NO: 14723 - DNA, 20 bp, Artificial Sequence
  Synthetic oligonucleotide; TGG chr11 5278555 5278574 5278571 +
cagagtctcgctctggaggc

SEQ ID NO: 14724 - DNA, 20 bp, Artificial Sequence
  Synthetic oligonucleotide; GAG chr11 5278557 5278576 5278573 +
gagtctcgctctggaggctg

SEQ ID NO: 14725 - DNA, 20 bp, Artificial Sequence
  Synthetic oligonucleotide; TGG chr11 5278565 5278584 5278581 +
ctctggaggctggagtgcaa

SEQ ID NO: 14726 - DNA, 20 bp, Artificial Sequence
  Synthetic oligonucleotide; CAG chr11 5278581 5278600 5278597 +
gcaatggcatgatctctgct

SEQ ID NO: 14727 - DNA, 20 bp, Artificial Sequence
  Synthetic oligonucleotide; CGG chr11 5278601 5278620 5278617 +
cagtgcaaactccacctccc

SEQ ID NO: 14728 - DNA, 20 bp, Artificial Sequence
  Synthetic oligonucleotide; AAG chr11 5278607 5278626 5278623 +
aaactccacctccccggttc

SEQ ID NO: 14729 - DNA, 20 bp, Artificial Sequence
  Synthetic oligonucleotide; CAG chr11 5278624 5278643 5278640 +
ttcaagcgattctcctgcct

SEQ ID NO: 14730 - DNA, 20 bp, Artificial Sequence
  Synthetic oligonucleotide; AAG chr11 5278633 5278652 5278649 +
ttctcctgcctcagcctccc

SEQ ID NO: 14731 - DNA, 20 bp, Artificial Sequence
  Synthetic oligonucleotide; TAG chr11 5278636 5278655 5278652 +
tcctgcctcagcctcccaag

SEQ ID NO: 14732 - DNA, 20 bp, Artificial Sequence
  Synthetic oligonucleotide; TGG chr11 5278640 5278659 5278656 +
gcctcagcctcccaagtagt

SEQ ID NO: 14733 - DNA, 20 bp, Artificial Sequence
  Synthetic oligonucleotide; CAG chr11 5278647 5278666 5278663 +
cctcccaagtagttggatta

SEQ ID NO: 14734 - DNA, 20 bp, Artificial Sequence
  Synthetic oligonucleotide; AGG chr11 5278648 5278667 5278664 +
ctcccaagtagttggattac

SEQ ID NO: 14735 - DNA, 20 bp, Artificial Sequence
  Synthetic oligonucleotide; CAG chr11 5278667 5278686 5278683 +
caggctcccgtcaccacgtc

SEQ ID NO: 14736 - DNA, 20 bp, Artificial Sequence
  Synthetic oligonucleotide; AAG chr11 5278687 5278706 5278703 +
cagctaatttttatattttt

SEQ ID NO: 14737 - DNA, 20 bp, Artificial Sequence
  Synthetic oligonucleotide; CAG chr11 5278690 5278709 5278706 +
ctaatttttatatttttaag

SEQ ID NO: 14738 - DNA, 20 bp, Artificial Sequence
  Synthetic oligonucleotide; GAG chr11 5278692 5278711 5278708 +
aatttttatatttttaagca

SEQ ID NO: 14739 - DNA, 20 bp, Artificial Sequence
  Synthetic oligonucleotide; CAG chr11 5278697 5278716 5278713 +
ttatatttttaagcagagac

SEQ ID NO: 14740 - DNA, 20 bp, Artificial Sequence
  Synthetic oligonucleotide; AGG chr11 5278698 5278717 5278714 +
tatatttttaagcagagacc

SEQ ID NO: 14741 - DNA, 20 bp, Artificial Sequence
  Synthetic oligonucleotide; TGG chr11 5278712 5278731 5278728 +
gagaccaggtttcactatgt

SEQ ID NO: 14742 - DNA, 20 bp, Artificial Sequence
  Synthetic oligonucleotide; TGG chr11 5278716 5278735 5278732 +
ccaggtttcactatgttggc

SEQ ID NO: 14743 - DNA, 20 bp, Artificial Sequence
  Synthetic oligonucleotide; GGG chr11 5278717 5278736 5278733 +
caggtttcactatgttggct

SEQ ID NO: 14744 - DNA, 20 bp, Artificial Sequence
  Synthetic oligonucleotide; TGG chr11 5278721 5278740 5278737 +
tttcactatgttggctgggc

SEQ ID NO: 14745 - DNA, 20 bp, Artificial Sequence
  Synthetic oligonucleotide; AAG chr11 5278742 5278761 5278758 +
ggtgtccaactcctgacctc

SEQ ID NO: 14746 - DNA, 20 bp, Artificial Sequence
  Synthetic oligonucleotide; TGG chr11 5278759 5278778 5278775 +
ctcaagtgatctgcccacct

SEQ ID NO: 14747 - DNA, 20 bp, Artificial Sequence
  Synthetic oligonucleotide; CAG chr11 5278783 5278802 5278799 +
gtcccaaactgctgtgatta

SEQ ID NO: 14748 - DNA, 20 bp, Artificial Sequence
  Synthetic oligonucleotide; AGG chr11 5278784 5278803 5278800 +
tcccaaactgctgtgattac

SEQ ID NO: 14749 - DNA, 20 bp, Artificial Sequence
  Synthetic oligonucleotide; GAG chr11 5278786 5278805 5278802 +
ccaaactgctgtgattacag

SEQ ID NO: 14750 - DNA, 20 bp, Artificial Sequence
  Synthetic oligonucleotide; GAG chr11 5278790 5278809 5278806 +
actgctgtgattacaggagt

SEQ ID NO: 14751 - DNA, 20 bp, Artificial Sequence
  Synthetic oligonucleotide; AAG chr11 5278805 5278824 5278821 +
ggagtgagccaccgcacctc

SEQ ID NO: 14752 - DNA, 20 bp, Artificial Sequence
  Synthetic oligonucleotide; AGG chr11 5278806 5278825 5278822 +
gagtgagccaccgcacctca

SEQ ID NO: 14753 - DNA, 20 bp, Artificial Sequence
  Synthetic oligonucleotide; TAG chr11 5278820 5278839 5278836 +
acctcaaggaatttgatgtt

SEQ ID NO: 14754 - DNA, 20 bp, Artificial Sequence
  Synthetic oligonucleotide; AGG chr11 5278821 5278840 5278837 +
cctcaaggaatttgatgttt

SEQ ID NO: 14755 - DNA, 20 bp, Artificial Sequence
  Synthetic oligonucleotide; TAG chr11 5278839 5278858 5278855 +
ttaggctgtgacctctgcac

SEQ ID NO: 14756 - DNA, 20 bp, Artificial Sequence
  Synthetic oligonucleotide; AGG chr11 5278840 5278859 5278856 +
taggctgtgacctctgcact

SEQ ID NO: 14757 - DNA, 20 bp, Artificial Sequence
  Synthetic oligonucleotide; TGG chr11 5278845 5278864 5278861 +
tgtgacctctgcactaggaa

SEQ ID NO: 14758 - DNA, 20 bp, Artificial Sequence
  Synthetic oligonucleotide; AAG chr11 5278848 5278867 5278864 +
gacctctgcactaggaatgg

SEQ ID NO: 14759 - DNA, 20 bp, Artificial Sequence
  Synthetic oligonucleotide; AGG chr11 5278849 5278868 5278865 +
acctctgcactaggaatgga

SEQ ID NO: 14760 - DNA, 20 bp, Artificial Sequence
  Synthetic oligonucleotide; TAG chr11 5278853 5278872 5278869 +
ctgcactaggaatggaaggt

SEQ ID NO: 14761 - DNA, 20 bp, Artificial Sequence
  Synthetic oligonucleotide; AAG chr11 5278883 5278902 5278899 +
caccccacccttcgtcctgc

SEQ ID NO: 14762 - DNA, 20 bp, Artificial Sequence
  Synthetic oligonucleotide; CAG chr11 5278901 5278920 5278917 +
gcaagtacccaatcacactg

SEQ ID NO: 14763 - DNA, 20 bp, Artificial Sequence
  Synthetic oligonucleotide; GAG chr11 5278903 5278922 5278919 +
aagtacccaatcacactgca

SEQ ID NO: 14764 - DNA, 20 bp, Artificial Sequence
  Synthetic oligonucleotide; TAG chr11 5278922 5278941 5278938 +
agagccacacctgccttcct

SEQ ID NO: 14765 - DNA, 20 bp, Artificial Sequence
  Synthetic oligonucleotide; GAG chr11 5278924 5278943 5278940 +
agccacacctgccttcctta

SEQ ID NO: 14766 - DNA, 20 bp, Artificial Sequence
  Synthetic oligonucleotide; AGG chr11 5278925 5278944 5278941 +
gccacacctgccttccttag

SEQ ID NO: 14767 - DNA, 20 bp, Artificial Sequence
  Synthetic oligonucleotide; GAG chr11 5278946 5278965 5278962 +
ggcgtgcctccatccctgat

SEQ ID NO: 14768 - DNA, 20 bp, Artificial Sequence
  Synthetic oligonucleotide; TAG chr11 5278964 5278983 5278980 +
atgagtttttcctccatgtg

SEQ ID NO: 14769 - DNA, 20 bp, Artificial Sequence
  Synthetic oligonucleotide; AAG chr11 5278975 5278994 5278991 +
ctccatgtgtagaattgaat

SEQ ID NO: 14770 - DNA, 20 bp, Artificial Sequence
  Synthetic oligonucleotide; AAG chr11 5278978 5278997 5278994 +
catgtgtagaattgaataag

SEQ ID NO: 14771 - DNA, 20 bp, Artificial Sequence
  Synthetic oligonucleotide; AGG chr11 5278979 5278998 5278995 +
atgtgtagaattgaataaga

SEQ ID NO: 14772 - DNA, 20 bp, Artificial Sequence
  Synthetic oligonucleotide; TAG chr11 5278983 5279002 5278999 +
gtagaattgaataagaagga

SEQ ID NO: 14773 - DNA, 20 bp, Artificial Sequence
  Synthetic oligonucleotide; AAG chr11 5278999 5279018 5279015 +
aggatagaattcaatttaac

SEQ ID NO: 14774 - DNA, 20 bp, Artificial Sequence
  Synthetic oligonucleotide; GAG chr11 5279006 5279025 5279022 +
aattcaatttaacaagcttt

SEQ ID NO: 14775 - DNA, 20 bp, Artificial Sequence
  Synthetic oligonucleotide; TAG chr11 5279018 5279037 5279034 +
caagctttgagtacttccta

SEQ ID NO: 14776 - DNA, 20 bp, Artificial Sequence
  Synthetic oligonucleotide; TAG chr11 5279023 5279042 5279039 +
tttgagtacttcctatagcc

SEQ ID NO: 14777 - DNA, 20 bp, Artificial Sequence
  Synthetic oligonucleotide; AGG chr11 5279024 5279043 5279040 +
ttgagtacttcctatagcct

SEQ ID NO: 14778 - DNA, 20 bp, Artificial Sequence
  Synthetic oligonucleotide; TAG chr11 5279047 5279066 5279063 +
cattgtgctgacaactatgt

SEQ ID NO: 14779 - DNA, 20 bp, Artificial Sequence
  Synthetic oligonucleotide; GAG chr11 5279049 5279068 5279065 +
ttgtgctgacaactatgtta

SEQ ID NO: 14780 - DNA, 20 bp, Artificial Sequence
  Synthetic oligonucleotide; GAG chr11 5279051 5279070 5279067 +
gtgctgacaactatgttaga

SEQ ID NO: 14781 - DNA, 20 bp, Artificial Sequence
  Synthetic oligonucleotide; GAG chr11 5279053 5279072 5279069 +
gctgacaactatgttagaga

SEQ ID NO: 14782 - DNA, 20 bp, Artificial Sequence
  Synthetic oligonucleotide; TAG chr11 5279059 5279078 5279075 +
aactatgttagagagagaaa

SEQ ID NO: 14783 - DNA, 20 bp, Artificial Sequence
  Synthetic oligonucleotide; AAG chr11 5279064 5279083 5279080 +
tgttagagagagaaatagac

SEQ ID NO: 14784 - DNA, 20 bp, Artificial Sequence
  Synthetic oligonucleotide; CAG chr11 5279082 5279101 5279098 +
acaagctataaacttttcct

SEQ ID NO: 14785 - DNA, 20 bp, Artificial Sequence
  Synthetic oligonucleotide; AGG chr11 5279083 5279102 5279099 +
caagctataaacttttcctc

SEQ ID NO: 14786 - DNA, 20 bp, Artificial Sequence
  Synthetic oligonucleotide; TAG chr11 5279103 5279122 5279119 +
aggaccatctacataatttc

SEQ ID NO: 14787 - DNA, 20 bp, Artificial Sequence
  Synthetic oligonucleotide; AGG chr11 5279104 5279123 5279120 +
ggaccatctacataatttct

SEQ ID NO: 14788 - DNA, 20 bp, Artificial Sequence
  Synthetic oligonucleotide; TAG chr11 5279129 5279148 5279145 +
caatataaaatgaaaatgaa

SEQ ID NO: 14789 - DNA, 20 bp, Artificial Sequence
  Synthetic oligonucleotide; AAG chr11 5279149 5279168 5279165 +
tagcccctttgtcaaaaatt

SEQ ID NO: 14790 - DNA, 20 bp, Artificial Sequence
  Synthetic oligonucleotide; AGG chr11 5279150 5279169 5279166 +
agcccctttgtcaaaaatta

SEQ ID NO: 14791 - DNA, 20 bp, Artificial Sequence
  Synthetic oligonucleotide; CAG chr11 5279162 5279181 5279178 +
aaaaattaaggatttcatgt

SEQ ID NO: 14792 - DNA, 20 bp, Artificial Sequence
  Synthetic oligonucleotide; AGG chr11 5279163 5279182 5279179 +
aaaattaaggatttcatgtc

SEQ ID NO: 14793 - DNA, 20 bp, Artificial Sequence
  Synthetic oligonucleotide; CAG chr11 5279168 5279187 5279184 +
taaggatttcatgtcaggaa

SEQ ID NO: 14794 - DNA, 20 bp, Artificial Sequence
  Synthetic oligonucleotide; AAG chr11 5279172 5279191 5279188 +
gatttcatgtcaggaacagc

SEQ ID NO: 14795 - DNA, 20 bp, Artificial Sequence
  Synthetic oligonucleotide; AGG chr11 5279173 5279192 5279189 +
atttcatgtcaggaacagca

SEQ ID NO: 14796 - DNA, 20 bp, Artificial Sequence
  Synthetic oligonucleotide; AAG chr11 5279186 5279205 5279202 +
aacagcaaggatgttaaacc

SEQ ID NO: 14797 - DNA, 20 bp, Artificial Sequence
  Synthetic oligonucleotide; TGG chr11 5279191 5279210 5279207 +
caaggatgttaaaccaagca

SEQ ID NO: 14798 - DNA, 20 bp, Artificial Sequence
  Synthetic oligonucleotide; GGG chr11 5279192 5279211 5279208 +
aaggatgttaaaccaagcat

SEQ ID NO: 14799 - DNA, 20 bp, Artificial Sequence
  Synthetic oligonucleotide; GGG chr11 5279193 5279212 5279209 +
aggatgttaaaccaagcatg

SEQ ID NO: 14800 - DNA, 20 bp, Artificial Sequence
  Synthetic oligonucleotide; AAG chr11 5279201 5279220 5279217 +
aaaccaagcatggggccatc

SEQ ID NO: 14801 - DNA, 20 bp, Artificial Sequence
  Synthetic oligonucleotide; AAG chr11 5279235 5279254 5279251 +
attcatgatacgaaaaaata

SEQ ID NO: 14802 - DNA, 20 bp, Artificial Sequence
  Synthetic oligonucleotide; GAG chr11 5279237 5279256 5279253 +
tcatgatacgaaaaaataaa

SEQ ID NO: 14803 - DNA, 20 bp, Artificial Sequence
  Synthetic oligonucleotide; TAG chr11 5279245 5279264 5279261 +
cgaaaaaataaagagtattc

SEQ ID NO: 14804 - DNA, 20 bp, Artificial Sequence
  Synthetic oligonucleotide; TAG chr11 5279253 5279272 5279269 +
taaagagtattctagttatt

SEQ ID NO: 14805 - DNA, 20 bp, Artificial Sequence
  Synthetic oligonucleotide; AAG chr11 5279267 5279286 5279283 +
gttatttagccacatatttc

SEQ ID NO: 14806 - DNA, 20 bp, Artificial Sequence
  Synthetic oligonucleotide; TAG chr11 5279272 5279291 5279288 +
ttagccacatatttcaagtt

SEQ ID NO: 14807 - DNA, 20 bp, Artificial Sequence
  Synthetic oligonucleotide; TAG chr11 5279320 5279339 5279336 +
cactcaacctaaaacaatgc

SEQ ID NO: 14808 - DNA, 20 bp, Artificial Sequence
  Synthetic oligonucleotide; TAG chr11 5279329 5279348 5279345 +
taaaacaatgctagtctttc

SEQ ID NO: 14809 - DNA, 20 bp, Artificial Sequence
  Synthetic oligonucleotide; TGG chr11 5279341 5279360 5279357 +
agtctttctagacccatcca

SEQ ID NO: 14810 - DNA, 20 bp, Artificial Sequence
  Synthetic oligonucleotide; TGG chr11 5279389 5279408 5279405 +
taattaatttgtgatttaaa

SEQ ID NO: 14811 - DNA, 20 bp, Artificial Sequence
  Synthetic oligonucleotide; CAG chr11 5279401 5279420 5279417 +
gatttaaatggctcatattc

SEQ ID NO: 14812 - DNA, 20 bp, Artificial Sequence
  Synthetic oligonucleotide; CAG chr11 5279413 5279432 5279429 +
tcatattccagcctgtgcca

SEQ ID NO: 14813 - DNA, 20 bp, Artificial Sequence
  Synthetic oligonucleotide; CAG chr11 5279469 5279488 5279485 +
ttatctgtataaatactctt

SEQ ID NO: 14814 - DNA, 20 bp, Artificial Sequence
  Synthetic oligonucleotide; AGG chr11 5279470 5279489 5279486 +
tatctgtataaatactcttc

SEQ ID NO: 14815 - DNA, 20 bp, Artificial Sequence
  Synthetic oligonucleotide; TAG chr11 5279505 5279524 5279521 +
cttaatgtttgtgtttatgt

SEQ ID NO: 14816 - DNA, 20 bp, Artificial Sequence
  Synthetic oligonucleotide; TAG chr11 5279520 5279539 5279536 +
tatgttagatatgcatcatg

SEQ ID NO: 14817 - DNA, 20 bp, Artificial Sequence
  Synthetic oligonucleotide; AAG chr11 5279563 5279582 5279579 +
aaacatacacttgaaccaaa

SEQ ID NO: 14818 - DNA, 20 bp, Artificial Sequence
  Synthetic oligonucleotide; AGG chr11 5279564 5279583 5279580 +
aacatacacttgaaccaaaa

SEQ ID NO: 14819 - DNA, 20 bp, Artificial Sequence
  Synthetic oligonucleotide; AAG chr11 5279567 5279586 5279583 +
atacacttgaaccaaaaagg

SEQ ID NO: 14820 - DNA, 20 bp, Artificial Sequence
  Synthetic oligonucleotide; TAG chr11 5279578 5279597 5279594 +
ccaaaaaggaagtttttaca

SEQ ID NO: 14821 - DNA, 20 bp, Artificial Sequence
  Synthetic oligonucleotide; TAG chr11 5279608 5279627 5279624 +
aaatcttctctctgtgctct

SEQ ID NO: 14822 - DNA, 20 bp, Artificial Sequence
  Synthetic oligonucleotide; AAG chr11 5279618 5279637 5279634 +
tctgtgctcttagcgaaacc

SEQ ID NO: 14823 - DNA, 20 bp, Artificial Sequence
  Synthetic oligonucleotide; TAG chr11 5279621 5279640 5279637 +
gtgctcttagcgaaaccaag

SEQ ID NO: 14824 - DNA, 20 bp, Artificial Sequence
  Synthetic oligonucleotide; AGG chr11 5279622 5279641 5279638 +
tgctcttagcgaaaccaagt

SEQ ID NO: 14825 - DNA, 20 bp, Artificial Sequence
  Synthetic oligonucleotide; AAG chr11 5279630 5279649 5279646 +
gcgaaaccaagtaggctgac

SEQ ID NO: 14826 - DNA, 20 bp, Artificial Sequence
  Synthetic oligonucleotide; CAG chr11 5279647 5279666 5279663 +
gacaagacatcattcattca

SEQ ID NO: 14827 - DNA, 20 bp, Artificial Sequence
  Synthetic oligonucleotide; GAG chr11 5279657 5279676 5279673 +
cattcattcacagcgaaacc

SEQ ID NO: 14828 - DNA, 20 bp, Artificial Sequence
  Synthetic oligonucleotide; TAG chr11 5279660 5279679 5279676 +
tcattcacagcgaaaccgag

SEQ ID NO: 14829 - DNA, 20 bp, Artificial Sequence
  Synthetic oligonucleotide; AAG chr11 5279669 5279688 5279685 +
gcgaaaccgagtagactgac

SEQ ID NO: 14830 - DNA, 20 bp, Artificial Sequence
  Synthetic oligonucleotide; GAG chr11 5279671 5279690 5279687 +
gaaaccgagtagactgacaa

SEQ ID NO: 14831 - DNA, 20 bp, Artificial Sequence
  Synthetic oligonucleotide; AGG chr11 5279672 5279691 5279688 +
aaaccgagtagactgacaag

SEQ ID NO: 14832 - DNA, 20 bp, Artificial Sequence
  Synthetic oligonucleotide; CAG chr11 5279703 5279722 5279719 +
tcacaaatgaatacaaaaaa

SEQ ID NO: 14833 - DNA, 20 bp, Artificial Sequence
  Synthetic oligonucleotide; AAG chr11 5279710 5279729 5279726 +
tgaatacaaaaaacagtgtc

SEQ ID NO: 14834 - DNA, 20 bp, Artificial Sequence
  Synthetic oligonucleotide; GAG chr11 5279720 5279739 5279736 +
aaacagtgtcaagtatacgt

SEQ ID NO: 14835 - DNA, 20 bp, Artificial Sequence
  Synthetic oligonucleotide; AGG chr11 5279721 5279740 5279737 +
aacagtgtcaagtatacgtg

SEQ ID NO: 14836 - DNA, 20 bp, Artificial Sequence
  Synthetic oligonucleotide; TGG chr11 5279732 5279751 5279748 +
gtatacgtgaggtcctgtaa

SEQ ID NO: 14837 - DNA, 20 bp, Artificial Sequence
  Synthetic oligonucleotide; GGG chr11 5279733 5279752 5279749 +
tatacgtgaggtcctgtaat

SEQ ID NO: 14838 - DNA, 20 bp, Artificial Sequence
  Synthetic oligonucleotide; TGG chr11 5279739 5279758 5279755 +
tgaggtcctgtaatgggtcc

SEQ ID NO: 14839 - DNA, 20 bp, Artificial Sequence
  Synthetic oligonucleotide; GGG chr11 5279740 5279759 5279756 +
gaggtcctgtaatgggtcct

SEQ ID NO: 14840 - DNA, 20 bp, Artificial Sequence
  Synthetic oligonucleotide; CAG chr11 5279758 5279777 5279774 +
ctgggcctgcaaaaccctca

SEQ ID NO: 14841 - DNA, 20 bp, Artificial Sequence
  Synthetic oligonucleotide; AAG chr11 5279772 5279791 5279788 +
ccctcacagctgctaacctc

SEQ ID NO: 14842 - DNA, 20 bp, Artificial Sequence
  Synthetic oligonucleotide; AAG chr11 5279775 5279794 5279791 +
tcacagctgctaacctcaag

SEQ ID NO: 14843 - DNA, 20 bp, Artificial Sequence
  Synthetic oligonucleotide; CAG chr11 5279780 5279799 5279796 +
gctgctaacctcaagaagct

SEQ ID NO: 14844 - DNA, 20 bp, Artificial Sequence
  Synthetic oligonucleotide; TGG chr11 5279783 5279802 5279799 +
gctaacctcaagaagctcag

SEQ ID NO: 14845 - DNA, 20 bp, Artificial Sequence
  Synthetic oligonucleotide; GAG chr11 5279785 5279804 5279801 +
taacctcaagaagctcagtg

SEQ ID NO: 14846 - DNA, 20 bp, Artificial Sequence
  Synthetic oligonucleotide; TAG chr11 5279868 5279887 5279884 +
taaatttgttcctttttgta

SEQ ID NO: 14847 - DNA, 20 bp, Artificial Sequence
  Synthetic oligonucleotide; AAG chr11 5279877 5279896 5279893 +
tcctttttgtatagttcctt

SEQ ID NO: 14848 - DNA, 20 bp, Artificial Sequence
  Synthetic oligonucleotide; CAG chr11 5279923 5279942 5279939 +
tttgccactgtgaactccta

SEQ ID NO: 14849 - DNA, 20 bp, Artificial Sequence
  Synthetic oligonucleotide; AAG chr11 5279926 5279945 5279942 +
gccactgtgaactcctacag

SEQ ID NO: 14850 - DNA, 20 bp, Artificial Sequence
  Synthetic oligonucleotide; CAG chr11 5279930 5279949 5279946 +
ctgtgaactcctacagaagc

SEQ ID NO: 14851 - DNA, 20 bp, Artificial Sequence
  Synthetic oligonucleotide; AAG chr11 5279938 5279957 5279954 +
tcctacagaagccagcttca

SEQ ID NO: 14852 - DNA, 20 bp, Artificial Sequence
  Synthetic oligonucleotide; TGG chr11 5279950 5279969 5279966 +
cagcttcaaagccattcttc

SEQ ID NO: 14853 - DNA, 20 bp, Artificial Sequence
  Synthetic oligonucleotide; AAG chr11 5279953 5279972 5279969 +
cttcaaagccattcttctgg

SEQ ID NO: 14854 - DNA, 20 bp, Artificial Sequence
  Synthetic oligonucleotide; AAG chr11 5279994 5280013 5280010 +
cctcctgttttttctcccac

SEQ ID NO: 14855 - DNA, 20 bp, Artificial Sequence
  Synthetic oligonucleotide; TAG chr11 5280033 5280052 5280049 +
cattgtttttcatcctcttg

SEQ ID NO: 14856 - DNA, 20 bp, Artificial Sequence
  Synthetic oligonucleotide; CAG chr11 5280043 5280062 5280059 +
catcctcttgtagtccttca

SEQ ID NO: 14857 - DNA, 20 bp, Artificial Sequence
  Synthetic oligonucleotide; CAG chr11 5280055 5280074 5280071 +
gtccttcacagttacccaca

SEQ ID NO: 14858 - DNA, 20 bp, Artificial Sequence
  Synthetic oligonucleotide; AGG chr11 5280056 5280075 5280072 +
tccttcacagttacccacac

SEQ ID NO: 14859 - DNA, 20 bp, Artificial Sequence
  Synthetic oligonucleotide; TAG chr11 5280069 5280088 5280085 +
cccacacaggtgaacccttt

SEQ ID NO: 14860 - DNA, 20 bp, Artificial Sequence
  Synthetic oligonucleotide; TGG chr11 5280078 5280097 5280094 +
gtgaacccttttagctctcc

SEQ ID NO: 14861 - DNA, 20 bp, Artificial Sequence
  Synthetic oligonucleotide; GAG chr11 5280080 5280099 5280096 +
gaacccttttagctctcctg

SEQ ID NO: 14862 - DNA, 20 bp, Artificial Sequence
  Synthetic oligonucleotide; AGG chr11 5280081 5280100 5280097 +
aacccttttagctctcctgg

SEQ ID NO: 14863 - DNA, 20 bp, Artificial Sequence
  Synthetic oligonucleotide; CAG chr11 5280100 5280119 5280116 +
gaggaatgtttctttcctct

SEQ ID NO: 14864 - DNA, 20 bp, Artificial Sequence
  Synthetic oligonucleotide; AGG chr11 5280101 5280120 5280117 +
aggaatgtttctttcctctc

SEQ ID NO: 14865 - DNA, 20 bp, Artificial Sequence
  Synthetic oligonucleotide; CAG chr11 5280106 5280125 5280122 +
tgtttctttcctctcaggat

SEQ ID NO: 14866 - DNA, 20 bp, Artificial Sequence
  Synthetic oligonucleotide; GAG chr11 5280108 5280127 5280124 +
tttctttcctctcaggatca

SEQ ID NO: 14867 - DNA, 20 bp, Artificial Sequence
  Synthetic oligonucleotide; AAG chr11 5280135 5280154 5280151 +
ctacatcttcctaatgcacc

SEQ ID NO: 14868 - DNA, 20 bp, Artificial Sequence
  Synthetic oligonucleotide; TGG chr11 5280140 5280159 5280156 +
tcttcctaatgcaccaagac

SEQ ID NO: 14869 - DNA, 20 bp, Artificial Sequence
  Synthetic oligonucleotide; GAG chr11 5280146 5280165 5280162 +
taatgcaccaagactggcct

SEQ ID NO: 14870 - DNA, 20 bp, Artificial Sequence
  Synthetic oligonucleotide; AAG chr11 5280159 5280178 5280175 +
ctggcctgagatgtatcctt

SEQ ID NO: 14871 - DNA, 20 bp, Artificial Sequence
  Synthetic oligonucleotide; GAG chr11 5280164 5280183 5280180 +
ctgagatgtatccttaagat

SEQ ID NO: 14872 - DNA, 20 bp, Artificial Sequence
  Synthetic oligonucleotide; GAG chr11 5280166 5280185 5280182 +
gagatgtatccttaagatga

SEQ ID NO: 14873 - DNA, 20 bp, Artificial Sequence
  Synthetic oligonucleotide; CAG chr11 5280174 5280193 5280190 +
tccttaagatgagagcttcc

SEQ ID NO: 14874 - DNA, 20 bp, Artificial Sequence
  Synthetic oligonucleotide; TAG chr11 5280177 5280196 5280193 +
ttaagatgagagcttcccag

SEQ ID NO: 14875 - DNA, 20 bp, Artificial Sequence
  Synthetic oligonucleotide; AAG chr11 5280186 5280205 5280202 +
gagcttcccagtagcacccc

SEQ ID NO: 14876 - DNA, 20 bp, Artificial Sequence
  Synthetic oligonucleotide; CAG chr11 5280190 5280209 5280206 +
ttcccagtagcaccccaagt

SEQ ID NO: 14877 - DNA, 20 bp, Artificial Sequence
  Synthetic oligonucleotide; GAG chr11 5280209 5280228 5280225 +
tcagatctgaccccgtatgt

SEQ ID NO: 14878 - DNA, 20 bp, Artificial Sequence
  Synthetic oligonucleotide; CAG chr11 5280226 5280245 5280242 +
tgtgagcatgtgtcctctaa

SEQ ID NO: 14879 - DNA, 20 bp, Artificial Sequence
  Synthetic oligonucleotide; CAG chr11 5280231 5280250 5280247 +
gcatgtgtcctctaacagca

SEQ ID NO: 14880 - DNA, 20 bp, Artificial Sequence
  Synthetic oligonucleotide; AGG chr11 5280232 5280251 5280248 +
catgtgtcctctaacagcac

SEQ ID NO: 14881 - DNA, 20 bp, Artificial Sequence
  Synthetic oligonucleotide; TAG chr11 5280247 5280266 5280263 +
agcacaggccttttgccacc

SEQ ID NO: 14882 - DNA, 20 bp, Artificial Sequence
  Synthetic oligonucleotide; CAG chr11 5280255 5280274 5280271 +
ccttttgccacctagctgtc

SEQ ID NO: 14883 - DNA, 20 bp, Artificial Sequence
  Synthetic oligonucleotide; AGG chr11 5280256 5280275 5280272 +
cttttgccacctagctgtcc

SEQ ID NO: 14884 - DNA, 20 bp, Artificial Sequence
  Synthetic oligonucleotide; GGG chr11 5280257 5280276 5280273 +
ttttgccacctagctgtcca

SEQ ID NO: 14885 - DNA, 20 bp, Artificial Sequence
  Synthetic oligonucleotide; GGG chr11 5280258 5280277 5280274 +
tttgccacctagctgtccag

SEQ ID NO: 14886 - DNA, 20 bp, Artificial Sequence
  Synthetic oligonucleotide; TGG chr11 5280271 5280290 5280287 +
tgtccaggggtgccttaaaa

SEQ ID NO: 14887 - DNA, 20 bp, Artificial Sequence
  Synthetic oligonucleotide; AAG chr11 5280279 5280298 5280295 +
ggtgccttaaaatggcaaac

SEQ ID NO: 14888 - DNA, 20 bp, Artificial Sequence
  Synthetic oligonucleotide; AGG chr11 5280280 5280299 5280296 +
gtgccttaaaatggcaaaca

SEQ ID NO: 14889 - DNA, 20 bp, Artificial Sequence
  Synthetic oligonucleotide; TAG chr11 5280350 5280369 5280366 +
ttcatattaatacatgtgta

SEQ ID NO: 14890 - DNA, 20 bp, Artificial Sequence
  Synthetic oligonucleotide; AAG chr11 5280383 5280402 5280399 +
tctatacacatgtattaata

SEQ ID NO: 14891 - DNA, 20 bp, Artificial Sequence
  Synthetic oligonucleotide; TAG chr11 5280403 5280422 5280419 +
aagcctgattctgccgcttc

SEQ ID NO: 14892 - DNA, 20 bp, Artificial Sequence
  Synthetic oligonucleotide; AGG chr11 5280404 5280423 5280420 +
agcctgattctgccgcttct

SEQ ID NO: 14893 - DNA, 20 bp, Artificial Sequence
  Synthetic oligonucleotide; TAG chr11 5280409 5280428 5280425 +
gattctgccgcttctaggta

SEQ ID NO: 14894 - DNA, 20 bp, Artificial Sequence
  Synthetic oligonucleotide; GAG chr11 5280411 5280430 5280427 +
ttctgccgcttctaggtata

SEQ ID NO: 14895 - DNA, 20 bp, Artificial Sequence
  Synthetic oligonucleotide; AGG chr11 5280412 5280431 5280428 +
tctgccgcttctaggtatag

SEQ ID NO: 14896 - DNA, 20 bp, Artificial Sequence
  Synthetic oligonucleotide; AAG chr11 5280423 5280442 5280439 +
taggtatagaggccacctgc

SEQ ID NO: 14897 - DNA, 20 bp, Artificial Sequence
  Synthetic oligonucleotide; TGG chr11 5280460 5280479 5280476 +
cacaataactaatcattcta

SEQ ID NO: 14898 - DNA, 20 bp, Artificial Sequence
  Synthetic oligonucleotide; CAG chr11 5280530 5280549 5280546 +
tgtatatatatatatatatt

SEQ ID NO: 14899 - DNA, 20 bp, Artificial Sequence
  Synthetic oligonucleotide; AGG chr11 5280531 5280550 5280547 +
gtatatatatatatatattc

SEQ ID NO: 14900 - DNA, 20 bp, Artificial Sequence
  Synthetic oligonucleotide; TAG chr11 5280547 5280566 5280563 +
attcaggaaataatatattc

SEQ ID NO: 14901 - DNA, 20 bp, Artificial Sequence
  Synthetic oligonucleotide; CAG chr11 5280569 5280588 5280585 +
gaatatgtcacattctgtct

SEQ ID NO: 14902 - DNA, 20 bp, Artificial Sequence
  Synthetic oligonucleotide; AGG chr11 5280570 5280589 5280586 +
aatatgtcacattctgtctc

SEQ ID NO: 14903 - DNA, 20 bp, Artificial Sequence
  Synthetic oligonucleotide; GAG chr11 5280599 5280618 5280615 +
ttttctttatgatgccgttt

SEQ ID NO: 14904 - DNA, 20 bp, Artificial Sequence
  Synthetic oligonucleotide; AGG chr11 5280600 5280619 5280616 +
tttctttatgatgccgtttg

SEQ ID NO: 14905 - DNA, 20 bp, Artificial Sequence
  Synthetic oligonucleotide; TGG chr11 5280603 5280622 5280619 +
ctttatgatgccgtttgagg

SEQ ID NO: 14906 - DNA, 20 bp, Artificial Sequence
  Synthetic oligonucleotide; GAG chr11 5280605 5280624 5280621 +
ttatgatgccgtttgaggtg

SEQ ID NO: 14907 - DNA, 20 bp, Artificial Sequence
  Synthetic oligonucleotide; TAG chr11 5280611 5280630 5280627 +
tgccgtttgaggtggagttt

SEQ ID NO: 14908 - DNA, 20 bp, Artificial Sequence
  Synthetic oligonucleotide; CAG chr11 5280615 5280634 5280631 +
gtttgaggtggagttttagt

SEQ ID NO: 14909 - DNA, 20 bp, Artificial Sequence
  Synthetic oligonucleotide; AGG chr11 5280616 5280635 5280632 +
tttgaggtggagttttagtc

SEQ ID NO: 14910 - DNA, 20 bp, Artificial Sequence
  Synthetic oligonucleotide; TGG chr11 5280619 5280638 5280635 +
gaggtggagttttagtcagg

SEQ ID NO: 14911 - DNA, 20 bp, Artificial Sequence
  Synthetic oligonucleotide; CAG chr11 5280623 5280642 5280639 +
tggagttttagtcaggtggt

SEQ ID NO: 14912 - DNA, 20 bp, Artificial Sequence
  Synthetic oligonucleotide; AAG chr11 5280655 5280674 5280671 +
ttttttgccatctgccctgt

SEQ ID NO: 14913 - DNA, 20 bp, Artificial Sequence
  Synthetic oligonucleotide; TGG chr11 5280666 5280685 5280682 +
ctgccctgtaagcatcctgc

SEQ ID NO: 14914 - DNA, 20 bp, Artificial Sequence
  Synthetic oligonucleotide; GGG chr11 5280667 5280686 5280683 +
tgccctgtaagcatcctgct

SEQ ID NO: 14915 - DNA, 20 bp, Artificial Sequence
  Synthetic oligonucleotide; GGG chr11 5280668 5280687 5280684 +
gccctgtaagcatcctgctg

SEQ ID NO: 14916 - DNA, 20 bp, Artificial Sequence
  Synthetic oligonucleotide; CAG chr11 5280674 5280693 5280690 +
taagcatcctgctggggacc

SEQ ID NO: 14917 - DNA, 20 bp, Artificial Sequence
  Synthetic oligonucleotide; TAG chr11 5280678 5280697 5280694 +
catcctgctggggacccaga

SEQ ID NO: 14918 - DNA, 20 bp, Artificial Sequence
  Synthetic oligonucleotide; AGG chr11 5280679 5280698 5280695 +
atcctgctggggacccagat

SEQ ID NO: 14919 - DNA, 20 bp, Artificial Sequence
  Synthetic oligonucleotide; GAG chr11 5280681 5280700 5280697 +
cctgctggggacccagatag

SEQ ID NO: 14920 - DNA, 20 bp, Artificial Sequence
  Synthetic oligonucleotide; TAG chr11 5280693 5280712 5280709 +
ccagataggagtcatcactc

SEQ ID NO: 14921 - DNA, 20 bp, Artificial Sequence
  Synthetic oligonucleotide; AGG chr11 5280694 5280713 5280710 +
cagataggagtcatcactct

SEQ ID NO: 14922 - DNA, 20 bp, Artificial Sequence
  Synthetic oligonucleotide; GAG chr11 5280699 5280718 5280715 +
aggagtcatcactctaggct

SEQ ID NO: 14923 - DNA, 20 bp, Artificial Sequence
  Synthetic oligonucleotide; TGG chr11 5280708 5280727 5280724 +
cactctaggctgagaacatc

SEQ ID NO: 14924 - DNA, 20 bp, Artificial Sequence
  Synthetic oligonucleotide; GGG chr11 5280709 5280728 5280725 +
actctaggctgagaacatct

SEQ ID NO: 14925 - DNA, 20 bp, Artificial Sequence
  Synthetic oligonucleotide; AAG chr11 5280722 5280741 5280738 +
aacatctgggcacacaccct

SEQ ID NO: 14926 - DNA, 20 bp, Artificial Sequence
  Synthetic oligonucleotide; CAG chr11 5280728 5280747 5280744 +
tgggcacacaccctaagcct

SEQ ID NO: 14927 - DNA, 20 bp, Artificial Sequence
  Synthetic oligonucleotide; CAG chr11 5280748 5280767 5280764 +
cagcatgactcatcatgact

SEQ ID NO: 14928 - DNA, 20 bp, Artificial Sequence
  Synthetic oligonucleotide; GAG chr11 5280764 5280783 5280780 +
gactcagcattgctgtgctt

SEQ ID NO: 14929 - DNA, 20 bp, Artificial Sequence
  Synthetic oligonucleotide; CAG chr11 5280768 5280787 5280784 +
cagcattgctgtgcttgagc

SEQ ID NO: 14930 - DNA, 20 bp, Artificial Sequence
  Synthetic oligonucleotide; AAG chr11 5280771 5280790 5280787 +
cattgctgtgcttgagccag

SEQ ID NO: 14931 - DNA, 20 bp, Artificial Sequence
  Synthetic oligonucleotide; AGG chr11 5280772 5280791 5280788 +
attgctgtgcttgagccaga

SEQ ID NO: 14932 - DNA, 20 bp, Artificial Sequence
  Synthetic oligonucleotide; TAG chr11 5280781 5280800 5280797 +
cttgagccagaaggtttgct

SEQ ID NO: 14933 - DNA, 20 bp, Artificial Sequence
  Synthetic oligonucleotide; AAG chr11 5280784 5280803 5280800 +
gagccagaaggtttgcttag

SEQ ID NO: 14934 - DNA, 20 bp, Artificial Sequence
  Synthetic oligonucleotide; AGG chr11 5280785 5280804 5280801 +
agccagaaggtttgcttaga

SEQ ID NO: 14935 - DNA, 20 bp, Artificial Sequence
  Synthetic oligonucleotide; CAG chr11 5280793 5280812 5280809 +
ggtttgcttagaaggttaca

SEQ ID NO: 14936 - DNA, 20 bp, Artificial Sequence
  Synthetic oligonucleotide; CAG chr11 5280799 5280818 5280815 +
cttagaaggttacacagaac

SEQ ID NO: 14937 - DNA, 20 bp, Artificial Sequence
  Synthetic oligonucleotide; AAG chr11 5280802 5280821 5280818 +
agaaggttacacagaaccag

SEQ ID NO: 14938 - DNA, 20 bp, Artificial Sequence
  Synthetic oligonucleotide; AGG chr11 5280803 5280822 5280819 +
gaaggttacacagaaccaga

SEQ ID NO: 14939 - DNA, 20 bp, Artificial Sequence
  Synthetic oligonucleotide; CGG chr11 5280806 5280825 5280822 +
ggttacacagaaccagaagg

SEQ ID NO: 14940 - DNA, 20 bp, Artificial Sequence
  Synthetic oligonucleotide; GGG chr11 5280807 5280826 5280823 +
gttacacagaaccagaaggc

SEQ ID NO: 14941 - DNA, 20 bp, Artificial Sequence
  Synthetic oligonucleotide; GGG chr11 5280808 5280827 5280824 +
ttacacagaaccagaaggcg

SEQ ID NO: 14942 - DNA, 20 bp, Artificial Sequence
  Synthetic oligonucleotide; GGG chr11 5280809 5280828 5280825 +
tacacagaaccagaaggcgg

SEQ ID NO: 14943 - DNA, 20 bp, Artificial Sequence
  Synthetic oligonucleotide; TGG chr11 5280812 5280831 5280828 +
acagaaccagaaggcggggg

SEQ ID NO: 14944 - DNA, 20 bp, Artificial Sequence
  Synthetic oligonucleotide; GGG chr11 5280813 5280832 5280829 +
cagaaccagaaggcgggggt

SEQ ID NO: 14945 - DNA, 20 bp, Artificial Sequence
  Synthetic oligonucleotide; GGG chr11 5280814 5280833 5280830 +
agaaccagaaggcgggggtg

SEQ ID NO: 14946 - DNA, 20 bp, Artificial Sequence
  Synthetic oligonucleotide; CAG chr11 5280829 5280848 5280845 +
gggtggggcactgaccccga

SEQ ID NO: 14947 - DNA, 20 bp, Artificial Sequence
  Synthetic oligonucleotide; AGG chr11 5280830 5280849 5280846 +
ggtggggcactgaccccgac

SEQ ID NO: 14948 - DNA, 20 bp, Artificial Sequence
  Synthetic oligonucleotide; GGG chr11 5280831 5280850 5280847 +
gtggggcactgaccccgaca

SEQ ID NO: 14949 - DNA, 20 bp, Artificial Sequence
  Synthetic oligonucleotide; GGG chr11 5280832 5280851 5280848 +
tggggcactgaccccgacag

SEQ ID NO: 14950 - DNA, 20 bp, Artificial Sequence
  Synthetic oligonucleotide; TGG chr11 5280837 5280856 5280853 +
cactgaccccgacaggggcc

SEQ ID NO: 14951 - DNA, 20 bp, Artificial Sequence
  Synthetic oligonucleotide; CAG chr11 5280841 5280860 5280857 +
gaccccgacaggggcctggc

SEQ ID NO: 14952 - DNA, 20 bp, Artificial Sequence
  Synthetic oligonucleotide; TGG chr11 5280857 5280876 5280873 +
tggccagaactgctcatgct

SEQ ID NO: 14953 - DNA, 20 bp, Artificial Sequence
  Synthetic oligonucleotide; TGG chr11 5280864 5280883 5280880 +
aactgctcatgcttggacta

SEQ ID NO: 14954 - DNA, 20 bp, Artificial Sequence
  Synthetic oligonucleotide; GGG chr11 5280865 5280884 5280881 +
actgctcatgcttggactat

SEQ ID NO: 14955 - DNA, 20 bp, Artificial Sequence
  Synthetic oligonucleotide; GAG chr11 5280867 5280886 5280883 +
tgctcatgcttggactatgg

SEQ ID NO: 14956 - DNA, 20 bp, Artificial Sequence
  Synthetic oligonucleotide; AGG chr11 5280868 5280887 5280884 +
gctcatgcttggactatggg

SEQ ID NO: 14957 - DNA, 20 bp, Artificial Sequence
  Synthetic oligonucleotide; TGG chr11 5280878 5280897 5280894 +
ggactatgggaggtcactaa

SEQ ID NO: 14958 - DNA, 20 bp, Artificial Sequence
  Synthetic oligonucleotide; GAG chr11 5280880 5280899 5280896 +
actatgggaggtcactaatg

SEQ ID NO: 14959 - DNA, 20 bp, Artificial Sequence
  Synthetic oligonucleotide; CAG chr11 5280888 5280907 5280904 +
aggtcactaatggagacaca

SEQ ID NO: 14960 - DNA, 20 bp, Artificial Sequence
  Synthetic oligonucleotide; CAG chr11 5280899 5280918 5280915 +
ggagacacacagaaatgtaa

SEQ ID NO: 14961 - DNA, 20 bp, Artificial Sequence
  Synthetic oligonucleotide; AGG chr11 5280900 5280919 5280916 +
gagacacacagaaatgtaac

SEQ ID NO: 14962 - DNA, 20 bp, Artificial Sequence
  Synthetic oligonucleotide; AAG chr11 5280907 5280926 5280923 +
acagaaatgtaacaggaact

SEQ ID NO: 14963 - DNA, 20 bp, Artificial Sequence
  Synthetic oligonucleotide; AGG chr11 5280908 5280927 5280924 +
cagaaatgtaacaggaacta

SEQ ID NO: 14964 - DNA, 20 bp, Artificial Sequence
  Synthetic oligonucleotide; AAG chr11 5280919 5280938 5280935 +
caggaactaaggaaaaactg

SEQ ID NO: 14965 - DNA, 20 bp, Artificial Sequence
  Synthetic oligonucleotide; CAG chr11 5280932 5280951 5280948 +
aaaactgaagcttatttaat

SEQ ID NO: 14966 - DNA, 20 bp, Artificial Sequence
  Synthetic oligonucleotide; GAG chr11 5280934 5280953 5280950 +
aactgaagcttatttaatca

SEQ ID NO: 14967 - DNA, 20 bp, Artificial Sequence
  Synthetic oligonucleotide; GAG chr11 5280939 5280958 5280955 +
aagcttatttaatcagagat

SEQ ID NO: 14968 - DNA, 20 bp, Artificial Sequence
  Synthetic oligonucleotide; AGG chr11 5280940 5280959 5280956 +
agcttatttaatcagagatg

SEQ ID NO: 14969 - DNA, 20 bp, Artificial Sequence
  Synthetic oligonucleotide; TGG chr11 5280947 5280966 5280963 +
ttaatcagagatgaggatgc

SEQ ID NO: 14970 - DNA, 20 bp, Artificial Sequence
  Synthetic oligonucleotide; AAG chr11 5280950 5280969 5280966 +
atcagagatgaggatgctgg

SEQ ID NO: 14971 - DNA, 20 bp, Artificial Sequence
  Synthetic oligonucleotide; AGG chr11 5280951 5280970 5280967 +
tcagagatgaggatgctgga

SEQ ID NO: 14972 - DNA, 20 bp, Artificial Sequence
  Synthetic oligonucleotide; GGG chr11 5280952 5280971 5280968 +
cagagatgaggatgctggaa

SEQ ID NO: 14973 - DNA, 20 bp, Artificial Sequence
  Synthetic oligonucleotide; TAG chr11 5280956 5280975 5280972 +
gatgaggatgctggaaggga

SEQ ID NO: 14974 - DNA, 20 bp, Artificial Sequence
  Synthetic oligonucleotide; GAG chr11 5280958 5280977 5280974 +
tgaggatgctggaagggata

SEQ ID NO: 14975 - DNA, 20 bp, Artificial Sequence
  Synthetic oligonucleotide; AGG chr11 5280959 5280978 5280975 +
gaggatgctggaagggatag

SEQ ID NO: 14976 - DNA, 20 bp, Artificial Sequence
  Synthetic oligonucleotide; GGG chr11 5280960 5280979 5280976 +
aggatgctggaagggataga

SEQ ID NO: 14977 - DNA, 20 bp, Artificial Sequence
  Synthetic oligonucleotide; GAG chr11 5280962 5280981 5280978 +
gatgctggaagggatagagg

SEQ ID NO: 14978 - DNA, 20 bp, Artificial Sequence
  Synthetic oligonucleotide; GAG chr11 5280967 5280986 5280983 +
tggaagggatagagggagct

SEQ ID NO: 14979 - DNA, 20 bp, Artificial Sequence
  Synthetic oligonucleotide; AAG chr11 5280978 5280997 5280994 +
gagggagctgagcttgtaaa

SEQ ID NO: 14980 - DNA, 20 bp, Artificial Sequence
  Synthetic oligonucleotide; TAG chr11 5280983 5281002 5280999 +
agctgagcttgtaaaaagta

SEQ ID NO: 14981 - DNA, 20 bp, Artificial Sequence
  Synthetic oligonucleotide; CAG chr11 5280994 5281013 5281010 +
taaaaagtatagtaatcatt

SEQ ID NO: 14982 - DNA, 20 bp, Artificial Sequence
  Synthetic oligonucleotide; TGG chr11 5281001 5281020 5281017 +
tatagtaatcattcagcaaa

SEQ ID NO: 14983 - DNA, 20 bp, Artificial Sequence
  Synthetic oligonucleotide; AAG chr11 5281009 5281028 5281025 +
tcattcagcaaatggttttg

SEQ ID NO: 14984 - DNA, 20 bp, Artificial Sequence
  Synthetic oligonucleotide; TGG chr11 5281019 5281038 5281035 +
aatggttttgaagcacctgc

SEQ ID NO: 14985 - DNA, 20 bp, Artificial Sequence
  Synthetic oligonucleotide; CAG chr11 5281039 5281058 5281055 +
tggatgctaaacactatttt

SEQ ID NO: 14986 - DNA, 20 bp, Artificial Sequence
  Synthetic oligonucleotide; AAG chr11 5281058 5281077 5281074 +
tcagtgcttgaatcataaat

SEQ ID NO: 14987 - DNA, 20 bp, Artificial Sequence
  Synthetic oligonucleotide; AAG chr11 5281087 5281106 5281103 +
acatgtatcttattccccac

SEQ ID NO: 14988 - DNA, 20 bp, Artificial Sequence
  Synthetic oligonucleotide; GAG chr11 5281089 5281108 5281105 +
atgtatcttattccccacaa

SEQ ID NO: 14989 - DNA, 20 bp, Artificial Sequence
  Synthetic oligonucleotide; AAG chr11 5281095 5281114 5281111 +
cttattccccacaagagtcc

SEQ ID NO: 14990 - DNA, 20 bp, Artificial Sequence
  Synthetic oligonucleotide; CAG chr11 5281108 5281127 5281124 +
agagtccaagtaaaaaataa

SEQ ID NO: 14991 - DNA, 20 bp, Artificial Sequence
  Synthetic oligonucleotide; CAG chr11 5281135 5281154 5281151 +
ttataatgtgctctgtcccc

SEQ ID NO: 14992 - DNA, 20 bp, Artificial Sequence
  Synthetic oligonucleotide; AGG chr11 5281136 5281155 5281152 +
tataatgtgctctgtccccc

SEQ ID NO: 14993 - DNA, 20 bp, Artificial Sequence
  Synthetic oligonucleotide; TGG chr11 5281140 5281159 5281156 +
atgtgctctgtcccccaggc

SEQ ID NO: 14994 - DNA, 20 bp, Artificial Sequence
  Synthetic oligonucleotide; GAG chr11 5281142 5281161 5281158 +
gtgctctgtcccccaggctg

SEQ ID NO: 14995 - DNA, 20 bp, Artificial Sequence
  Synthetic oligonucleotide; CAG chr11 5281147 5281166 5281163 +
ctgtcccccaggctggagtg

SEQ ID NO: 14996 - DNA, 20 bp, Artificial Sequence
  Synthetic oligonucleotide; TGG chr11 5281150 5281169 5281166 +
tcccccaggctggagtgcag

SEQ ID NO: 14997 - DNA, 20 bp, Artificial Sequence
  Synthetic oligonucleotide; CAG chr11 5281161 5281180 5281177 +
ggagtgcagtggcacgatct

SEQ ID NO: 14998 - DNA, 20 bp, Artificial Sequence
  Synthetic oligonucleotide; CGG chr11 5281185 5281204 5281201 +
tcactgcaacctccgcctcc

SEQ ID NO: 14999 - DNA, 20 bp, Artificial Sequence
  Synthetic oligonucleotide; GGG chr11 5281186 5281205 5281202 +
cactgcaacctccgcctccc

SEQ ID NO: 15000 - DNA, 20 bp, Artificial Sequence
  Synthetic oligonucleotide; AAG chr11 5281192 5281211 5281208 +
aacctccgcctcccgggttc

SEQ ID NO: 15001 - DNA, 20 bp, Artificial Sequence
  Synthetic oligonucleotide; CAG chr11 5281209 5281228 5281225 +
ttcaagcaattctcctgcct

SEQ ID NO: 15002 - DNA, 20 bp, Artificial Sequence
  Synthetic oligonucleotide; TAG chr11 5281221 5281240 5281237 +
tcctgcctcagccaccctaa

SEQ ID NO: 15003 - DNA, 20 bp, Artificial Sequence
  Synthetic oligonucleotide; TGG chr11 5281225 5281244 5281241 +
gcctcagccaccctaatagc

SEQ ID NO: 15004 - DNA, 20 bp, Artificial Sequence
  Synthetic oligonucleotide; GGG chr11 5281226 5281245 5281242 +
cctcagccaccctaatagct

SEQ ID NO: 15005 - DNA, 20 bp, Artificial Sequence
  Synthetic oligonucleotide; CAG chr11 5281233 5281252 5281249 +
caccctaatagctgggatta

SEQ ID NO: 15006 - DNA, 20 bp, Artificial Sequence
  Synthetic oligonucleotide; AGG chr11 5281234 5281253 5281250 +
accctaatagctgggattac

SEQ ID NO: 15007 - DNA, 20 bp, Artificial Sequence
  Synthetic oligonucleotide; CAG chr11 5281252 5281271 5281268 +
acaggtgcacaccaccatgc

SEQ ID NO: 15008 - DNA, 20 bp, Artificial Sequence
  Synthetic oligonucleotide; AGG chr11 5281253 5281272 5281269 +
caggtgcacaccaccatgcc

SEQ ID NO: 15009 - DNA, 20 bp, Artificial Sequence
  Synthetic oligonucleotide; TAG chr11 5281275 5281294 5281291 +
gctaatttttgtactttttg

SEQ ID NO: 15010 - DNA, 20 bp, Artificial Sequence
  Synthetic oligonucleotide; GAG chr11 5281277 5281296 5281293 +
taatttttgtactttttgta

SEQ ID NO: 15011 - DNA, 20 bp, Artificial Sequence
  Synthetic oligonucleotide; AGG chr11 5281278 5281297 5281294 +
aatttttgtactttttgtag

SEQ ID NO: 15012 - DNA, 20 bp, Artificial Sequence
  Synthetic oligonucleotide; CAG chr11 5281281 5281300 5281297 +
ttttgtactttttgtagagg

SEQ ID NO: 15013 - DNA, 20 bp, Artificial Sequence
  Synthetic oligonucleotide; AGG chr11 5281282 5281301 5281298 +
tttgtactttttgtagaggc

SEQ ID NO: 15014 - DNA, 20 bp, Artificial Sequence
  Synthetic oligonucleotide; GGG chr11 5281283 5281302 5281299 +
ttgtactttttgtagaggca

SEQ ID NO: 15015 - DNA, 20 bp, Artificial Sequence
  Synthetic oligonucleotide; AAG chr11 5281302 5281321 5281318 +
agggtatcaccatgttgtcc

SEQ ID NO: 15016 - DNA, 20 bp, Artificial Sequence
  Synthetic oligonucleotide; TGG chr11 5281306 5281325 5281322 +
tatcaccatgttgtccaaga

SEQ ID NO: 15017 - DNA, 20 bp, Artificial Sequence
  Synthetic oligonucleotide; GAG chr11 5281321 5281340 5281337 +
caagatggtcttgaactcct

SEQ ID NO: 15018 - DNA, 20 bp, Artificial Sequence
  Synthetic oligonucleotide; AAG chr11 5281328 5281347 5281344 +
gtcttgaactcctgagctcc

SEQ ID NO: 15019 - DNA, 20 bp, Artificial Sequence
  Synthetic oligonucleotide; CAG chr11 5281331 5281350 5281347 +
ttgaactcctgagctccaag

SEQ ID NO: 15020 - DNA, 20 bp, Artificial Sequence
  Synthetic oligonucleotide; CAG chr11 5281345 5281364 5281361 +
tccaagcagtccacccacct

SEQ ID NO: 15021 - DNA, 20 bp, Artificial Sequence
  Synthetic oligonucleotide; AAG chr11 5281355 5281374 5281371 +
ccacccacctcagcctccca

SEQ ID NO: 15022 - DNA, 20 bp, Artificial Sequence
  Synthetic oligonucleotide; TGG chr11 5281361 5281380 5281377 +
acctcagcctcccaaagtgc

SEQ ID NO: 15023 - DNA, 20 bp, Artificial Sequence
  Synthetic oligonucleotide; GGG chr11 5281362 5281381 5281378 +
cctcagcctcccaaagtgct

SEQ ID NO: 15024 - DNA, 20 bp, Artificial Sequence
  Synthetic oligonucleotide; CAG chr11 5281369 5281388 5281385 +
ctcccaaagtgctgggatta

SEQ ID NO: 15025 - DNA, 20 bp, Artificial Sequence
  Synthetic oligonucleotide; AGG chr11 5281370 5281389 5281386 +
tcccaaagtgctgggattac

SEQ ID NO: 15026 - DNA, 20 bp, Artificial Sequence
  Synthetic oligonucleotide; GAG chr11 5281376 5281395 5281392 +
agtgctgggattacaggtgt

SEQ ID NO: 15027 - DNA, 20 bp, Artificial Sequence
  Synthetic oligonucleotide; CAG chr11 5281389 5281408 5281405 +
caggtgtgagacaccatgcc

SEQ ID NO: 15028 - DNA, 20 bp, Artificial Sequence
  Synthetic oligonucleotide; TAG chr11 5281407 5281426 5281423 +
cccagattttccatatttaa

SEQ ID NO: 15029 - DNA, 20 bp, Artificial Sequence
  Synthetic oligonucleotide; GAG chr11 5281409 5281428 5281425 +
cagattttccatatttaata

SEQ ID NO: 15030 - DNA, 20 bp, Artificial Sequence
  Synthetic oligonucleotide; AGG chr11 5281410 5281429 5281426 +
agattttccatatttaatag

SEQ ID NO: 15031 - DNA, 20 bp, Artificial Sequence
  Synthetic oligonucleotide; TGG chr11 5281419 5281438 5281435 +
atatttaatagaggtattta

SEQ ID NO: 15032 - DNA, 20 bp, Artificial Sequence
  Synthetic oligonucleotide; GGG chr11 5281420 5281439 5281436 +
tatttaatagaggtatttat

SEQ ID NO: 15033 - DNA, 20 bp, Artificial Sequence
  Synthetic oligonucleotide; TGG chr11 5281424 5281443 5281440 +
taatagaggtatttatggga

SEQ ID NO: 15034 - DNA, 20 bp, Artificial Sequence
  Synthetic oligonucleotide; GGG chr11 5281425 5281444 5281441 +
aatagaggtatttatgggat

SEQ ID NO: 15035 - DNA, 20 bp, Artificial Sequence
  Synthetic oligonucleotide; GGG chr11 5281426 5281445 5281442 +
atagaggtatttatgggatg

SEQ ID NO: 15036 - DNA, 20 bp, Artificial Sequence
  Synthetic oligonucleotide; GGG chr11 5281427 5281446 5281443 +
tagaggtatttatgggatgg

SEQ ID NO: 15037 - DNA, 20 bp, Artificial Sequence
  Synthetic oligonucleotide; AAG chr11 5281432 5281451 5281448 +
gtatttatgggatgggggaa

SEQ ID NO: 15038 - DNA, 20 bp, Artificial Sequence
  Synthetic oligonucleotide; TGG chr11 5281451 5281470 5281467 +
aaagaatgtttctctcactg

SEQ ID NO: 15039 - DNA, 20 bp, Artificial Sequence
  Synthetic oligonucleotide; TAG chr11 5281461 5281480 5281477 +
tctctcactgtggattattt

SEQ ID NO: 15040 - DNA, 20 bp, Artificial Sequence
  Synthetic oligonucleotide; GAG chr11 5281463 5281482 5281479 +
tctcactgtggattatttta

SEQ ID NO: 15041 - DNA, 20 bp, Artificial Sequence
  Synthetic oligonucleotide; GAG chr11 5281465 5281484 5281481 +
tcactgtggattattttaga

SEQ ID NO: 15042 - DNA, 20 bp, Artificial Sequence
  Synthetic oligonucleotide; TGG chr11 5281468 5281487 5281484 +
ctgtggattattttagagag

SEQ ID NO: 15043 - DNA, 20 bp, Artificial Sequence
  Synthetic oligonucleotide; GAG chr11 5281470 5281489 5281486 +
gtggattattttagagagtg

SEQ ID NO: 15044 - DNA, 20 bp, Artificial Sequence
  Synthetic oligonucleotide; TGG chr11 5281475 5281494 5281491 +
ttattttagagagtggagaa

SEQ ID NO: 15045 - DNA, 20 bp, Artificial Sequence
  Synthetic oligonucleotide; AAG chr11 5281480 5281499 5281496 +
ttagagagtggagaatggtc

SEQ ID NO: 15046 - DNA, 20 bp, Artificial Sequence
  Synthetic oligonucleotide; AAG chr11 5281498 5281517 5281514 +
tcaagatttttttaaaaatt

SEQ ID NO: 15047 - DNA, 20 bp, Artificial Sequence
  Synthetic oligonucleotide; AAG chr11 5281508 5281527 5281524 +
tttaaaaattaagaaaacat

SEQ ID NO: 15048 - DNA, 20 bp, Artificial Sequence
  Synthetic oligonucleotide; TGG chr11 5281512 5281531 5281528 +
aaaattaagaaaacataagt

SEQ ID NO: 15049 - DNA, 20 bp, Artificial Sequence
  Synthetic oligonucleotide; GAG chr11 5281520 5281539 5281536 +
gaaaacataagttggacctt

SEQ ID NO: 15050 - DNA, 20 bp, Artificial Sequence
  Synthetic oligonucleotide; TGG chr11 5281545 5281564 5281561 +
atgaaaatttatttttttgt

SEQ ID NO: 15051 - DNA, 20 bp, Artificial Sequence
  Synthetic oligonucleotide; GAG chr11 5281547 5281566 5281563 +
gaaaatttatttttttgttg

SEQ ID NO: 15052 - DNA, 20 bp, Artificial Sequence
  Synthetic oligonucleotide; AGG chr11 5281548 5281567 5281564 +
aaaatttatttttttgttgg

SEQ ID NO: 15053 - DNA, 20 bp, Artificial Sequence
  Synthetic oligonucleotide; CAG chr11 5281573 5281592 5281589 +
acccattctctatctcccat

SEQ ID NO: 15054 - DNA, 20 bp, Artificial Sequence
  Synthetic oligonucleotide; AGG chr11 5281574 5281593 5281590 +
cccattctctatctcccatc

SEQ ID NO: 15055 - DNA, 20 bp, Artificial Sequence
  Synthetic oligonucleotide; GGG chr11 5281575 5281594 5281591 +
ccattctctatctcccatca

SEQ ID NO: 15056 - DNA, 20 bp, Artificial Sequence
  Synthetic oligonucleotide; AAG chr11 5281579 5281598 5281595 +
tctctatctcccatcagggc

SEQ ID NO: 15057 - DNA, 20 bp, Artificial Sequence
  Synthetic oligonucleotide; AAG chr11 5281586 5281605 5281602 +
ctcccatcagggcaagctgt

SEQ ID NO: 15058 - DNA, 20 bp, Artificial Sequence
  Synthetic oligonucleotide; AGG chr11 5281587 5281606 5281603 +
tcccatcagggcaagctgta

SEQ ID NO: 15059 - DNA, 20 bp, Artificial Sequence
  Synthetic oligonucleotide; TGG chr11 5281593 5281612 5281609 +
cagggcaagctgtaaggaac

SEQ ID NO: 15060 - DNA, 20 bp, Artificial Sequence
  Synthetic oligonucleotide; AAG chr11 5281598 5281617 5281614 +
caagctgtaaggaactggct

SEQ ID NO: 15061 - DNA, 20 bp, Artificial Sequence
  Synthetic oligonucleotide; CAG chr11 5281604 5281623 5281620 +
gtaaggaactggctaagaca

SEQ ID NO: 15062 - DNA, 20 bp, Artificial Sequence
  Synthetic oligonucleotide; GAG chr11 5281608 5281627 5281624 +
ggaactggctaagacacagt

SEQ ID NO: 15063 - DNA, 20 bp, Artificial Sequence
  Synthetic oligonucleotide; CAG chr11 5281612 5281631 5281628 +
ctggctaagacacagtgaga

SEQ ID NO: 15064 - DNA, 20 bp, Artificial Sequence
  Synthetic oligonucleotide; GAG chr11 5281614 5281633 5281630 +
ggctaagacacagtgagaca

SEQ ID NO: 15065 - DNA, 20 bp, Artificial Sequence
  Synthetic oligonucleotide; TAG chr11 5281622 5281641 5281638 +
cacagtgagacagagtgact

SEQ ID NO: 15066 - DNA, 20 bp, Artificial Sequence
  Synthetic oligonucleotide; TAG chr11 5281628 5281647 5281644 +
gagacagagtgacttagtct

SEQ ID NO: 15067 - DNA, 20 bp, Artificial Sequence
  Synthetic oligonucleotide; GAG chr11 5281630 5281649 5281646 +
gacagagtgacttagtctta

SEQ ID NO: 15068 - DNA, 20 bp, Artificial Sequence
  Synthetic oligonucleotide; AGG chr11 5281631 5281650 5281647 +
acagagtgacttagtcttag

SEQ ID NO: 15069 - DNA, 20 bp, Artificial Sequence
  Synthetic oligonucleotide; TGG chr11 5281640 5281659 5281656 +
cttagtcttagaggccccac

SEQ ID NO: 15070 - DNA, 20 bp, Artificial Sequence
  Synthetic oligonucleotide; CAG chr11 5281647 5281666 5281663 +
ttagaggccccactggtacc

SEQ ID NO: 15071 - DNA, 20 bp, Artificial Sequence
  Synthetic oligonucleotide; GAG chr11 5281652 5281671 5281668 +
ggccccactggtacccagat

SEQ ID NO: 15072 - DNA, 20 bp, Artificial Sequence
  Synthetic oligonucleotide; AAG chr11 5281655 5281674 5281671 +
cccactggtacccagatgag

SEQ ID NO: 15073 - DNA, 20 bp, Artificial Sequence
  Synthetic oligonucleotide; AGG chr11 5281656 5281675 5281672 +
ccactggtacccagatgaga

SEQ ID NO: 15074 - DNA, 20 bp, Artificial Sequence
  Synthetic oligonucleotide; CAG chr11 5281677 5281696 5281693 +
ggcaccttcatcactcatca

SEQ ID NO: 15075 - DNA, 20 bp, Artificial Sequence
  Synthetic oligonucleotide; CAG chr11 5281681 5281700 5281697 +
ccttcatcactcatcacagt

SEQ ID NO: 15076 - DNA, 20 bp, Artificial Sequence
  Synthetic oligonucleotide; CAG chr11 5281713 5281732 5281729 +
tctcctctctcctttctcat

SEQ ID NO: 15077 - DNA, 20 bp, Artificial Sequence
  Synthetic oligonucleotide; AAG chr11 5281725 5281744 5281741 +
tttctcatcagaaatttcat

SEQ ID NO: 15078 - DNA, 20 bp, Artificial Sequence
  Synthetic oligonucleotide; TAG chr11 5281733 5281752 5281749 +
cagaaatttcataagtctac

SEQ ID NO: 15079 - DNA, 20 bp, Artificial Sequence
  Synthetic oligonucleotide; AGG chr11 5281734 5281753 5281750 +
agaaatttcataagtctact

SEQ ID NO: 15080 - DNA, 20 bp, Artificial Sequence
  Synthetic oligonucleotide; GGG chr11 5281735 5281754 5281751 +
gaaatttcataagtctacta

SEQ ID NO: 15081 - DNA, 20 bp, Artificial Sequence
  Synthetic oligonucleotide; CAG chr11 5281739 5281758 5281755 +
tttcataagtctactagggt

SEQ ID NO: 15082 - DNA, 20 bp, Artificial Sequence
  Synthetic oligonucleotide; AGG chr11 5281740 5281759 5281756 +
ttcataagtctactagggtc

SEQ ID NO: 15083 - DNA, 20 bp, Artificial Sequence
  Synthetic oligonucleotide; CAG chr11 5281743 5281762 5281759 +
ataagtctactagggtcagg

SEQ ID NO: 15084 - DNA, 20 bp, Artificial Sequence
  Synthetic oligonucleotide; AAG chr11 5281753 5281772 5281769 +
tagggtcaggcagatcacat

SEQ ID NO: 15085 - DNA, 20 bp, Artificial Sequence
  Synthetic oligonucleotide; AAG chr11 5281758 5281777 5281774 +
tcaggcagatcacataagaa

SEQ ID NO: 15086 - DNA, 20 bp, Artificial Sequence
  Synthetic oligonucleotide; GAG chr11 5281760 5281779 5281776 +
aggcagatcacataagaaaa

SEQ ID NO: 15087 - DNA, 20 bp, Artificial Sequence
  Synthetic oligonucleotide; AGG chr11 5281761 5281780 5281777 +
ggcagatcacataagaaaag

SEQ ID NO: 15088 - DNA, 20 bp, Artificial Sequence
  Synthetic oligonucleotide; CAG chr11 5281768 5281787 5281784 +
cacataagaaaagaggatgc

SEQ ID NO: 15089 - DNA, 20 bp, Artificial Sequence
  Synthetic oligonucleotide; AAG chr11 5281773 5281792 5281789 +
aagaaaagaggatgccagtt

SEQ ID NO: 15090 - DNA, 20 bp, Artificial Sequence
  Synthetic oligonucleotide; AGG chr11 5281774 5281793 5281790 +
agaaaagaggatgccagtta

SEQ ID NO: 15091 - DNA, 20 bp, Artificial Sequence
  Synthetic oligonucleotide; CAG chr11 5281781 5281800 5281797 +
aggatgccagttaaggtctg

SEQ ID NO: 15092 - DNA, 20 bp, Artificial Sequence
  Synthetic oligonucleotide; GAG chr11 5281785 5281804 5281801 +
tgccagttaaggtctgcagt

SEQ ID NO: 15093 - DNA, 20 bp, Artificial Sequence
  Synthetic oligonucleotide; GAG chr11 5281791 5281810 5281807 +
ttaaggtctgcagtgagtat

SEQ ID NO: 15094 - DNA, 20 bp, Artificial Sequence
  Synthetic oligonucleotide; AAG chr11 5281811 5281830 5281827 +
gagcccatccctgatgaatt

SEQ ID NO: 15095 - DNA, 20 bp, Artificial Sequence
  Synthetic oligonucleotide; AGG chr11 5281812 5281831 5281828 +
agcccatccctgatgaatta

SEQ ID NO: 15096 - DNA, 20 bp, Artificial Sequence
  Synthetic oligonucleotide; TAG chr11 5281827 5281846 5281843 +
aattaaggcaatcaacactt

SEQ ID NO: 15097 - DNA, 20 bp, Artificial Sequence
  Synthetic oligonucleotide; AGG chr11 5281828 5281847 5281844 +
attaaggcaatcaacacttt

SEQ ID NO: 15098 - DNA, 20 bp, Artificial Sequence
  Synthetic oligonucleotide; CAG chr11 5281831 5281850 5281847 +
aaggcaatcaacactttagg

SEQ ID NO: 15099 - DNA, 20 bp, Artificial Sequence
  Synthetic oligonucleotide; GAG chr11 5281846 5281865 5281862 +
ttaggcagccatgttgccat

SEQ ID NO: 15100 - DNA, 20 bp, Artificial Sequence
  Synthetic oligonucleotide; GAG chr11 5281848 5281867 5281864 +
aggcagccatgttgccatga

SEQ ID NO: 15101 - DNA, 20 bp, Artificial Sequence
  Synthetic oligonucleotide; TAG chr11 5281853 5281872 5281869 +
gccatgttgccatgagagat

SEQ ID NO: 15102 - DNA, 20 bp, Artificial Sequence
  Synthetic oligonucleotide; AGG chr11 5281854 5281873 5281870 +
ccatgttgccatgagagatt

SEQ ID NO: 15103 - DNA, 20 bp, Artificial Sequence
  Synthetic oligonucleotide; GAG chr11 5281856 5281875 5281872 +
atgttgccatgagagattag

SEQ ID NO: 15104 - DNA, 20 bp, Artificial Sequence
  Synthetic oligonucleotide; AGG chr11 5281857 5281876 5281873 +
tgttgccatgagagattagg

SEQ ID NO: 15105 - DNA, 20 bp, Artificial Sequence
  Synthetic oligonucleotide; GGG chr11 5281858 5281877 5281874 +
gttgccatgagagattagga

SEQ ID NO: 15106 - DNA, 20 bp, Artificial Sequence
  Synthetic oligonucleotide; GGG chr11 5281859 5281878 5281875 +
ttgccatgagagattaggag

SEQ ID NO: 15107 - DNA, 20 bp, Artificial Sequence
  Synthetic oligonucleotide; GAG chr11 5281868 5281887 5281884 +
gagattaggaggggccaaat

SEQ ID NO: 15108 - DNA, 20 bp, Artificial Sequence
  Synthetic oligonucleotide; CAG chr11 5281873 5281892 5281889 +
taggaggggccaaatgagcc

SEQ ID NO: 15109 - DNA, 20 bp, Artificial Sequence
  Synthetic oligonucleotide; TAG chr11 5281893 5281912 5281909 +
cagaaataccacctacttct

SEQ ID NO: 15110 - DNA, 20 bp, Artificial Sequence
  Synthetic oligonucleotide; GAG chr11 5281904 5281923 5281920 +
cctacttcttagatgatctt

SEQ ID NO: 15111 - DNA, 20 bp, Artificial Sequence
  Synthetic oligonucleotide; AAG chr11 5281908 5281927 5281924 +
cttcttagatgatcttgagc

SEQ ID NO: 15112 - DNA, 20 bp, Artificial Sequence
  Synthetic oligonucleotide; AAG chr11 5281926 5281945 5281942 +
gcaagttgcttaacttcttg

SEQ ID NO: 15113 - DNA, 20 bp, Artificial Sequence
  Synthetic oligonucleotide; TAG chr11 5281940 5281959 5281956 +
ttcttgaagtctctgaaata

SEQ ID NO: 15114 - DNA, 20 bp, Artificial Sequence
  Synthetic oligonucleotide; AGG chr11 5281941 5281960 5281957 +
tcttgaagtctctgaaatat

SEQ ID NO: 15115 - DNA, 20 bp, Artificial Sequence
  Synthetic oligonucleotide; TAG chr11 5281958 5281977 5281974 +
tataggatgataatatgtat

SEQ ID NO: 15116 - DNA, 20 bp, Artificial Sequence
  Synthetic oligonucleotide; TAG chr11 5281965 5281984 5281981 +
tgataatatgtattagctaa

SEQ ID NO: 15117 - DNA, 20 bp, Artificial Sequence
  Synthetic oligonucleotide; GAG chr11 5281974 5281993 5281990 +
gtattagctaatagaattat

SEQ ID NO: 15118 - DNA, 20 bp, Artificial Sequence
  Synthetic oligonucleotide; AGG chr11 5281975 5281994 5281991 +
tattagctaatagaattatg

SEQ ID NO: 15119 - DNA, 20 bp, Artificial Sequence
  Synthetic oligonucleotide; GAG chr11 5281980 5281999 5281996 +
gctaatagaattatgaggat

SEQ ID NO: 15120 - DNA, 20 bp, Artificial Sequence
  Synthetic oligonucleotide; TAG chr11 5281985 5282004 5282001 +
tagaattatgaggatgagat

SEQ ID NO: 15121 - DNA, 20 bp, Artificial Sequence
  Synthetic oligonucleotide; AAG chr11 5281999 5282018 5282015 +
tgagattagtttattgtgta

SEQ ID NO: 15122 - DNA, 20 bp, Artificial Sequence
  Synthetic oligonucleotide; TAG chr11 5282005 5282024 5282021 +
tagtttattgtgtaaagaac

SEQ ID NO: 15123 - DNA, 20 bp, Artificial Sequence
  Synthetic oligonucleotide; AGG chr11 5282006 5282025 5282022 +
agtttattgtgtaaagaact

SEQ ID NO: 15124 - DNA, 20 bp, Artificial Sequence
  Synthetic oligonucleotide; GGG chr11 5282007 5282026 5282023 +
gtttattgtgtaaagaacta

SEQ ID NO: 15125 - DNA, 20 bp, Artificial Sequence
  Synthetic oligonucleotide; CAG chr11 5282013 5282032 5282029 +
tgtgtaaagaactagggaca

SEQ ID NO: 15126 - DNA, 20 bp, Artificial Sequence
  Synthetic oligonucleotide; CAG chr11 5282024 5282043 5282040 +
ctagggacacagtatatatt

SEQ ID NO: 15127 - DNA, 20 bp, Artificial Sequence
  Synthetic oligonucleotide; AAG chr11 5282028 5282047 5282044 +
ggacacagtatatattcagt

SEQ ID NO: 15128 - DNA, 20 bp, Artificial Sequence
  Synthetic oligonucleotide; CAG chr11 5282043 5282062 5282059 +
tcagtaagtgttttctgtta

SEQ ID NO: 15129 - DNA, 20 bp, Artificial Sequence
  Synthetic oligonucleotide; CAG chr11 5282077 5282096 5282093 +
atatatacatgcaactatta

SEQ ID NO: 15130 - DNA, 20 bp, Artificial Sequence
  Synthetic oligonucleotide; AAG chr11 5282095 5282114 5282111 +
tacagttgcatgctacctta

SEQ ID NO: 15131 - DNA, 20 bp, Artificial Sequence
  Synthetic oligonucleotide; TGG chr11 5282104 5282123 5282120 +
atgctaccttaaagaataat

SEQ ID NO: 15132 - DNA, 20 bp, Artificial Sequence
  Synthetic oligonucleotide; GAG chr11 5282106 5282125 5282122 +
gctaccttaaagaataattg

SEQ ID NO: 15133 - DNA, 20 bp, Artificial Sequence
  Synthetic oligonucleotide; AGG chr11 5282107 5282126 5282123 +
ctaccttaaagaataattgg

SEQ ID NO: 15134 - DNA, 20 bp, Artificial Sequence
  Synthetic oligonucleotide; CAG chr11 5282112 5282131 5282128 +
ttaaagaataattggaggta

SEQ ID NO: 15135 - DNA, 20 bp, Artificial Sequence
  Synthetic oligonucleotide; CGG chr11 5282120 5282139 5282136 +
taattggaggtacagttatt

SEQ ID NO: 15136 - DNA, 20 bp, Artificial Sequence
  Synthetic oligonucleotide; GAG chr11 5282122 5282141 5282138 +
attggaggtacagttattcg

SEQ ID NO: 15137 - DNA, 20 bp, Artificial Sequence
  Synthetic oligonucleotide; AGG chr11 5282123 5282142 5282139 +
ttggaggtacagttattcgg

SEQ ID NO: 15138 - DNA, 20 bp, Artificial Sequence
  Synthetic oligonucleotide; TGG chr11 5282146 5282165 5282162 +
tatttcttgactgttaatgt

SEQ ID NO: 15139 - DNA, 20 bp, Artificial Sequence
  Synthetic oligonucleotide; CAG chr11 5282149 5282168 5282165 +
ttcttgactgttaatgttgg

SEQ ID NO: 15140 - DNA, 20 bp, Artificial Sequence
  Synthetic oligonucleotide; CAG chr11 5282152 5282171 5282168 +
ttgactgttaatgttggcag

SEQ ID NO: 15141 - DNA, 20 bp, Artificial Sequence
  Synthetic oligonucleotide; CAG chr11 5282158 5282177 5282174 +
gttaatgttggcagcagatt

SEQ ID NO: 15142 - DNA, 20 bp, Artificial Sequence
  Synthetic oligonucleotide; CAG chr11 5282180 5282199 5282196 +
gcttattttacaacactatt

SEQ ID NO: 15143 - DNA, 20 bp, Artificial Sequence
  Synthetic oligonucleotide; TAG chr11 5282202 5282221 5282218 +
gacctctcacaataattccc

SEQ ID NO: 15144 - DNA, 20 bp, Artificial Sequence
  Synthetic oligonucleotide; AGG chr11 5282203 5282222 5282219 +
acctctcacaataattccct

SEQ ID NO: 15145 - DNA, 20 bp, Artificial Sequence
  Synthetic oligonucleotide; GAG chr11 5282205 5282224 5282221 +
ctctcacaataattccctag

SEQ ID NO: 15146 - DNA, 20 bp, Artificial Sequence
  Synthetic oligonucleotide; TAG chr11 5282213 5282232 5282229 +
ataattccctaggagatatt

SEQ ID NO: 15147 - DNA, 20 bp, Artificial Sequence
  Synthetic oligonucleotide; AAG chr11 5282221 5282240 5282237 +
ctaggagatatttagacaac

SEQ ID NO: 15148 - DNA, 20 bp, Artificial Sequence
  Synthetic oligonucleotide; AAG chr11 5282304 5282323 5282320 +
tttgctctctgttcctgtga

SEQ ID NO: 15149 - DNA, 20 bp, Artificial Sequence
  Synthetic oligonucleotide; TAG chr11 5282319 5282338 5282335 +
tgtgaaagtacccttctact

SEQ ID NO: 15150 - DNA, 20 bp, Artificial Sequence
  Synthetic oligonucleotide; CAG chr11 5282334 5282353 5282350 +
ctacttagcctacttttgac

SEQ ID NO: 15151 - DNA, 20 bp, Artificial Sequence
  Synthetic oligonucleotide; TGG chr11 5282349 5282368 5282365 +
ttgaccagtgtgcatgtcac

SEQ ID NO: 15152 - DNA, 20 bp, Artificial Sequence
  Synthetic oligonucleotide; GGG chr11 5282350 5282369 5282366 +
tgaccagtgtgcatgtcact

SEQ ID NO: 15153 - DNA, 20 bp, Artificial Sequence
  Synthetic oligonucleotide; AAG chr11 5282359 5282378 5282375 +
tgcatgtcactgggcaatac

SEQ ID NO: 15154 - DNA, 20 bp, Artificial Sequence
  Synthetic oligonucleotide; GAG chr11 5282368 5282387 5282384 +
ctgggcaatacaagacctct

SEQ ID NO: 15155 - DNA, 20 bp, Artificial Sequence
  Synthetic oligonucleotide; TGG chr11 5282374 5282393 5282390 +
aatacaagacctctgagctt

SEQ ID NO: 15156 - DNA, 20 bp, Artificial Sequence
  Synthetic oligonucleotide; TAG chr11 5282379 5282398 5282395 +
aagacctctgagctttggct

SEQ ID NO: 15157 - DNA, 20 bp, Artificial Sequence
  Synthetic oligonucleotide; AAG chr11 5282382 5282401 5282398 +
acctctgagctttggcttag

SEQ ID NO: 15158 - DNA, 20 bp, Artificial Sequence
  Synthetic oligonucleotide; AGG chr11 5282383 5282402 5282399 +
cctctgagctttggcttaga

SEQ ID NO: 15159 - DNA, 20 bp, Artificial Sequence
  Synthetic oligonucleotide; TGG chr11 5282397 5282416 5282413 +
cttagaaggaaatacaataa

SEQ ID NO: 15160 - DNA, 20 bp, Artificial Sequence
  Synthetic oligonucleotide; GAG chr11 5282409 5282428 5282425 +
tacaataatggctaattttt

SEQ ID NO: 15161 - DNA, 20 bp, Artificial Sequence
  Synthetic oligonucleotide; AAG chr11 5282413 5282432 5282429 +
ataatggctaatttttgaga

SEQ ID NO: 15162 - DNA, 20 bp, Artificial Sequence
  Synthetic oligonucleotide; GAG chr11 5282415 5282434 5282431 +
aatggctaatttttgagaaa

SEQ ID NO: 15163 - DNA, 20 bp, Artificial Sequence
  Synthetic oligonucleotide; AGG chr11 5282416 5282435 5282432 +
atggctaatttttgagaaag

SEQ ID NO: 15164 - DNA, 20 bp, Artificial Sequence
  Synthetic oligonucleotide; TAG chr11 5282424 5282443 5282440 +
tttttgagaaagaggaactc

SEQ ID NO: 15165 - DNA, 20 bp, Artificial Sequence
  Synthetic oligonucleotide; CAG chr11 5282432 5282451 5282448 +
aaagaggaactctagcccat

SEQ ID NO: 15166 - DNA, 20 bp, Artificial Sequence
  Synthetic oligonucleotide; AGG chr11 5282433 5282452 5282449 +
aagaggaactctagcccatc

SEQ ID NO: 15167 - DNA, 20 bp, Artificial Sequence
  Synthetic oligonucleotide; GGG chr11 5282434 5282453 5282450 +
agaggaactctagcccatca

SEQ ID NO: 15168 - DNA, 20 bp, Artificial Sequence
  Synthetic oligonucleotide; AAG chr11 5282437 5282456 5282453 +
ggaactctagcccatcaggg

SEQ ID NO: 15169 - DNA, 20 bp, Artificial Sequence
  Synthetic oligonucleotide; TAG chr11 5282443 5282462 5282459 +
ctagcccatcagggaagaca

SEQ ID NO: 15170 - DNA, 20 bp, Artificial Sequence
  Synthetic oligonucleotide; AGG chr11 5282444 5282463 5282460 +
tagcccatcagggaagacat

SEQ ID NO: 15171 - DNA, 20 bp, Artificial Sequence
  Synthetic oligonucleotide; GGG chr11 5282445 5282464 5282461 +
agcccatcagggaagacata

SEQ ID NO: 15172 - DNA, 20 bp, Artificial Sequence
  Synthetic oligonucleotide; GAG chr11 5282447 5282466 5282463 +
cccatcagggaagacatagg

SEQ ID NO: 15173 - DNA, 20 bp, Artificial Sequence
  Synthetic oligonucleotide; TAG chr11 5282455 5282474 5282471 +
ggaagacatagggagttctg

SEQ ID NO: 15174 - DNA, 20 bp, Artificial Sequence
  Synthetic oligonucleotide; AGG chr11 5282456 5282475 5282472 +
gaagacatagggagttctgt

SEQ ID NO: 15175 - DNA, 20 bp, Artificial Sequence
  Synthetic oligonucleotide; GAG chr11 5282462 5282481 5282478 +
atagggagttctgtaggaat

SEQ ID NO: 15176 - DNA, 20 bp, Artificial Sequence
  Synthetic oligonucleotide; CAG chr11 5282482 5282501 5282498 +
gagttcttccattcttttta

SEQ ID NO: 15177 - DNA, 20 bp, Artificial Sequence
  Synthetic oligonucleotide; GAG chr11 5282487 5282506 5282503 +
cttccattctttttacagat

SEQ ID NO: 15178 - DNA, 20 bp, Artificial Sequence
  Synthetic oligonucleotide; AAG chr11 5282491 5282510 5282507 +
cattctttttacagatgaga

SEQ ID NO: 15179 - DNA, 20 bp, Artificial Sequence
  Synthetic oligonucleotide; AAG chr11 5282502 5282521 5282518 +
cagatgagaaagacaatgtg

SEQ ID NO: 15180 - DNA, 20 bp, Artificial Sequence
  Synthetic oligonucleotide; AAG chr11 5282520 5282539 5282536 +
tgaagccccaaatgatttta

SEQ ID NO: 15181 - DNA, 20 bp, Artificial Sequence
  Synthetic oligonucleotide; TAG chr11 5282523 5282542 5282539 +
agccccaaatgattttaaag

SEQ ID NO: 15182 - DNA, 20 bp, Artificial Sequence
  Synthetic oligonucleotide; TAG chr11 5282527 5282546 5282543 +
ccaaatgattttaaagtagt

SEQ ID NO: 15183 - DNA, 20 bp, Artificial Sequence
  Synthetic oligonucleotide; TGG chr11 5282534 5282553 5282550 +
attttaaagtagttagcata

SEQ ID NO: 15184 - DNA, 20 bp, Artificial Sequence
  Synthetic oligonucleotide; GAG chr11 5282536 5282555 5282552 +
tttaaagtagttagcatatg

SEQ ID NO: 15185 - DNA, 20 bp, Artificial Sequence
  Synthetic oligonucleotide; TGG chr11 5282542 5282561 5282558 +
gtagttagcatatggagaaa

SEQ ID NO: 15186 - DNA, 20 bp, Artificial Sequence
  Synthetic oligonucleotide; TGG chr11 5282552 5282571 5282568 +
tatggagaaatggcttgcat

SEQ ID NO: 15187 - DNA, 20 bp, Artificial Sequence
  Synthetic oligonucleotide; TGG chr11 5282562 5282581 5282578 +
tggcttgcattggtaaaatt

SEQ ID NO: 15188 - DNA, 20 bp, Artificial Sequence
  Synthetic oligonucleotide; GGG chr11 5282563 5282582 5282579 +
ggcttgcattggtaaaattt

SEQ ID NO: 15189 - DNA, 20 bp, Artificial Sequence
  Synthetic oligonucleotide; GGG chr11 5282564 5282583 5282580 +
gcttgcattggtaaaatttg

SEQ ID NO: 15190 - DNA, 20 bp, Artificial Sequence
  Synthetic oligonucleotide; CAG chr11 5282579 5282598 5282595 +
atttggggaaactttgttgt

SEQ ID NO: 15191 - DNA, 20 bp, Artificial Sequence
  Synthetic oligonucleotide; CGG chr11 5282585 5282604 5282601 +
ggaaactttgttgtcagacc

SEQ ID NO: 15192 - DNA, 20 bp, Artificial Sequence
  Synthetic oligonucleotide; AAG chr11 5282590 5282609 5282606 +
ctttgttgtcagacccggca

SEQ ID NO: 15193 - DNA, 20 bp, Artificial Sequence
  Synthetic oligonucleotide; AGG chr11 5282591 5282610 5282607 +
tttgttgtcagacccggcaa

SEQ ID NO: 15194 - DNA, 20 bp, Artificial Sequence
  Synthetic oligonucleotide; GGG chr11 5282592 5282611 5282608 +
ttgttgtcagacccggcaaa

SEQ ID NO: 15195 - DNA, 20 bp, Artificial Sequence
  Synthetic oligonucleotide; GAG chr11 5282594 5282613 5282610 +
gttgtcagacccggcaaagg

SEQ ID NO: 15196 - DNA, 20 bp, Artificial Sequence
  Synthetic oligonucleotide; CAG chr11 5282600 5282619 5282616 +
agacccggcaaagggagatg

SEQ ID NO: 15197 - DNA, 20 bp, Artificial Sequence
  Synthetic oligonucleotide; GAG chr11 5282602 5282621 5282618 +
acccggcaaagggagatgca

SEQ ID NO: 15198 - DNA, 20 bp, Artificial Sequence
  Synthetic oligonucleotide; CAG chr11 5282611 5282630 5282627 +
agggagatgcagagaatctg

SEQ ID NO: 15199 - DNA, 20 bp, Artificial Sequence
  Synthetic oligonucleotide; CAG chr11 5282642 5282661 5282658 +
catttcttgtgtacctatca

SEQ ID NO: 15200 - DNA, 20 bp, Artificial Sequence
  Synthetic oligonucleotide; CAG chr11 5282650 5282669 5282666 +
gtgtacctatcacagcacca

SEQ ID NO: 15201 - DNA, 20 bp, Artificial Sequence
  Synthetic oligonucleotide; TAG chr11 5282662 5282681 5282678 +
cagcaccacagcactattcc

SEQ ID NO: 15202 - DNA, 20 bp, Artificial Sequence
  Synthetic oligonucleotide; TAG chr11 5282667 5282686 5282683 +
ccacagcactattcctagca

SEQ ID NO: 15203 - DNA, 20 bp, Artificial Sequence
  Synthetic oligonucleotide; TAG chr11 5282672 5282691 5282688 +
gcactattcctagcatagtt

SEQ ID NO: 15204 - DNA, 20 bp, Artificial Sequence
  Synthetic oligonucleotide; AGG chr11 5282673 5282692 5282689 +
cactattcctagcatagttt

SEQ ID NO: 15205 - DNA, 20 bp, Artificial Sequence
  Synthetic oligonucleotide; GGG chr11 5282674 5282693 5282690 +
actattcctagcatagttta

SEQ ID NO: 15206 - DNA, 20 bp, Artificial Sequence
  Synthetic oligonucleotide; CAG chr11 5282681 5282700 5282697 +
ctagcatagtttagggccct

SEQ ID NO: 15207 - DNA, 20 bp, Artificial Sequence
  Synthetic oligonucleotide; TAG chr11 5282694 5282713 5282710 +
gggccctcagttcttgacgc

SEQ ID NO: 15208 - DNA, 20 bp, Artificial Sequence
  Synthetic oligonucleotide; TAG chr11 5282698 5282717 5282714 +
cctcagttcttgacgctagt

SEQ ID NO: 15209 - DNA, 20 bp, Artificial Sequence
  Synthetic oligonucleotide; TAG chr11 5282721 5282740 5282737 +
aatttcacacaaacttaaac

SEQ ID NO: 15210 - DNA, 20 bp, Artificial Sequence
  Synthetic oligonucleotide; GAG chr11 5282744 5282763 5282760 +
acaaacatatgtatgtttct

SEQ ID NO: 15211 - DNA, 20 bp, Artificial Sequence
  Synthetic oligonucleotide; AGG chr11 5282745 5282764 5282761 +
caaacatatgtatgtttctg

SEQ ID NO: 15212 - DNA, 20 bp, Artificial Sequence
  Synthetic oligonucleotide; GAG chr11 5282752 5282771 5282768 +
atgtatgtttctgaggcact

SEQ ID NO: 15213 - DNA, 20 bp, Artificial Sequence
  Synthetic oligonucleotide; AGG chr11 5282753 5282772 5282769 +
tgtatgtttctgaggcactg

SEQ ID NO: 15214 - DNA, 20 bp, Artificial Sequence
  Synthetic oligonucleotide; CAG chr11 5282762 5282781 5282778 +
ctgaggcactgaggtcactg

SEQ ID NO: 15215 - DNA, 20 bp, Artificial Sequence
  Synthetic oligonucleotide; AGG chr11 5282763 5282782 5282779 +
tgaggcactgaggtcactgc

SEQ ID NO: 15216 - DNA, 20 bp, Artificial Sequence
  Synthetic oligonucleotide; AAG chr11 5282769 5282788 5282785 +
actgaggtcactgcaggatg

SEQ ID NO: 15217 - DNA, 20 bp, Artificial Sequence
  Synthetic oligonucleotide; CGG chr11 5282773 5282792 5282789 +
aggtcactgcaggatgaaga

SEQ ID NO: 15218 - DNA, 20 bp, Artificial Sequence
  Synthetic oligonucleotide; GAG chr11 5282775 5282794 5282791 +
gtcactgcaggatgaagacg

SEQ ID NO: 15219 - DNA, 20 bp, Artificial Sequence
  Synthetic oligonucleotide; TGG chr11 5282782 5282801 5282798 +
caggatgaagacggagccaa

SEQ ID NO: 15220 - DNA, 20 bp, Artificial Sequence
  Synthetic oligonucleotide; GGG chr11 5282783 5282802 5282799 +
aggatgaagacggagccaat

SEQ ID NO: 15221 - DNA, 20 bp, Artificial Sequence
  Synthetic oligonucleotide; TAG chr11 5282787 5282806 5282803 +
tgaagacggagccaatgggt

SEQ ID NO: 15222 - DNA, 20 bp, Artificial Sequence
  Synthetic oligonucleotide; CAG chr11 5282792 5282811 5282808 +
acggagccaatgggttagac

SEQ ID NO: 15223 - DNA, 20 bp, Artificial Sequence
  Synthetic oligonucleotide; AAG chr11 5282795 5282814 5282811 +
gagccaatgggttagaccag

SEQ ID NO: 15224 - DNA, 20 bp, Artificial Sequence
  Synthetic oligonucleotide; GAG chr11 5282797 5282816 5282813 +
gccaatgggttagaccagaa

SEQ ID NO: 15225 - DNA, 20 bp, Artificial Sequence
  Synthetic oligonucleotide; AAG chr11 5282839 5282858 5282855 +
ataaacactccctttaacca

SEQ ID NO: 15226 - DNA, 20 bp, Artificial Sequence
  Synthetic oligonucleotide; CAG chr11 5282845 5282864 5282861 +
actccctttaaccaaagttg

SEQ ID NO: 15227 - DNA, 20 bp, Artificial Sequence
  Synthetic oligonucleotide; AAG chr11 5282855 5282874 5282871 +
accaaagttgcagcttgacc

SEQ ID NO: 15228 - DNA, 20 bp, Artificial Sequence
  Synthetic oligonucleotide; AGG chr11 5282856 5282875 5282872 +
ccaaagttgcagcttgacca

SEQ ID NO: 15229 - DNA, 20 bp, Artificial Sequence
  Synthetic oligonucleotide; GGG chr11 5282857 5282876 5282873 +
caaagttgcagcttgaccaa

SEQ ID NO: 15230 - DNA, 20 bp, Artificial Sequence
  Synthetic oligonucleotide; GGG chr11 5282858 5282877 5282874 +
aaagttgcagcttgaccaag

SEQ ID NO: 15231 - DNA, 20 bp, Artificial Sequence
  Synthetic oligonucleotide; AAG chr11 5282864 5282883 5282880 +
gcagcttgaccaaggggtca

SEQ ID NO: 15232 - DNA, 20 bp, Artificial Sequence
  Synthetic oligonucleotide; AGG chr11 5282865 5282884 5282881 +
cagcttgaccaaggggtcaa

SEQ ID NO: 15233 - DNA, 20 bp, Artificial Sequence
  Synthetic oligonucleotide; GGG chr11 5282866 5282885 5282882 +
agcttgaccaaggggtcaaa

SEQ ID NO: 15234 - DNA, 20 bp, Artificial Sequence
  Synthetic oligonucleotide; TGG chr11 5282874 5282893 5282890 +
caaggggtcaaagggtaatt

SEQ ID NO: 15235 - DNA, 20 bp, Artificial Sequence
  Synthetic oligonucleotide; GGG chr11 5282875 5282894 5282891 +
aaggggtcaaagggtaattt

SEQ ID NO: 15236 - DNA, 20 bp, Artificial Sequence
  Synthetic oligonucleotide; CAG chr11 5282878 5282897 5282894 +
gggtcaaagggtaatttggg

SEQ ID NO: 15237 - DNA, 20 bp, Artificial Sequence
  Synthetic oligonucleotide; AGG chr11 5282879 5282898 5282895 +
ggtcaaagggtaatttgggc

SEQ ID NO: 15238 - DNA, 20 bp, Artificial Sequence
  Synthetic oligonucleotide; TGG chr11 5282884 5282903 5282900 +
aagggtaatttgggcaggca

SEQ ID NO: 15239 - DNA, 20 bp, Artificial Sequence
  Synthetic oligonucleotide; GGG chr11 5282885 5282904 5282901 +
agggtaatttgggcaggcat

SEQ ID NO: 15240 - DNA, 20 bp, Artificial Sequence
  Synthetic oligonucleotide; CAG chr11 5282892 5282911 5282908 +
tttgggcaggcatgggcctt

SEQ ID NO: 15241 - DNA, 20 bp, Artificial Sequence
  Synthetic oligonucleotide; AAG chr11 5282902 5282921 5282918 +
catgggccttcagttttctc

SEQ ID NO: 15242 - DNA, 20 bp, Artificial Sequence
  Synthetic oligonucleotide; AAG chr11 5282945 5282964 5282961 +
tatgacaatctctgtaaccc

SEQ ID NO: 15243 - DNA, 20 bp, Artificial Sequence
  Synthetic oligonucleotide; GAG chr11 5282947 5282966 5282963 +
tgacaatctctgtaacccaa

SEQ ID NO: 15244 - DNA, 20 bp, Artificial Sequence
  Synthetic oligonucleotide; AAG chr11 5282967 5282986 5282983 +
gagaaaatctctttattctg

SEQ ID NO: 15245 - DNA, 20 bp, Artificial Sequence
  Synthetic oligonucleotide; AAG chr11 5283016 5283035 5283032 +
ttctccctcaaactttcctg

SEQ ID NO: 15246 - DNA, 20 bp, Artificial Sequence
  Synthetic oligonucleotide; TGG chr11 5283030 5283049 5283046 +
ttcctgaagaaatgcaatta

SEQ ID NO: 15247 - DNA, 20 bp, Artificial Sequence
  Synthetic oligonucleotide; GAG chr11 5283035 5283054 5283051 +
gaagaaatgcaattatggtt

SEQ ID NO: 15248 - DNA, 20 bp, Artificial Sequence
  Synthetic oligonucleotide; AGG chr11 5283036 5283055 5283052 +
aagaaatgcaattatggttg

SEQ ID NO: 15249 - DNA, 20 bp, Artificial Sequence
  Synthetic oligonucleotide; AAG chr11 5283039 5283058 5283055 +
aaatgcaattatggttgagg

SEQ ID NO: 15250 - DNA, 20 bp, Artificial Sequence
  Synthetic oligonucleotide; TGG chr11 5283044 5283063 5283060 +
caattatggttgaggaagta

SEQ ID NO: 15251 - DNA, 20 bp, Artificial Sequence
  Synthetic oligonucleotide; TGG chr11 5283057 5283076 5283073 +
ggaagtatggtctgcaactg

SEQ ID NO: 15252 - DNA, 20 bp, Artificial Sequence
  Synthetic oligonucleotide; TGG chr11 5283062 5283081 5283078 +
tatggtctgcaactgtggct

SEQ ID NO: 15253 - DNA, 20 bp, Artificial Sequence
  Synthetic oligonucleotide; AAG chr11 5283084 5283103 5283100 +
gaccacaacttccaatcgac

SEQ ID NO: 15254 - DNA, 20 bp, Artificial Sequence
  Synthetic oligonucleotide; AAG chr11 5283087 5283106 5283103 +
cacaacttccaatcgacaag

SEQ ID NO: 15255 - DNA, 20 bp, Artificial Sequence
  Synthetic oligonucleotide; AAG chr11 5283093 5283112 5283109 +
ttccaatcgacaagaagtaa

SEQ ID NO: 15256 - DNA, 20 bp, Artificial Sequence
  Synthetic oligonucleotide; AAG chr11 5283097 5283116 5283113 +
aatcgacaagaagtaaaagt

SEQ ID NO: 15257 - DNA, 20 bp, Artificial Sequence
  Synthetic oligonucleotide; AAG chr11 5283100 5283119 5283116 +
cgacaagaagtaaaagtaag

SEQ ID NO: 15258 - DNA, 20 bp, Artificial Sequence
  Synthetic oligonucleotide; AAG chr11 5283104 5283123 5283120 +
aagaagtaaaagtaagaagc

SEQ ID NO: 15259 - DNA, 20 bp, Artificial Sequence
  Synthetic oligonucleotide; AGG chr11 5283105 5283124 5283121 +
agaagtaaaagtaagaagca

SEQ ID NO: 15260 - DNA, 20 bp, Artificial Sequence
  Synthetic oligonucleotide; GGG chr11 5283106 5283125 5283122 +
gaagtaaaagtaagaagcaa

SEQ ID NO: 15261 - DNA, 20 bp, Artificial Sequence
  Synthetic oligonucleotide; CAG chr11 5283112 5283131 5283128 +
aaagtaagaagcaagggcca

SEQ ID NO: 15262 - DNA, 20 bp, Artificial Sequence
  Synthetic oligonucleotide; AGG chr11 5283113 5283132 5283129 +
aagtaagaagcaagggccac

SEQ ID NO: 15263 - DNA, 20 bp, Artificial Sequence
  Synthetic oligonucleotide; GGG chr11 5283114 5283133 5283130 +
agtaagaagcaagggccaca

SEQ ID NO: 15264 - DNA, 20 bp, Artificial Sequence
  Synthetic oligonucleotide; CAG chr11 5283117 5283136 5283133 +
aagaagcaagggccacaggg

SEQ ID NO: 15265 - DNA, 20 bp, Artificial Sequence
  Synthetic oligonucleotide; AGG chr11 5283118 5283137 5283134 +
agaagcaagggccacagggc

SEQ ID NO: 15266 - DNA, 20 bp, Artificial Sequence
  Synthetic oligonucleotide; GAG chr11 5283157 5283176 5283173 +
ttctcgcatccacaatatct

SEQ ID NO: 15267 - DNA, 20 bp, Artificial Sequence
  Synthetic oligonucleotide; TGG chr11 5283174 5283193 5283190 +
tctgagtttgtgttttgctg

SEQ ID NO: 15268 - DNA, 20 bp, Artificial Sequence
  Synthetic oligonucleotide; CAG chr11 5283192 5283211 5283208 +
tgtggaaaaaacactgtctt

SEQ ID NO: 15269 - DNA, 20 bp, Artificial Sequence
  Synthetic oligonucleotide; GAG chr11 5283194 5283213 5283210 +
tggaaaaaacactgtcttca

SEQ ID NO: 15270 - DNA, 20 bp, Artificial Sequence
  Synthetic oligonucleotide; AGG chr11 5283195 5283214 5283211 +
ggaaaaaacactgtcttcag

SEQ ID NO: 15271 - DNA, 20 bp, Artificial Sequence
  Synthetic oligonucleotide; TAG chr11 5283198 5283217 5283214 +
aaaaacactgtcttcagagg

SEQ ID NO: 15272 - DNA, 20 bp, Artificial Sequence
  Synthetic oligonucleotide; CAG chr11 5283201 5283220 5283217 +
aacactgtcttcagaggtag

SEQ ID NO: 15273 - DNA, 20 bp, Artificial Sequence
  Synthetic oligonucleotide; TGG chr11 5283207 5283226 5283223 +
gtcttcagaggtagcagaac

SEQ ID NO: 15274 - DNA, 20 bp, Artificial Sequence
  Synthetic oligonucleotide; GGG chr11 5283208 5283227 5283224 +
tcttcagaggtagcagaact

SEQ ID NO: 15275 - DNA, 20 bp, Artificial Sequence
  Synthetic oligonucleotide; TAG chr11 5283220 5283239 5283236 +
gcagaactgggtctacatcc

SEQ ID NO: 15276 - DNA, 20 bp, Artificial Sequence
  Synthetic oligonucleotide; TGG chr11 5283233 5283252 5283249 +
tacatcctagccttactact

SEQ ID NO: 15277 - DNA, 20 bp, Artificial Sequence
  Synthetic oligonucleotide; TGG chr11 5283236 5283255 5283252 +
atcctagccttactacttgg

SEQ ID NO: 15278 - DNA, 20 bp, Artificial Sequence
  Synthetic oligonucleotide; AAG chr11 5283245 5283264 5283261 +
ttactacttggtggttctgt

SEQ ID NO: 15279 - DNA, 20 bp, Artificial Sequence
  Synthetic oligonucleotide; TGG chr11 5283250 5283269 5283266 +
acttggtggttctgtaagct

SEQ ID NO: 15280 - DNA, 20 bp, Artificial Sequence
  Synthetic oligonucleotide; GAG chr11 5283280 5283299 5283296 +
atttcatgtctttgattttc

SEQ ID NO: 15281 - DNA, 20 bp, Artificial Sequence
  Synthetic oligonucleotide; CAG chr11 5283287 5283306 5283303 +
gtctttgattttcgagtccc

SEQ ID NO: 15282 - DNA, 20 bp, Artificial Sequence
  Synthetic oligonucleotide; AAG chr11 5283295 5283314 5283311 +
ttttcgagtccccagttaat

SEQ ID NO: 15283 - DNA, 20 bp, Artificial Sequence
  Synthetic oligonucleotide; GAG chr11 5283297 5283316 5283313 +
ttcgagtccccagttaataa

SEQ ID NO: 15284 - DNA, 20 bp, Artificial Sequence
  Synthetic oligonucleotide; TAG chr11 5283311 5283330 5283327 +
taataagagctcatgtaatg

SEQ ID NO: 15285 - DNA, 20 bp, Artificial Sequence
  Synthetic oligonucleotide; CAG chr11 5283315 5283334 5283331 +
aagagctcatgtaatgtaga

SEQ ID NO: 15286 - DNA, 20 bp, Artificial Sequence
  Synthetic oligonucleotide; TAG chr11 5283318 5283337 5283334 +
agctcatgtaatgtagacag

SEQ ID NO: 15287 - DNA, 20 bp, Artificial Sequence
  Synthetic oligonucleotide; AGG chr11 5283319 5283338 5283335 +
gctcatgtaatgtagacagt

SEQ ID NO: 15288 - DNA, 20 bp, Artificial Sequence
  Synthetic oligonucleotide; GAG chr11 5283321 5283340 5283337 +
tcatgtaatgtagacagtag

SEQ ID NO: 15289 - DNA, 20 bp, Artificial Sequence
  Synthetic oligonucleotide; GAG chr11 5283323 5283342 5283339 +
atgtaatgtagacagtagga

SEQ ID NO: 15290 - DNA, 20 bp, Artificial Sequence
  Synthetic oligonucleotide; CAG chr11 5283328 5283347 5283344 +
atgtagacagtaggagagct

SEQ ID NO: 15291 - DNA, 20 bp, Artificial Sequence
  Synthetic oligonucleotide; TAG chr11 5283366 5283385 5283382 +
attactaattgtctacttat

SEQ ID NO: 15292 - DNA, 20 bp, Artificial Sequence
  Synthetic oligonucleotide; AAG chr11 5283383 5283402 5283399 +
tattagcttgtgctttcaat

SEQ ID NO: 15293 - DNA, 20 bp, Artificial Sequence
  Synthetic oligonucleotide; AAG chr11 5283400 5283419 5283416 +
aataagttgatctacactac

SEQ ID NO: 15294 - DNA, 20 bp, Artificial Sequence
  Synthetic oligonucleotide; TGG chr11 5283408 5283427 5283424 +
gatctacactacaagtacat

SEQ ID NO: 15295 - DNA, 20 bp, Artificial Sequence
  Synthetic oligonucleotide; GGG chr11 5283409 5283428 5283425 +
atctacactacaagtacatt

SEQ ID NO: 15296 - DNA, 20 bp, Artificial Sequence
  Synthetic oligonucleotide; GAG chr11 5283428 5283447 5283444 +
tgggctcctcatcaataaat

SEQ ID NO: 15297 - DNA, 20 bp, Artificial Sequence
  Synthetic oligonucleotide; AGG chr11 5283429 5283448 5283445 +
gggctcctcatcaataaatg

SEQ ID NO: 15298 - DNA, 20 bp, Artificial Sequence
  Synthetic oligonucleotide; GAG chr11 5283447 5283466 5283463 +
tgaggtaataatctacttct

SEQ ID NO: 15299 - DNA, 20 bp, Artificial Sequence
  Synthetic oligonucleotide; TGG chr11 5283453 5283472 5283469 +
aataatctacttctgagtat

SEQ ID NO: 15300 - DNA, 20 bp, Artificial Sequence
  Synthetic oligonucleotide; GAG chr11 5283459 5283478 5283475 +
ctacttctgagtattggtgt

SEQ ID NO: 15301 - DNA, 20 bp, Artificial Sequence
  Synthetic oligonucleotide; AAG chr11 5283469 5283488 5283485 +
gtattggtgtgagtaaaact

SEQ ID NO: 15302 - DNA, 20 bp, Artificial Sequence
  Synthetic oligonucleotide; GAG chr11 5283506 5283525 5283522 +
aaacttcttttttttttttt

SEQ ID NO: 15303 - DNA, 20 bp, Artificial Sequence
  Synthetic oligonucleotide; TGG chr11 5283510 5283529 5283526 +
ttctttttttttttttgaga

SEQ ID NO: 15304 - DNA, 20 bp, Artificial Sequence
  Synthetic oligonucleotide; GAG chr11 5283512 5283531 5283528 +
ctttttttttttttgagatg

SEQ ID NO: 15305 - DNA, 20 bp, Artificial Sequence
  Synthetic oligonucleotide; TAG chr11 5283530 5283549 5283546 +
tggagtctcactctgtcgcc

SEQ ID NO: 15306 - DNA, 20 bp, Artificial Sequence
  Synthetic oligonucleotide; AGG chr11 5283531 5283550 5283547 +
ggagtctcactctgtcgcct

SEQ ID NO: 15307 - DNA, 20 bp, Artificial Sequence
  Synthetic oligonucleotide; TGG chr11 5283535 5283554 5283551 +
tctcactctgtcgcctaggc

SEQ ID NO: 15308 - DNA, 20 bp, Artificial Sequence
  Synthetic oligonucleotide; GAG chr11 5283537 5283556 5283553 +
tcactctgtcgcctaggctg

SEQ ID NO: 15309 - DNA, 20 bp, Artificial Sequence
  Synthetic oligonucleotide; CAG chr11 5283542 5283561 5283558 +
ctgtcgcctaggctggagtg

SEQ ID NO: 15310 - DNA, 20 bp, Artificial Sequence
  Synthetic oligonucleotide; TGG chr11 5283545 5283564 5283561 +
tcgcctaggctggagtgcag

SEQ ID NO: 15311 - DNA, 20 bp, Artificial Sequence
  Synthetic oligonucleotide; TAG chr11 5283556 5283575 5283572 +
ggagtgcagtggtgcaatct

SEQ ID NO: 15312 - DNA, 20 bp, Artificial Sequence
  Synthetic oligonucleotide; TGG chr11 5283580 5283599 5283596 +
tcactgcaacctccacctcc

SEQ ID NO: 15313 - DNA, 20 bp, Artificial Sequence
  Synthetic oligonucleotide; GGG chr11 5283581 5283600 5283597 +
cactgcaacctccacctcct

SEQ ID NO: 15314 - DNA, 20 bp, Artificial Sequence
  Synthetic oligonucleotide; AAG chr11 5283587 5283606 5283603 +
aacctccacctcctgggttc

SEQ ID NO: 15315 - DNA, 20 bp, Artificial Sequence
  Synthetic oligonucleotide; CAG chr11 5283604 5283623 5283620 +
ttcaagtgattctcctgcct

SEQ ID NO: 15316 - DNA, 20 bp, Artificial Sequence
  Synthetic oligonucleotide; GAG chr11 5283613 5283632 5283629 +
ttctcctgcctcagcctcct

SEQ ID NO: 15317 - DNA, 20 bp, Artificial Sequence
  Synthetic oligonucleotide; TAG chr11 5283616 5283635 5283632 +
tcctgcctcagcctcctgag

SEQ ID NO: 15318 - DNA, 20 bp, Artificial Sequence
  Synthetic oligonucleotide; TGG chr11 5283620 5283639 5283636 +
gcctcagcctcctgagtagc

SEQ ID NO: 15319 - DNA, 20 bp, Artificial Sequence
  Synthetic oligonucleotide; GGG chr11 5283621 5283640 5283637 +
cctcagcctcctgagtagct

SEQ ID NO: 15320 - DNA, 20 bp, Artificial Sequence
  Synthetic oligonucleotide; TAG chr11 5283628 5283647 5283644 +
ctcctgagtagctgggatta

SEQ ID NO: 15321 - DNA, 20 bp, Artificial Sequence
  Synthetic oligonucleotide; TGG chr11 5283648 5283667 5283664 +
tagacgcgtgccaccacacc

SEQ ID NO: 15322 - DNA, 20 bp, Artificial Sequence
  Synthetic oligonucleotide; TAG chr11 5283669 5283688 5283685 +
ggctgattttttgtattttt

SEQ ID NO: 15323 - DNA, 20 bp, Artificial Sequence
  Synthetic oligonucleotide; TAG chr11 5283672 5283691 5283688 +
tgattttttgtattttttag

SEQ ID NO: 15324 - DNA, 20 bp, Artificial Sequence
  Synthetic oligonucleotide; GAG chr11 5283674 5283693 5283690 +
attttttgtattttttagta

SEQ ID NO: 15325 - DNA, 20 bp, Artificial Sequence
  Synthetic oligonucleotide; AAG chr11 5283677 5283696 5283693 +
ttttgtattttttagtagag

SEQ ID NO: 15326 - DNA, 20 bp, Artificial Sequence
  Synthetic oligonucleotide; AGG chr11 5283678 5283697 5283694 +
tttgtattttttagtagaga

SEQ ID NO: 15327 - DNA, 20 bp, Artificial Sequence
  Synthetic oligonucleotide; GGG chr11 5283679 5283698 5283695 +
ttgtattttttagtagagaa

SEQ ID NO: 15328 - DNA, 20 bp, Artificial Sequence
  Synthetic oligonucleotide; GGG chr11 5283680 5283699 5283696 +
tgtattttttagtagagaag

SEQ ID NO: 15329 - DNA, 20 bp, Artificial Sequence
  Synthetic oligonucleotide; TGG chr11 5283694 5283713 5283710 +
gagaaggggtttcaccatgt

SEQ ID NO: 15330 - DNA, 20 bp, Artificial Sequence
  Synthetic oligonucleotide; CAG chr11 5283698 5283717 5283714 +
aggggtttcaccatgttggc

SEQ ID NO: 15331 - DNA, 20 bp, Artificial Sequence
  Synthetic oligonucleotide; AGG chr11 5283699 5283718 5283715 +
ggggtttcaccatgttggcc

SEQ ID NO: 15332 - DNA, 20 bp, Artificial Sequence
  Synthetic oligonucleotide; TGG chr11 5283703 5283722 5283719 +
tttcaccatgttggccaggc

SEQ ID NO: 15333 - DNA, 20 bp, Artificial Sequence
  Synthetic oligonucleotide; TGG chr11 5283708 5283727 5283724 +
ccatgttggccaggctggtc

SEQ ID NO: 15334 - DNA, 20 bp, Artificial Sequence
  Synthetic oligonucleotide; CAG chr11 5283723 5283742 5283739 +
tggtctggaactcctgacct

SEQ ID NO: 15335 - DNA, 20 bp, Artificial Sequence
  Synthetic oligonucleotide; AGG chr11 5283724 5283743 5283740 +
ggtctggaactcctgacctc

SEQ ID NO: 15336 - DNA, 20 bp, Artificial Sequence
  Synthetic oligonucleotide; TGG chr11 5283741 5283760 5283757 +
ctcaggtgatccaattgcct

SEQ ID NO: 15337 - DNA, 20 bp, Artificial Sequence
  Synthetic oligonucleotide; AAG chr11 5283751 5283770 5283767 +
ccaattgccttggcctccca

SEQ ID NO: 15338 - DNA, 20 bp, Artificial Sequence
  Synthetic oligonucleotide; TGG chr11 5283757 5283776 5283773 +
gccttggcctcccaaagtgc

SEQ ID NO: 15339 - DNA, 20 bp, Artificial Sequence
  Synthetic oligonucleotide; GGG chr11 5283758 5283777 5283774 +
ccttggcctcccaaagtgct

SEQ ID NO: 15340 - DNA, 20 bp, Artificial Sequence
  Synthetic oligonucleotide; CAG chr11 5283765 5283784 5283781 +
ctcccaaagtgctgggatta

SEQ ID NO: 15341 - DNA, 20 bp, Artificial Sequence
  Synthetic oligonucleotide; AGG chr11 5283766 5283785 5283782 +
tcccaaagtgctgggattac

SEQ ID NO: 15342 - DNA, 20 bp, Artificial Sequence
  Synthetic oligonucleotide; GAG chr11 5283786 5283805 5283802 +
aggcatgtaatcccatatat

SEQ ID NO: 15343 - DNA, 20 bp, Artificial Sequence
  Synthetic oligonucleotide; CGG chr11 5283799 5283818 5283815 +
catatatgagccaccgtgcc

SEQ ID NO: 15344 - DNA, 20 bp, Artificial Sequence
  Synthetic oligonucleotide; TAG chr11 5283830 5283849 5283846 +
gataaacttaaatttgattc

SEQ ID NO: 15345 - DNA, 20 bp, Artificial Sequence
  Synthetic oligonucleotide; AAG chr11 5283841 5283860 5283857 +
atttgattctagcatatact

SEQ ID NO: 15346 - DNA, 20 bp, Artificial Sequence
  Synthetic oligonucleotide; AAG chr11 5283849 5283868 5283865 +
ctagcatatactaagtactc

SEQ ID NO: 15347 - DNA, 20 bp, Artificial Sequence
  Synthetic oligonucleotide; GAG chr11 5283851 5283870 5283867 +
agcatatactaagtactcaa

SEQ ID NO: 15348 - DNA, 20 bp, Artificial Sequence
  Synthetic oligonucleotide; AGG chr11 5283852 5283871 5283868 +
gcatatactaagtactcaag

SEQ ID NO: 15349 - DNA, 20 bp, Artificial Sequence
  Synthetic oligonucleotide; TAG chr11 5283868 5283887 5283884 +
caagaggtgttacttatcat

SEQ ID NO: 15350 - DNA, 20 bp, Artificial Sequence
  Synthetic oligonucleotide; TAG chr11 5283880 5283899 5283896 +
cttatcattagtattaatta

SEQ ID NO: 15351 - DNA, 20 bp, Artificial Sequence
  Synthetic oligonucleotide; CAG chr11 5283906 5283925 5283922 +
gttcaataatacatatctca

SEQ ID NO: 15352 - DNA, 20 bp, Artificial Sequence
  Synthetic oligonucleotide; GAG chr11 5283925 5283944 5283941 +
acagaattaccatatgtaat

SEQ ID NO: 15353 - DNA, 20 bp, Artificial Sequence
  Synthetic oligonucleotide; TGG chr11 5283947 5283966 5283963 +
gattattaaatatcataaaa

SEQ ID NO: 15354 - DNA, 20 bp, Artificial Sequence
  Synthetic oligonucleotide; TAG chr11 5283961 5283980 5283977 +
ataaaatggcacctgacata

SEQ ID NO: 15355 - DNA, 20 bp, Artificial Sequence
  Synthetic oligonucleotide; AAG chr11 5283965 5283984 5283981 +
aatggcacctgacatataga

SEQ ID NO: 15356 - DNA, 20 bp, Artificial Sequence
  Synthetic oligonucleotide; CAG chr11 5283972 5283991 5283988 +
cctgacatatagaaagattt

SEQ ID NO: 15357 - DNA, 20 bp, Artificial Sequence
  Synthetic oligonucleotide; AAG chr11 5283976 5283995 5283992 +
acatatagaaagatttcagt

SEQ ID NO: 15358 - DNA, 20 bp, Artificial Sequence
  Synthetic oligonucleotide; CAG chr11 5284010 5284029 5284026 +
acttctctttcatttacctc

SEQ ID NO: 15359 - DNA, 20 bp, Artificial Sequence
  Synthetic oligonucleotide; TGG chr11 5284047 5284066 5284063 +
atttcctcgtgtctctcatg

SEQ ID NO: 15360 - DNA, 20 bp, Artificial Sequence
  Synthetic oligonucleotide; TAG chr11 5284054 5284073 5284070 +
cgtgtctctcatgtggtttc

SEQ ID NO: 15361 - DNA, 20 bp, Artificial Sequence
  Synthetic oligonucleotide; CAG chr11 5284093 5284112 5284109 +
tttccctctcaactcctgtg

SEQ ID NO: 15362 - DNA, 20 bp, Artificial Sequence
  Synthetic oligonucleotide; CAG chr11 5284118 5284137 5284134 +
tcctaaaaatttctcatgtt

SEQ ID NO: 15363 - DNA, 20 bp, Artificial Sequence
  Synthetic oligonucleotide; TGG chr11 5284126 5284145 5284142 +
atttctcatgttcagaacct

SEQ ID NO: 15364 - DNA, 20 bp, Artificial Sequence
  Synthetic oligonucleotide; GGG chr11 5284127 5284146 5284143 +
tttctcatgttcagaacctt

SEQ ID NO: 15365 - DNA, 20 bp, Artificial Sequence
  Synthetic oligonucleotide; CAG chr11 5284142 5284161 5284158 +
accttgggcttccatgtttc

SEQ ID NO: 15366 - DNA, 20 bp, Artificial Sequence
  Synthetic oligonucleotide; AAG chr11 5284147 5284166 5284163 +
gggcttccatgtttccagtg

SEQ ID NO: 15367 - DNA, 20 bp, Artificial Sequence
  Synthetic oligonucleotide; CAG chr11 5284151 5284170 5284167 +
ttccatgtttccagtgaagt

SEQ ID NO: 15368 - DNA, 20 bp, Artificial Sequence
  Synthetic oligonucleotide; TAG chr11 5284161 5284180 5284177 +
ccagtgaagtcagatttttt

SEQ ID NO: 15369 - DNA, 20 bp, Artificial Sequence
  Synthetic oligonucleotide; TGG chr11 5284165 5284184 5284181 +
tgaagtcagatttttttaga

SEQ ID NO: 15370 - DNA, 20 bp, Artificial Sequence
  Synthetic oligonucleotide; AAG chr11 5284170 5284189 5284186 +
tcagatttttttagatggca

SEQ ID NO: 15371 - DNA, 20 bp, Artificial Sequence
  Synthetic oligonucleotide; TAG chr11 5284180 5284199 5284196 +
ttagatggcaaagttgctgt

SEQ ID NO: 15372 - DNA, 20 bp, Artificial Sequence
  Synthetic oligonucleotide; TAG chr11 5284205 5284224 5284221 +
aatttcatctgtgccctgct

SEQ ID NO: 15373 - DNA, 20 bp, Artificial Sequence
  Synthetic oligonucleotide; AGG chr11 5284206 5284225 5284222 +
atttcatctgtgccctgctt

SEQ ID NO: 15374 - DNA, 20 bp, Artificial Sequence
  Synthetic oligonucleotide; GAG chr11 5284208 5284227 5284224 +
ttcatctgtgccctgcttag

SEQ ID NO: 15375 - DNA, 20 bp, Artificial Sequence
  Synthetic oligonucleotide; AAG chr11 5284226 5284245 5284242 +
aggagcttaatctttaatga

SEQ ID NO: 15376 - DNA, 20 bp, Artificial Sequence
  Synthetic oligonucleotide; AAG chr11 5284231 5284250 5284247 +
cttaatctttaatgaaagct

SEQ ID NO: 15377 - DNA, 20 bp, Artificial Sequence
  Synthetic oligonucleotide; AAG chr11 5284247 5284266 5284263 +
agctaagctttcattaaaaa

SEQ ID NO: 15378 - DNA, 20 bp, Artificial Sequence
  Synthetic oligonucleotide; CAG chr11 5284256 5284275 5284272 +
ttcattaaaaaaagtctaac

SEQ ID NO: 15379 - DNA, 20 bp, Artificial Sequence
  Synthetic oligonucleotide; CAG chr11 5284278 5284297 5284294 +
gctgcattcgactttgactg

SEQ ID NO: 15380 - DNA, 20 bp, Artificial Sequence
  Synthetic oligonucleotide; CAG chr11 5284281 5284300 5284297 +
gcattcgactttgactgcag

SEQ ID NO: 15381 - DNA, 20 bp, Artificial Sequence
  Synthetic oligonucleotide; TGG chr11 5284285 5284304 5284301 +
tcgactttgactgcagcagc

SEQ ID NO: 15382 - DNA, 20 bp, Artificial Sequence
  Synthetic oligonucleotide; TAG chr11 5284289 5284308 5284305 +
ctttgactgcagcagctggt

SEQ ID NO: 15383 - DNA, 20 bp, Artificial Sequence
  Synthetic oligonucleotide; AAG chr11 5284292 5284311 5284308 +
tgactgcagcagctggttag

SEQ ID NO: 15384 - DNA, 20 bp, Artificial Sequence
  Synthetic oligonucleotide; AGG chr11 5284293 5284312 5284309 +
gactgcagcagctggttaga

SEQ ID NO: 15385 - DNA, 20 bp, Artificial Sequence
  Synthetic oligonucleotide; TGG chr11 5284302 5284321 5284318 +
agctggttagaaggttctac

SEQ ID NO: 15386 - DNA, 20 bp, Artificial Sequence
  Synthetic oligonucleotide; GAG chr11 5284304 5284323 5284320 +
ctggttagaaggttctactg

SEQ ID NO: 15387 - DNA, 20 bp, Artificial Sequence
  Synthetic oligonucleotide; AGG chr11 5284305 5284324 5284321 +
tggttagaaggttctactgg

SEQ ID NO: 15388 - DNA, 20 bp, Artificial Sequence
  Synthetic oligonucleotide; GAG chr11 5284307 5284326 5284323 +
gttagaaggttctactggag

SEQ ID NO: 15389 - DNA, 20 bp, Artificial Sequence
  Synthetic oligonucleotide; AGG chr11 5284308 5284327 5284324 +
ttagaaggttctactggagg

SEQ ID NO: 15390 - DNA, 20 bp, Artificial Sequence
  Synthetic oligonucleotide; GGG chr11 5284309 5284328 5284325 +
tagaaggttctactggagga

SEQ ID NO: 15391 - DNA, 20 bp, Artificial Sequence
  Synthetic oligonucleotide; CAG chr11 5284315 5284334 5284331 +
gttctactggaggagggtcc

SEQ ID NO: 15392 - DNA, 20 bp, Artificial Sequence
  Synthetic oligonucleotide; CAG chr11 5284337 5284356 5284353 +
gcccattgctaaattaacat

SEQ ID NO: 15393 - DNA, 20 bp, Artificial Sequence
  Synthetic oligonucleotide; AGG chr11 5284338 5284357 5284354 +
cccattgctaaattaacatc

SEQ ID NO: 15394 - DNA, 20 bp, Artificial Sequence
  Synthetic oligonucleotide; GAG chr11 5284345 5284364 5284361 +
ctaaattaacatcaggctct

SEQ ID NO: 15395 - DNA, 20 bp, Artificial Sequence
  Synthetic oligonucleotide; TGG chr11 5284350 5284369 5284366 +
ttaacatcaggctctgagac

SEQ ID NO: 15396 - DNA, 20 bp, Artificial Sequence
  Synthetic oligonucleotide; CAG chr11 5284353 5284372 5284369 +
acatcaggctctgagactgg

SEQ ID NO: 15397 - DNA, 20 bp, Artificial Sequence
  Synthetic oligonucleotide; CAG chr11 5284367 5284386 5284383 +
gactggcagtatatctctaa

SEQ ID NO: 15398 - DNA, 20 bp, Artificial Sequence
  Synthetic oligonucleotide; TGG chr11 5284370 5284389 5284386 +
tggcagtatatctctaacag

SEQ ID NO: 15399 - DNA, 20 bp, Artificial Sequence
  Synthetic oligonucleotide; TGG chr11 5284387 5284406 5284403 +
cagtggttgatgctatcttc

SEQ ID NO: 15400 - DNA, 20 bp, Artificial Sequence
  Synthetic oligonucleotide; GAG chr11 5284407 5284426 5284423 +
tggaacttgcctgctacatt

SEQ ID NO: 15401 - DNA, 20 bp, Artificial Sequence
  Synthetic oligonucleotide; TAG chr11 5284426 5284445 5284442 +
tgagaccactgacccataca

SEQ ID NO: 15402 - DNA, 20 bp, Artificial Sequence
  Synthetic oligonucleotide; AGG chr11 5284427 5284446 5284443 +
gagaccactgacccatacat

SEQ ID NO: 15403 - DNA, 20 bp, Artificial Sequence
  Synthetic oligonucleotide; AAG chr11 5284430 5284449 5284446 +
accactgacccatacatagg

SEQ ID NO: 15404 - DNA, 20 bp, Artificial Sequence
  Synthetic oligonucleotide; TAG chr11 5284437 5284456 5284453 +
acccatacataggaagccca

SEQ ID NO: 15405 - DNA, 20 bp, Artificial Sequence
  Synthetic oligonucleotide; TAG chr11 5284456 5284475 5284472 +
atagctctgtcctgaactgt

SEQ ID NO: 15406 - DNA, 20 bp, Artificial Sequence
  Synthetic oligonucleotide; AGG chr11 5284457 5284476 5284473 +
tagctctgtcctgaactgtt

SEQ ID NO: 15407 - DNA, 20 bp, Artificial Sequence
  Synthetic oligonucleotide; TGG chr11 5284464 5284483 5284480 +
gtcctgaactgttaggccac

SEQ ID NO: 15408 - DNA, 20 bp, Artificial Sequence
  Synthetic oligonucleotide; CAG chr11 5284469 5284488 5284485 +
gaactgttaggccactggtc

SEQ ID NO: 15409 - DNA, 20 bp, Artificial Sequence
  Synthetic oligonucleotide; GAG chr11 5284471 5284490 5284487 +
actgttaggccactggtcca

SEQ ID NO: 15410 - DNA, 20 bp, Artificial Sequence
  Synthetic oligonucleotide; GAG chr11 5284473 5284492 5284489 +
tgttaggccactggtccaga

SEQ ID NO: 15411 - DNA, 20 bp, Artificial Sequence
  Synthetic oligonucleotide; GAG chr11 5284510 5284529 5284526 +
gatcctcataataaccctat

SEQ ID NO: 15412 - DNA, 20 bp, Artificial Sequence
  Synthetic oligonucleotide; TAG chr11 5284514 5284533 5284530 +
ctcataataaccctatgaga

SEQ ID NO: 15413 - DNA, 20 bp, Artificial Sequence
  Synthetic oligonucleotide; TAG chr11 5284540 5284559 5284556 +
caattattactcttacttta

SEQ ID NO: 15414 - DNA, 20 bp, Artificial Sequence
  Synthetic oligonucleotide; TAG chr11 5284561 5284580 5284577 +
agatgatgatcctgaaaaca

SEQ ID NO: 15415 - DNA, 20 bp, Artificial Sequence
  Synthetic oligonucleotide; AGG chr11 5284562 5284581 5284578 +
gatgatgatcctgaaaacat

SEQ ID NO: 15416 - DNA, 20 bp, Artificial Sequence
  Synthetic oligonucleotide; GAG chr11 5284564 5284583 5284580 +
tgatgatcctgaaaacatag

SEQ ID NO: 15417 - DNA, 20 bp, Artificial Sequence
  Synthetic oligonucleotide; AAG chr11 5284569 5284588 5284585 +
atcctgaaaacataggagtc

SEQ ID NO: 15418 - DNA, 20 bp, Artificial Sequence
  Synthetic oligonucleotide; AGG chr11 5284570 5284589 5284586 +
tcctgaaaacataggagtca

SEQ ID NO: 15419 - DNA, 20 bp, Artificial Sequence
  Synthetic oligonucleotide; TAG chr11 5284583 5284602 5284599 +
ggagtcaaggcacttgcccc

SEQ ID NO: 15420 - DNA, 20 bp, Artificial Sequence
  Synthetic oligonucleotide; TGG chr11 5284587 5284606 5284603 +
tcaaggcacttgcccctagc

SEQ ID NO: 15421 - DNA, 20 bp, Artificial Sequence
  Synthetic oligonucleotide; GGG chr11 5284588 5284607 5284604 +
caaggcacttgcccctagct

SEQ ID NO: 15422 - DNA, 20 bp, Artificial Sequence
  Synthetic oligonucleotide; GGG chr11 5284589 5284608 5284605 +
aaggcacttgcccctagctg

SEQ ID NO: 15423 - DNA, 20 bp, Artificial Sequence
  Synthetic oligonucleotide; GGG chr11 5284590 5284609 5284606 +
aggcacttgcccctagctgg

SEQ ID NO: 15424 - DNA, 20 bp, Artificial Sequence
  Synthetic oligonucleotide; TAG chr11 5284595 5284614 5284611 +
cttgcccctagctgggggta

SEQ ID NO: 15425 - DNA, 20 bp, Artificial Sequence
  Synthetic oligonucleotide; AGG chr11 5284596 5284615 5284612 +
ttgcccctagctgggggtat

SEQ ID NO: 15426 - DNA, 20 bp, Artificial Sequence
  Synthetic oligonucleotide; GGG chr11 5284597 5284616 5284613 +
tgcccctagctgggggtata

SEQ ID NO: 15427 - DNA, 20 bp, Artificial Sequence
  Synthetic oligonucleotide; GGG chr11 5284598 5284617 5284614 +
gcccctagctgggggtatag

SEQ ID NO: 15428 - DNA, 20 bp, Artificial Sequence
  Synthetic oligonucleotide; GAG chr11 5284600 5284619 5284616 +
ccctagctgggggtataggg

SEQ ID NO: 15429 - DNA, 20 bp, Artificial Sequence
  Synthetic oligonucleotide; CAG chr11 5284603 5284622 5284619 +
tagctgggggtataggggag

SEQ ID NO: 15430 - DNA, 20 bp, Artificial Sequence
  Synthetic oligonucleotide; TAG chr11 5284613 5284632 5284629 +
tataggggagcagtcccatg

SEQ ID NO: 15431 - DNA, 20 bp, Artificial Sequence
  Synthetic oligonucleotide; TAG chr11 5284616 5284635 5284632 +
aggggagcagtcccatgtag

SEQ ID NO: 15432 - DNA, 20 bp, Artificial Sequence
  Synthetic oligonucleotide; TAG chr11 5284619 5284638 5284635 +
ggagcagtcccatgtagtag

SEQ ID NO: 15433 - DNA, 20 bp, Artificial Sequence
  Synthetic oligonucleotide; TGG chr11 5284681 5284700 5284697 +
ccatgtctgccctctactca

SEQ ID NO: 15434 - DNA, 20 bp, Artificial Sequence
  Synthetic oligonucleotide; TGG chr11 5284695 5284714 5284711 +
tactcatggtctatctctcc

SEQ ID NO: 15435 - DNA, 20 bp, Artificial Sequence
  Synthetic oligonucleotide; TGG chr11 5284702 5284721 5284718 +
ggtctatctctcctggctcc

SEQ ID NO: 15436 - DNA, 20 bp, Artificial Sequence
  Synthetic oligonucleotide; GGG chr11 5284703 5284722 5284719 +
gtctatctctcctggctcct

SEQ ID NO: 15437 - DNA, 20 bp, Artificial Sequence
  Synthetic oligonucleotide; GAG chr11 5284705 5284724 5284721 +
ctatctctcctggctcctgg

SEQ ID NO: 15438 - DNA, 20 bp, Artificial Sequence
  Synthetic oligonucleotide; TGG chr11 5284711 5284730 5284727 +
ctcctggctcctgggagtca

SEQ ID NO: 15439 - DNA, 20 bp, Artificial Sequence
  Synthetic oligonucleotide; CAG chr11 5284722 5284741 5284738 +
tgggagtcatggactccacc

SEQ ID NO: 15440 - DNA, 20 bp, Artificial Sequence
  Synthetic oligonucleotide; GAG chr11 5284754 5284773 5284770 +
cctgacctaaccacctatct

SEQ ID NO: 15441 - DNA, 20 bp, Artificial Sequence
  Synthetic oligonucleotide; CAG chr11 5284762 5284781 5284778 +
aaccacctatctgagcctgc

SEQ ID NO: 15442 - DNA, 20 bp, Artificial Sequence
  Synthetic oligonucleotide; TGG chr11 5284778 5284797 5284794 +
ctgccagcctataacccatc

SEQ ID NO: 15443 - DNA, 20 bp, Artificial Sequence
  Synthetic oligonucleotide; GGG chr11 5284779 5284798 5284795 +
tgccagcctataacccatct

SEQ ID NO: 15444 - DNA, 20 bp, Artificial Sequence
  Synthetic oligonucleotide; TAG chr11 5284788 5284807 5284804 +
ataacccatctgggccctga

SEQ ID NO: 15445 - DNA, 20 bp, Artificial Sequence
  Synthetic oligonucleotide; TGG chr11 5284792 5284811 5284808 +
cccatctgggccctgatagc

SEQ ID NO: 15446 - DNA, 20 bp, Artificial Sequence
  Synthetic oligonucleotide; TGG chr11 5284795 5284814 5284811 +
atctgggccctgatagctgg

SEQ ID NO: 15447 - DNA, 20 bp, Artificial Sequence
  Synthetic oligonucleotide; CAG chr11 5284799 5284818 5284815 +
gggccctgatagctggtggc

SEQ ID NO: 15448 - DNA, 20 bp, Artificial Sequence
  Synthetic oligonucleotide; TGG chr11 5284825 5284844 5284841 +
tgaccccaccccaccctccc

SEQ ID NO: 15449 - DNA, 20 bp, Artificial Sequence
  Synthetic oligonucleotide; TAG chr11 5284837 5284856 5284853 +
accctccctggaacctctga

SEQ ID NO: 15450 - DNA, 20 bp, Artificial Sequence
  Synthetic oligonucleotide; TGG chr11 5284847 5284866 5284863 +
gaacctctgatagacacatc

SEQ ID NO: 15451 - DNA, 20 bp, Artificial Sequence
  Synthetic oligonucleotide; CAG chr11 5284855 5284874 5284871 +
gatagacacatctggcacac

SEQ ID NO: 15452 - DNA, 20 bp, Artificial Sequence
  Synthetic oligonucleotide; AAG chr11 5284864 5284883 5284880 +
atctggcacaccagctcgca

SEQ ID NO: 15453 - DNA, 20 bp, Artificial Sequence
  Synthetic oligonucleotide; GAG chr11 5284874 5284893 5284890 +
ccagctcgcaaagtcaccgt

SEQ ID NO: 15454 - DNA, 20 bp, Artificial Sequence
  Synthetic oligonucleotide; AGG chr11 5284875 5284894 5284891 +
cagctcgcaaagtcaccgtg

SEQ ID NO: 15455 - DNA, 20 bp, Artificial Sequence
  Synthetic oligonucleotide; GGG chr11 5284876 5284895 5284892 +
agctcgcaaagtcaccgtga

SEQ ID NO: 15456 - DNA, 20 bp, Artificial Sequence
  Synthetic oligonucleotide; GAG chr11 5284892 5284911 5284908 +
gtgagggtcttgtgtttgct

SEQ ID NO: 15457 - DNA, 20 bp, Artificial Sequence
  Synthetic oligonucleotide; AAG chr11 5284914 5284933 5284930 +
gtcaaaattccttgaaatcc

SEQ ID NO: 15458 - DNA, 20 bp, Artificial Sequence
  Synthetic oligonucleotide; TAG chr11 5284921 5284940 5284937 +
ttccttgaaatccaagtcct

SEQ ID NO: 15459 - DNA, 20 bp, Artificial Sequence
  Synthetic oligonucleotide; GAG chr11 5284923 5284942 5284939 +
ccttgaaatccaagtcctta

SEQ ID NO: 15460 - DNA, 20 bp, Artificial Sequence
  Synthetic oligonucleotide; CAG chr11 5284945 5284964 5284961 +
gactcctgctcccaaattta

SEQ ID NO: 15461 - DNA, 20 bp, Artificial Sequence
  Synthetic oligonucleotide; TAG chr11 5284951 5284970 5284967 +
tgctcccaaatttacagtca

SEQ ID NO: 15462 - DNA, 20 bp, Artificial Sequence
  Synthetic oligonucleotide; TGG chr11 5284963 5284982 5284979 +
tacagtcatagacttcttca

SEQ ID NO: 15463 - DNA, 20 bp, Artificial Sequence
  Synthetic oligonucleotide; CAG chr11 5284982 5285001 5284998 +
atggctgtctcctttatcca

SEQ ID NO: 15464 - DNA, 20 bp, Artificial Sequence
  Synthetic oligonucleotide; CAG chr11 5285030 5285049 5285046 +
atccatctgatcctcctcat

SEQ ID NO: 15465 - DNA, 20 bp, Artificial Sequence
  Synthetic oligonucleotide; CAG chr11 5285035 5285054 5285051 +
tctgatcctcctcatcagtg

SEQ ID NO: 15466 - DNA, 20 bp, Artificial Sequence
  Synthetic oligonucleotide; CAG chr11 5285040 5285059 5285056 +
tcctcctcatcagtgcagca

SEQ ID NO: 15467 - DNA, 20 bp, Artificial Sequence
  Synthetic oligonucleotide; AGG chr11 5285041 5285060 5285057 +
cctcctcatcagtgcagcac

SEQ ID NO: 15468 - DNA, 20 bp, Artificial Sequence
  Synthetic oligonucleotide; GGG chr11 5285042 5285061 5285058 +
ctcctcatcagtgcagcaca

SEQ ID NO: 15469 - DNA, 20 bp, Artificial Sequence
  Synthetic oligonucleotide; GAG chr11 5285050 5285069 5285066 +
cagtgcagcacagggcccat

SEQ ID NO: 15470 - DNA, 20 bp, Artificial Sequence
  Synthetic oligonucleotide; CAG chr11 5285053 5285072 5285069 +
tgcagcacagggcccatgag

SEQ ID NO: 15471 - DNA, 20 bp, Artificial Sequence
  Synthetic oligonucleotide; TAG chr11 5285056 5285075 5285072 +
agcacagggcccatgagcag

SEQ ID NO: 15472 - DNA, 20 bp, Artificial Sequence
  Synthetic oligonucleotide; CAG chr11 5285062 5285081 5285078 +
gggcccatgagcagtagctg

SEQ ID NO: 15473 - DNA, 20 bp, Artificial Sequence
  Synthetic oligonucleotide; GAG chr11 5285064 5285083 5285080 +
gcccatgagcagtagctgca

SEQ ID NO: 15474 - DNA, 20 bp, Artificial Sequence
  Synthetic oligonucleotide; TAG chr11 5285074 5285093 5285090 +
agtagctgcagagtctcaca

SEQ ID NO: 15475 - DNA, 20 bp, Artificial Sequence
  Synthetic oligonucleotide; AGG chr11 5285075 5285094 5285091 +
gtagctgcagagtctcacat

SEQ ID NO: 15476 - DNA, 20 bp, Artificial Sequence
  Synthetic oligonucleotide; TGG chr11 5285080 5285099 5285096 +
tgcagagtctcacataggtc

SEQ ID NO: 15477 - DNA, 20 bp, Artificial Sequence
  Synthetic oligonucleotide; TAG chr11 5285107 5285126 5285123 +
gcctctgacatgtccgacct

SEQ ID NO: 15478 - DNA, 20 bp, Artificial Sequence
  Synthetic oligonucleotide; AGG chr11 5285108 5285127 5285124 +
cctctgacatgtccgacctt

SEQ ID NO: 15479 - DNA, 20 bp, Artificial Sequence
  Synthetic oligonucleotide; GAG chr11 5285129 5285148 5285145 +
ggcaaatgcttgactcttct

SEQ ID NO: 15480 - DNA, 20 bp, Artificial Sequence
  Synthetic oligonucleotide; CAG chr11 5285134 5285153 5285150 +
atgcttgactcttctgagct

SEQ ID NO: 15481 - DNA, 20 bp, Artificial Sequence
  Synthetic oligonucleotide; TGG chr11 5285145 5285164 5285161 +
ttctgagctcagtcttgtca

SEQ ID NO: 15482 - DNA, 20 bp, Artificial Sequence
  Synthetic oligonucleotide; AAG chr11 5285155 5285174 5285171 +
agtcttgtcatggcaaaata

SEQ ID NO: 15483 - DNA, 20 bp, Artificial Sequence
  Synthetic oligonucleotide; TAG chr11 5285165 5285184 5285181 +
tggcaaaataaagataataa

SEQ ID NO: 15484 - DNA, 20 bp, Artificial Sequence
  Synthetic oligonucleotide; TGG chr11 5285178 5285197 5285194 +
ataataatagtgttttttta

SEQ ID NO: 15485 - DNA, 20 bp, Artificial Sequence
  Synthetic oligonucleotide; GAG chr11 5285180 5285199 5285196 +
aataatagtgtttttttatg

SEQ ID NO: 15486 - DNA, 20 bp, Artificial Sequence
  Synthetic oligonucleotide; TAG chr11 5285184 5285203 5285200 +
atagtgtttttttatggagt

SEQ ID NO: 15487 - DNA, 20 bp, Artificial Sequence
  Synthetic oligonucleotide; GAG chr11 5285190 5285209 5285206 +
tttttttatggagttagcgt

SEQ ID NO: 15488 - DNA, 20 bp, Artificial Sequence
  Synthetic oligonucleotide; AGG chr11 5285191 5285210 5285207 +
ttttttatggagttagcgtg

SEQ ID NO: 15489 - DNA, 20 bp, Artificial Sequence
  Synthetic oligonucleotide; TGG chr11 5285195 5285214 5285211 +
ttatggagttagcgtgagga

SEQ ID NO: 15490 - DNA, 20 bp, Artificial Sequence
  Synthetic oligonucleotide; TAG chr11 5285205 5285224 5285221 +
agcgtgaggatggaaaacaa

SEQ ID NO: 15491 - DNA, 20 bp, Artificial Sequence
  Synthetic oligonucleotide; TAG chr11 5285218 5285237 5285234 +
aaaacaatagcaaaattgat

SEQ ID NO: 15492 - DNA, 20 bp, Artificial Sequence
  Synthetic oligonucleotide; AAG chr11 5285228 5285247 5285244 +
caaaattgattagactataa

SEQ ID NO: 15493 - DNA, 20 bp, Artificial Sequence
  Synthetic oligonucleotide; AGG chr11 5285229 5285248 5285245 +
aaaattgattagactataaa

SEQ ID NO: 15494 - DNA, 20 bp, Artificial Sequence
  Synthetic oligonucleotide; TAG chr11 5285242 5285261 5285258 +
ctataaaaggtctcaacaaa

SEQ ID NO: 15495 - DNA, 20 bp, Artificial Sequence
  Synthetic oligonucleotide; TAG chr11 5285245 5285264 5285261 +
taaaaggtctcaacaaatag

SEQ ID NO: 15496 - DNA, 20 bp, Artificial Sequence
  Synthetic oligonucleotide; TAG chr11 5285248 5285267 5285264 +
aaggtctcaacaaatagtag

SEQ ID NO: 15497 - DNA, 20 bp, Artificial Sequence
  Synthetic oligonucleotide; AAG chr11 5285332 5285351 5285348 +
aattttcccttacctataat

SEQ ID NO: 15498 - DNA, 20 bp, Artificial Sequence
  Synthetic oligonucleotide; GAG chr11 5285334 5285353 5285350 +
ttttcccttacctataataa

SEQ ID NO: 15499 - DNA, 20 bp, Artificial Sequence
  Synthetic oligonucleotide; TAG chr11 5285363 5285382 5285379 +
ctcttattatattcttctta

SEQ ID NO: 15500 - DNA, 20 bp, Artificial Sequence
  Synthetic oligonucleotide; TGG chr11 5285372 5285391 5285388 +
tattcttcttatagtgattc

SEQ ID NO: 15501 - DNA, 20 bp, Artificial Sequence
  Synthetic oligonucleotide; AAG chr11 5285381 5285400 5285397 +
tatagtgattctggatatta

SEQ ID NO: 15502 - DNA, 20 bp, Artificial Sequence
  Synthetic oligonucleotide; TGG chr11 5285384 5285403 5285400 +
agtgattctggatattaaag

SEQ ID NO: 15503 - DNA, 20 bp, Artificial Sequence
  Synthetic oligonucleotide; GGG chr11 5285385 5285404 5285401 +
gtgattctggatattaaagt

SEQ ID NO: 15504 - DNA, 20 bp, Artificial Sequence
  Synthetic oligonucleotide; GAG chr11 5285391 5285410 5285407 +
ctggatattaaagtgggaat

SEQ ID NO: 15505 - DNA, 20 bp, Artificial Sequence
  Synthetic oligonucleotide; AGG chr11 5285392 5285411 5285408 +
tggatattaaagtgggaatg

SEQ ID NO: 15506 - DNA, 20 bp, Artificial Sequence
  Synthetic oligonucleotide; GGG chr11 5285393 5285412 5285409 +
ggatattaaagtgggaatga

SEQ ID NO: 15507 - DNA, 20 bp, Artificial Sequence
  Synthetic oligonucleotide; GGG chr11 5285394 5285413 5285410 +
gatattaaagtgggaatgag

SEQ ID NO: 15508 - DNA, 20 bp, Artificial Sequence
  Synthetic oligonucleotide; CAG chr11 5285397 5285416 5285413 +
attaaagtgggaatgagggg

SEQ ID NO: 15509 - DNA, 20 bp, Artificial Sequence
  Synthetic oligonucleotide; AGG chr11 5285398 5285417 5285414 +
ttaaagtgggaatgaggggc

SEQ ID NO: 15510 - DNA, 20 bp, Artificial Sequence
  Synthetic oligonucleotide; AAG chr11 5285410 5285429 5285426 +
tgaggggcaggccactaacg

SEQ ID NO: 15511 - DNA, 20 bp, Artificial Sequence
  Synthetic oligonucleotide; AAG chr11 5285413 5285432 5285429 +
ggggcaggccactaacgaag

SEQ ID NO: 15512 - DNA, 20 bp, Artificial Sequence
  Synthetic oligonucleotide; AAG chr11 5285426 5285445 5285442 +
aacgaagaagatgtttctca

SEQ ID NO: 15513 - DNA, 20 bp, Artificial Sequence
  Synthetic oligonucleotide; AAG chr11 5285429 5285448 5285445 +
gaagaagatgtttctcaaag

SEQ ID NO: 15514 - DNA, 20 bp, Artificial Sequence
  Synthetic oligonucleotide; TAG chr11 5285446 5285465 5285462 +
aagaagccattctccccaca

SEQ ID NO: 15515 - DNA, 20 bp, Artificial Sequence
  Synthetic oligonucleotide; CAG chr11 5285456 5285475 5285472 +
tctccccacatagatcatct

SEQ ID NO: 15516 - DNA, 20 bp, Artificial Sequence
  Synthetic oligonucleotide; CAG chr11 5285459 5285478 5285475 +
ccccacatagatcatctcag

SEQ ID NO: 15517 - DNA, 20 bp, Artificial Sequence
  Synthetic oligonucleotide; AGG chr11 5285460 5285479 5285476 +
cccacatagatcatctcagc

SEQ ID NO: 15518 - DNA, 20 bp, Artificial Sequence
  Synthetic oligonucleotide; GGG chr11 5285461 5285480 5285477 +
ccacatagatcatctcagca

SEQ ID NO: 15519 - DNA, 20 bp, Artificial Sequence
  Synthetic oligonucleotide; CAG chr11 5285466 5285485 5285482 +
tagatcatctcagcagggtt

SEQ ID NO: 15520 - DNA, 20 bp, Artificial Sequence
  Synthetic oligonucleotide; AGG chr11 5285467 5285486 5285483 +
agatcatctcagcagggttc

SEQ ID NO: 15521 - DNA, 20 bp, Artificial Sequence
  Synthetic oligonucleotide; AAG chr11 5285470 5285489 5285486 +
tcatctcagcagggttcagg

SEQ ID NO: 15522 - DNA, 20 bp, Artificial Sequence
  Synthetic oligonucleotide; AAG chr11 5285476 5285495 5285492 +
cagcagggttcaggaagata

SEQ ID NO: 15523 - DNA, 20 bp, Artificial Sequence
  Synthetic oligonucleotide; AGG chr11 5285477 5285496 5285493 +
agcagggttcaggaagataa

SEQ ID NO: 15524 - DNA, 20 bp, Artificial Sequence
  Synthetic oligonucleotide; GAG chr11 5285479 5285498 5285495 +
cagggttcaggaagataaag

SEQ ID NO: 15525 - DNA, 20 bp, Artificial Sequence
  Synthetic oligonucleotide; AGG chr11 5285480 5285499 5285496 +
agggttcaggaagataaagg

SEQ ID NO: 15526 - DNA, 20 bp, Artificial Sequence
  Synthetic oligonucleotide; AAG chr11 5285486 5285505 5285502 +
caggaagataaaggaggatc

SEQ ID NO: 15527 - DNA, 20 bp, Artificial Sequence
  Synthetic oligonucleotide; AGG chr11 5285487 5285506 5285503 +
aggaagataaaggaggatca

SEQ ID NO: 15528 - DNA, 20 bp, Artificial Sequence
  Synthetic oligonucleotide; AAG chr11 5285493 5285512 5285509 +
ataaaggaggatcaaggtcg

SEQ ID NO: 15529 - DNA, 20 bp, Artificial Sequence
  Synthetic oligonucleotide; AGG chr11 5285494 5285513 5285510 +
taaaggaggatcaaggtcga

SEQ ID NO: 15530 - DNA, 20 bp, Artificial Sequence
  Synthetic oligonucleotide; TAG chr11 5285497 5285516 5285513 +
aggaggatcaaggtcgaagg

SEQ ID NO: 15531 - DNA, 20 bp, Artificial Sequence
  Synthetic oligonucleotide; AGG chr11 5285498 5285517 5285514 +
ggaggatcaaggtcgaaggt

SEQ ID NO: 15532 - DNA, 20 bp, Artificial Sequence
  Synthetic oligonucleotide; AAG chr11 5285505 5285524 5285521 +
caaggtcgaaggtaggaact

SEQ ID NO: 15533 - DNA, 20 bp, Artificial Sequence
  Synthetic oligonucleotide; AGG chr11 5285506 5285525 5285522 +
aaggtcgaaggtaggaacta

SEQ ID NO: 15534 - DNA, 20 bp, Artificial Sequence
  Synthetic oligonucleotide; AAG chr11 5285509 5285528 5285525 +
gtcgaaggtaggaactaagg

SEQ ID NO: 15535 - DNA, 20 bp, Artificial Sequence
  Synthetic oligonucleotide; TGG chr11 5285517 5285536 5285533 +
taggaactaaggaagaacac

SEQ ID NO: 15536 - DNA, 20 bp, Artificial Sequence
  Synthetic oligonucleotide; GGG chr11 5285518 5285537 5285534 +
aggaactaaggaagaacact

SEQ ID NO: 15537 - DNA, 20 bp, Artificial Sequence
  Synthetic oligonucleotide; AAG chr11 5285522 5285541 5285538 +
actaaggaagaacactgggc

SEQ ID NO: 15538 - DNA, 20 bp, Artificial Sequence
  Synthetic oligonucleotide; TGG chr11 5285525 5285544 5285541 +
aaggaagaacactgggcaag

SEQ ID NO: 15539 - DNA, 20 bp, Artificial Sequence
  Synthetic oligonucleotide; CAG chr11 5285531 5285550 5285547 +
gaacactgggcaagtggatc

SEQ ID NO: 15540 - DNA, 20 bp, Artificial Sequence
  Synthetic oligonucleotide; AGG chr11 5285532 5285551 5285548 +
aacactgggcaagtggatcc

SEQ ID NO: 15541 - DNA, 20 bp, Artificial Sequence
  Synthetic oligonucleotide; AAG chr11 5285549 5285568 5285565 +
tccaggttgtccaacgctga

SEQ ID NO: 15542 - DNA, 20 bp, Artificial Sequence
  Synthetic oligonucleotide; TAG chr11 5285552 5285571 5285568 +
aggttgtccaacgctgaaag

SEQ ID NO: 15543 - DNA, 20 bp, Artificial Sequence
  Synthetic oligonucleotide; AGG chr11 5285553 5285572 5285569 +
ggttgtccaacgctgaaagt

SEQ ID NO: 15544 - DNA, 20 bp, Artificial Sequence
  Synthetic oligonucleotide; AAG chr11 5285561 5285580 5285577 +
aacgctgaaagtaggaatct

SEQ ID NO: 15545 - DNA, 20 bp, Artificial Sequence
  Synthetic oligonucleotide; TAG chr11 5285567 5285586 5285583 +
gaaagtaggaatctaagcac

SEQ ID NO: 15546 - DNA, 20 bp, Artificial Sequence
  Synthetic oligonucleotide; TGG chr11 5285574 5285593 5285590 +
ggaatctaagcactagtctc

SEQ ID NO: 15547 - DNA, 20 bp, Artificial Sequence
  Synthetic oligonucleotide; TAG chr11 5285581 5285600 5285597 +
aagcactagtctctggatgc

SEQ ID NO: 15548 - DNA, 20 bp, Artificial Sequence
  Synthetic oligonucleotide; AGG chr11 5285582 5285601 5285598 +
agcactagtctctggatgct

SEQ ID NO: 15549 - DNA, 20 bp, Artificial Sequence
  Synthetic oligonucleotide; GAG chr11 5285584 5285603 5285600 +
cactagtctctggatgctag

SEQ ID NO: 15550 - DNA, 20 bp, Artificial Sequence
  Synthetic oligonucleotide; AGG chr11 5285585 5285604 5285601 +
actagtctctggatgctagg

SEQ ID NO: 15551 - DNA, 20 bp, Artificial Sequence
  Synthetic oligonucleotide; GGG chr11 5285586 5285605 5285602 +
ctagtctctggatgctagga

SEQ ID NO: 15552 - DNA, 20 bp, Artificial Sequence
  Synthetic oligonucleotide; TGG chr11 5285597 5285616 5285613 +
atgctaggagggcctctgca

SEQ ID NO: 15553 - DNA, 20 bp, Artificial Sequence
  Synthetic oligonucleotide; GGG chr11 5285598 5285617 5285614 +
tgctaggagggcctctgcat

SEQ ID NO: 15554 - DNA, 20 bp, Artificial Sequence
  Synthetic oligonucleotide; TAG chr11 5285614 5285633 5285630 +
gcatgggtaactctttcaac

SEQ ID NO: 15555 - DNA, 20 bp, Artificial Sequence
  Synthetic oligonucleotide; CAG chr11 5285618 5285637 5285634 +
gggtaactctttcaactagc

SEQ ID NO: 15556 - DNA, 20 bp, Artificial Sequence
  Synthetic oligonucleotide; AGG chr11 5285619 5285638 5285635 +
ggtaactctttcaactagcc

SEQ ID NO: 15557 - DNA, 20 bp, Artificial Sequence
  Synthetic oligonucleotide; GGG chr11 5285620 5285639 5285636 +
gtaactctttcaactagcca

SEQ ID NO: 15558 - DNA, 20 bp, Artificial Sequence
  Synthetic oligonucleotide; GGG chr11 5285621 5285640 5285637 +
taactctttcaactagccag

SEQ ID NO: 15559 - DNA, 20 bp, Artificial Sequence
  Synthetic oligonucleotide; TGG chr11 5285625 5285644 5285641 +
tctttcaactagccaggggc

SEQ ID NO: 15560 - DNA, 20 bp, Artificial Sequence
  Synthetic oligonucleotide; TGG chr11 5285632 5285651 5285648 +
actagccaggggctggactg

SEQ ID NO: 15561 - DNA, 20 bp, Artificial Sequence
  Synthetic oligonucleotide; GAG chr11 5285634 5285653 5285650 +
tagccaggggctggactgtg

SEQ ID NO: 15562 - DNA, 20 bp, Artificial Sequence
  Synthetic oligonucleotide; CAG chr11 5285647 5285666 5285663 +
gactgtggagaaaccatttc

SEQ ID NO: 15563 - DNA, 20 bp, Artificial Sequence
  Synthetic oligonucleotide; TAG chr11 5285651 5285670 5285667 +
gtggagaaaccatttccaga

SEQ ID NO: 15564 - DNA, 20 bp, Artificial Sequence
  Synthetic oligonucleotide; AAG chr11 5285654 5285673 5285670 +
gagaaaccatttccagatag

SEQ ID NO: 15565 - DNA, 20 bp, Artificial Sequence
  Synthetic oligonucleotide; GAG chr11 5285658 5285677 5285674 +
aaccatttccagatagaagt

SEQ ID NO: 15566 - DNA, 20 bp, Artificial Sequence
  Synthetic oligonucleotide; AGG chr11 5285659 5285678 5285675 +
accatttccagatagaagtg

SEQ ID NO: 15567 - DNA, 20 bp, Artificial Sequence
  Synthetic oligonucleotide; GAG chr11 5285661 5285680 5285677 +
catttccagatagaagtgag

SEQ ID NO: 15568 - DNA, 20 bp, Artificial Sequence
  Synthetic oligonucleotide; CAG chr11 5285668 5285687 5285684 +
agatagaagtgaggagattc

SEQ ID NO: 15569 - DNA, 20 bp, Artificial Sequence
  Synthetic oligonucleotide; CAG chr11 5285671 5285690 5285687 +
tagaagtgaggagattccag

SEQ ID NO: 15570 - DNA, 20 bp, Artificial Sequence
  Synthetic oligonucleotide; AGG chr11 5285672 5285691 5285688 +
agaagtgaggagattccagc

SEQ ID NO: 15571 - DNA, 20 bp, Artificial Sequence
  Synthetic oligonucleotide; AAG chr11 5285683 5285702 5285699 +
gattccagcaggaaacactt

SEQ ID NO: 15572 - DNA, 20 bp, Artificial Sequence
  Synthetic oligonucleotide; GAG chr11 5285685 5285704 5285701 +
ttccagcaggaaacacttaa

SEQ ID NO: 15573 - DNA, 20 bp, Artificial Sequence
  Synthetic oligonucleotide; GAG chr11 5285687 5285706 5285703 +
ccagcaggaaacacttaaga

SEQ ID NO: 15574 - DNA, 20 bp, Artificial Sequence
  Synthetic oligonucleotide; AGG chr11 5285688 5285707 5285704 +
cagcaggaaacacttaagag

SEQ ID NO: 15575 - DNA, 20 bp, Artificial Sequence
  Synthetic oligonucleotide; TGG chr11 5285696 5285715 5285712 +
aacacttaagagaggatccc

SEQ ID NO: 15576 - DNA, 20 bp, Artificial Sequence
  Synthetic oligonucleotide; AAG chr11 5285699 5285718 5285715 +
acttaagagaggatccctgg

SEQ ID NO: 15577 - DNA, 20 bp, Artificial Sequence
  Synthetic oligonucleotide; CGG chr11 5285704 5285723 5285720 +
agagaggatccctggaagtt

SEQ ID NO: 15578 - DNA, 20 bp, Artificial Sequence
  Synthetic oligonucleotide; GGG chr11 5285705 5285724 5285721 +
gagaggatccctggaagttc

SEQ ID NO: 15579 - DNA, 20 bp, Artificial Sequence
  Synthetic oligonucleotide; GGG chr11 5285706 5285725 5285722 +
agaggatccctggaagttcg

SEQ ID NO: 15580 - DNA, 20 bp, Artificial Sequence
  Synthetic oligonucleotide; CAG chr11 5285709 5285728 5285725 +
ggatccctggaagttcgggg

SEQ ID NO: 15581 - DNA, 20 bp, Artificial Sequence
  Synthetic oligonucleotide; AGG chr11 5285710 5285729 5285726 +
gatccctggaagttcggggc

SEQ ID NO: 15582 - DNA, 20 bp, Artificial Sequence
  Synthetic oligonucleotide; GAG chr11 5285712 5285731 5285728 +
tccctggaagttcggggcag

SEQ ID NO: 15583 - DNA, 20 bp, Artificial Sequence
  Synthetic oligonucleotide; AGG chr11 5285713 5285732 5285729 +
ccctggaagttcggggcagg

SEQ ID NO: 15584 - DNA, 20 bp, Artificial Sequence
  Synthetic oligonucleotide; AAG chr11 5285730 5285749 5285746 +
aggaggctccctgtcacatg

SEQ ID NO: 15585 - DNA, 20 bp, Artificial Sequence
  Synthetic oligonucleotide; AGG chr11 5285731 5285750 5285747 +
ggaggctccctgtcacatga

SEQ ID NO: 15586 - DNA, 20 bp, Artificial Sequence
  Synthetic oligonucleotide; CAG chr11 5285743 5285762 5285759 +
tcacatgaaggaaacctgct

SEQ ID NO: 15587 - DNA, 20 bp, Artificial Sequence
  Synthetic oligonucleotide; TAG chr11 5285748 5285767 5285764 +
tgaaggaaacctgctcagcg

SEQ ID NO: 15588 - DNA, 20 bp, Artificial Sequence
  Synthetic oligonucleotide; AGG chr11 5285749 5285768 5285765 +
gaaggaaacctgctcagcgt

SEQ ID NO: 15589 - DNA, 20 bp, Artificial Sequence
  Synthetic oligonucleotide; TAG chr11 5285755 5285774 5285771 +
aacctgctcagcgtaggctc

SEQ ID NO: 15590 - DNA, 20 bp, Artificial Sequence
  Synthetic oligonucleotide; AGG chr11 5285756 5285775 5285772 +
acctgctcagcgtaggctct

SEQ ID NO: 15591 - DNA, 20 bp, Artificial Sequence
  Synthetic oligonucleotide; TGG chr11 5285780 5285799 5285796 +
tcttccctactcttatccaa

SEQ ID NO: 15592 - DNA, 20 bp, Artificial Sequence
  Synthetic oligonucleotide; GGG chr11 5285781 5285800 5285797 +
cttccctactcttatccaat

SEQ ID NO: 15593 - DNA, 20 bp, Artificial Sequence
  Synthetic oligonucleotide; GGG chr11 5285782 5285801 5285798 +
ttccctactcttatccaatg

SEQ ID NO: 15594 - DNA, 20 bp, Artificial Sequence
  Synthetic oligonucleotide; AAG chr11 5285796 5285815 5285812 +
ccaatggggcttctgatttt

SEQ ID NO: 15595 - DNA, 20 bp, Artificial Sequence
  Synthetic oligonucleotide; CAG chr11 5285800 5285819 5285816 +
tggggcttctgattttaagc

SEQ ID NO: 15596 - DNA, 20 bp, Artificial Sequence
  Synthetic oligonucleotide; AAG chr11 5285811 5285830 5285827 +
attttaagccagtcttcaca

SEQ ID NO: 15597 - DNA, 20 bp, Artificial Sequence
  Synthetic oligonucleotide; CAG chr11 5285817 5285836 5285833 +
agccagtcttcacaaagccc

SEQ ID NO: 15598 - DNA, 20 bp, Artificial Sequence
  Synthetic oligonucleotide; TGG chr11 5285832 5285851 5285848 +
agccccagatttctacatgc

SEQ ID NO: 15599 - DNA, 20 bp, Artificial Sequence
  Synthetic oligonucleotide; GAG chr11 5285834 5285853 5285850 +
ccccagatttctacatgctg

SEQ ID NO: 15600 - DNA, 20 bp, Artificial Sequence
  Synthetic oligonucleotide; TGG chr11 5285844 5285863 5285860 +
ctacatgctggagccctgaa

SEQ ID NO: 15601 - DNA, 20 bp, Artificial Sequence
  Synthetic oligonucleotide; GGG chr11 5285845 5285864 5285861 +
tacatgctggagccctgaat

SEQ ID NO: 15602 - DNA, 20 bp, Artificial Sequence
  Synthetic oligonucleotide; CAG chr11 5285848 5285867 5285864 +
atgctggagccctgaatggg

SEQ ID NO: 15603 - DNA, 20 bp, Artificial Sequence
  Synthetic oligonucleotide; AGG chr11 5285849 5285868 5285865 +
tgctggagccctgaatgggc

SEQ ID NO: 15604 - DNA, 20 bp, Artificial Sequence
  Synthetic oligonucleotide; AAG chr11 5285852 5285871 5285868 +
tggagccctgaatgggcagg

SEQ ID NO: 15605 - DNA, 20 bp, Artificial Sequence
  Synthetic oligonucleotide; CGG chr11 5285860 5285879 5285876 +
tgaatgggcaggaagcattg

SEQ ID NO: 15606 - DNA, 20 bp, Artificial Sequence
  Synthetic oligonucleotide; CAG chr11 5285876 5285895 5285892 +
attgcggtttccatttcatt

SEQ ID NO: 15607 - DNA, 20 bp, Artificial Sequence
  Synthetic oligonucleotide; GAG chr11 5285878 5285897 5285894 +
tgcggtttccatttcattca

SEQ ID NO: 15608 - DNA, 20 bp, Artificial Sequence
  Synthetic oligonucleotide; TAG chr11 5285904 5285923 5285920 +
tttcataccctgcttcccca

SEQ ID NO: 15609 - DNA, 20 bp, Artificial Sequence
  Synthetic oligonucleotide; AAG chr11 5285948 5285967 5285964 +
ataatctgattcatgcaacc

SEQ ID NO: 15610 - DNA, 20 bp, Artificial Sequence
  Synthetic oligonucleotide; GAG chr11 5285957 5285976 5285973 +
ttcatgcaaccaagaattat

SEQ ID NO: 15611 - DNA, 20 bp, Artificial Sequence
  Synthetic oligonucleotide; GAG chr11 5285959 5285978 5285975 +
catgcaaccaagaattatga

SEQ ID NO: 15612 - DNA, 20 bp, Artificial Sequence
  Synthetic oligonucleotide; GAG chr11 5285961 5285980 5285977 +
tgcaaccaagaattatgaga

SEQ ID NO: 15613 - DNA, 20 bp, Artificial Sequence
  Synthetic oligonucleotide; CAG chr11 5285968 5285987 5285984 +
aagaattatgagagagcctt

SEQ ID NO: 15614 - DNA, 20 bp, Artificial Sequence
  Synthetic oligonucleotide; TAG chr11 5285978 5285997 5285994 +
agagagccttcagtcatgcc

SEQ ID NO: 15615 - DNA, 20 bp, Artificial Sequence
  Synthetic oligonucleotide; AGG chr11 5285979 5285998 5285995 +
gagagccttcagtcatgcct

SEQ ID NO: 15616 - DNA, 20 bp, Artificial Sequence
  Synthetic oligonucleotide; TGG chr11 5286007 5286026 5286023 +
atttattgttgtgcatatga

SEQ ID NO: 15617 - DNA, 20 bp, Artificial Sequence
  Synthetic oligonucleotide; GGG chr11 5286008 5286027 5286024 +
tttattgttgtgcatatgat

SEQ ID NO: 15618 - DNA, 20 bp, Artificial Sequence
  Synthetic oligonucleotide; GGG chr11 5286009 5286028 5286025 +
ttattgttgtgcatatgatg

SEQ ID NO: 15619 - DNA, 20 bp, Artificial Sequence
  Synthetic oligonucleotide; TAG chr11 5286012 5286031 5286028 +
ttgttgtgcatatgatgggg

SEQ ID NO: 15620 - DNA, 20 bp, Artificial Sequence
  Synthetic oligonucleotide; CAG chr11 5286015 5286034 5286031 +
ttgtgcatatgatggggtag

SEQ ID NO: 15621 - DNA, 20 bp, Artificial Sequence
  Synthetic oligonucleotide; AAG chr11 5286020 5286039 5286036 +
catatgatggggtagcagac

SEQ ID NO: 15622 - DNA, 20 bp, Artificial Sequence
  Synthetic oligonucleotide; CAG chr11 5286033 5286052 5286049 +
agcagacaagaaaacgttaa

SEQ ID NO: 15623 - DNA, 20 bp, Artificial Sequence
  Synthetic oligonucleotide; TAG chr11 5286038 5286057 5286054 +
acaagaaaacgttaacagca

SEQ ID NO: 15624 - DNA, 20 bp, Artificial Sequence
  Synthetic oligonucleotide; CAG chr11 5286048 5286067 5286064 +
gttaacagcatagactttct

SEQ ID NO: 15625 - DNA, 20 bp, Artificial Sequence
  Synthetic oligonucleotide; GAG chr11 5286050 5286069 5286066 +
taacagcatagactttctca

SEQ ID NO: 15626 - DNA, 20 bp, Artificial Sequence
  Synthetic oligonucleotide; GAG chr11 5286059 5286078 5286075 +
agactttctcagagctatat

SEQ ID NO: 15627 - DNA, 20 bp, Artificial Sequence
  Synthetic oligonucleotide; TGG chr11 5286064 5286083 5286080 +
ttctcagagctatatgagtt

SEQ ID NO: 15628 - DNA, 20 bp, Artificial Sequence
  Synthetic oligonucleotide; GGG chr11 5286065 5286084 5286081 +
tctcagagctatatgagttt

SEQ ID NO: 15629 - DNA, 20 bp, Artificial Sequence
  Synthetic oligonucleotide; AAG chr11 5286076 5286095 5286092 +
tatgagtttgggaattaatc

SEQ ID NO: 15630 - DNA, 20 bp, Artificial Sequence
  Synthetic oligonucleotide; CAG chr11 5286081 5286100 5286097 +
gtttgggaattaatcaagac

SEQ ID NO: 15631 - DNA, 20 bp, Artificial Sequence
  Synthetic oligonucleotide; CAG chr11 5286093 5286112 5286109 +
atcaagaccagccttttgct

SEQ ID NO: 15632 - DNA, 20 bp, Artificial Sequence
  Synthetic oligonucleotide; AGG chr11 5286094 5286113 5286110 +
tcaagaccagccttttgctc

SEQ ID NO: 15633 - DNA, 20 bp, Artificial Sequence
  Synthetic oligonucleotide; GGG chr11 5286095 5286114 5286111 +
caagaccagccttttgctca

SEQ ID NO: 15634 - DNA, 20 bp, Artificial Sequence
  Synthetic oligonucleotide; TAG chr11 5286098 5286117 5286114 +
gaccagccttttgctcaggg

SEQ ID NO: 15635 - DNA, 20 bp, Artificial Sequence
  Synthetic oligonucleotide; TAG chr11 5286111 5286130 5286127 +
ctcagggtagaaatccccta

SEQ ID NO: 15636 - DNA, 20 bp, Artificial Sequence
  Synthetic oligonucleotide; AGG chr11 5286112 5286131 5286128 +
tcagggtagaaatcccctat

SEQ ID NO: 15637 - DNA, 20 bp, Artificial Sequence
  Synthetic oligonucleotide; GGG chr11 5286113 5286132 5286129 +
cagggtagaaatcccctata

SEQ ID NO: 15638 - DNA, 20 bp, Artificial Sequence
  Synthetic oligonucleotide; TGG chr11 5286129 5286148 5286145 +
tatagggatttattcaatga

SEQ ID NO: 15639 - DNA, 20 bp, Artificial Sequence
  Synthetic oligonucleotide; GGG chr11 5286130 5286149 5286146 +
atagggatttattcaatgat

SEQ ID NO: 15640 - DNA, 20 bp, Artificial Sequence
  Synthetic oligonucleotide; AAG chr11 5286137 5286156 5286153 +
tttattcaatgatgggttaa

SEQ ID NO: 15641 - DNA, 20 bp, Artificial Sequence
  Synthetic oligonucleotide; TGG chr11 5286149 5286168 5286165 +
tgggttaaaagctttctata

SEQ ID NO: 15642 - DNA, 20 bp, Artificial Sequence
  Synthetic oligonucleotide; GAG chr11 5286153 5286172 5286169 +
ttaaaagctttctatatggt

SEQ ID NO: 15643 - DNA, 20 bp, Artificial Sequence
  Synthetic oligonucleotide; AGG chr11 5286154 5286173 5286170 +
taaaagctttctatatggtg

SEQ ID NO: 15644 - DNA, 20 bp, Artificial Sequence
  Synthetic oligonucleotide; GAG chr11 5286156 5286175 5286172 +
aaagctttctatatggtgag

SEQ ID NO: 15645 - DNA, 20 bp, Artificial Sequence
  Synthetic oligonucleotide; CAG chr11 5286163 5286182 5286179 +
tctatatggtgaggagctca

SEQ ID NO: 15646 - DNA, 20 bp, Artificial Sequence
  Synthetic oligonucleotide; AAG chr11 5286173 5286192 5286189 +
gaggagctcacagattttcc

SEQ ID NO: 15647 - DNA, 20 bp, Artificial Sequence
  Synthetic oligonucleotide; TAG chr11 5286189 5286208 5286205 +
ttccaagcccttgcttttgc

SEQ ID NO: 15648 - DNA, 20 bp, Artificial Sequence
  Synthetic oligonucleotide; CAG chr11 5286193 5286212 5286209 +
aagcccttgcttttgctaga

SEQ ID NO: 15649 - DNA, 20 bp, Artificial Sequence
  Synthetic oligonucleotide; CAG chr11 5286222 5286241 5286238 +
gtttatgaaattcttacaca

SEQ ID NO: 15650 - DNA, 20 bp, Artificial Sequence
  Synthetic oligonucleotide; AAG chr11 5286225 5286244 5286241 +
tatgaaattcttacacacag

SEQ ID NO: 15651 - DNA, 20 bp, Artificial Sequence
  Synthetic oligonucleotide; TGG chr11 5286241 5286260 5286257 +
acagaagaatcttctaatcc

SEQ ID NO: 15652 - DNA, 20 bp, Artificial Sequence
  Synthetic oligonucleotide; GGG chr11 5286242 5286261 5286258 +
cagaagaatcttctaatcct

SEQ ID NO: 15653 - DNA, 20 bp, Artificial Sequence
  Synthetic oligonucleotide; CAG chr11 5286273 5286292 5286289 +
tataacttgattccctattc

SEQ ID NO: 15654 - DNA, 20 bp, Artificial Sequence
  Synthetic oligonucleotide; AAG chr11 5286276 5286295 5286292 +
aacttgattccctattccag

SEQ ID NO: 15655 - DNA, 20 bp, Artificial Sequence
  Synthetic oligonucleotide; AAG chr11 5286298 5286317 5286314 +
gataatattcccatattctg

SEQ ID NO: 15656 - DNA, 20 bp, Artificial Sequence
  Synthetic oligonucleotide; TAG chr11 5286323 5286342 5286339 +
ttcatgcatttgttaaataa

SEQ ID NO: 15657 - DNA, 20 bp, Artificial Sequence
  Synthetic oligonucleotide; AGG chr11 5286324 5286343 5286340 +
tcatgcatttgttaaataat

SEQ ID NO: 15658 - DNA, 20 bp, Artificial Sequence
  Synthetic oligonucleotide; TAG chr11 5286329 5286348 5286345 +
catttgttaaataataggca

SEQ ID NO: 15659 - DNA, 20 bp, Artificial Sequence
  Synthetic oligonucleotide; AAG chr11 5286336 5286355 5286352 +
taaataataggcatagtgac

SEQ ID NO: 15660 - DNA, 20 bp, Artificial Sequence
  Synthetic oligonucleotide; CAG chr11 5286342 5286361 5286358 +
ataggcatagtgacaagtgc

SEQ ID NO: 15661 - DNA, 20 bp, Artificial Sequence
  Synthetic oligonucleotide; CAG chr11 5286353 5286372 5286369 +
gacaagtgccagaactctaa

SEQ ID NO: 15662 - DNA, 20 bp, Artificial Sequence
  Synthetic oligonucleotide; CAG chr11 5286361 5286380 5286377 +
ccagaactctaacagtcaac

SEQ ID NO: 15663 - DNA, 20 bp, Artificial Sequence
  Synthetic oligonucleotide; GAG chr11 5286363 5286382 5286379 +
agaactctaacagtcaacca

SEQ ID NO: 15664 - DNA, 20 bp, Artificial Sequence
  Synthetic oligonucleotide; GAG chr11 5286365 5286384 5286381 +
aactctaacagtcaaccaga

SEQ ID NO: 15665 - DNA, 20 bp, Artificial Sequence
  Synthetic oligonucleotide; CAG chr11 5286371 5286390 5286387 +
aacagtcaaccagagagcca

SEQ ID NO: 15666 - DNA, 20 bp, Artificial Sequence
  Synthetic oligonucleotide; AAG chr11 5286388 5286407 5286404 +
ccacagttttcaacttcaca

SEQ ID NO: 15667 - DNA, 20 bp, Artificial Sequence
  Synthetic oligonucleotide; AAG chr11 5286406 5286425 5286422 +
caaagttaaccatctaactg

SEQ ID NO: 15668 - DNA, 20 bp, Artificial Sequence
  Synthetic oligonucleotide; CAG chr11 5286410 5286429 5286426 +
gttaaccatctaactgaaga

SEQ ID NO: 15669 - DNA, 20 bp, Artificial Sequence
  Synthetic oligonucleotide; CAG chr11 5286413 5286432 5286429 +
aaccatctaactgaagacag

SEQ ID NO: 15670 - DNA, 20 bp, Artificial Sequence
  Synthetic oligonucleotide; TGG chr11 5286444 5286463 5286460 +
accaccaccccttctccaca

SEQ ID NO: 15671 - DNA, 20 bp, Artificial Sequence
  Synthetic oligonucleotide; TAG chr11 5286449 5286468 5286465 +
caccccttctccacatggtg

SEQ ID NO: 15672 - DNA, 20 bp, Artificial Sequence
  Synthetic oligonucleotide; CAG chr11 5286465 5286484 5286481 +
ggtgtagtctttcctgatgt

SEQ ID NO: 15673 - DNA, 20 bp, Artificial Sequence
  Synthetic oligonucleotide; AGG chr11 5286466 5286485 5286482 +
gtgtagtctttcctgatgtc

SEQ ID NO: 15674 - DNA, 20 bp, Artificial Sequence
  Synthetic oligonucleotide; GGG chr11 5286467 5286486 5286483 +
tgtagtctttcctgatgtca

SEQ ID NO: 15675 - DNA, 20 bp, Artificial Sequence
  Synthetic oligonucleotide; TAG chr11 5286474 5286493 5286490 +
tttcctgatgtcagggatgt

SEQ ID NO: 15676 - DNA, 20 bp, Artificial Sequence
  Synthetic oligonucleotide; AGG chr11 5286475 5286494 5286491 +
ttcctgatgtcagggatgtt

SEQ ID NO: 15677 - DNA, 20 bp, Artificial Sequence
  Synthetic oligonucleotide; CAG chr11 5286480 5286499 5286496 +
gatgtcagggatgttaggct

SEQ ID NO: 15678 - DNA, 20 bp, Artificial Sequence
  Synthetic oligonucleotide; AGG chr11 5286481 5286500 5286497 +
atgtcagggatgttaggctc

SEQ ID NO: 15679 - DNA, 20 bp, Artificial Sequence
  Synthetic oligonucleotide; TAG chr11 5286485 5286504 5286501 +
cagggatgttaggctcaggt

SEQ ID NO: 15680 - DNA, 20 bp, Artificial Sequence
  Synthetic oligonucleotide; AGG chr11 5286486 5286505 5286502 +
agggatgttaggctcaggtt

SEQ ID NO: 15681 - DNA, 20 bp, Artificial Sequence
  Synthetic oligonucleotide; AAG chr11 5286490 5286509 5286506 +
atgttaggctcaggttagga

SEQ ID NO: 15682 - DNA, 20 bp, Artificial Sequence
  Synthetic oligonucleotide; CAG chr11 5286494 5286513 5286510 +
taggctcaggttaggaaagt

SEQ ID NO: 15683 - DNA, 20 bp, Artificial Sequence
  Synthetic oligonucleotide; CAG chr11 5286507 5286526 5286523 +
ggaaagtcagactatcatcc

SEQ ID NO: 15684 - DNA, 20 bp, Artificial Sequence
  Synthetic oligonucleotide; GAG chr11 5286509 5286528 5286525 +
aaagtcagactatcatccca

SEQ ID NO: 15685 - DNA, 20 bp, Artificial Sequence
  Synthetic oligonucleotide; CAG chr11 5286512 5286531 5286528 +
gtcagactatcatcccagag

SEQ ID NO: 15686 - DNA, 20 bp, Artificial Sequence
  Synthetic oligonucleotide; AGG chr11 5286513 5286532 5286529 +
tcagactatcatcccagagc

SEQ ID NO: 15687 - DNA, 20 bp, Artificial Sequence
  Synthetic oligonucleotide; CAG chr11 5286519 5286538 5286535 +
tatcatcccagagcaggaca

SEQ ID NO: 15688 - DNA, 20 bp, Artificial Sequence
  Synthetic oligonucleotide; AAG chr11 5286529 5286548 5286545 +
gagcaggacacagacgaata

SEQ ID NO: 15689 - DNA, 20 bp, Artificial Sequence
  Synthetic oligonucleotide; TAG chr11 5286542 5286561 5286558 +
acgaataaagtgtaattttt

SEQ ID NO: 15690 - DNA, 20 bp, Artificial Sequence
  Synthetic oligonucleotide; TAG chr11 5286550 5286569 5286566 +
agtgtaattttttagtcact

SEQ ID NO: 15691 - DNA, 20 bp, Artificial Sequence
  Synthetic oligonucleotide; AGG chr11 5286551 5286570 5286567 +
gtgtaattttttagtcactt

SEQ ID NO: 15692 - DNA, 20 bp, Artificial Sequence
  Synthetic oligonucleotide; CAG chr11 5286559 5286578 5286575 +
ttttagtcacttaggaaaaa

SEQ ID NO: 15693 - DNA, 20 bp, Artificial Sequence
  Synthetic oligonucleotide; TGG chr11 5286562 5286581 5286578 +
tagtcacttaggaaaaacag

SEQ ID NO: 15694 - DNA, 20 bp, Artificial Sequence
  Synthetic oligonucleotide; AAG chr11 5286571 5286590 5286587 +
aggaaaaacagtggaatgca

SEQ ID NO: 15695 - DNA, 20 bp, Artificial Sequence
  Synthetic oligonucleotide; GAG chr11 5286573 5286592 5286589 +
gaaaaacagtggaatgcaaa

SEQ ID NO: 15696 - DNA, 20 bp, Artificial Sequence
  Synthetic oligonucleotide; TGG chr11 5286594 5286613 5286610 +
agtaaaaaatgctttctgaa

SEQ ID NO: 15697 - DNA, 20 bp, Artificial Sequence
  Synthetic oligonucleotide; TGG chr11 5286603 5286622 5286619 +
tgctttctgaatggataact

SEQ ID NO: 15698 - DNA, 20 bp, Artificial Sequence
  Synthetic oligonucleotide; TGG chr11 5286608 5286627 5286624 +
tctgaatggataacttggcc

SEQ ID NO: 15699 - DNA, 20 bp, Artificial Sequence
  Synthetic oligonucleotide; GGG chr11 5286609 5286628 5286625 +
ctgaatggataacttggcct

SEQ ID NO: 15700 - DNA, 20 bp, Artificial Sequence
  Synthetic oligonucleotide; GAG chr11 5286611 5286630 5286627 +
gaatggataacttggcctgg

SEQ ID NO: 15701 - DNA, 20 bp, Artificial Sequence
  Synthetic oligonucleotide; AGG chr11 5286612 5286631 5286628 +
aatggataacttggcctggg

SEQ ID NO: 15702 - DNA, 20 bp, Artificial Sequence
  Synthetic oligonucleotide; TGG chr11 5286619 5286638 5286635 +
aacttggcctgggaggcctt

SEQ ID NO: 15703 - DNA, 20 bp, Artificial Sequence
  Synthetic oligonucleotide; AAG chr11 5286622 5286641 5286638 +
ttggcctgggaggcctttgg

SEQ ID NO: 15704 - DNA, 20 bp, Artificial Sequence
  Synthetic oligonucleotide; CAG chr11 5286625 5286644 5286641 +
gcctgggaggcctttggaag

SEQ ID NO: 15705 - DNA, 20 bp, Artificial Sequence
  Synthetic oligonucleotide; GAG chr11 5286627 5286646 5286643 +
ctgggaggcctttggaagca

SEQ ID NO: 15706 - DNA, 20 bp, Artificial Sequence
  Synthetic oligonucleotide; TGG chr11 5286632 5286651 5286648 +
aggcctttggaagcagagac

SEQ ID NO: 15707 - DNA, 20 bp, Artificial Sequence
  Synthetic oligonucleotide; GAG chr11 5286634 5286653 5286650 +
gcctttggaagcagagactg

SEQ ID NO: 15708 - DNA, 20 bp, Artificial Sequence
  Synthetic oligonucleotide; CAG chr11 5286663 5286682 5286679 +
tttaaacatctttgtatccc

SEQ ID NO: 15709 - DNA, 20 bp, Artificial Sequence
  Synthetic oligonucleotide; CAG chr11 5286670 5286689 5286686 +
atctttgtatccccagcatc

SEQ ID NO: 15710 - DNA, 20 bp, Artificial Sequence
  Synthetic oligonucleotide; CAG chr11 5286677 5286696 5286693 +
tatccccagcatccagcata

SEQ ID NO: 15711 - DNA, 20 bp, Artificial Sequence
  Synthetic oligonucleotide; AAG chr11 5286686 5286705 5286702 +
catccagcatacagactgcc

SEQ ID NO: 15712 - DNA, 20 bp, Artificial Sequence
  Synthetic oligonucleotide; AAG chr11 5286689 5286708 5286705 +
ccagcatacagactgccaag

SEQ ID NO: 15713 - DNA, 20 bp, Artificial Sequence
  Synthetic oligonucleotide; TGG chr11 5286713 5286732 5286729 +
acatgtcaataaatatttat

SEQ ID NO: 15714 - DNA, 20 bp, Artificial Sequence
  Synthetic oligonucleotide; TAG chr11 5286717 5286736 5286733 +
gtcaataaatatttattgga

SEQ ID NO: 15715 - DNA, 20 bp, Artificial Sequence
  Synthetic oligonucleotide; GAG chr11 5286721 5286740 5286737 +
ataaatatttattggatagt

SEQ ID NO: 15716 - DNA, 20 bp, Artificial Sequence
  Synthetic oligonucleotide; AAG chr11 5286726 5286745 5286742 +
tatttattggatagtgagca

SEQ ID NO: 15717 - DNA, 20 bp, Artificial Sequence
  Synthetic oligonucleotide; TAG chr11 5286736 5286755 5286752 +
atagtgagcaaagacataat

SEQ ID NO: 15718 - DNA, 20 bp, Artificial Sequence
  Synthetic oligonucleotide; AGG chr11 5286737 5286756 5286753 +
tagtgagcaaagacataatt

SEQ ID NO: 15719 - DNA, 20 bp, Artificial Sequence
  Synthetic oligonucleotide; TAG chr11 5286765 5286784 5286781 +
atctcaattctactatttgc

SEQ ID NO: 15720 - DNA, 20 bp, Artificial Sequence
  Synthetic oligonucleotide; TAG chr11 5286768 5286787 5286784 +
tcaattctactatttgctag

SEQ ID NO: 15721 - DNA, 20 bp, Artificial Sequence
  Synthetic oligonucleotide; GAG chr11 5286788 5286807 5286804 +
tagtttatgtttgtgtgtgt

SEQ ID NO: 15722 - DNA, 20 bp, Artificial Sequence
  Synthetic oligonucleotide; GAG chr11 5286790 5286809 5286806 +
gtttatgtttgtgtgtgtga

SEQ ID NO: 15723 - DNA, 20 bp, Artificial Sequence
  Synthetic oligonucleotide; GAG chr11 5286802 5286821 5286818 +
gtgtgtgagagtgtatgctt

SEQ ID NO: 15724 - DNA, 20 bp, Artificial Sequence
  Synthetic oligonucleotide; AAG chr11 5286806 5286825 5286822 +
gtgagagtgtatgcttgagc

SEQ ID NO: 15725 - DNA, 20 bp, Artificial Sequence
  Synthetic oligonucleotide; GAG chr11 5286811 5286830 5286827 +
agtgtatgcttgagcaagtt

SEQ ID NO: 15726 - DNA, 20 bp, Artificial Sequence
  Synthetic oligonucleotide; GAG chr11 5286813 5286832 5286829 +
tgtatgcttgagcaagttga

SEQ ID NO: 15727 - DNA, 20 bp, Artificial Sequence
  Synthetic oligonucleotide; AGG chr11 5286814 5286833 5286830 +
gtatgcttgagcaagttgag

SEQ ID NO: 15728 - DNA, 20 bp, Artificial Sequence
  Synthetic oligonucleotide; TAG chr11 5286817 5286836 5286833 +
tgcttgagcaagttgagagg

SEQ ID NO: 15729 - DNA, 20 bp, Artificial Sequence
  Synthetic oligonucleotide; TAG chr11 5286832 5286851 5286848 +
agaggtagtttttttaactg

SEQ ID NO: 15730 - DNA, 20 bp, Artificial Sequence
  Synthetic oligonucleotide; TGG chr11 5286840 5286859 5286856 +
tttttttaactgtagtaaaa

SEQ ID NO: 15731 - DNA, 20 bp, Artificial Sequence
  Synthetic oligonucleotide; GGG chr11 5286841 5286860 5286857 +
ttttttaactgtagtaaaat

SEQ ID NO: 15732 - DNA, 20 bp, Artificial Sequence
  Synthetic oligonucleotide; GGG chr11 5286842 5286861 5286858 +
tttttaactgtagtaaaatg

SEQ ID NO: 15733 - DNA, 20 bp, Artificial Sequence
  Synthetic oligonucleotide; TAG chr11 5286852 5286871 5286868 +
tagtaaaatggggataataa

SEQ ID NO: 15734 - DNA, 20 bp, Artificial Sequence
  Synthetic oligonucleotide; AAG chr11 5286866 5286885 5286882 +
taataatagtatctacctga

SEQ ID NO: 15735 - DNA, 20 bp, Artificial Sequence
  Synthetic oligonucleotide; AAG chr11 5286874 5286893 5286890 +
gtatctacctgaaagaatcc

SEQ ID NO: 15736 - DNA, 20 bp, Artificial Sequence
  Synthetic oligonucleotide; GAG chr11 5286876 5286895 5286892 +
atctacctgaaagaatccaa

SEQ ID NO: 15737 - DNA, 20 bp, Artificial Sequence
  Synthetic oligonucleotide; AAG chr11 5286902 5286921 5286918 +
taaatatgattaattatgca

SEQ ID NO: 15738 - DNA, 20 bp, Artificial Sequence
  Synthetic oligonucleotide; CAG chr11 5286914 5286933 5286930 +
attatgcaaagcactaatta

SEQ ID NO: 15739 - DNA, 20 bp, Artificial Sequence
  Synthetic oligonucleotide; TAG chr11 5286924 5286943 5286940 +
gcactaattacagtctctga

SEQ ID NO: 15740 - DNA, 20 bp, Artificial Sequence
  Synthetic oligonucleotide; CAG chr11 5286941 5286960 5286957 +
tgatagccttcaataaatgt

SEQ ID NO: 15741 - DNA, 20 bp, Artificial Sequence
  Synthetic oligonucleotide; CAG chr11 5286959 5286978 5286975 +
gtcagttatttttattatta

SEQ ID NO: 15742 - DNA, 20 bp, Artificial Sequence
  Synthetic oligonucleotide; AAG chr11 5286965 5286984 5286981 +
tatttttattattacagtta

SEQ ID NO: 15743 - DNA, 20 bp, Artificial Sequence
  Synthetic oligonucleotide; TGG chr11 5286973 5286992 5286989 +
ttattacagttaaagatgaa

SEQ ID NO: 15744 - DNA, 20 bp, Artificial Sequence
  Synthetic oligonucleotide; GGG chr11 5286974 5286993 5286990 +
tattacagttaaagatgaat

SEQ ID NO: 15745 - DNA, 20 bp, Artificial Sequence
  Synthetic oligonucleotide; AAG chr11 5286981 5287000 5286997 +
gttaaagatgaatgggcata

SEQ ID NO: 15746 - DNA, 20 bp, Artificial Sequence
  Synthetic oligonucleotide; CAG chr11 5286986 5287005 5287002 +
agatgaatgggcataaagta

SEQ ID NO: 15747 - DNA, 20 bp, Artificial Sequence
  Synthetic oligonucleotide; TAG chr11 5286994 5287013 5287010 +
gggcataaagtacagaacac

SEQ ID NO: 15748 - DNA, 20 bp, Artificial Sequence
  Synthetic oligonucleotide; CAG chr11 5287007 5287026 5287023 +
agaacactagttttcacctg

SEQ ID NO: 15749 - DNA, 20 bp, Artificial Sequence
  Synthetic oligonucleotide; AAG chr11 5287011 5287030 5287027 +
cactagttttcacctgcagc

SEQ ID NO: 15750 - DNA, 20 bp, Artificial Sequence
  Synthetic oligonucleotide; CAG chr11 5287022 5287041 5287038 +
acctgcagcaagaatgattg

SEQ ID NO: 15751 - DNA, 20 bp, Artificial Sequence
  Synthetic oligonucleotide; TAG chr11 5287040 5287059 5287056 +
tgcagttaaacaaaaaatac

SEQ ID NO: 15752 - DNA, 20 bp, Artificial Sequence
  Synthetic oligonucleotide; TAG chr11 5287053 5287072 5287069 +
aaaatactagcaaacatttc

SEQ ID NO: 15753 - DNA, 20 bp, Artificial Sequence
  Synthetic oligonucleotide; GAG chr11 5287055 5287074 5287071 +
aatactagcaaacatttcta

SEQ ID NO: 15754 - DNA, 20 bp, Artificial Sequence
  Synthetic oligonucleotide; TAG chr11 5287058 5287077 5287074 +
actagcaaacatttctagag

SEQ ID NO: 15755 - DNA, 20 bp, Artificial Sequence
  Synthetic oligonucleotide; TAG chr11 5287062 5287081 5287078 +
gcaaacatttctagagtagt

SEQ ID NO: 15756 - DNA, 20 bp, Artificial Sequence
  Synthetic oligonucleotide; AAG chr11 5287072 5287091 5287088 +
ctagagtagttagcatttat

SEQ ID NO: 15757 - DNA, 20 bp, Artificial Sequence
  Synthetic oligonucleotide; CGG chr11 5287111 5287130 5287127 +
tttgcatgtattaactcact

SEQ ID NO: 15758 - DNA, 20 bp, Artificial Sequence
  Synthetic oligonucleotide; GGG chr11 5287112 5287131 5287128 +
ttgcatgtattaactcactc

SEQ ID NO: 15759 - DNA, 20 bp, Artificial Sequence
  Synthetic oligonucleotide; CAG chr11 5287118 5287137 5287134 +
gtattaactcactcgggctg

SEQ ID NO: 15760 - DNA, 20 bp, Artificial Sequence
  Synthetic oligonucleotide; GAG chr11 5287132 5287151 5287148 +
gggctgcagaacaatcttat

SEQ ID NO: 15761 - DNA, 20 bp, Artificial Sequence
  Synthetic oligonucleotide; CAG chr11 5287169 5287188 5287185 +
tgtaatcatgcttataatcc

SEQ ID NO: 15762 - DNA, 20 bp, Artificial Sequence
  Synthetic oligonucleotide; TGG chr11 5287177 5287196 5287193 +
tgcttataatcccagcactt

SEQ ID NO: 15763 - DNA, 20 bp, Artificial Sequence
  Synthetic oligonucleotide; AAG chr11 5287180 5287199 5287196 +
ttataatcccagcactttgg

SEQ ID NO: 15764 - DNA, 20 bp, Artificial Sequence
  Synthetic oligonucleotide; AGG chr11 5287181 5287200 5287197 +
tataatcccagcactttgga

SEQ ID NO: 15765 - DNA, 20 bp, Artificial Sequence
  Synthetic oligonucleotide; GAG chr11 5287186 5287205 5287202 +
tcccagcactttggaaggct

SEQ ID NO: 15766 - DNA, 20 bp, Artificial Sequence
  Synthetic oligonucleotide; AGG chr11 5287187 5287206 5287203 +
cccagcactttggaaggctg

SEQ ID NO: 15767 - DNA, 20 bp, Artificial Sequence
  Synthetic oligonucleotide; TGG chr11 5287190 5287209 5287206 +
agcactttggaaggctgagg

SEQ ID NO: 15768 - DNA, 20 bp, Artificial Sequence
  Synthetic oligonucleotide; GGG chr11 5287191 5287210 5287207 +
gcactttggaaggctgaggt

SEQ ID NO: 15769 - DNA, 20 bp, Artificial Sequence
  Synthetic oligonucleotide; CAG chr11 5287194 5287213 5287210 +
ctttggaaggctgaggtggg

SEQ ID NO: 15770 - DNA, 20 bp, Artificial Sequence
  Synthetic oligonucleotide; GAG chr11 5287204 5287223 5287220 +
ctgaggtgggcagattgctt

SEQ ID NO: 15771 - DNA, 20 bp, Artificial Sequence
  Synthetic oligonucleotide; CGG chr11 5287210 5287229 5287226 +
tgggcagattgcttgagctc

SEQ ID NO: 15772 - DNA, 20 bp, Artificial Sequence
  Synthetic oligonucleotide; GAG chr11 5287212 5287231 5287228 +
ggcagattgcttgagctccg

SEQ ID NO: 15773 - DNA, 20 bp, Artificial Sequence
  Synthetic oligonucleotide; GAG chr11 5287218 5287237 5287234 +
ttgcttgagctccggagtct

SEQ ID NO: 15774 - DNA, 20 bp, Artificial Sequence
  Synthetic oligonucleotide; TAG chr11 5287272 5287291 5287288 +
ctaccaaaaatacaaaaaat

SEQ ID NO: 15775 - DNA, 20 bp, Artificial Sequence
  Synthetic oligonucleotide; GAG chr11 5287276 5287295 5287292 +
caaaaatacaaaaaattagc

SEQ ID NO: 15776 - DNA, 20 bp, Artificial Sequence
  Synthetic oligonucleotide; AGG chr11 5287277 5287296 5287293 +
aaaaatacaaaaaattagcg

SEQ ID NO: 15777 - DNA, 20 bp, Artificial Sequence
  Synthetic oligonucleotide; TGG chr11 5287282 5287301 5287298 +
tacaaaaaattagcgaggta

SEQ ID NO: 15778 - DNA, 20 bp, Artificial Sequence
  Synthetic oligonucleotide; TGG chr11 5287285 5287304 5287301 +
aaaaaattagcgaggtatgg

SEQ ID NO: 15779 - DNA, 20 bp, Artificial Sequence
  Synthetic oligonucleotide; TGG chr11 5287298 5287317 5287314 +
ggtatggtggtgtgtacctg

SEQ ID NO: 15780 - DNA, 20 bp, Artificial Sequence
  Synthetic oligonucleotide; CAG chr11 5287304 5287323 5287320 +
gtggtgtgtacctgtggttc

SEQ ID NO: 15781 - DNA, 20 bp, Artificial Sequence
  Synthetic oligonucleotide; CAG chr11 5287312 5287331 5287328 +
tacctgtggttccagctact

SEQ ID NO: 15782 - DNA, 20 bp, Artificial Sequence
  Synthetic oligonucleotide; AGG chr11 5287313 5287332 5287329 +
acctgtggttccagctactc

SEQ ID NO: 15783 - DNA, 20 bp, Artificial Sequence
  Synthetic oligonucleotide; GAG chr11 5287321 5287340 5287337 +
ttccagctactcaggatgtt

SEQ ID NO: 15784 - DNA, 20 bp, Artificial Sequence
  Synthetic oligonucleotide; AGG chr11 5287322 5287341 5287338 +
tccagctactcaggatgttg

SEQ ID NO: 15785 - DNA, 20 bp, Artificial Sequence
  Synthetic oligonucleotide; TGG chr11 5287325 5287344 5287341 +
agctactcaggatgttgagg

SEQ ID NO: 15786 - DNA, 20 bp, Artificial Sequence
  Synthetic oligonucleotide; GGG chr11 5287326 5287345 5287342 +
gctactcaggatgttgaggt

SEQ ID NO: 15787 - DNA, 20 bp, Artificial Sequence
  Synthetic oligonucleotide; GAG chr11 5287328 5287347 5287344 +
tactcaggatgttgaggtgg

SEQ ID NO: 15788 - DNA, 20 bp, Artificial Sequence
  Synthetic oligonucleotide; AGG chr11 5287329 5287348 5287345 +
actcaggatgttgaggtggg

SEQ ID NO: 15789 - DNA, 20 bp, Artificial Sequence
  Synthetic oligonucleotide; GAG chr11 5287339 5287358 5287355 +
ttgaggtgggaggaccgctt

SEQ ID NO: 15790 - DNA, 20 bp, Artificial Sequence
  Synthetic oligonucleotide; TGG chr11 5287344 5287363 5287360 +
gtgggaggaccgcttgagcc

SEQ ID NO: 15791 - DNA, 20 bp, Artificial Sequence
  Synthetic oligonucleotide; GGG chr11 5287345 5287364 5287361 +
tgggaggaccgcttgagcct

SEQ ID NO: 15792 - DNA, 20 bp, Artificial Sequence
  Synthetic oligonucleotide; AAG chr11 5287348 5287367 5287364 +
gaggaccgcttgagcctggg

SEQ ID NO: 15793 - DNA, 20 bp, Artificial Sequence
  Synthetic oligonucleotide; AAG chr11 5287354 5287373 5287370 +
cgcttgagcctgggaagtgc

SEQ ID NO: 15794 - DNA, 20 bp, Artificial Sequence
  Synthetic oligonucleotide; CAG chr11 5287360 5287379 5287376 +
agcctgggaagtgcaagttg

SEQ ID NO: 15795 - DNA, 20 bp, Artificial Sequence
  Synthetic oligonucleotide; GAG chr11 5287364 5287383 5287380 +
tgggaagtgcaagttgcagt

SEQ ID NO: 15796 - DNA, 20 bp, Artificial Sequence
  Synthetic oligonucleotide; GAG chr11 5287369 5287388 5287385 +
agtgcaagttgcagtgagcc

SEQ ID NO: 15797 - DNA, 20 bp, Artificial Sequence
  Synthetic oligonucleotide; TGG chr11 5287394 5287413 5287410 +
tttgccactacactcccatt

SEQ ID NO: 15798 - DNA, 20 bp, Artificial Sequence
  Synthetic oligonucleotide; GGG chr11 5287395 5287414 5287411 +
ttgccactacactcccattt

SEQ ID NO: 15799 - DNA, 20 bp, Artificial Sequence
  Synthetic oligonucleotide; CAG chr11 5287401 5287420 5287417 +
ctacactcccatttgggtga

SEQ ID NO: 15800 - DNA, 20 bp, Artificial Sequence
  Synthetic oligonucleotide; GAG chr11 5287403 5287422 5287419 +
acactcccatttgggtgaca

SEQ ID NO: 15801 - DNA, 20 bp, Artificial Sequence
  Synthetic oligonucleotide; GAG chr11 5287407 5287426 5287423 +
tcccatttgggtgacagagt

SEQ ID NO: 15802 - DNA, 20 bp, Artificial Sequence
  Synthetic oligonucleotide; CAG chr11 5287453 5287472 5287469 +
ttaaaaaaccctccatttta

SEQ ID NO: 15803 - DNA, 20 bp, Artificial Sequence
  Synthetic oligonucleotide; AAG chr11 5287459 5287478 5287475 +
aaccctccattttacagatg

SEQ ID NO: 15804 - DNA, 20 bp, Artificial Sequence
  Synthetic oligonucleotide; GAG chr11 5287467 5287486 5287483 +
attttacagatgaagaaact

SEQ ID NO: 15805 - DNA, 20 bp, Artificial Sequence
  Synthetic oligonucleotide; AAG chr11 5287483 5287502 5287499 +
aactgagtcatacaactact

SEQ ID NO: 15806 - DNA, 20 bp, Artificial Sequence
  Synthetic oligonucleotide; GAG chr11 5287485 5287504 5287501 +
ctgagtcatacaactactaa

SEQ ID NO: 15807 - DNA, 20 bp, Artificial Sequence
  Synthetic oligonucleotide; GAG chr11 5287493 5287512 5287509 +
tacaactactaagagaaact

SEQ ID NO: 15808 - DNA, 20 bp, Artificial Sequence
  Synthetic oligonucleotide; CAG chr11 5287508 5287527 5287524 +
aaactgagtcactaatcact

SEQ ID NO: 15809 - DNA, 20 bp, Artificial Sequence
  Synthetic oligonucleotide; AGG chr11 5287509 5287528 5287525 +
aactgagtcactaatcactc

SEQ ID NO: 15810 - DNA, 20 bp, Artificial Sequence
  Synthetic oligonucleotide; TGG chr11 5287512 5287531 5287528 +
tgagtcactaatcactcagg

SEQ ID NO: 15811 - DNA, 20 bp, Artificial Sequence
  Synthetic oligonucleotide; TGG chr11 5287517 5287536 5287533 +
cactaatcactcaggtggtc

SEQ ID NO: 15812 - DNA, 20 bp, Artificial Sequence
  Synthetic oligonucleotide; CAG chr11 5287523 5287542 5287539 +
tcactcaggtggtctggctc

SEQ ID NO: 15813 - DNA, 20 bp, Artificial Sequence
  Synthetic oligonucleotide; AAG chr11 5287560 5287579 5287576 +
atctctgctctatactgccc

SEQ ID NO: 15814 - DNA, 20 bp, Artificial Sequence
  Synthetic oligonucleotide; AAG chr11 5287572 5287591 5287588 +
tactgcccaagacttttata

SEQ ID NO: 15815 - DNA, 20 bp, Artificial Sequence
  Synthetic oligonucleotide; AAG chr11 5287577 5287596 5287593 +
cccaagacttttataaagtc

SEQ ID NO: 15816 - DNA, 20 bp, Artificial Sequence
  Synthetic oligonucleotide; AGG chr11 5287578 5287597 5287594 +
ccaagacttttataaagtca

SEQ ID NO: 15817 - DNA, 20 bp, Artificial Sequence
  Synthetic oligonucleotide; GGG chr11 5287579 5287598 5287595 +
caagacttttataaagtcaa

SEQ ID NO: 15818 - DNA, 20 bp, Artificial Sequence
  Synthetic oligonucleotide; GAG chr11 5287584 5287603 5287600 +
cttttataaagtcaagggtt

SEQ ID NO: 15819 - DNA, 20 bp, Artificial Sequence
  Synthetic oligonucleotide; GAG chr11 5287597 5287616 5287613 +
aagggttgagtcactgaaat

SEQ ID NO: 15820 - DNA, 20 bp, Artificial Sequence
  Synthetic oligonucleotide; TGG chr11 5287604 5287623 5287620 +
gagtcactgaaatgagttat

SEQ ID NO: 15821 - DNA, 20 bp, Artificial Sequence
  Synthetic oligonucleotide; GGG chr11 5287605 5287624 5287621 +
agtcactgaaatgagttatt

SEQ ID NO: 15822 - DNA, 20 bp, Artificial Sequence
  Synthetic oligonucleotide; TGG chr11 5287609 5287628 5287625 +
actgaaatgagttattggga

SEQ ID NO: 15823 - DNA, 20 bp, Artificial Sequence
  Synthetic oligonucleotide; TGG chr11 5287617 5287636 5287633 +
gagttattgggatggctgtg

SEQ ID NO: 15824 - DNA, 20 bp, Artificial Sequence
  Synthetic oligonucleotide; GGG chr11 5287618 5287637 5287634 +
agttattgggatggctgtgt

SEQ ID NO: 15825 - DNA, 20 bp, Artificial Sequence
  Synthetic oligonucleotide; AAG chr11 5287621 5287640 5287637 +
tattgggatggctgtgtggg

SEQ ID NO: 15826 - DNA, 20 bp, Artificial Sequence
  Synthetic oligonucleotide; AGG chr11 5287622 5287641 5287638 +
attgggatggctgtgtggga

SEQ ID NO: 15827 - DNA, 20 bp, Artificial Sequence
  Synthetic oligonucleotide; GGG chr11 5287623 5287642 5287639 +
ttgggatggctgtgtgggaa

SEQ ID NO: 15828 - DNA, 20 bp, Artificial Sequence
  Synthetic oligonucleotide; AAG chr11 5287630 5287649 5287646 +
ggctgtgtgggaagggtgct

SEQ ID NO: 15829 - DNA, 20 bp, Artificial Sequence
  Synthetic oligonucleotide; AAG chr11 5287643 5287662 5287659 +
gggtgctaagttctttccta

SEQ ID NO: 15830 - DNA, 20 bp, Artificial Sequence
  Synthetic oligonucleotide; AGG chr11 5287644 5287663 5287660 +
ggtgctaagttctttcctaa

SEQ ID NO: 15831 - DNA, 20 bp, Artificial Sequence
  Synthetic oligonucleotide; GAG chr11 5287652 5287671 5287668 +
gttctttcctaaaggtatgt

SEQ ID NO: 15832 - DNA, 20 bp, Artificial Sequence
  Synthetic oligonucleotide; AAG chr11 5287661 5287680 5287677 +
taaaggtatgtgagaataca

SEQ ID NO: 15833 - DNA, 20 bp, Artificial Sequence
  Synthetic oligonucleotide; AGG chr11 5287662 5287681 5287678 +
aaaggtatgtgagaatacaa

SEQ ID NO: 15834 - DNA, 20 bp, Artificial Sequence
  Synthetic oligonucleotide; AAG chr11 5287666 5287685 5287682 +
gtatgtgagaatacaaagga

SEQ ID NO: 15835 - DNA, 20 bp, Artificial Sequence
  Synthetic oligonucleotide; AAG chr11 5287669 5287688 5287685 +
tgtgagaatacaaaggaaag

SEQ ID NO: 15836 - DNA, 20 bp, Artificial Sequence
  Synthetic oligonucleotide; TAG chr11 5287697 5287716 5287713 +
tcctttttacacacgtgaac

SEQ ID NO: 15837 - DNA, 20 bp, Artificial Sequence
  Synthetic oligonucleotide; CAG chr11 5287719 5287738 5287735 +
gtgcatgcaaatctgacact

SEQ ID NO: 15838 - DNA, 20 bp, Artificial Sequence
  Synthetic oligonucleotide; TGG chr11 5287722 5287741 5287738 +
catgcaaatctgacactcag

SEQ ID NO: 15839 - DNA, 20 bp, Artificial Sequence
  Synthetic oligonucleotide; GGG chr11 5287723 5287742 5287739 +
atgcaaatctgacactcagt

SEQ ID NO: 15840 - DNA, 20 bp, Artificial Sequence
  Synthetic oligonucleotide; TGG chr11 5287728 5287747 5287744 +
aatctgacactcagtgggcc

SEQ ID NO: 15841 - DNA, 20 bp, Artificial Sequence
  Synthetic oligonucleotide; GGG chr11 5287729 5287748 5287745 +
atctgacactcagtgggcct

SEQ ID NO: 15842 - DNA, 20 bp, Artificial Sequence
  Synthetic oligonucleotide; AAG chr11 5287734 5287753 5287750 +
acactcagtgggcctgggtg

SEQ ID NO: 15843 - DNA, 20 bp, Artificial Sequence
  Synthetic oligonucleotide; AGG chr11 5287735 5287754 5287751 +
cactcagtgggcctgggtga

SEQ ID NO: 15844 - DNA, 20 bp, Artificial Sequence
  Synthetic oligonucleotide; GAG chr11 5287739 5287758 5287755 +
cagtgggcctgggtgaaggt

SEQ ID NO: 15845 - DNA, 20 bp, Artificial Sequence
  Synthetic oligonucleotide; GAG chr11 5287758 5287777 5287774 +
tgagaattttattgctgaat

SEQ ID NO: 15846 - DNA, 20 bp, Artificial Sequence
  Synthetic oligonucleotide; GAG chr11 5287760 5287779 5287776 +
agaattttattgctgaatga

SEQ ID NO: 15847 - DNA, 20 bp, Artificial Sequence
  Synthetic oligonucleotide; TGG chr11 5287767 5287786 5287783 +
tattgctgaatgagagcctc

SEQ ID NO: 15848 - DNA, 20 bp, Artificial Sequence
  Synthetic oligonucleotide; GGG chr11 5287768 5287787 5287784 +
attgctgaatgagagcctct

SEQ ID NO: 15849 - DNA, 20 bp, Artificial Sequence
  Synthetic oligonucleotide; GGG chr11 5287769 5287788 5287785 +
ttgctgaatgagagcctctg

SEQ ID NO: 15850 - DNA, 20 bp, Artificial Sequence
  Synthetic oligonucleotide; CAG chr11 5287781 5287800 5287797 +
agcctctggggacatcttgc

SEQ ID NO: 15851 - DNA, 20 bp, Artificial Sequence
  Synthetic oligonucleotide; GAG chr11 5287789 5287808 5287805 +
gggacatcttgccagtcaat

SEQ ID NO: 15852 - DNA, 20 bp, Artificial Sequence
  Synthetic oligonucleotide; CAG chr11 5287795 5287814 5287811 +
tcttgccagtcaatgagtct

SEQ ID NO: 15853 - DNA, 20 bp, Artificial Sequence
  Synthetic oligonucleotide; AGG chr11 5287796 5287815 5287812 +
cttgccagtcaatgagtctc

SEQ ID NO: 15854 - DNA, 20 bp, Artificial Sequence
  Synthetic oligonucleotide; CAG chr11 5287813 5287832 5287829 +
ctcaggttcaatttccttct

SEQ ID NO: 15855 - DNA, 20 bp, Artificial Sequence
  Synthetic oligonucleotide; TGG chr11 5287819 5287838 5287835 +
ttcaatttccttctcagtct

SEQ ID NO: 15856 - DNA, 20 bp, Artificial Sequence
  Synthetic oligonucleotide; GAG chr11 5287821 5287840 5287837 +
caatttccttctcagtcttg

SEQ ID NO: 15857 - DNA, 20 bp, Artificial Sequence
  Synthetic oligonucleotide; CAG chr11 5287827 5287846 5287843 +
ccttctcagtcttggagtaa

SEQ ID NO: 15858 - DNA, 20 bp, Artificial Sequence
  Synthetic oligonucleotide; AAG chr11 5287830 5287849 5287846 +
tctcagtcttggagtaacag

SEQ ID NO: 15859 - DNA, 20 bp, Artificial Sequence
  Synthetic oligonucleotide; CGG chr11 5287850 5287869 5287866 +
aagctcatgcatttaataaa

SEQ ID NO: 15860 - DNA, 20 bp, Artificial Sequence
  Synthetic oligonucleotide; GAG chr11 5287870 5287889 5287886 +
cggaaattttgtattgaaat

SEQ ID NO: 15861 - DNA, 20 bp, Artificial Sequence
  Synthetic oligonucleotide; GAG chr11 5287872 5287891 5287888 +
gaaattttgtattgaaatga

SEQ ID NO: 15862 - DNA, 20 bp, Artificial Sequence
  Synthetic oligonucleotide; TGG chr11 5287879 5287898 5287895 +
tgtattgaaatgagagccat

SEQ ID NO: 15863 - DNA, 20 bp, Artificial Sequence
  Synthetic oligonucleotide; CAG chr11 5287895 5287914 5287911 +
ccattggaaatcatttactc

SEQ ID NO: 15864 - DNA, 20 bp, Artificial Sequence
  Synthetic oligonucleotide; AAG chr11 5287913 5287932 5287929 +
tccagactcctacttataaa

SEQ ID NO: 15865 - DNA, 20 bp, Artificial Sequence
  Synthetic oligonucleotide; GAG chr11 5287915 5287934 5287931 +
cagactcctacttataaaaa

SEQ ID NO: 15866 - DNA, 20 bp, Artificial Sequence
  Synthetic oligonucleotide; GAG chr11 5287923 5287942 5287939 +
tacttataaaaagagaaact

SEQ ID NO: 15867 - DNA, 20 bp, Artificial Sequence
  Synthetic oligonucleotide; AGG chr11 5287924 5287943 5287940 +
acttataaaaagagaaactg

SEQ ID NO: 15868 - DNA, 20 bp, Artificial Sequence
  Synthetic oligonucleotide; CAG chr11 5287929 5287948 5287945 +
taaaaagagaaactgaggct

SEQ ID NO: 15869 - DNA, 20 bp, Artificial Sequence
  Synthetic oligonucleotide; GAG chr11 5287931 5287950 5287947 +
aaaagagaaactgaggctca

SEQ ID NO: 15870 - DNA, 20 bp, Artificial Sequence
  Synthetic oligonucleotide; AAG chr11 5287934 5287953 5287950 +
agagaaactgaggctcagag

SEQ ID NO: 15871 - DNA, 20 bp, Artificial Sequence
  Synthetic oligonucleotide; AGG chr11 5287935 5287954 5287951 +
gagaaactgaggctcagaga

SEQ ID NO: 15872 - DNA, 20 bp, Artificial Sequence
  Synthetic oligonucleotide; GGG chr11 5287936 5287955 5287952 +
agaaactgaggctcagagaa

SEQ ID NO: 15873 - DNA, 20 bp, Artificial Sequence
  Synthetic oligonucleotide; TGG chr11 5287939 5287958 5287955 +
aactgaggctcagagaaggg

SEQ ID NO: 15874 - DNA, 20 bp, Artificial Sequence
  Synthetic oligonucleotide; GGG chr11 5287940 5287959 5287956 +
actgaggctcagagaagggt

SEQ ID NO: 15875 - DNA, 20 bp, Artificial Sequence
  Synthetic oligonucleotide; GGG chr11 5287941 5287960 5287957 +
ctgaggctcagagaagggtg

SEQ ID NO: 15876 - DNA, 20 bp, Artificial Sequence
  Synthetic oligonucleotide; CAG chr11 5287951 5287970 5287967 +
gagaagggtggggactttct

SEQ ID NO: 15877 - DNA, 20 bp, Artificial Sequence
  Synthetic oligonucleotide; TGG chr11 5287961 5287980 5287977 +
gggactttctcagtatgaca

SEQ ID NO: 15878 - DNA, 20 bp, Artificial Sequence
  Synthetic oligonucleotide; CAG chr11 5287971 5287990 5287987 +
cagtatgacatggaaatgat

SEQ ID NO: 15879 - DNA, 20 bp, Artificial Sequence
  Synthetic oligonucleotide; AGG chr11 5287972 5287991 5287988 +
agtatgacatggaaatgatc

SEQ ID NO: 15880 - DNA, 20 bp, Artificial Sequence
  Synthetic oligonucleotide; TGG chr11 5287977 5287996 5287993 +
gacatggaaatgatcaggct

SEQ ID NO: 15881 - DNA, 20 bp, Artificial Sequence
  Synthetic oligonucleotide; AAG chr11 5287985 5288004 5288001 +
aatgatcaggcttggattca

SEQ ID NO: 15882 - DNA, 20 bp, Artificial Sequence
  Synthetic oligonucleotide; TAG chr11 5288004 5288023 5288020 +
aaagctcctgactttctgtc

SEQ ID NO: 15883 - DNA, 20 bp, Artificial Sequence
  Synthetic oligonucleotide; CAG chr11 5288015 5288034 5288031 +
ctttctgtctagtgtatgtg

SEQ ID NO: 15884 - DNA, 20 bp, Artificial Sequence
  Synthetic oligonucleotide; GAG chr11 5288019 5288038 5288035 +
ctgtctagtgtatgtgcagt

SEQ ID NO: 15885 - DNA, 20 bp, Artificial Sequence
  Synthetic oligonucleotide; AAG chr11 5288041 5288060 5288057 +
gccccttttcctctaactga

SEQ ID NO: 15886 - DNA, 20 bp, Artificial Sequence
  Synthetic oligonucleotide; AAG chr11 5288044 5288063 5288060 +
ccttttcctctaactgaaag

SEQ ID NO: 15887 - DNA, 20 bp, Artificial Sequence
  Synthetic oligonucleotide; AGG chr11 5288045 5288064 5288061 +
cttttcctctaactgaaaga

SEQ ID NO: 15888 - DNA, 20 bp, Artificial Sequence
  Synthetic oligonucleotide; TGG chr11 5288057 5288076 5288073 +
ctgaaagaaggaaaaaaaaa

SEQ ID NO: 15889 - DNA, 20 bp, Artificial Sequence
  Synthetic oligonucleotide; TAG chr11 5288078 5288097 5288094 +
ggaacccaaaatattctaca

SEQ ID NO: 15890 - DNA, 20 bp, Artificial Sequence
  Synthetic oligonucleotide; CAG chr11 5288092 5288111 5288108 +
tctacatagtttccatgtca

SEQ ID NO: 15891 - DNA, 20 bp, Artificial Sequence
  Synthetic oligonucleotide; CAG chr11 5288096 5288115 5288112 +
catagtttccatgtcacagc

SEQ ID NO: 15892 - DNA, 20 bp, Artificial Sequence
  Synthetic oligonucleotide; AGG chr11 5288097 5288116 5288113 +
atagtttccatgtcacagcc

SEQ ID NO: 15893 - DNA, 20 bp, Artificial Sequence
  Synthetic oligonucleotide; GGG chr11 5288098 5288117 5288114 +
tagtttccatgtcacagcca

SEQ ID NO: 15894 - DNA, 20 bp, Artificial Sequence
  Synthetic oligonucleotide; TGG chr11 5288102 5288121 5288118 +
ttccatgtcacagccagggc

SEQ ID NO: 15895 - DNA, 20 bp, Artificial Sequence
  Synthetic oligonucleotide; GGG chr11 5288103 5288122 5288119 +
tccatgtcacagccagggct

SEQ ID NO: 15896 - DNA, 20 bp, Artificial Sequence
  Synthetic oligonucleotide; CAG chr11 5288106 5288125 5288122 +
atgtcacagccagggctggg

SEQ ID NO: 15897 - DNA, 20 bp, Artificial Sequence
  Synthetic oligonucleotide; AAG chr11 5288157 5288176 5288173 +
tatcatttaaatgcataaat

SEQ ID NO: 15898 - DNA, 20 bp, Artificial Sequence
  Synthetic oligonucleotide; CGG chr11 5288171 5288190 5288187 +
ataaataagcaaaccctgct

SEQ ID NO: 15899 - DNA, 20 bp, Artificial Sequence
  Synthetic oligonucleotide; GGG chr11 5288172 5288191 5288188 +
taaataagcaaaccctgctc

SEQ ID NO: 15900 - DNA, 20 bp, Artificial Sequence
  Synthetic oligonucleotide; TGG chr11 5288177 5288196 5288193 +
aagcaaaccctgctcgggaa

SEQ ID NO: 15901 - DNA, 20 bp, Artificial Sequence
  Synthetic oligonucleotide; GGG chr11 5288178 5288197 5288194 +
agcaaaccctgctcgggaat

SEQ ID NO: 15902 - DNA, 20 bp, Artificial Sequence
  Synthetic oligonucleotide; GAG chr11 5288180 5288199 5288196 +
caaaccctgctcgggaatgg

SEQ ID NO: 15903 - DNA, 20 bp, Artificial Sequence
  Synthetic oligonucleotide; AGG chr11 5288181 5288200 5288197 +
aaaccctgctcgggaatggg

SEQ ID NO: 15904 - DNA, 20 bp, Artificial Sequence
  Synthetic oligonucleotide; GGG chr11 5288182 5288201 5288198 +
aaccctgctcgggaatggga

SEQ ID NO: 15905 - DNA, 20 bp, Artificial Sequence
  Synthetic oligonucleotide; GAG chr11 5288184 5288203 5288200 +
ccctgctcgggaatgggagg

SEQ ID NO: 15906 - DNA, 20 bp, Artificial Sequence
  Synthetic oligonucleotide; GAG chr11 5288186 5288205 5288202 +
ctgctcgggaatgggaggga

SEQ ID NO: 15907 - DNA, 20 bp, Artificial Sequence
  Synthetic oligonucleotide; TGG chr11 5288193 5288212 5288209 +
ggaatgggagggagagtctc

SEQ ID NO: 15908 - DNA, 20 bp, Artificial Sequence
  Synthetic oligonucleotide; GAG chr11 5288195 5288214 5288211 +
aatgggagggagagtctctg

SEQ ID NO: 15909 - DNA, 20 bp, Artificial Sequence
  Synthetic oligonucleotide; CGG chr11 5288210 5288229 5288226 +
ctctggagtccaccccttct

SEQ ID NO: 15910 - DNA, 20 bp, Artificial Sequence
  Synthetic oligonucleotide; TGG chr11 5288216 5288235 5288232 +
agtccaccccttctcggccc

SEQ ID NO: 15911 - DNA, 20 bp, Artificial Sequence
  Synthetic oligonucleotide; CAG chr11 5288224 5288243 5288240 +
ccttctcggccctggctctg

SEQ ID NO: 15912 - DNA, 20 bp, Artificial Sequence
  Synthetic oligonucleotide; TAG chr11 5288228 5288247 5288244 +
ctcggccctggctctgcaga

SEQ ID NO: 15913 - DNA, 20 bp, Artificial Sequence
  Synthetic oligonucleotide; AAG chr11 5288239 5288258 5288255 +
ctctgcagatagtgctatca

SEQ ID NO: 15914 - DNA, 20 bp, Artificial Sequence
  Synthetic oligonucleotide; CAG chr11 5288248 5288267 5288264 +
tagtgctatcaaagccctga

SEQ ID NO: 15915 - DNA, 20 bp, Artificial Sequence
  Synthetic oligonucleotide; GAG chr11 5288250 5288269 5288266 +
gtgctatcaaagccctgaca

SEQ ID NO: 15916 - DNA, 20 bp, Artificial Sequence
  Synthetic oligonucleotide; TGG chr11 5288266 5288285 5288282 +
gacagagccctgcccattgc

SEQ ID NO: 15917 - DNA, 20 bp, Artificial Sequence
  Synthetic oligonucleotide; GGG chr11 5288267 5288286 5288283 +
acagagccctgcccattgct

SEQ ID NO: 15918 - DNA, 20 bp, Artificial Sequence
  Synthetic oligonucleotide; TGG chr11 5288273 5288292 5288289 +
ccctgcccattgctgggcct

SEQ ID NO: 15919 - DNA, 20 bp, Artificial Sequence
  Synthetic oligonucleotide; GAG chr11 5288275 5288294 5288291 +
ctgcccattgctgggccttg

SEQ ID NO: 15920 - DNA, 20 bp, Artificial Sequence
  Synthetic oligonucleotide; GAG chr11 5288279 5288298 5288295 +
ccattgctgggccttggagt

SEQ ID NO: 15921 - DNA, 20 bp, Artificial Sequence
  Synthetic oligonucleotide; CAG chr11 5288283 5288302 5288299 +
tgctgggccttggagtgagt

SEQ ID NO: 15922 - DNA, 20 bp, Artificial Sequence
  Synthetic oligonucleotide; TAG chr11 5288288 5288307 5288304 +
ggccttggagtgagtcagcc

SEQ ID NO: 15923 - DNA, 20 bp, Artificial Sequence
  Synthetic oligonucleotide; TAG chr11 5288291 5288310 5288307 +
cttggagtgagtcagcctag

SEQ ID NO: 15924 - DNA, 20 bp, Artificial Sequence
  Synthetic oligonucleotide; GAG chr11 5288293 5288312 5288309 +
tggagtgagtcagcctagta

SEQ ID NO: 15925 - DNA, 20 bp, Artificial Sequence
  Synthetic oligonucleotide; GAG chr11 5288295 5288314 5288311 +
gagtgagtcagcctagtaga

SEQ ID NO: 15926 - DNA, 20 bp, Artificial Sequence
  Synthetic oligonucleotide; AGG chr11 5288296 5288315 5288312 +
agtgagtcagcctagtagag

SEQ ID NO: 15927 - DNA, 20 bp, Artificial Sequence
  Synthetic oligonucleotide; CAG chr11 5288299 5288318 5288315 +
gagtcagcctagtagagagg

SEQ ID NO: 15928 - DNA, 20 bp, Artificial Sequence
  Synthetic oligonucleotide; AGG chr11 5288300 5288319 5288316 +
agtcagcctagtagagaggc

SEQ ID NO: 15929 - DNA, 20 bp, Artificial Sequence
  Synthetic oligonucleotide; GGG chr11 5288301 5288320 5288317 +
gtcagcctagtagagaggca

SEQ ID NO: 15930 - DNA, 20 bp, Artificial Sequence
  Synthetic oligonucleotide; AAG chr11 5288305 5288324 5288321 +
gcctagtagagaggcagggc

SEQ ID NO: 15931 - DNA, 20 bp, Artificial Sequence
  Synthetic oligonucleotide; TAG chr11 5288316 5288335 5288332 +
aggcagggcaagccatctca

SEQ ID NO: 15932 - DNA, 20 bp, Artificial Sequence
  Synthetic oligonucleotide; GAG chr11 5288324 5288343 5288340 +
caagccatctcatagctgct

SEQ ID NO: 15933 - DNA, 20 bp, Artificial Sequence
  Synthetic oligonucleotide; TGG chr11 5288327 5288346 5288343 +
gccatctcatagctgctgag

SEQ ID NO: 15934 - DNA, 20 bp, Artificial Sequence
  Synthetic oligonucleotide; GGG chr11 5288328 5288347 5288344 +
ccatctcatagctgctgagt

SEQ ID NO: 15935 - DNA, 20 bp, Artificial Sequence
  Synthetic oligonucleotide; GAG chr11 5288330 5288349 5288346 +
atctcatagctgctgagtgg

SEQ ID NO: 15936 - DNA, 20 bp, Artificial Sequence
  Synthetic oligonucleotide; GAG chr11 5288332 5288351 5288348 +
ctcatagctgctgagtggga

SEQ ID NO: 15937 - DNA, 20 bp, Artificial Sequence
  Synthetic oligonucleotide; GAG chr11 5288334 5288353 5288350 +
catagctgctgagtgggaga

SEQ ID NO: 15938 - DNA, 20 bp, Artificial Sequence
  Synthetic oligonucleotide; AAG chr11 5288339 5288358 5288355 +
ctgctgagtgggagagagaa

SEQ ID NO: 15939 - DNA, 20 bp, Artificial Sequence
  Synthetic oligonucleotide; AGG chr11 5288340 5288359 5288356 +
tgctgagtgggagagagaaa

SEQ ID NO: 15940 - DNA, 20 bp, Artificial Sequence
  Synthetic oligonucleotide; GGG chr11 5288341 5288360 5288357 +
gctgagtgggagagagaaaa

SEQ ID NO: 15941 - DNA, 20 bp, Artificial Sequence
  Synthetic oligonucleotide; CAG chr11 5288361 5288380 5288377 +
gggctcattgtctataaact

SEQ ID NO: 15942 - DNA, 20 bp, Artificial Sequence
  Synthetic oligonucleotide; AGG chr11 5288362 5288381 5288378 +
ggctcattgtctataaactc

SEQ ID NO: 15943 - DNA, 20 bp, Artificial Sequence
  Synthetic oligonucleotide; TGG chr11 5288368 5288387 5288384 +
ttgtctataaactcaggtca

SEQ ID NO: 15944 - DNA, 20 bp, Artificial Sequence
  Synthetic oligonucleotide; AAG chr11 5288390 5288409 5288406 +
gctattcttattctcacact

SEQ ID NO: 15945 - DNA, 20 bp, Artificial Sequence
  Synthetic oligonucleotide; AAG chr11 5288396 5288415 5288412 +
cttattctcacactaagaaa

SEQ ID NO: 15946 - DNA, 20 bp, Artificial Sequence
  Synthetic oligonucleotide; GAG chr11 5288402 5288421 5288418 +
ctcacactaagaaaaagaat

SEQ ID NO: 15947 - DNA, 20 bp, Artificial Sequence
  Synthetic oligonucleotide; TGG chr11 5288440 5288459 5288456 +
ctgcgtcccctcttgtgtac

SEQ ID NO: 15948 - DNA, 20 bp, Artificial Sequence
  Synthetic oligonucleotide; GGG chr11 5288441 5288460 5288457 +
tgcgtcccctcttgtgtact

SEQ ID NO: 15949 - DNA, 20 bp, Artificial Sequence
  Synthetic oligonucleotide; GGG chr11 5288442 5288461 5288458 +
gcgtcccctcttgtgtactg

SEQ ID NO: 15950 - DNA, 20 bp, Artificial Sequence
  Synthetic oligonucleotide; AAG chr11 5288450 5288469 5288466 +
tcttgtgtactggggtcccc

SEQ ID NO: 15951 - DNA, 20 bp, Artificial Sequence
  Synthetic oligonucleotide; GAG chr11 5288452 5288471 5288468 +
ttgtgtactggggtccccaa

SEQ ID NO: 15952 - DNA, 20 bp, Artificial Sequence
  Synthetic oligonucleotide; AAG chr11 5288463 5288482 5288479 +
ggtccccaagagctctctaa

SEQ ID NO: 15953 - DNA, 20 bp, Artificial Sequence
  Synthetic oligonucleotide; TGG chr11 5288469 5288488 5288485 +
caagagctctctaaaagtga

SEQ ID NO: 15954 - DNA, 20 bp, Artificial Sequence
  Synthetic oligonucleotide; AAG chr11 5288474 5288493 5288490 +
gctctctaaaagtgatggca

SEQ ID NO: 15955 - DNA, 20 bp, Artificial Sequence
  Synthetic oligonucleotide; TAG chr11 5288486 5288505 5288502 +
tgatggcaaagtcattgcgc

SEQ ID NO: 15956 - DNA, 20 bp, Artificial Sequence
  Synthetic oligonucleotide; CAG chr11 5288532 5288551 5288548 +
ctgcatttgtctccacacac

SEQ ID NO: 15957 - DNA, 20 bp, Artificial Sequence
  Synthetic oligonucleotide; TGG chr11 5288538 5288557 5288554 +
ttgtctccacacaccagtca

SEQ ID NO: 15958 - DNA, 20 bp, Artificial Sequence
  Synthetic oligonucleotide; CAG chr11 5288557 5288576 5288573 +
atggacaataaccctcctcc

SEQ ID NO: 15959 - DNA, 20 bp, Artificial Sequence
  Synthetic oligonucleotide; AGG chr11 5288558 5288577 5288574 +
tggacaataaccctcctccc

SEQ ID NO: 15960 - DNA, 20 bp, Artificial Sequence
  Synthetic oligonucleotide; AAG chr11 5288589 5288608 5288605 +
cttgtctttgtataatactc

SEQ ID NO: 15961 - DNA, 20 bp, Artificial Sequence
  Synthetic oligonucleotide; CGG chr11 5288598 5288617 5288614 +
gtataatactcaagtaattt

SEQ ID NO: 15962 - DNA, 20 bp, Artificial Sequence
  Synthetic oligonucleotide; TGG chr11 5288643 5288662 5288659 +
ttctgttattcctgtttcaa

SEQ ID NO: 15963 - DNA, 20 bp, Artificial Sequence
  Synthetic oligonucleotide; TAG chr11 5288648 5288667 5288664 +
ttattcctgtttcaatggct

SEQ ID NO: 15964 - DNA, 20 bp, Artificial Sequence
  Synthetic oligonucleotide; TAG chr11 5288651 5288670 5288667 +
ttcctgtttcaatggcttag

SEQ ID NO: 15965 - DNA, 20 bp, Artificial Sequence
  Synthetic oligonucleotide; AAG chr11 5288657 5288676 5288673 +
tttcaatggcttagtagaaa

SEQ ID NO: 15966 - DNA, 20 bp, Artificial Sequence
  Synthetic oligonucleotide; TAG chr11 5288689 5288708 5288705 +
gttttcccataaattgacaa

SEQ ID NO: 15967 - DNA, 20 bp, Artificial Sequence
  Synthetic oligonucleotide; TGG chr11 5288715 5288734 5288731 +
atttcacatcaatgtctata

SEQ ID NO: 15968 - DNA, 20 bp, Artificial Sequence
  Synthetic oligonucleotide; GGG chr11 5288716 5288735 5288732 +
tttcacatcaatgtctatat

SEQ ID NO: 15969 - DNA, 20 bp, Artificial Sequence
  Synthetic oligonucleotide; AAG chr11 5288776 5288795 5288792 +
ctttatattgttactactct

SEQ ID NO: 15970 - DNA, 20 bp, Artificial Sequence
  Synthetic oligonucleotide; AAG chr11 5288780 5288799 5288796 +
atattgttactactctaaga

SEQ ID NO: 15971 - DNA, 20 bp, Artificial Sequence
  Synthetic oligonucleotide; TGG chr11 5288791 5288810 5288807 +
actctaagaaagttacaaca

SEQ ID NO: 15972 - DNA, 20 bp, Artificial Sequence
  Synthetic oligonucleotide; AAG chr11 5288801 5288820 5288817 +
agttacaacatggtgaatac

SEQ ID NO: 15973 - DNA, 20 bp, Artificial Sequence
  Synthetic oligonucleotide; GAG chr11 5288803 5288822 5288819 +
ttacaacatggtgaatacaa

SEQ ID NO: 15974 - DNA, 20 bp, Artificial Sequence
  Synthetic oligonucleotide; AAG chr11 5288807 5288826 5288823 +
aacatggtgaatacaagaga

SEQ ID NO: 15975 - DNA, 20 bp, Artificial Sequence
  Synthetic oligonucleotide; AAG chr11 5288817 5288836 5288833 +
atacaagagaaagctattac

SEQ ID NO: 15976 - DNA, 20 bp, Artificial Sequence
  Synthetic oligonucleotide; CAG chr11 5288822 5288841 5288838 +
agagaaagctattacaagtc

SEQ ID NO: 15977 - DNA, 20 bp, Artificial Sequence
  Synthetic oligonucleotide; AAG chr11 5288832 5288851 5288848 +
attacaagtccagaaaataa

SEQ ID NO: 15978 - DNA, 20 bp, Artificial Sequence
  Synthetic oligonucleotide; GAG chr11 5288845 5288864 5288861 +
aaaataaaagttatcatctt

SEQ ID NO: 15979 - DNA, 20 bp, Artificial Sequence
  Synthetic oligonucleotide; AGG chr11 5288846 5288865 5288862 +
aaataaaagttatcatcttg

SEQ ID NO: 15980 - DNA, 20 bp, Artificial Sequence
  Synthetic oligonucleotide; CAG chr11 5288852 5288871 5288868 +
aagttatcatcttgaggcct

SEQ ID NO: 15981 - DNA, 20 bp, Artificial Sequence
  Synthetic oligonucleotide; TAG chr11 5288860 5288879 5288876 +
atcttgaggcctcagctttc

SEQ ID NO: 15982 - DNA, 20 bp, Artificial Sequence
  Synthetic oligonucleotide; AGG chr11 5288861 5288880 5288877 +
tcttgaggcctcagctttct

SEQ ID NO: 15983 - DNA, 20 bp, Artificial Sequence
  Synthetic oligonucleotide; CAG chr11 5288904 5288923 5288920 +
attaatctaacaattatgaa

SEQ ID NO: 15984 - DNA, 20 bp, Artificial Sequence
  Synthetic oligonucleotide; GAG chr11 5288911 5288930 5288927 +
taacaattatgaacagcaat

SEQ ID NO: 15985 - DNA, 20 bp, Artificial Sequence
  Synthetic oligonucleotide; AAG chr11 5288926 5288945 5288942 +
gcaatgagataatgtgtaca

SEQ ID NO: 15986 - DNA, 20 bp, Artificial Sequence
  Synthetic oligonucleotide; CAG chr11 5288933 5288952 5288949 +
gataatgtgtacaaagtacc

SEQ ID NO: 15987 - DNA, 20 bp, Artificial Sequence
  Synthetic oligonucleotide; TGG chr11 5288943 5288962 5288959 +
acaaagtacccagacctatg

SEQ ID NO: 15988 - DNA, 20 bp, Artificial Sequence
  Synthetic oligonucleotide; TAG chr11 5288946 5288965 5288962 +
aagtacccagacctatgtgg

SEQ ID NO: 15989 - DNA, 20 bp, Artificial Sequence
  Synthetic oligonucleotide; GAG chr11 5288948 5288967 5288964 +
gtacccagacctatgtggta

SEQ ID NO: 15990 - DNA, 20 bp, Artificial Sequence
  Synthetic oligonucleotide; AAG chr11 5288955 5288974 5288971 +
gacctatgtggtagagcatc

SEQ ID NO: 15991 - DNA, 20 bp, Artificial Sequence
  Synthetic oligonucleotide; AGG chr11 5288956 5288975 5288972 +
acctatgtggtagagcatca

SEQ ID NO: 15992 - DNA, 20 bp, Artificial Sequence
  Synthetic oligonucleotide; AAG chr11 5288959 5288978 5288975 +
tatgtggtagagcatcaagg

SEQ ID NO: 15993 - DNA, 20 bp, Artificial Sequence
  Synthetic oligonucleotide; CGG chr11 5288969 5288988 5288985 +
agcatcaaggaagcgcattg

SEQ ID NO: 15994 - DNA, 20 bp, Artificial Sequence
  Synthetic oligonucleotide; GAG chr11 5288971 5288990 5288987 +
catcaaggaagcgcattgcg

SEQ ID NO: 15995 - DNA, 20 bp, Artificial Sequence
  Synthetic oligonucleotide; CAG chr11 5288974 5288993 5288990 +
caaggaagcgcattgcggag

SEQ ID NO: 15996 - DNA, 20 bp, Artificial Sequence
  Synthetic oligonucleotide; GAG chr11 5289011 5289030 5289027 +
gtttttgtattctgtttcgt

SEQ ID NO: 15997 - DNA, 20 bp, Artificial Sequence
  Synthetic oligonucleotide; AGG chr11 5289012 5289031 5289028 +
tttttgtattctgtttcgtg

SEQ ID NO: 15998 - DNA, 20 bp, Artificial Sequence
  Synthetic oligonucleotide; AAG chr11 5289016 5289035 5289032 +
tgtattctgtttcgtgaggc

SEQ ID NO: 15999 - DNA, 20 bp, Artificial Sequence
  Synthetic oligonucleotide; AGG chr11 5289017 5289036 5289033 +
gtattctgtttcgtgaggca

SEQ ID NO: 16000 - DNA, 20 bp, Artificial Sequence
  Synthetic oligonucleotide; CAG chr11 5289035 5289054 5289051 +
caaggtttcactctgctgtc

SEQ ID NO: 16001 - DNA, 20 bp, Artificial Sequence
  Synthetic oligonucleotide; AGG chr11 5289036 5289055 5289052 +
aaggtttcactctgctgtcc

SEQ ID NO: 16002 - DNA, 20 bp, Artificial Sequence
  Synthetic oligonucleotide; TGG chr11 5289040 5289059 5289056 +
tttcactctgctgtccaggc

SEQ ID NO: 16003 - DNA, 20 bp, Artificial Sequence
  Synthetic oligonucleotide; GAG chr11 5289042 5289061 5289058 +
tcactctgctgtccaggctg

SEQ ID NO: 16004 - DNA, 20 bp, Artificial Sequence
  Synthetic oligonucleotide; CAG chr11 5289047 5289066 5289063 +
ctgctgtccaggctggagtg

SEQ ID NO: 16005 - DNA, 20 bp, Artificial Sequence
  Synthetic oligonucleotide; TGG chr11 5289050 5289069 5289066 +
ctgtccaggctggagtgcag

SEQ ID NO: 16006 - DNA, 20 bp, Artificial Sequence
  Synthetic oligonucleotide; AAG chr11 5289054 5289073 5289070 +
ccaggctggagtgcagtggc

SEQ ID NO: 16007 - DNA, 20 bp, Artificial Sequence
  Synthetic oligonucleotide; CAG chr11 5289071 5289090 5289087 +
ggcaagatcatgtctcactg

SEQ ID NO: 16008 - DNA, 20 bp, Artificial Sequence
  Synthetic oligonucleotide; GAG chr11 5289086 5289105 5289102 +
cactgcagccttgacctcct

SEQ ID NO: 16009 - DNA, 20 bp, Artificial Sequence
  Synthetic oligonucleotide; AAG chr11 5289092 5289111 5289108 +
agccttgacctcctgagctc

SEQ ID NO: 16010 - DNA, 20 bp, Artificial Sequence
  Synthetic oligonucleotide; AGG chr11 5289093 5289112 5289109 +
gccttgacctcctgagctca

SEQ ID NO: 16011 - DNA, 20 bp, Artificial Sequence
  Synthetic oligonucleotide; GGG chr11 5289094 5289113 5289110 +
ccttgacctcctgagctcaa

SEQ ID NO: 16012 - DNA, 20 bp, Artificial Sequence
  Synthetic oligonucleotide; CGG chr11 5289109 5289128 5289125 +
ctcaagggatcctcccattt

SEQ ID NO: 16013 - DNA, 20 bp, Artificial Sequence
  Synthetic oligonucleotide; GAG chr11 5289118 5289137 5289134 +
tcctcccatttcggcctcct

SEQ ID NO: 16014 - DNA, 20 bp, Artificial Sequence
  Synthetic oligonucleotide; TAG chr11 5289121 5289140 5289137 +
tcccatttcggcctcctgag

SEQ ID NO: 16015 - DNA, 20 bp, Artificial Sequence
  Synthetic oligonucleotide; TGG chr11 5289125 5289144 5289141 +
atttcggcctcctgagtagc

SEQ ID NO: 16016 - DNA, 20 bp, Artificial Sequence
  Synthetic oligonucleotide; GGG chr11 5289126 5289145 5289142 +
tttcggcctcctgagtagct

SEQ ID NO: 16017 - DNA, 20 bp, Artificial Sequence
  Synthetic oligonucleotide; CAG chr11 5289133 5289152 5289149 +
ctcctgagtagctgggacta

SEQ ID NO: 16018 - DNA, 20 bp, Artificial Sequence
  Synthetic oligonucleotide; AGG chr11 5289134 5289153 5289150 +
tcctgagtagctgggactac

SEQ ID NO: 16019 - DNA, 20 bp, Artificial Sequence
  Synthetic oligonucleotide; TGG chr11 5289152 5289171 5289168 +
acaggtgtacatcacatgcc

SEQ ID NO: 16020 - DNA, 20 bp, Artificial Sequence
  Synthetic oligonucleotide; AAG chr11 5289175 5289194 5289191 +
ctaatttttttttttttttt

SEQ ID NO: 16021 - DNA, 20 bp, Artificial Sequence
  Synthetic oligonucleotide; TAG chr11 5289178 5289197 5289194 +
attttttttttttttttaag

SEQ ID NO: 16022 - DNA, 20 bp, Artificial Sequence
  Synthetic oligonucleotide; GAG chr11 5289180 5289199 5289196 +
tttttttttttttttaagta

SEQ ID NO: 16023 - DNA, 20 bp, Artificial Sequence
  Synthetic oligonucleotide; GAG chr11 5289185 5289204 5289201 +
ttttttttttaagtagagac

SEQ ID NO: 16024 - DNA, 20 bp, Artificial Sequence
  Synthetic oligonucleotide; AGG chr11 5289186 5289205 5289202 +
tttttttttaagtagagacg

SEQ ID NO: 16025 - DNA, 20 bp, Artificial Sequence
  Synthetic oligonucleotide; CAG chr11 5289204 5289223 5289220 +
cgaggtcttgctatgttgtc

SEQ ID NO: 16026 - DNA, 20 bp, Artificial Sequence
  Synthetic oligonucleotide; AGG chr11 5289205 5289224 5289221 +
gaggtcttgctatgttgtcc

SEQ ID NO: 16027 - DNA, 20 bp, Artificial Sequence
  Synthetic oligonucleotide; GAG chr11 5289224 5289243 5289240 +
caggataatatcaaactctt

SEQ ID NO: 16028 - DNA, 20 bp, Artificial Sequence
  Synthetic oligonucleotide; AAG chr11 5289230 5289249 5289246 +
aatatcaaactcttgagctc

SEQ ID NO: 16029 - DNA, 20 bp, Artificial Sequence
  Synthetic oligonucleotide; CAG chr11 5289233 5289252 5289249 +
atcaaactcttgagctcaag

SEQ ID NO: 16030 - DNA, 20 bp, Artificial Sequence
  Synthetic oligonucleotide; AAG chr11 5289256 5289275 5289272 +
tcctcccacttctacctctc

SEQ ID NO: 16031 - DNA, 20 bp, Artificial Sequence
  Synthetic oligonucleotide; TGG chr11 5289262 5289281 5289278 +
cacttctacctctcaagtgc

SEQ ID NO: 16032 - DNA, 20 bp, Artificial Sequence
  Synthetic oligonucleotide; CAG chr11 5289270 5289289 5289286 +
cctctcaagtgctggaatta

SEQ ID NO: 16033 - DNA, 20 bp, Artificial Sequence
  Synthetic oligonucleotide; GAG chr11 5289277 5289296 5289293 +
agtgctggaattacagacat

SEQ ID NO: 16034 - DNA, 20 bp, Artificial Sequence
  Synthetic oligonucleotide; TGG chr11 5289290 5289309 5289306 +
cagacatgagccaccactcc

SEQ ID NO: 16035 - DNA, 20 bp, Artificial Sequence
  Synthetic oligonucleotide; CAG chr11 5289297 5289316 5289313 +
gagccaccactcctggcttg

SEQ ID NO: 16036 - DNA, 20 bp, Artificial Sequence
  Synthetic oligonucleotide; GAG chr11 5289332 5289351 5289348 +
actaattcctgacactactt

SEQ ID NO: 16037 - DNA, 20 bp, Artificial Sequence
  Synthetic oligonucleotide; AGG chr11 5289333 5289352 5289349 +
ctaattcctgacactacttg

SEQ ID NO: 16038 - DNA, 20 bp, Artificial Sequence
  Synthetic oligonucleotide; GGG chr11 5289334 5289353 5289350 +
taattcctgacactacttga

SEQ ID NO: 16039 - DNA, 20 bp, Artificial Sequence
  Synthetic oligonucleotide; TAG chr11 5289341 5289360 5289357 +
tgacactacttgagggatac

SEQ ID NO: 16040 - DNA, 20 bp, Artificial Sequence
  Synthetic oligonucleotide; CAG chr11 5289345 5289364 5289361 +
actacttgagggatactaga

SEQ ID NO: 16041 - DNA, 20 bp, Artificial Sequence
  Synthetic oligonucleotide; TAG chr11 5289348 5289367 5289364 +
acttgagggatactagacag

SEQ ID NO: 16042 - DNA, 20 bp, Artificial Sequence
  Synthetic oligonucleotide; TGG chr11 5289375 5289394 5289391 +
cacatctttaatataccaaa

SEQ ID NO: 16043 - DNA, 20 bp, Artificial Sequence
  Synthetic oligonucleotide; GGG chr11 5289376 5289395 5289392 +
acatctttaatataccaaat

SEQ ID NO: 16044 - DNA, 20 bp, Artificial Sequence
  Synthetic oligonucleotide; TAG chr11 5289385 5289404 5289401 +
atataccaaatgggtgactg

SEQ ID NO: 16045 - DNA, 20 bp, Artificial Sequence
  Synthetic oligonucleotide; AGG chr11 5289386 5289405 5289402 +
tataccaaatgggtgactgt

SEQ ID NO: 16046 - DNA, 20 bp, Artificial Sequence
  Synthetic oligonucleotide; GGG chr11 5289387 5289406 5289403 +
ataccaaatgggtgactgta

SEQ ID NO: 16047 - DNA, 20 bp, Artificial Sequence
  Synthetic oligonucleotide; GAG chr11 5289392 5289411 5289408 +
aaatgggtgactgtagggtt

SEQ ID NO: 16048 - DNA, 20 bp, Artificial Sequence
  Synthetic oligonucleotide; GAG chr11 5289394 5289413 5289410 +
atgggtgactgtagggttga

SEQ ID NO: 16049 - DNA, 20 bp, Artificial Sequence
  Synthetic oligonucleotide; AGG chr11 5289395 5289414 5289411 +
tgggtgactgtagggttgag

SEQ ID NO: 16050 - DNA, 20 bp, Artificial Sequence
  Synthetic oligonucleotide; GGG chr11 5289396 5289415 5289412 +
gggtgactgtagggttgaga

SEQ ID NO: 16051 - DNA, 20 bp, Artificial Sequence
  Synthetic oligonucleotide; GAG chr11 5289398 5289417 5289414 +
gtgactgtagggttgagagg

SEQ ID NO: 16052 - DNA, 20 bp, Artificial Sequence
  Synthetic oligonucleotide; TAG chr11 5289403 5289422 5289419 +
tgtagggttgagagggagat

SEQ ID NO: 16053 - DNA, 20 bp, Artificial Sequence
  Synthetic oligonucleotide; AAG chr11 5289428 5289447 5289444 +
ttcaatgttttatgaccaaa

SEQ ID NO: 16054 - DNA, 20 bp, Artificial Sequence
  Synthetic oligonucleotide; AGG chr11 5289429 5289448 5289445 +
tcaatgttttatgaccaaaa

SEQ ID NO: 16055 - DNA, 20 bp, Artificial Sequence
  Synthetic oligonucleotide; CAG chr11 5289439 5289458 5289455 +
atgaccaaaaaggcttaaat

SEQ ID NO: 16056 - DNA, 20 bp, Artificial Sequence
  Synthetic oligonucleotide; AGG chr11 5289440 5289459 5289456 +
tgaccaaaaaggcttaaatc

SEQ ID NO: 16057 - DNA, 20 bp, Artificial Sequence
  Synthetic oligonucleotide; AAG chr11 5289446 5289465 5289462 +
aaaaggcttaaatcaggcac

SEQ ID NO: 16058 - DNA, 20 bp, Artificial Sequence
  Synthetic oligonucleotide; TAG chr11 5289451 5289470 5289467 +
gcttaaatcaggcacaagct

SEQ ID NO: 16059 - DNA, 20 bp, Artificial Sequence
  Synthetic oligonucleotide; AGG chr11 5289452 5289471 5289468 +
cttaaatcaggcacaagctt

SEQ ID NO: 16060 - DNA, 20 bp, Artificial Sequence
  Synthetic oligonucleotide; GAG chr11 5289468 5289487 5289484 +
gcttaggtcttttcaactgt

SEQ ID NO: 16061 - DNA, 20 bp, Artificial Sequence
  Synthetic oligonucleotide; AGG chr11 5289469 5289488 5289485 +
cttaggtcttttcaactgtg

SEQ ID NO: 16062 - DNA, 20 bp, Artificial Sequence
  Synthetic oligonucleotide; CGG chr11 5289474 5289493 5289490 +
gtcttttcaactgtgaggac

SEQ ID NO: 16063 - DNA, 20 bp, Artificial Sequence
  Synthetic oligonucleotide; AAG chr11 5289482 5289501 5289498 +
aactgtgaggaccggactga

SEQ ID NO: 16064 - DNA, 20 bp, Artificial Sequence
  Synthetic oligonucleotide; CAG chr11 5289489 5289508 5289505 +
aggaccggactgaaagtgtg

SEQ ID NO: 16065 - DNA, 20 bp, Artificial Sequence
  Synthetic oligonucleotide; AAG chr11 5289495 5289514 5289511 +
ggactgaaagtgtgcagttc

SEQ ID NO: 16066 - DNA, 20 bp, Artificial Sequence
  Synthetic oligonucleotide; AGG chr11 5289496 5289515 5289512 +
gactgaaagtgtgcagttca

SEQ ID NO: 16067 - DNA, 20 bp, Artificial Sequence
  Synthetic oligonucleotide; TAG chr11 5289504 5289523 5289520 +
gtgtgcagttcaaggccctg

SEQ ID NO: 16068 - DNA, 20 bp, Artificial Sequence
  Synthetic oligonucleotide; CAG chr11 5289525 5289544 5289541 +
agttgctgtttaactgttcc

SEQ ID NO: 16069 - DNA, 20 bp, Artificial Sequence
  Synthetic oligonucleotide; AGG chr11 5289526 5289545 5289542 +
gttgctgtttaactgttccc

SEQ ID NO: 16070 - DNA, 20 bp, Artificial Sequence
  Synthetic oligonucleotide; TGG chr11 5289529 5289548 5289545 +
gctgtttaactgttcccagg

SEQ ID NO: 16071 - DNA, 20 bp, Artificial Sequence
  Synthetic oligonucleotide; AAG chr11 5289532 5289551 5289548 +
gtttaactgttcccaggtgg

SEQ ID NO: 16072 - DNA, 20 bp, Artificial Sequence
  Synthetic oligonucleotide; AAG chr11 5289543 5289562 5289559 +
cccaggtggaagtctcttca

SEQ ID NO: 16073 - DNA, 20 bp, Artificial Sequence
  Synthetic oligonucleotide; TGG chr11 5289552 5289571 5289568 +
aagtctcttcaaagaaccac

SEQ ID NO: 16074 - DNA, 20 bp, Artificial Sequence
  Synthetic oligonucleotide; AAG chr11 5289561 5289580 5289577 +
caaagaaccactggtgcaaa

SEQ ID NO: 16075 - DNA, 20 bp, Artificial Sequence
  Synthetic oligonucleotide; AGG chr11 5289562 5289581 5289578 +
aaagaaccactggtgcaaaa

SEQ ID NO: 16076 - DNA, 20 bp, Artificial Sequence
  Synthetic oligonucleotide; GGG chr11 5289563 5289582 5289579 +
aagaaccactggtgcaaaaa

SEQ ID NO: 16077 - DNA, 20 bp, Artificial Sequence
  Synthetic oligonucleotide; TGG chr11 5289573 5289592 5289589 +
ggtgcaaaaagggaactacc

SEQ ID NO: 16078 - DNA, 20 bp, Artificial Sequence
  Synthetic oligonucleotide; GGG chr11 5289574 5289593 5289590 +
gtgcaaaaagggaactacct

SEQ ID NO: 16079 - DNA, 20 bp, Artificial Sequence
  Synthetic oligonucleotide; GGG chr11 5289575 5289594 5289591 +
tgcaaaaagggaactacctg

SEQ ID NO: 16080 - DNA, 20 bp, Artificial Sequence
  Synthetic oligonucleotide; CAG chr11 5289592 5289611 5289608 +
ctggggataaatatttcctc

SEQ ID NO: 16081 - DNA, 20 bp, Artificial Sequence
  Synthetic oligonucleotide; AAG chr11 5289596 5289615 5289612 +
ggataaatatttcctccaga

SEQ ID NO: 16082 - DNA, 20 bp, Artificial Sequence
  Synthetic oligonucleotide; AGG chr11 5289597 5289616 5289613 +
gataaatatttcctccagaa

SEQ ID NO: 16083 - DNA, 20 bp, Artificial Sequence
  Synthetic oligonucleotide; GGG chr11 5289598 5289617 5289614 +
ataaatatttcctccagaaa

SEQ ID NO: 16084 - DNA, 20 bp, Artificial Sequence
  Synthetic oligonucleotide; GGG chr11 5289599 5289618 5289615 +
taaatatttcctccagaaag

SEQ ID NO: 16085 - DNA, 20 bp, Artificial Sequence
  Synthetic oligonucleotide; GGG chr11 5289600 5289619 5289616 +
aaatatttcctccagaaagg

SEQ ID NO: 16086 - DNA, 20 bp, Artificial Sequence
  Synthetic oligonucleotide; AAG chr11 5289604 5289623 5289620 +
atttcctccagaaaggggga

SEQ ID NO: 16087 - DNA, 20 bp, Artificial Sequence
  Synthetic oligonucleotide; AAG chr11 5289610 5289629 5289626 +
tccagaaagggggaaagtgc

SEQ ID NO: 16088 - DNA, 20 bp, Artificial Sequence
  Synthetic oligonucleotide; AAG chr11 5289625 5289644 5289641 +
agtgcaagctcccctaccaa

SEQ ID NO: 16089 - DNA, 20 bp, Artificial Sequence
  Synthetic oligonucleotide; CAG chr11 5289631 5289650 5289647 +
agctcccctaccaaaagcac

SEQ ID NO: 16090 - DNA, 20 bp, Artificial Sequence
  Synthetic oligonucleotide; AGG chr11 5289632 5289651 5289648 +
gctcccctaccaaaagcacc

SEQ ID NO: 16091 - DNA, 20 bp, Artificial Sequence
  Synthetic oligonucleotide; AAG chr11 5289636 5289655 5289652 +
ccctaccaaaagcaccaggc

SEQ ID NO: 16092 - DNA, 20 bp, Artificial Sequence
  Synthetic oligonucleotide; AAG chr11 5289658 5289677 5289674 +
gtccttgtctattttccctg

SEQ ID NO: 16093 - DNA, 20 bp, Artificial Sequence
  Synthetic oligonucleotide; AAG chr11 5289667 5289686 5289683 +
tattttccctgaagttctca

SEQ ID NO: 16094 - DNA, 20 bp, Artificial Sequence
  Synthetic oligonucleotide; GAG chr11 5289674 5289693 5289690 +
cctgaagttctcaaagaaat

SEQ ID NO: 16095 - DNA, 20 bp, Artificial Sequence
  Synthetic oligonucleotide; AAG chr11 5289693 5289712 5289709 +
tgagacccttgtttaccttt

SEQ ID NO: 16096 - DNA, 20 bp, Artificial Sequence
  Synthetic oligonucleotide; TAG chr11 5289698 5289717 5289714 +
cccttgtttacctttaagat

SEQ ID NO: 16097 - DNA, 20 bp, Artificial Sequence
  Synthetic oligonucleotide; GAG chr11 5289700 5289719 5289716 +
cttgtttacctttaagatta

SEQ ID NO: 16098 - DNA, 20 bp, Artificial Sequence
  Synthetic oligonucleotide; AAG chr11 5289703 5289722 5289719 +
gtttacctttaagattagag

SEQ ID NO: 16099 - DNA, 20 bp, Artificial Sequence
  Synthetic oligonucleotide; AGG chr11 5289704 5289723 5289720 +
tttacctttaagattagaga

SEQ ID NO: 16100 - DNA, 20 bp, Artificial Sequence
  Synthetic oligonucleotide; AAG chr11 5289713 5289732 5289729 +
aagattagagaaggcttgaa

SEQ ID NO: 16101 - DNA, 20 bp, Artificial Sequence
  Synthetic oligonucleotide; GAG chr11 5289719 5289738 5289735 +
agagaaggcttgaaaagttt

SEQ ID NO: 16102 - DNA, 20 bp, Artificial Sequence
  Synthetic oligonucleotide; TGG chr11 5289731 5289750 5289747 +
aaaagtttgagctgtgcctt

SEQ ID NO: 16103 - DNA, 20 bp, Artificial Sequence
  Synthetic oligonucleotide; GAG chr11 5289733 5289752 5289749 +
aagtttgagctgtgcctttg

SEQ ID NO: 16104 - DNA, 20 bp, Artificial Sequence
  Synthetic oligonucleotide; AGG chr11 5289734 5289753 5289750 +
agtttgagctgtgcctttgg

SEQ ID NO: 16105 - DNA, 20 bp, Artificial Sequence
  Synthetic oligonucleotide; AAG chr11 5289764 5289783 5289780 +
acttttctcctttgttgacc

SEQ ID NO: 16106 - DNA, 20 bp, Artificial Sequence
  Synthetic oligonucleotide; CAG chr11 5289769 5289788 5289785 +
tctcctttgttgaccaagtt

SEQ ID NO: 16107 - DNA, 20 bp, Artificial Sequence
  Synthetic oligonucleotide; AAG chr11 5289789 5289808 5289805 +
cagctctcctgtatgcttcc

SEQ ID NO: 16108 - DNA, 20 bp, Artificial Sequence
  Synthetic oligonucleotide; AGG chr11 5289790 5289809 5289806 +
agctctcctgtatgcttcca

SEQ ID NO: 16109 - DNA, 20 bp, Artificial Sequence
  Synthetic oligonucleotide; AAG chr11 5289804 5289823 5289820 +
cttccaaggtctgttgcatc

SEQ ID NO: 16110 - DNA, 20 bp, Artificial Sequence
  Synthetic oligonucleotide; GAG chr11 5289806 5289825 5289822 +
tccaaggtctgttgcatcaa

SEQ ID NO: 16111 - DNA, 20 bp, Artificial Sequence
  Synthetic oligonucleotide; GAG chr11 5289810 5289829 5289826 +
aggtctgttgcatcaagagt

SEQ ID NO: 16112 - DNA, 20 bp, Artificial Sequence
  Synthetic oligonucleotide; AAG chr11 5289818 5289837 5289834 +
tgcatcaagagtgagaattg

SEQ ID NO: 16113 - DNA, 20 bp, Artificial Sequence
  Synthetic oligonucleotide; AGG chr11 5289819 5289838 5289835 +
gcatcaagagtgagaattga

SEQ ID NO: 16114 - DNA, 20 bp, Artificial Sequence
  Synthetic oligonucleotide; TAG chr11 5289825 5289844 5289841 +
agagtgagaattgaaggtct

SEQ ID NO: 16115 - DNA, 20 bp, Artificial Sequence
  Synthetic oligonucleotide; AAG chr11 5289828 5289847 5289844 +
gtgagaattgaaggtcttag

SEQ ID NO: 16116 - DNA, 20 bp, Artificial Sequence
  Synthetic oligonucleotide; TGG chr11 5289832 5289851 5289848 +
gaattgaaggtcttagaagc

SEQ ID NO: 16117 - DNA, 20 bp, Artificial Sequence
  Synthetic oligonucleotide; GGG chr11 5289833 5289852 5289849 +
aattgaaggtcttagaagct

SEQ ID NO: 16118 - DNA, 20 bp, Artificial Sequence
  Synthetic oligonucleotide; CAG chr11 5289840 5289859 5289856 +
ggtcttagaagctgggatct

SEQ ID NO: 16119 - DNA, 20 bp, Artificial Sequence
  Synthetic oligonucleotide; TAG chr11 5289846 5289865 5289862 +
agaagctgggatctcagatg

SEQ ID NO: 16120 - DNA, 20 bp, Artificial Sequence
  Synthetic oligonucleotide; AGG chr11 5289847 5289866 5289863 +
gaagctgggatctcagatgt

SEQ ID NO: 16121 - DNA, 20 bp, Artificial Sequence
  Synthetic oligonucleotide; GGG chr11 5289848 5289867 5289864 +
aagctgggatctcagatgta

SEQ ID NO: 16122 - DNA, 20 bp, Artificial Sequence
  Synthetic oligonucleotide; AAG chr11 5289853 5289872 5289869 +
gggatctcagatgtagggaa

SEQ ID NO: 16123 - DNA, 20 bp, Artificial Sequence
  Synthetic oligonucleotide; GAG chr11 5289855 5289874 5289871 +
gatctcagatgtagggaaaa

SEQ ID NO: 16124 - DNA, 20 bp, Artificial Sequence
  Synthetic oligonucleotide; AGG chr11 5289856 5289875 5289872 +
atctcagatgtagggaaaag

SEQ ID NO: 16125 - DNA, 20 bp, Artificial Sequence
  Synthetic oligonucleotide; GAG chr11 5289858 5289877 5289874 +
ctcagatgtagggaaaagag

SEQ ID NO: 16126 - DNA, 20 bp, Artificial Sequence
  Synthetic oligonucleotide; AAG chr11 5289882 5289901 5289898 +
tttcctgttcactcactgtt

SEQ ID NO: 16127 - DNA, 20 bp, Artificial Sequence
  Synthetic oligonucleotide; TGG chr11 5289888 5289907 5289904 +
gttcactcactgttaagata

SEQ ID NO: 16128 - DNA, 20 bp, Artificial Sequence
  Synthetic oligonucleotide; TAG chr11 5289907 5289926 5289923 +
atggctgaaattttttgatc

SEQ ID NO: 16129 - DNA, 20 bp, Artificial Sequence
  Synthetic oligonucleotide; AAG chr11 5289919 5289938 5289935 +
ttttgatctagtcatctaca

SEQ ID NO: 16130 - DNA, 20 bp, Artificial Sequence
  Synthetic oligonucleotide; GAG chr11 5289925 5289944 5289941 +
tctagtcatctacaaagcat

SEQ ID NO: 16131 - DNA, 20 bp, Artificial Sequence
  Synthetic oligonucleotide; TGG chr11 5289931 5289950 5289947 +
catctacaaagcatgagttg

SEQ ID NO: 16132 - DNA, 20 bp, Artificial Sequence
  Synthetic oligonucleotide; GGG chr11 5289932 5289951 5289948 +
atctacaaagcatgagttgt

SEQ ID NO: 16133 - DNA, 20 bp, Artificial Sequence
  Synthetic oligonucleotide; CAG chr11 5289936 5289955 5289952 +
acaaagcatgagttgtgggt

SEQ ID NO: 16134 - DNA, 20 bp, Artificial Sequence
  Synthetic oligonucleotide; CAG chr11 5289975 5289994 5289991 +
cttttgacttcctttgacat

SEQ ID NO: 16135 - DNA, 20 bp, Artificial Sequence
  Synthetic oligonucleotide; TAG chr11 5289987 5290006 5290003 +
tttgacatcagaatataacc

SEQ ID NO: 16136 - DNA, 20 bp, Artificial Sequence
  Synthetic oligonucleotide; AGG chr11 5289988 5290007 5290004 +
ttgacatcagaatataacct

SEQ ID NO: 16137 - DNA, 20 bp, Artificial Sequence
  Synthetic oligonucleotide; AAG chr11 5290003 5290022 5290019 +
aacctaggaattgattactt

SEQ ID NO: 16138 - DNA, 20 bp, Artificial Sequence
  Synthetic oligonucleotide; AAG chr11 5290008 5290027 5290024 +
aggaattgattacttaagtg

SEQ ID NO: 16139 - DNA, 20 bp, Artificial Sequence
  Synthetic oligonucleotide; AGG chr11 5290009 5290028 5290025 +
ggaattgattacttaagtga

SEQ ID NO: 16140 - DNA, 20 bp, Artificial Sequence
  Synthetic oligonucleotide; AAG chr11 5290013 5290032 5290029 +
ttgattacttaagtgaaggc

SEQ ID NO: 16141 - DNA, 20 bp, Artificial Sequence
  Synthetic oligonucleotide; AGG chr11 5290014 5290033 5290030 +
tgattacttaagtgaaggca

SEQ ID NO: 16142 - DNA, 20 bp, Artificial Sequence
  Synthetic oligonucleotide; TGG chr11 5290022 5290041 5290038 +
taagtgaaggcaaggtactt

SEQ ID NO: 16143 - DNA, 20 bp, Artificial Sequence
  Synthetic oligonucleotide; TGG chr11 5290027 5290046 5290043 +
gaaggcaaggtactttggtc

SEQ ID NO: 16144 - DNA, 20 bp, Artificial Sequence
  Synthetic oligonucleotide; CAG chr11 5290031 5290050 5290047 +
gcaaggtactttggtctgga

SEQ ID NO: 16145 - DNA, 20 bp, Artificial Sequence
  Synthetic oligonucleotide; AGG chr11 5290032 5290051 5290048 +
caaggtactttggtctggac

SEQ ID NO: 16146 - DNA, 20 bp, Artificial Sequence
  Synthetic oligonucleotide; AAG chr11 5290047 5290066 5290063 +
tggacaggaacattttgaac

SEQ ID NO: 16147 - DNA, 20 bp, Artificial Sequence
  Synthetic oligonucleotide; AGG chr11 5290048 5290067 5290064 +
ggacaggaacattttgaaca

SEQ ID NO: 16148 - DNA, 20 bp, Artificial Sequence
  Synthetic oligonucleotide; TAG chr11 5290051 5290070 5290067 +
caggaacattttgaacaagg

SEQ ID NO: 16149 - DNA, 20 bp, Artificial Sequence
  Synthetic oligonucleotide; AGG chr11 5290052 5290071 5290068 +
aggaacattttgaacaaggt

SEQ ID NO: 16150 - DNA, 20 bp, Artificial Sequence
  Synthetic oligonucleotide; GGG chr11 5290053 5290072 5290069 +
ggaacattttgaacaaggta

SEQ ID NO: 16151 - DNA, 20 bp, Artificial Sequence
  Synthetic oligonucleotide; GAG chr11 5290055 5290074 5290071 +
aacattttgaacaaggtagg

SEQ ID NO: 16152 - DNA, 20 bp, Artificial Sequence
  Synthetic oligonucleotide; CAG chr11 5290059 5290078 5290075 +
ttttgaacaaggtagggaga

SEQ ID NO: 16153 - DNA, 20 bp, Artificial Sequence
  Synthetic oligonucleotide; AAG chr11 5290067 5290086 5290083 +
aaggtagggagacagctatg

SEQ ID NO: 16154 - DNA, 20 bp, Artificial Sequence
  Synthetic oligonucleotide; AGG chr11 5290068 5290087 5290084 +
aggtagggagacagctatga

SEQ ID NO: 16155 - DNA, 20 bp, Artificial Sequence
  Synthetic oligonucleotide; AAG chr11 5290072 5290091 5290088 +
agggagacagctatgaaggc

SEQ ID NO: 16156 - DNA, 20 bp, Artificial Sequence
  Synthetic oligonucleotide; AAG chr11 5290151 5290170 5290167 +
tatttatacatttaaacaaa

SEQ ID NO: 16157 - DNA, 20 bp, Artificial Sequence
  Synthetic oligonucleotide; TAG chr11 5290156 5290175 5290172 +
atacatttaaacaaaaagta

SEQ ID NO: 16158 - DNA, 20 bp, Artificial Sequence
  Synthetic oligonucleotide; GAG chr11 5290158 5290177 5290174 +
acatttaaacaaaaagtata

SEQ ID NO: 16159 - DNA, 20 bp, Artificial Sequence
  Synthetic oligonucleotide; TAG chr11 5290163 5290182 5290179 +
taaacaaaaagtatagagcg

SEQ ID NO: 16160 - DNA, 20 bp, Artificial Sequence
  Synthetic oligonucleotide; AAG chr11 5290176 5290195 5290192 +
tagagcgtagtataatttgt

SEQ ID NO: 16161 - DNA, 20 bp, Artificial Sequence
  Synthetic oligonucleotide; CAG chr11 5290183 5290202 5290199 +
tagtataatttgtaagtgct

SEQ ID NO: 16162 - DNA, 20 bp, Artificial Sequence
  Synthetic oligonucleotide; AGG chr11 5290184 5290203 5290200 +
agtataatttgtaagtgctc

SEQ ID NO: 16163 - DNA, 20 bp, Artificial Sequence
  Synthetic oligonucleotide; GGG chr11 5290185 5290204 5290201 +
gtataatttgtaagtgctca

SEQ ID NO: 16164 - DNA, 20 bp, Artificial Sequence
  Synthetic oligonucleotide; TGG chr11 5290199 5290218 5290215 +
tgctcagggctgtgtgtgta

SEQ ID NO: 16165 - DNA, 20 bp, Artificial Sequence
  Synthetic oligonucleotide; AAG chr11 5290221 5290240 5290237 +
gattgtttgaaatgaaacta

SEQ ID NO: 16166 - DNA, 20 bp, Artificial Sequence
  Synthetic oligonucleotide; TGG chr11 5290224 5290243 5290240 +
tgtttgaaatgaaactaaag

SEQ ID NO: 16167 - DNA, 20 bp, Artificial Sequence
  Synthetic oligonucleotide; GGG chr11 5290225 5290244 5290241 +
gtttgaaatgaaactaaagt

SEQ ID NO: 16168 - DNA, 20 bp, Artificial Sequence
  Synthetic oligonucleotide; GAG chr11 5290227 5290246 5290243 +
ttgaaatgaaactaaagtgg

SEQ ID NO: 16169 - DNA, 20 bp, Artificial Sequence
  Synthetic oligonucleotide; TGG chr11 5290257 5290276 5290273 +
ctactgcccccttaaccctg

SEQ ID NO: 16170 - DNA, 20 bp, Artificial Sequence
  Synthetic oligonucleotide; AAG chr11 5290277 5290296 5290293 +
tggtccctacactaccctgc

SEQ ID NO: 16171 - DNA, 20 bp, Artificial Sequence
  Synthetic oligonucleotide; TAG chr11 5290285 5290304 5290301 +
acactaccctgcaagactct

SEQ ID NO: 16172 - DNA, 20 bp, Artificial Sequence
  Synthetic oligonucleotide; TAG chr11 5290293 5290312 5290309 +
ctgcaagactcttagctgct

SEQ ID NO: 16173 - DNA, 20 bp, Artificial Sequence
  Synthetic oligonucleotide; GAG chr11 5290305 5290324 5290321 +
tagctgcttagcttaattgt

SEQ ID NO: 16174 - DNA, 20 bp, Artificial Sequence
  Synthetic oligonucleotide; AGG chr11 5290306 5290325 5290322 +
agctgcttagcttaattgtg

SEQ ID NO: 16175 - DNA, 20 bp, Artificial Sequence
  Synthetic oligonucleotide; TGG chr11 5290315 5290334 5290331 +
gcttaattgtgaggctgatt

SEQ ID NO: 16176 - DNA, 20 bp, Artificial Sequence
  Synthetic oligonucleotide; GGG chr11 5290316 5290335 5290332 +
cttaattgtgaggctgattt

SEQ ID NO: 16177 - DNA, 20 bp, Artificial Sequence
  Synthetic oligonucleotide; GGG chr11 5290317 5290336 5290333 +
ttaattgtgaggctgatttg

SEQ ID NO: 16178 - DNA, 20 bp, Artificial Sequence
  Synthetic oligonucleotide; TAG chr11 5290322 5290341 5290338 +
tgtgaggctgatttggggca

SEQ ID NO: 16179 - DNA, 20 bp, Artificial Sequence
  Synthetic oligonucleotide; GAG chr11 5290366 5290385 5290382 +
caacatcctcataataactt

SEQ ID NO: 16180 - DNA, 20 bp, Artificial Sequence
  Synthetic oligonucleotide; TAG chr11 5290392 5290411 5290408 +
aattttataaaatatcacaa

SEQ ID NO: 16181 - DNA, 20 bp, Artificial Sequence
  Synthetic oligonucleotide; AGG chr11 5290393 5290412 5290409 +
attttataaaatatcacaat

SEQ ID NO: 16182 - DNA, 20 bp, Artificial Sequence
  Synthetic oligonucleotide; GGG chr11 5290394 5290413 5290410 +
ttttataaaatatcacaata

SEQ ID NO: 16183 - DNA, 20 bp, Artificial Sequence
  Synthetic oligonucleotide; CAG chr11 5290404 5290423 5290420 +
tatcacaatagggtcatgtt

SEQ ID NO: 16184 - DNA, 20 bp, Artificial Sequence
  Synthetic oligonucleotide; TAG chr11 5290407 5290426 5290423 +
cacaatagggtcatgttcag

SEQ ID NO: 16185 - DNA, 20 bp, Artificial Sequence
  Synthetic oligonucleotide; AGG chr11 5290408 5290427 5290424 +
acaatagggtcatgttcagt

SEQ ID NO: 16186 - DNA, 20 bp, Artificial Sequence
  Synthetic oligonucleotide; GGG chr11 5290409 5290428 5290425 +
caatagggtcatgttcagta

SEQ ID NO: 16187 - DNA, 20 bp, Artificial Sequence
  Synthetic oligonucleotide; TAG chr11 5290425 5290444 5290441 +
agtagggtgatatataaaat

SEQ ID NO: 16188 - DNA, 20 bp, Artificial Sequence
  Synthetic oligonucleotide; AAG chr11 5290430 5290449 5290446 +
ggtgatatataaaattagac

SEQ ID NO: 16189 - DNA, 20 bp, Artificial Sequence
  Synthetic oligonucleotide; TAG chr11 5290436 5290455 5290452 +
atataaaattagacaagcca

SEQ ID NO: 16190 - DNA, 20 bp, Artificial Sequence
  Synthetic oligonucleotide; GAG chr11 5290442 5290461 5290458 +
aattagacaagccatagttt

SEQ ID NO: 16191 - DNA, 20 bp, Artificial Sequence
  Synthetic oligonucleotide; AAG chr11 5290473 5290492 5290489 +
tttgaataaatatatgacaa

SEQ ID NO: 16192 - DNA, 20 bp, Artificial Sequence
  Synthetic oligonucleotide; AGG chr11 5290474 5290493 5290490 +
ttgaataaatatatgacaaa

SEQ ID NO: 16193 - DNA, 20 bp, Artificial Sequence
  Synthetic oligonucleotide; GAG chr11 5290495 5290514 5290511 +
ggcaatttaattatctttat

SEQ ID NO: 16194 - DNA, 20 bp, Artificial Sequence
  Synthetic oligonucleotide; TGG chr11 5290500 5290519 5290516 +
tttaattatctttatgagtt

SEQ ID NO: 16195 - DNA, 20 bp, Artificial Sequence
  Synthetic oligonucleotide; GAG chr11 5290502 5290521 5290518 +
taattatctttatgagtttg

SEQ ID NO: 16196 - DNA, 20 bp, Artificial Sequence
  Synthetic oligonucleotide; AGG chr11 5290503 5290522 5290519 +
aattatctttatgagtttgg

SEQ ID NO: 16197 - DNA, 20 bp, Artificial Sequence
  Synthetic oligonucleotide; CAG chr11 5290510 5290529 5290526 +
tttatgagtttggaggtatc

SEQ ID NO: 16198 - DNA, 20 bp, Artificial Sequence
  Synthetic oligonucleotide; TAG chr11 5290522 5290541 5290538 +
gaggtatccagtatgaaatt

SEQ ID NO: 16199 - DNA, 20 bp, Artificial Sequence
  Synthetic oligonucleotide; TAG chr11 5290540 5290559 5290556 +
tttagataatacctgccttc

SEQ ID NO: 16200 - DNA, 20 bp, Artificial Sequence
  Synthetic oligonucleotide; TAG chr11 5290552 5290571 5290568 +
ctgccttctagtgttgaaat

SEQ ID NO: 16201 - DNA, 20 bp, Artificial Sequence
  Synthetic oligonucleotide; TAG chr11 5290589 5290608 5290605 +
atgcatcaatgaacttatta

SEQ ID NO: 16202 - DNA, 20 bp, Artificial Sequence
  Synthetic oligonucleotide; TAG chr11 5290596 5290615 5290612 +
aatgaacttattatagttcc

SEQ ID NO: 16203 - DNA, 20 bp, Artificial Sequence
  Synthetic oligonucleotide; AAG chr11 5290603 5290622 5290619 +
ttattatagttcctagcaca

SEQ ID NO: 16204 - DNA, 20 bp, Artificial Sequence
  Synthetic oligonucleotide; AAG chr11 5290607 5290626 5290623 +
tatagttcctagcacaaagt

SEQ ID NO: 16205 - DNA, 20 bp, Artificial Sequence
  Synthetic oligonucleotide; TAG chr11 5290656 5290675 5290672 +
atgtatttatctgttattaa

SEQ ID NO: 16206 - DNA, 20 bp, Artificial Sequence
  Synthetic oligonucleotide; AGG chr11 5290657 5290676 5290673 +
tgtatttatctgttattaat

SEQ ID NO: 16207 - DNA, 20 bp, Artificial Sequence
  Synthetic oligonucleotide; TGG chr11 5290667 5290686 5290683 +
tgttattaataggaatctta

SEQ ID NO: 16208 - DNA, 20 bp, Artificial Sequence
  Synthetic oligonucleotide; GGG chr11 5290668 5290687 5290684 +
gttattaataggaatcttat

SEQ ID NO: 16209 - DNA, 20 bp, Artificial Sequence
  Synthetic oligonucleotide; AAG chr11 5290704 5290723 5290720 +
aatccttattaataactatg

SEQ ID NO: 16210 - DNA, 20 bp, Artificial Sequence
  Synthetic oligonucleotide; CAG chr11 5290707 5290726 5290723 +
ccttattaataactatgaag

SEQ ID NO: 16211 - DNA, 20 bp, Artificial Sequence
  Synthetic oligonucleotide; AGG chr11 5290708 5290727 5290724 +
cttattaataactatgaagc

SEQ ID NO: 16212 - DNA, 20 bp, Artificial Sequence
  Synthetic oligonucleotide; GAG chr11 5290720 5290739 5290736 +
tatgaagcaggtatttattt

SEQ ID NO: 16213 - DNA, 20 bp, Artificial Sequence
  Synthetic oligonucleotide; AAG chr11 5290729 5290748 5290745 +
ggtatttatttgagttttcc

SEQ ID NO: 16214 - DNA, 20 bp, Artificial Sequence
  Synthetic oligonucleotide; GAG chr11 5290733 5290752 5290749 +
tttatttgagttttccaagt

SEQ ID NO: 16215 - DNA, 20 bp, Artificial Sequence
  Synthetic oligonucleotide; AAG chr11 5290738 5290757 5290754 +
ttgagttttccaagtgagtt

SEQ ID NO: 16216 - DNA, 20 bp, Artificial Sequence
  Synthetic oligonucleotide; TAG chr11 5290743 5290762 5290759 +
ttttccaagtgagttaagta

SEQ ID NO: 16217 - DNA, 20 bp, Artificial Sequence
  Synthetic oligonucleotide; AAG chr11 5290758 5290777 5290774 +
aagtatagcttgtaatactt

SEQ ID NO: 16218 - DNA, 20 bp, Artificial Sequence
  Synthetic oligonucleotide; AGG chr11 5290759 5290778 5290775 +
agtatagcttgtaatactta

SEQ ID NO: 16219 - DNA, 20 bp, Artificial Sequence
  Synthetic oligonucleotide; CAG chr11 5290771 5290790 5290787 +
aatacttaaggaaatatcca

SEQ ID NO: 16220 - DNA, 20 bp, Artificial Sequence
  Synthetic oligonucleotide; AGG chr11 5290772 5290791 5290788 +
atacttaaggaaatatccac

SEQ ID NO: 16221 - DNA, 20 bp, Artificial Sequence
  Synthetic oligonucleotide; TAG chr11 5290780 5290799 5290796 +
ggaaatatccacaggttaca

SEQ ID NO: 16222 - DNA, 20 bp, Artificial Sequence
  Synthetic oligonucleotide; TAG chr11 5290784 5290803 5290800 +
atatccacaggttacatagc

SEQ ID NO: 16223 - DNA, 20 bp, Artificial Sequence
  Synthetic oligonucleotide; GAG chr11 5290796 5290815 5290812 +
tacatagctagtatataact

SEQ ID NO: 16224 - DNA, 20 bp, Artificial Sequence
  Synthetic oligonucleotide; CAG chr11 5290837 5290856 5290853 +
tataaaacattctaacaata

SEQ ID NO: 16225 - DNA, 20 bp, Artificial Sequence
  Synthetic oligonucleotide; AAG chr11 5290863 5290882 5290879 +
tatataaactaaaaaactga

SEQ ID NO: 16226 - DNA, 20 bp, Artificial Sequence
  Synthetic oligonucleotide; AGG chr11 5290864 5290883 5290880 +
atataaactaaaaaactgaa

SEQ ID NO: 16227 - DNA, 20 bp, Artificial Sequence
  Synthetic oligonucleotide; GGG chr11 5290865 5290884 5290881 +
tataaactaaaaaactgaaa

SEQ ID NO: 16228 - DNA, 20 bp, Artificial Sequence
  Synthetic oligonucleotide; TAG chr11 5290906 5290925 5290922 +
ctcaatatcacttcttcact

SEQ ID NO: 16229 - DNA, 20 bp, Artificial Sequence
  Synthetic oligonucleotide; CAG chr11 5290916 5290935 5290932 +
cttcttcacttagaaaaaac

SEQ ID NO: 16230 - DNA, 20 bp, Artificial Sequence
  Synthetic oligonucleotide; TAG chr11 5290922 5290941 5290938 +
cacttagaaaaaaccagcct

SEQ ID NO: 16231 - DNA, 20 bp, Artificial Sequence
  Synthetic oligonucleotide; GAG chr11 5290959 5290978 5290975 +
tcctttcaaaatatacttct

SEQ ID NO: 16232 - DNA, 20 bp, Artificial Sequence
  Synthetic oligonucleotide; GAG chr11 5290966 5290985 5290982 +
aaaatatacttctgagaaat

SEQ ID NO: 16233 - DNA, 20 bp, Artificial Sequence
  Synthetic oligonucleotide; GAG chr11 5290968 5290987 5290984 +
aatatacttctgagaaatga

SEQ ID NO: 16234 - DNA, 20 bp, Artificial Sequence
  Synthetic oligonucleotide; GAG chr11 5290970 5290989 5290986 +
tatacttctgagaaatgaga

SEQ ID NO: 16235 - DNA, 20 bp, Artificial Sequence
  Synthetic oligonucleotide; GAG chr11 5290972 5290991 5290988 +
tacttctgagaaatgagaga

SEQ ID NO: 16236 - DNA, 20 bp, Artificial Sequence
  Synthetic oligonucleotide; TGG chr11 5290978 5290997 5290994 +
tgagaaatgagagagagaaa

SEQ ID NO: 16237 - DNA, 20 bp, Artificial Sequence
  Synthetic oligonucleotide; GGG chr11 5290979 5290998 5290995 +
gagaaatgagagagagaaat

SEQ ID NO: 16238 - DNA, 20 bp, Artificial Sequence
  Synthetic oligonucleotide; GGG chr11 5290980 5290999 5290996 +
agaaatgagagagagaaatg

SEQ ID NO: 16239 - DNA, 20 bp, Artificial Sequence
  Synthetic oligonucleotide; GAG chr11 5290982 5291001 5290998 +
aaatgagagagagaaatggg

SEQ ID NO: 16240 - DNA, 20 bp, Artificial Sequence
  Synthetic oligonucleotide; AGG chr11 5290983 5291002 5290999 +
aatgagagagagaaatgggg

SEQ ID NO: 16241 - DNA, 20 bp, Artificial Sequence
  Synthetic oligonucleotide; GGG chr11 5290984 5291003 5291000 +
atgagagagagaaatgggga

SEQ ID NO: 16242 - DNA, 20 bp, Artificial Sequence
  Synthetic oligonucleotide; TAG chr11 5290987 5291006 5291003 +
agagagagaaatggggaggg

SEQ ID NO: 16243 - DNA, 20 bp, Artificial Sequence
  Synthetic oligonucleotide; AAG chr11 5290990 5291009 5291006 +
gagagaaatggggagggtag

SEQ ID NO: 16244 - DNA, 20 bp, Artificial Sequence
  Synthetic oligonucleotide; AGG chr11 5290991 5291010 5291007 +
agagaaatggggagggtaga

SEQ ID NO: 16245 - DNA, 20 bp, Artificial Sequence
  Synthetic oligonucleotide; AAG chr11 5290994 5291013 5291010 +
gaaatggggagggtagaagg

SEQ ID NO: 16246 - DNA, 20 bp, Artificial Sequence
  Synthetic oligonucleotide; AGG chr11 5290995 5291014 5291011 +
aaatggggagggtagaagga

SEQ ID NO: 16247 - DNA, 20 bp, Artificial Sequence
  Synthetic oligonucleotide; AAG chr11 5290998 5291017 5291014 +
tggggagggtagaaggaagg

SEQ ID NO: 16248 - DNA, 20 bp, Artificial Sequence
  Synthetic oligonucleotide; TAG chr11 5291002 5291021 5291018 +
gagggtagaaggaaggaaga

SEQ ID NO: 16249 - DNA, 20 bp, Artificial Sequence
  Synthetic oligonucleotide; AGG chr11 5291003 5291022 5291019 +
agggtagaaggaaggaagat

SEQ ID NO: 16250 - DNA, 20 bp, Artificial Sequence
  Synthetic oligonucleotide; GGG chr11 5291004 5291023 5291020 +
gggtagaaggaaggaagata

SEQ ID NO: 16251 - DNA, 20 bp, Artificial Sequence
  Synthetic oligonucleotide; AAG chr11 5291008 5291027 5291024 +
agaaggaaggaagatagggt

SEQ ID NO: 16252 - DNA, 20 bp, Artificial Sequence
  Synthetic oligonucleotide; GAG chr11 5291010 5291029 5291026 +
aaggaaggaagatagggtaa

SEQ ID NO: 16253 - DNA, 20 bp, Artificial Sequence
  Synthetic oligonucleotide; CAG chr11 5291014 5291033 5291030 +
aaggaagatagggtaagaga

SEQ ID NO: 16254 - DNA, 20 bp, Artificial Sequence
  Synthetic oligonucleotide; AGG chr11 5291015 5291034 5291031 +
aggaagatagggtaagagac

SEQ ID NO: 16255 - DNA, 20 bp, Artificial Sequence
  Synthetic oligonucleotide; GGG chr11 5291016 5291035 5291032 +
ggaagatagggtaagagaca

SEQ ID NO: 16256 - DNA, 20 bp, Artificial Sequence
  Synthetic oligonucleotide; AAG chr11 5291019 5291038 5291035 +
agatagggtaagagacaggg

SEQ ID NO: 16257 - DNA, 20 bp, Artificial Sequence
  Synthetic oligonucleotide; AGG chr11 5291020 5291039 5291036 +
gatagggtaagagacaggga

SEQ ID NO: 16258 - DNA, 20 bp, Artificial Sequence
  Synthetic oligonucleotide; GAG chr11 5291022 5291041 5291038 +
tagggtaagagacagggaag

SEQ ID NO: 16259 - DNA, 20 bp, Artificial Sequence
  Synthetic oligonucleotide; AGG chr11 5291023 5291042 5291039 +
agggtaagagacagggaagg

SEQ ID NO: 16260 - DNA, 20 bp, Artificial Sequence
  Synthetic oligonucleotide; TGG chr11 5291028 5291047 5291044 +
aagagacagggaaggaggtg

SEQ ID NO: 16261 - DNA, 20 bp, Artificial Sequence
  Synthetic oligonucleotide; GGG chr11 5291029 5291048 5291045 +
agagacagggaaggaggtgt

SEQ ID NO: 16262 - DNA, 20 bp, Artificial Sequence
  Synthetic oligonucleotide; GGG chr11 5291030 5291049 5291046 +
gagacagggaaggaggtgtg

SEQ ID NO: 16263 - DNA, 20 bp, Artificial Sequence
  Synthetic oligonucleotide; AAG chr11 5291034 5291053 5291050 +
cagggaaggaggtgtgggga

SEQ ID NO: 16264 - DNA, 20 bp, Artificial Sequence
  Synthetic oligonucleotide; AAG chr11 5291068 5291087 5291084 +
ttcttttctctgtctcttga

SEQ ID NO: 16265 - DNA, 20 bp, Artificial Sequence
  Synthetic oligonucleotide; GAG chr11 5291070 5291089 5291086 +
cttttctctgtctcttgaaa

SEQ ID NO: 16266 - DNA, 20 bp, Artificial Sequence
  Synthetic oligonucleotide; AAG chr11 5291095 5291114 5291111 +
ctttccattacattgaatca

SEQ ID NO: 16267 - DNA, 20 bp, Artificial Sequence
  Synthetic oligonucleotide; AGG chr11 5291096 5291115 5291112 +
tttccattacattgaatcaa

SEQ ID NO: 16268 - DNA, 20 bp, Artificial Sequence
  Synthetic oligonucleotide; TGG chr11 5291114 5291133 5291130 +
aaaggtaatgttgccatttc

SEQ ID NO: 16269 - DNA, 20 bp, Artificial Sequence
  Synthetic oligonucleotide; AAG chr11 5291129 5291148 5291145 +
atttctggactcttgaaata

SEQ ID NO: 16270 - DNA, 20 bp, Artificial Sequence
  Synthetic oligonucleotide; AAG chr11 5291133 5291152 5291149 +
ctggactcttgaaataaaga

SEQ ID NO: 16271 - DNA, 20 bp, Artificial Sequence
  Synthetic oligonucleotide; AAG chr11 5291159 5291178 5291175 +
gatgtatgaaataattttga

SEQ ID NO: 16272 - DNA, 20 bp, Artificial Sequence
  Synthetic oligonucleotide; TGG chr11 5291166 5291185 5291182 +
gaaataattttgaaagtcta

SEQ ID NO: 16273 - DNA, 20 bp, Artificial Sequence
  Synthetic oligonucleotide; AAG chr11 5291183 5291202 5291199 +
ctatggcattttcaaaatgc

SEQ ID NO: 16274 - DNA, 20 bp, Artificial Sequence
  Synthetic oligonucleotide; AGG chr11 5291184 5291203 5291200 +
tatggcattttcaaaatgca

SEQ ID NO: 16275 - DNA, 20 bp, Artificial Sequence
  Synthetic oligonucleotide; TAG chr11 5291202 5291221 5291218 +
caaggtgatgtcttactaac

SEQ ID NO: 16276 - DNA, 20 bp, Artificial Sequence
  Synthetic oligonucleotide; TAG chr11 5291220 5291239 5291236 +
actagcctttgctttattat

SEQ ID NO: 16277 - DNA, 20 bp, Artificial Sequence
  Synthetic oligonucleotide; TGG chr11 5291226 5291245 5291242 +
ctttgctttattattagaaa

SEQ ID NO: 16278 - DNA, 20 bp, Artificial Sequence
  Synthetic oligonucleotide; GGG chr11 5291227 5291246 5291243 +
tttgctttattattagaaat

SEQ ID NO: 16279 - DNA, 20 bp, Artificial Sequence
  Synthetic oligonucleotide; GGG chr11 5291228 5291247 5291244 +
ttgctttattattagaaatg

SEQ ID NO: 16280 - DNA, 20 bp, Artificial Sequence
  Synthetic oligonucleotide; AAG chr11 5291231 5291250 5291247 +
ctttattattagaaatgggg

SEQ ID NO: 16281 - DNA, 20 bp, Artificial Sequence
  Synthetic oligonucleotide; GAG chr11 5291235 5291254 5291251 +
attattagaaatggggaagt

SEQ ID NO: 16282 - DNA, 20 bp, Artificial Sequence
  Synthetic oligonucleotide; TAG chr11 5291240 5291259 5291256 +
tagaaatggggaagtgagta

SEQ ID NO: 16283 - DNA, 20 bp, Artificial Sequence
  Synthetic oligonucleotide; CAG chr11 5291252 5291271 5291268 +
agtgagtatagacattttat

SEQ ID NO: 16284 - DNA, 20 bp, Artificial Sequence
  Synthetic oligonucleotide; AGG chr11 5291253 5291272 5291269 +
gtgagtatagacattttatc

SEQ ID NO: 16285 - DNA, 20 bp, Artificial Sequence
  Synthetic oligonucleotide; GAG chr11 5291255 5291274 5291271 +
gagtatagacattttatcag

SEQ ID NO: 16286 - DNA, 20 bp, Artificial Sequence
  Synthetic oligonucleotide; TAG chr11 5291264 5291283 5291280 +
cattttatcaggagatatat

SEQ ID NO: 16287 - DNA, 20 bp, Artificial Sequence
  Synthetic oligonucleotide; AGG chr11 5291265 5291284 5291281 +
attttatcaggagatatatt

SEQ ID NO: 16288 - DNA, 20 bp, Artificial Sequence
  Synthetic oligonucleotide; AAG chr11 5291271 5291290 5291287 +
tcaggagatatattaggaaa

SEQ ID NO: 16289 - DNA, 20 bp, Artificial Sequence
  Synthetic oligonucleotide; AGG chr11 5291272 5291291 5291288 +
caggagatatattaggaaaa

SEQ ID NO: 16290 - DNA, 20 bp, Artificial Sequence
  Synthetic oligonucleotide; GGG chr11 5291273 5291292 5291289 +
aggagatatattaggaaaaa

SEQ ID NO: 16291 - DNA, 20 bp, Artificial Sequence
  Synthetic oligonucleotide; TGG chr11 5291280 5291299 5291296 +
atattaggaaaaagggaaac

SEQ ID NO: 16292 - DNA, 20 bp, Artificial Sequence
  Synthetic oligonucleotide; GAG chr11 5291282 5291301 5291298 +
attaggaaaaagggaaactg

SEQ ID NO: 16293 - DNA, 20 bp, Artificial Sequence
  Synthetic oligonucleotide; TGG chr11 5291289 5291308 5291305 +
aaaagggaaactggagaaac

SEQ ID NO: 16294 - DNA, 20 bp, Artificial Sequence
  Synthetic oligonucleotide; GGG chr11 5291290 5291309 5291306 +
aaagggaaactggagaaact

SEQ ID NO: 16295 - DNA, 20 bp, Artificial Sequence
  Synthetic oligonucleotide; GAG chr11 5291292 5291311 5291308 +
agggaaactggagaaactgg

SEQ ID NO: 16296 - DNA, 20 bp, Artificial Sequence
  Synthetic oligonucleotide; AGG chr11 5291293 5291312 5291309 +
gggaaactggagaaactggg

SEQ ID NO: 16297 - DNA, 20 bp, Artificial Sequence
  Synthetic oligonucleotide; GAG chr11 5291295 5291314 5291311 +
gaaactggagaaactgggag

SEQ ID NO: 16298 - DNA, 20 bp, Artificial Sequence
  Synthetic oligonucleotide; CAG chr11 5291302 5291321 5291318 +
gagaaactgggaggagtatc

SEQ ID NO: 16299 - DNA, 20 bp, Artificial Sequence
  Synthetic oligonucleotide; AAG chr11 5291320 5291339 5291336 +
tccagatgtcctgtccctgt

SEQ ID NO: 16300 - DNA, 20 bp, Artificial Sequence
  Synthetic oligonucleotide; AGG chr11 5291321 5291340 5291337 +
ccagatgtcctgtccctgta

SEQ ID NO: 16301 - DNA, 20 bp, Artificial Sequence
  Synthetic oligonucleotide; TGG chr11 5291324 5291343 5291340 +
gatgtcctgtccctgtaagg

SEQ ID NO: 16302 - DNA, 20 bp, Artificial Sequence
  Synthetic oligonucleotide; GGG chr11 5291325 5291344 5291341 +
atgtcctgtccctgtaaggt

SEQ ID NO: 16303 - DNA, 20 bp, Artificial Sequence
  Synthetic oligonucleotide; GGG chr11 5291326 5291345 5291342 +
tgtcctgtccctgtaaggtg

SEQ ID NO: 16304 - DNA, 20 bp, Artificial Sequence
  Synthetic oligonucleotide; GGG chr11 5291327 5291346 5291343 +
gtcctgtccctgtaaggtgg

SEQ ID NO: 16305 - DNA, 20 bp, Artificial Sequence
  Synthetic oligonucleotide; AAG chr11 5291347 5291366 5291363 +
gggcacccaccttcaatcaa

SEQ ID NO: 16306 - DNA, 20 bp, Artificial Sequence
  Synthetic oligonucleotide; AGG chr11 5291348 5291367 5291364 +
ggcacccaccttcaatcaaa

SEQ ID NO: 16307 - DNA, 20 bp, Artificial Sequence
  Synthetic oligonucleotide; GGG chr11 5291349 5291368 5291365 +
gcacccaccttcaatcaaaa

SEQ ID NO: 16308 - DNA, 20 bp, Artificial Sequence
  Synthetic oligonucleotide; TGG chr11 5291373 5291392 5291389 +
tccttaacaacttccttgct

SEQ ID NO: 16309 - DNA, 20 bp, Artificial Sequence
  Synthetic oligonucleotide; GGG chr11 5291374 5291393 5291390 +
ccttaacaacttccttgctt

SEQ ID NO: 16310 - DNA, 20 bp, Artificial Sequence
  Synthetic oligonucleotide; GGG chr11 5291375 5291394 5291391 +
cttaacaacttccttgcttg

SEQ ID NO: 16311 - DNA, 20 bp, Artificial Sequence
  Synthetic oligonucleotide; TGG chr11 5291389 5291408 5291405 +
tgcttggggctccaccatct

SEQ ID NO: 16312 - DNA, 20 bp, Artificial Sequence
  Synthetic oligonucleotide; TAG chr11 5291397 5291416 5291413 +
gctccaccatcttggaccat

SEQ ID NO: 16313 - DNA, 20 bp, Artificial Sequence
  Synthetic oligonucleotide; CAG chr11 5291405 5291424 5291421 +
atcttggaccattagctcca

SEQ ID NO: 16314 - DNA, 20 bp, Artificial Sequence
  Synthetic oligonucleotide; AGG chr11 5291406 5291425 5291422 +
tcttggaccattagctccac

SEQ ID NO: 16315 - DNA, 20 bp, Artificial Sequence
  Synthetic oligonucleotide; TAG chr11 5291423 5291442 5291439 +
cacaggtatcttcttccctc

SEQ ID NO: 16316 - DNA, 20 bp, Artificial Sequence
  Synthetic oligonucleotide; TGG chr11 5291426 5291445 5291442 +
aggtatcttcttccctctag

SEQ ID NO: 16317 - DNA, 20 bp, Artificial Sequence
  Synthetic oligonucleotide; CAG chr11 5291435 5291454 5291451 +
cttccctctagtggtcataa

SEQ ID NO: 16318 - DNA, 20 bp, Artificial Sequence
  Synthetic oligonucleotide; CAG chr11 5291438 5291457 5291454 +
ccctctagtggtcataacag

SEQ ID NO: 16319 - DNA, 20 bp, Artificial Sequence
  Synthetic oligonucleotide; CAG chr11 5291444 5291463 5291460 +
agtggtcataacagcagctt

SEQ ID NO: 16320 - DNA, 20 bp, Artificial Sequence
  Synthetic oligonucleotide; AAG chr11 5291458 5291477 5291474 +
cagcttcagctacctctcta

SEQ ID NO: 16321 - DNA, 20 bp, Artificial Sequence
  Synthetic oligonucleotide; GAG chr11 5291460 5291479 5291476 +
gcttcagctacctctctaaa

SEQ ID NO: 16322 - DNA, 20 bp, Artificial Sequence
  Synthetic oligonucleotide; CAG chr11 5291469 5291488 5291485 +
acctctctaaagagtcctgc

SEQ ID NO: 16323 - DNA, 20 bp, Artificial Sequence
  Synthetic oligonucleotide; TAG chr11 5291475 5291494 5291491 +
ctaaagagtcctgccagata

SEQ ID NO: 16324 - DNA, 20 bp, Artificial Sequence
  Synthetic oligonucleotide; AGG chr11 5291476 5291495 5291492 +
taaagagtcctgccagatat

SEQ ID NO: 16325 - DNA, 20 bp, Artificial Sequence
  Synthetic oligonucleotide; CAG chr11 5291480 5291499 5291496 +
gagtcctgccagatataggt

SEQ ID NO: 16326 - DNA, 20 bp, Artificial Sequence
  Synthetic oligonucleotide; AGG chr11 5291481 5291500 5291497 +
agtcctgccagatataggtc

SEQ ID NO: 16327 - DNA, 20 bp, Artificial Sequence
  Synthetic oligonucleotide; AAG chr11 5291504 5291523 5291520 +
aaatataatccactaataaa

SEQ ID NO: 16328 - DNA, 20 bp, Artificial Sequence
  Synthetic oligonucleotide; GAG chr11 5291506 5291525 5291522 +
atataatccactaataaaaa

SEQ ID NO: 16329 - DNA, 20 bp, Artificial Sequence
  Synthetic oligonucleotide; TAG chr11 5291523 5291542 5291539 +
aaagagaaacattttgactg

SEQ ID NO: 16330 - DNA, 20 bp, Artificial Sequence
  Synthetic oligonucleotide; CAG chr11 5291576 5291595 5291592 +
taacattctcactctttcat

SEQ ID NO: 16331 - DNA, 20 bp, Artificial Sequence
  Synthetic oligonucleotide; CAG chr11 5291587 5291606 5291603 +
ctctttcatcagtaatcact

SEQ ID NO: 16332 - DNA, 20 bp, Artificial Sequence
  Synthetic oligonucleotide; AGG chr11 5291588 5291607 5291604 +
tctttcatcagtaatcactc

SEQ ID NO: 16333 - DNA, 20 bp, Artificial Sequence
  Synthetic oligonucleotide; CAG chr11 5291606 5291625 5291622 +
tcaggttattctgtgaccaa

SEQ ID NO: 16334 - DNA, 20 bp, Artificial Sequence
  Synthetic oligonucleotide; TGG chr11 5291613 5291632 5291629 +
attctgtgaccaacagactg

SEQ ID NO: 16335 - DNA, 20 bp, Artificial Sequence
  Synthetic oligonucleotide; GGG chr11 5291614 5291633 5291630 +
ttctgtgaccaacagactgt

SEQ ID NO: 16336 - DNA, 20 bp, Artificial Sequence
  Synthetic oligonucleotide; CAG chr11 5291623 5291642 5291639 +
caacagactgtgggaaaaat

SEQ ID NO: 16337 - DNA, 20 bp, Artificial Sequence
  Synthetic oligonucleotide; GAG chr11 5291625 5291644 5291641 +
acagactgtgggaaaaatca

SEQ ID NO: 16338 - DNA, 20 bp, Artificial Sequence
  Synthetic oligonucleotide; AAG chr11 5291628 5291647 5291644 +
gactgtgggaaaaatcagag

SEQ ID NO: 16339 - DNA, 20 bp, Artificial Sequence
  Synthetic oligonucleotide; AGG chr11 5291629 5291648 5291645 +
actgtgggaaaaatcagaga

SEQ ID NO: 16340 - DNA, 20 bp, Artificial Sequence
  Synthetic oligonucleotide; GAG chr11 5291631 5291650 5291647 +
tgtgggaaaaatcagagaag

SEQ ID NO: 16341 - DNA, 20 bp, Artificial Sequence
  Synthetic oligonucleotide; AGG chr11 5291632 5291651 5291648 +
gtgggaaaaatcagagaagg

SEQ ID NO: 16342 - DNA, 20 bp, Artificial Sequence
  Synthetic oligonucleotide; TAG chr11 5291650 5291669 5291666 +
ggaggcatcctcatgcttac

SEQ ID NO: 16343 - DNA, 20 bp, Artificial Sequence
  Synthetic oligonucleotide; TAG chr11 5291671 5291690 5291687 +
agcctaaactgaaattgcta

SEQ ID NO: 16344 - DNA, 20 bp, Artificial Sequence
  Synthetic oligonucleotide; CAG chr11 5291674 5291693 5291690 +
ctaaactgaaattgctatag

SEQ ID NO: 16345 - DNA, 20 bp, Artificial Sequence
  Synthetic oligonucleotide; GAG chr11 5291676 5291695 5291692 +
aaactgaaattgctatagca

SEQ ID NO: 16346 - DNA, 20 bp, Artificial Sequence
  Synthetic oligonucleotide; CAG chr11 5291684 5291703 5291700 +
attgctatagcagagtgaac

SEQ ID NO: 16347 - DNA, 20 bp, Artificial Sequence
  Synthetic oligonucleotide; AAG chr11 5291687 5291706 5291703 +
gctatagcagagtgaaccag

SEQ ID NO: 16348 - DNA, 20 bp, Artificial Sequence
  Synthetic oligonucleotide; AGG chr11 5291688 5291707 5291704 +
ctatagcagagtgaaccaga

SEQ ID NO: 16349 - DNA, 20 bp, Artificial Sequence
  Synthetic oligonucleotide; CAG chr11 5291695 5291714 5291711 +
agagtgaaccagaaggttta

SEQ ID NO: 16350 - DNA, 20 bp, Artificial Sequence
  Synthetic oligonucleotide; AAG chr11 5291710 5291729 5291726 +
gtttacagatattttccaca

SEQ ID NO: 16351 - DNA, 20 bp, Artificial Sequence
  Synthetic oligonucleotide; GAG chr11 5291712 5291731 5291728 +
ttacagatattttccacaaa

SEQ ID NO: 16352 - DNA, 20 bp, Artificial Sequence
  Synthetic oligonucleotide; AAG chr11 5291718 5291737 5291734 +
atattttccacaaagagtaa

SEQ ID NO: 16353 - DNA, 20 bp, Artificial Sequence
  Synthetic oligonucleotide; AGG chr11 5291719 5291738 5291735 +
tattttccacaaagagtaaa

SEQ ID NO: 16354 - DNA, 20 bp, Artificial Sequence
  Synthetic oligonucleotide; AAG chr11 5291726 5291745 5291742 +
cacaaagagtaaaaggattg

SEQ ID NO: 16355 - DNA, 20 bp, Artificial Sequence
  Synthetic oligonucleotide; CAG chr11 5291736 5291755 5291752 +
aaaaggattgaagccttctc

SEQ ID NO: 16356 - DNA, 20 bp, Artificial Sequence
  Synthetic oligonucleotide; TAG chr11 5291748 5291767 5291764 +
gccttctccagatcaatgca

SEQ ID NO: 16357 - DNA, 20 bp, Artificial Sequence
  Synthetic oligonucleotide; AGG chr11 5291749 5291768 5291765 +
ccttctccagatcaatgcat

SEQ ID NO: 16358 - DNA, 20 bp, Artificial Sequence
  Synthetic oligonucleotide; TGG chr11 5291761 5291780 5291777 +
caatgcataggaaataataa

SEQ ID NO: 16359 - DNA, 20 bp, Artificial Sequence
  Synthetic oligonucleotide; TAG chr11 5291795 5291814 5291811 +
catattatgacgaacaacat

SEQ ID NO: 16360 - DNA, 20 bp, Artificial Sequence
  Synthetic oligonucleotide; AGG chr11 5291796 5291815 5291812 +
atattatgacgaacaacatt

SEQ ID NO: 16361 - DNA, 20 bp, Artificial Sequence
  Synthetic oligonucleotide; AAG chr11 5291801 5291820 5291817 +
atgacgaacaacattaggat

SEQ ID NO: 16362 - DNA, 20 bp, Artificial Sequence
  Synthetic oligonucleotide; CAG chr11 5291823 5291842 5291839 +
gtccatatcaatttttaatc

SEQ ID NO: 16363 - DNA, 20 bp, Artificial Sequence
  Synthetic oligonucleotide; AAG chr11 5291830 5291849 5291846 +
tcaatttttaatccagtcat

SEQ ID NO: 16364 - DNA, 20 bp, Artificial Sequence
  Synthetic oligonucleotide; CAG chr11 5291835 5291854 5291851 +
ttttaatccagtcataagca

SEQ ID NO: 16365 - DNA, 20 bp, Artificial Sequence
  Synthetic oligonucleotide; AAG chr11 5291846 5291865 5291862 +
tcataagcacagactacgtg

SEQ ID NO: 16366 - DNA, 20 bp, Artificial Sequence
  Synthetic oligonucleotide; AAG chr11 5291856 5291875 5291872 +
agactacgtgaagcacgtcc

SEQ ID NO: 16367 - DNA, 20 bp, Artificial Sequence
  Synthetic oligonucleotide; AAG chr11 5291861 5291880 5291877 +
acgtgaagcacgtccaagtg

SEQ ID NO: 16368 - DNA, 20 bp, Artificial Sequence
  Synthetic oligonucleotide; AGG chr11 5291862 5291881 5291878 +
cgtgaagcacgtccaagtga

SEQ ID NO: 16369 - DNA, 20 bp, Artificial Sequence
  Synthetic oligonucleotide; CAG chr11 5291865 5291884 5291881 +
gaagcacgtccaagtgaagg

SEQ ID NO: 16370 - DNA, 20 bp, Artificial Sequence
  Synthetic oligonucleotide; AGG chr11 5291866 5291885 5291882 +
aagcacgtccaagtgaaggc

SEQ ID NO: 16371 - DNA, 20 bp, Artificial Sequence
  Synthetic oligonucleotide; GAG chr11 5291868 5291887 5291884 +
gcacgtccaagtgaaggcag

SEQ ID NO: 16372 - DNA, 20 bp, Artificial Sequence
  Synthetic oligonucleotide; GAG chr11 5291875 5291894 5291891 +
caagtgaaggcaggagaaat

SEQ ID NO: 16373 - DNA, 20 bp, Artificial Sequence
  Synthetic oligonucleotide; GAG chr11 5291877 5291896 5291893 +
agtgaaggcaggagaaatga

SEQ ID NO: 16374 - DNA, 20 bp, Artificial Sequence
  Synthetic oligonucleotide; AGG chr11 5291878 5291897 5291894 +
gtgaaggcaggagaaatgag

SEQ ID NO: 16375 - DNA, 20 bp, Artificial Sequence
  Synthetic oligonucleotide; GAG chr11 5291880 5291899 5291896 +
gaaggcaggagaaatgagag

SEQ ID NO: 16376 - DNA, 20 bp, Artificial Sequence
  Synthetic oligonucleotide; AAG chr11 5291884 5291903 5291900 +
gcaggagaaatgagaggagc

SEQ ID NO: 16377 - DNA, 20 bp, Artificial Sequence
  Synthetic oligonucleotide; AAG chr11 5291888 5291907 5291904 +
gagaaatgagaggagcaaga

SEQ ID NO: 16378 - DNA, 20 bp, Artificial Sequence
  Synthetic oligonucleotide; GAG chr11 5291890 5291909 5291906 +
gaaatgagaggagcaagaaa

SEQ ID NO: 16379 - DNA, 20 bp, Artificial Sequence
  Synthetic oligonucleotide; AGG chr11 5291891 5291910 5291907 +
aaatgagaggagcaagaaag

SEQ ID NO: 16380 - DNA, 20 bp, Artificial Sequence
  Synthetic oligonucleotide; GAG chr11 5291893 5291912 5291909 +
atgagaggagcaagaaagag

SEQ ID NO: 16381 - DNA, 20 bp, Artificial Sequence
  Synthetic oligonucleotide; AAG chr11 5291906 5291925 5291922 +
gaaagaggagccatttgatc

SEQ ID NO: 16382 - DNA, 20 bp, Artificial Sequence
  Synthetic oligonucleotide; TAG chr11 5291911 5291930 5291927 +
aggagccatttgatcaagaa

SEQ ID NO: 16383 - DNA, 20 bp, Artificial Sequence
  Synthetic oligonucleotide; CAG chr11 5291914 5291933 5291930 +
agccatttgatcaagaatag

SEQ ID NO: 16384 - DNA, 20 bp, Artificial Sequence
  Synthetic oligonucleotide; AAG chr11 5291920 5291939 5291936 +
ttgatcaagaatagcagaaa

SEQ ID NO: 16385 - DNA, 20 bp, Artificial Sequence
  Synthetic oligonucleotide; AGG chr11 5291921 5291940 5291937 +
tgatcaagaatagcagaaaa

SEQ ID NO: 16386 - DNA, 20 bp, Artificial Sequence
  Synthetic oligonucleotide; AAG chr11 5291925 5291944 5291941 +
caagaatagcagaaaaagga

SEQ ID NO: 16387 - DNA, 20 bp, Artificial Sequence
  Synthetic oligonucleotide; AGG chr11 5291926 5291945 5291942 +
aagaatagcagaaaaaggaa

SEQ ID NO: 16388 - DNA, 20 bp, Artificial Sequence
  Synthetic oligonucleotide; AAG chr11 5291930 5291949 5291946 +
atagcagaaaaaggaaaggc

SEQ ID NO: 16389 - DNA, 20 bp, Artificial Sequence
  Synthetic oligonucleotide; CAG chr11 5291961 5291980 5291977 +
acaaatgattgtcatgccaa

SEQ ID NO: 16390 - DNA, 20 bp, Artificial Sequence
  Synthetic oligonucleotide; CAG chr11 5291966 5291985 5291982 +
tgattgtcatgccaacagta

SEQ ID NO: 16391 - DNA, 20 bp, Artificial Sequence
  Synthetic oligonucleotide; AAG chr11 5291984 5292003 5292000 +
tacagataactctgctaata

SEQ ID NO: 16392 - DNA, 20 bp, Artificial Sequence
  Synthetic oligonucleotide; AGG chr11 5291985 5292004 5292001 +
acagataactctgctaataa

SEQ ID NO: 16393 - DNA, 20 bp, Artificial Sequence
  Synthetic oligonucleotide; TAG chr11 5291988 5292007 5292004 +
gataactctgctaataaagg

SEQ ID NO: 16394 - DNA, 20 bp, Artificial Sequence
  Synthetic oligonucleotide; GAG chr11 5291990 5292009 5292006 +
taactctgctaataaaggta

SEQ ID NO: 16395 - DNA, 20 bp, Artificial Sequence
  Synthetic oligonucleotide; AGG chr11 5291991 5292010 5292007 +
aactctgctaataaaggtag

SEQ ID NO: 16396 - DNA, 20 bp, Artificial Sequence
  Synthetic oligonucleotide; CAG chr11 5292001 5292020 5292017 +
ataaaggtagaggcataata

SEQ ID NO: 16397 - DNA, 20 bp, Artificial Sequence
  Synthetic oligonucleotide; AGG chr11 5292002 5292021 5292018 +
taaaggtagaggcataatac

SEQ ID NO: 16398 - DNA, 20 bp, Artificial Sequence
  Synthetic oligonucleotide; TAG chr11 5292005 5292024 5292021 +
aggtagaggcataatacagg

SEQ ID NO: 16399 - DNA, 20 bp, Artificial Sequence
  Synthetic oligonucleotide; TAG chr11 5292008 5292027 5292024 +
tagaggcataatacaggtag

SEQ ID NO: 16400 - DNA, 20 bp, Artificial Sequence
  Synthetic oligonucleotide; CAG chr11 5292011 5292030 5292027 +
aggcataatacaggtagtag

SEQ ID NO: 16401 - DNA, 20 bp, Artificial Sequence
  Synthetic oligonucleotide; TAG chr11 5292023 5292042 5292039 +
ggtagtagcagatatctaca

SEQ ID NO: 16402 - DNA, 20 bp, Artificial Sequence
  Synthetic oligonucleotide; TAG chr11 5292026 5292045 5292042 +
agtagcagatatctacatag

SEQ ID NO: 16403 - DNA, 20 bp, Artificial Sequence
  Synthetic oligonucleotide; AAG chr11 5292032 5292051 5292048 +
agatatctacatagtagtta

SEQ ID NO: 16404 - DNA, 20 bp, Artificial Sequence
  Synthetic oligonucleotide; AGG chr11 5292033 5292052 5292049 +
gatatctacatagtagttaa

SEQ ID NO: 16405 - DNA, 20 bp, Artificial Sequence
  Synthetic oligonucleotide; TGG chr11 5292039 5292058 5292055 +
tacatagtagttaaaggaca

SEQ ID NO: 16406 - DNA, 20 bp, Artificial Sequence
  Synthetic oligonucleotide; CAG chr11 5292046 5292065 5292062 +
tagttaaaggacatggccat

SEQ ID NO: 16407 - DNA, 20 bp, Artificial Sequence
  Synthetic oligonucleotide; CAG chr11 5292051 5292070 5292067 +
aaaggacatggccatcagta

SEQ ID NO: 16408 - DNA, 20 bp, Artificial Sequence
  Synthetic oligonucleotide; AAG chr11 5292054 5292073 5292070 +
ggacatggccatcagtacag

SEQ ID NO: 16409 - DNA, 20 bp, Artificial Sequence
  Synthetic oligonucleotide; AAG chr11 5292065 5292084 5292081 +
tcagtacagaagattccata

SEQ ID NO: 16410 - DNA, 20 bp, Artificial Sequence
  Synthetic oligonucleotide; AGG chr11 5292066 5292085 5292082 +
cagtacagaagattccataa

SEQ ID NO: 16411 - DNA, 20 bp, Artificial Sequence
  Synthetic oligonucleotide; GAG chr11 5292068 5292087 5292084 +
gtacagaagattccataaag

SEQ ID NO: 16412 - DNA, 20 bp, Artificial Sequence
  Synthetic oligonucleotide; AAG chr11 5292077 5292096 5292093 +
attccataaaggagaaccta

SEQ ID NO: 16413 - DNA, 20 bp, Artificial Sequence
  Synthetic oligonucleotide; GAG chr11 5292079 5292098 5292095 +
tccataaaggagaacctaaa

SEQ ID NO: 16414 - DNA, 20 bp, Artificial Sequence
  Synthetic oligonucleotide; AGG chr11 5292080 5292099 5292096 +
ccataaaggagaacctaaag

SEQ ID NO: 16415 - DNA, 20 bp, Artificial Sequence
  Synthetic oligonucleotide; AAG chr11 5292083 5292102 5292099 +
taaaggagaacctaaagagg

SEQ ID NO: 16416 - DNA, 20 bp, Artificial Sequence
  Synthetic oligonucleotide; CAG chr11 5292096 5292115 5292112 +
aaagaggaagaataatttgt

SEQ ID NO: 16417 - DNA, 20 bp, Artificial Sequence
  Synthetic oligonucleotide; AAG chr11 5292099 5292118 5292115 +
gaggaagaataatttgtcag

SEQ ID NO: 16418 - DNA, 20 bp, Artificial Sequence
  Synthetic oligonucleotide; AAG chr11 5292107 5292126 5292123 +
ataatttgtcagaagcttaa

SEQ ID NO: 16419 - DNA, 20 bp, Artificial Sequence
  Synthetic oligonucleotide; GAG chr11 5292119 5292138 5292135 +
aagcttaaaagctgaactct

SEQ ID NO: 16420 - DNA, 20 bp, Artificial Sequence
  Synthetic oligonucleotide; AGG chr11 5292120 5292139 5292136 +
agcttaaaagctgaactctg

SEQ ID NO: 16421 - DNA, 20 bp, Artificial Sequence
  Synthetic oligonucleotide; TGG chr11 5292150 5292169 5292166 +
ctacaatatccttttgactg

SEQ ID NO: 16422 - DNA, 20 bp, Artificial Sequence
  Synthetic oligonucleotide; AAG chr11 5292154 5292173 5292170 +
aatatccttttgactgtgga

SEQ ID NO: 16423 - DNA, 20 bp, Artificial Sequence
  Synthetic oligonucleotide; AGG chr11 5292155 5292174 5292171 +
atatccttttgactgtggaa

SEQ ID NO: 16424 - DNA, 20 bp, Artificial Sequence
  Synthetic oligonucleotide; GGG chr11 5292156 5292175 5292172 +
tatccttttgactgtggaaa

SEQ ID NO: 16425 - DNA, 20 bp, Artificial Sequence
  Synthetic oligonucleotide; TGG chr11 5292159 5292178 5292175 +
ccttttgactgtggaaaggg

SEQ ID NO: 16426 - DNA, 20 bp, Artificial Sequence
  Synthetic oligonucleotide; AAG chr11 5292165 5292184 5292181 +
gactgtggaaagggtggtga

SEQ ID NO: 16427 - DNA, 20 bp, Artificial Sequence
  Synthetic oligonucleotide; AGG chr11 5292166 5292185 5292182 +
actgtggaaagggtggtgaa

SEQ ID NO: 16428 - DNA, 20 bp, Artificial Sequence
  Synthetic oligonucleotide; AAG chr11 5292170 5292189 5292186 +
tggaaagggtggtgaaagga

SEQ ID NO: 16429 - DNA, 20 bp, Artificial Sequence
  Synthetic oligonucleotide; AAG chr11 5292176 5292195 5292192 +
gggtggtgaaaggaaagttc

SEQ ID NO: 16430 - DNA, 20 bp, Artificial Sequence
  Synthetic oligonucleotide; AGG chr11 5292177 5292196 5292193 +
ggtggtgaaaggaaagttca

SEQ ID NO: 16431 - DNA, 20 bp, Artificial Sequence
  Synthetic oligonucleotide; GAG chr11 5292186 5292205 5292202 +
aggaaagttcaaggacattt

SEQ ID NO: 16432 - DNA, 20 bp, Artificial Sequence
  Synthetic oligonucleotide; TAG chr11 5292195 5292214 5292211 +
caaggacatttgagccaaca

SEQ ID NO: 16433 - DNA, 20 bp, Artificial Sequence
  Synthetic oligonucleotide; GAG chr11 5292197 5292216 5292213 +
aggacatttgagccaacata

SEQ ID NO: 16434 - DNA, 20 bp, Artificial Sequence
  Synthetic oligonucleotide; GAG chr11 5292199 5292218 5292215 +
gacatttgagccaacataga

SEQ ID NO: 16435 - DNA, 20 bp, Artificial Sequence
  Synthetic oligonucleotide; AGG chr11 5292200 5292219 5292216 +
acatttgagccaacatagag

SEQ ID NO: 16436 - DNA, 20 bp, Artificial Sequence
  Synthetic oligonucleotide; TGG chr11 5292208 5292227 5292224 +
gccaacatagagaggaacat

SEQ ID NO: 16437 - DNA, 20 bp, Artificial Sequence
  Synthetic oligonucleotide; TGG chr11 5292213 5292232 5292229 +
catagagaggaacattggct

SEQ ID NO: 16438 - DNA, 20 bp, Artificial Sequence
  Synthetic oligonucleotide; GAG chr11 5292217 5292236 5292233 +
gagaggaacattggcttggt

SEQ ID NO: 16439 - DNA, 20 bp, Artificial Sequence
  Synthetic oligonucleotide; AGG chr11 5292218 5292237 5292234 +
agaggaacattggcttggtg

SEQ ID NO: 16440 - DNA, 20 bp, Artificial Sequence
  Synthetic oligonucleotide; GGG chr11 5292219 5292238 5292235 +
gaggaacattggcttggtga

SEQ ID NO: 16441 - DNA, 20 bp, Artificial Sequence
  Synthetic oligonucleotide; CAG chr11 5292242 5292261 5292258 +
atatctgtcctgatgttgtc

SEQ ID NO: 16442 - DNA, 20 bp, Artificial Sequence
  Synthetic oligonucleotide; AGG chr11 5292243 5292262 5292259 +
tatctgtcctgatgttgtcc

SEQ ID NO: 16443 - DNA, 20 bp, Artificial Sequence
  Synthetic oligonucleotide; TGG chr11 5292247 5292266 5292263 +
tgtcctgatgttgtccagga

SEQ ID NO: 16444 - DNA, 20 bp, Artificial Sequence
  Synthetic oligonucleotide; TAG chr11 5292273 5292292 5292289 +
tgatacccatataaataacg

SEQ ID NO: 16445 - DNA, 20 bp, Artificial Sequence
  Synthetic oligonucleotide; GAG chr11 5292275 5292294 5292291 +
atacccatataaataacgta

SEQ ID NO: 16446 - DNA, 20 bp, Artificial Sequence
  Synthetic oligonucleotide; CAG chr11 5292282 5292301 5292298 +
tataaataacgtagagaaaa

SEQ ID NO: 16447 - DNA, 20 bp, Artificial Sequence
  Synthetic oligonucleotide; AGG chr11 5292283 5292302 5292299 +
ataaataacgtagagaaaac

SEQ ID NO: 16448 - DNA, 20 bp, Artificial Sequence
  Synthetic oligonucleotide; GAG chr11 5292285 5292304 5292301 +
aaataacgtagagaaaacag

SEQ ID NO: 16449 - DNA, 20 bp, Artificial Sequence
  Synthetic oligonucleotide; AGG chr11 5292286 5292305 5292302 +
aataacgtagagaaaacagg

SEQ ID NO: 16450 - DNA, 20 bp, Artificial Sequence
  Synthetic oligonucleotide; GGG chr11 5292287 5292306 5292303 +
ataacgtagagaaaacagga

SEQ ID NO: 16451 - DNA, 20 bp, Artificial Sequence
  Synthetic oligonucleotide; GGG chr11 5292288 5292307 5292304 +
taacgtagagaaaacaggag

SEQ ID NO: 16452 - DNA, 20 bp, Artificial Sequence
  Synthetic oligonucleotide; TAG chr11 5292292 5292311 5292308 +
gtagagaaaacaggagggga

SEQ ID NO: 16453 - DNA, 20 bp, Artificial Sequence
  Synthetic oligonucleotide; GAG chr11 5292294 5292313 5292310 +
agagaaaacaggaggggata

SEQ ID NO: 16454 - DNA, 20 bp, Artificial Sequence
  Synthetic oligonucleotide; TAG chr11 5292300 5292319 5292316 +
aacaggaggggatagagatc

SEQ ID NO: 16455 - DNA, 20 bp, Artificial Sequence
  Synthetic oligonucleotide; AAG chr11 5292306 5292325 5292322 +
aggggatagagatctagaca

SEQ ID NO: 16456 - DNA, 20 bp, Artificial Sequence
  Synthetic oligonucleotide; GAG chr11 5292308 5292327 5292324 +
gggatagagatctagacaaa

SEQ ID NO: 16457 - DNA, 20 bp, Artificial Sequence
  Synthetic oligonucleotide; AGG chr11 5292309 5292328 5292325 +
ggatagagatctagacaaag

SEQ ID NO: 16458 - DNA, 20 bp, Artificial Sequence
  Synthetic oligonucleotide; AAG chr11 5292317 5292336 5292333 +
atctagacaaagaggcatca

SEQ ID NO: 16459 - DNA, 20 bp, Artificial Sequence
  Synthetic oligonucleotide; TAG chr11 5292321 5292340 5292337 +
agacaaagaggcatcaaaga

SEQ ID NO: 16460 - DNA, 20 bp, Artificial Sequence
  Synthetic oligonucleotide; AGG chr11 5292322 5292341 5292338 +
gacaaagaggcatcaaagat

SEQ ID NO: 16461 - DNA, 20 bp, Artificial Sequence
  Synthetic oligonucleotide; GGG chr11 5292323 5292342 5292339 +
acaaagaggcatcaaagata

SEQ ID NO: 16462 - DNA, 20 bp, Artificial Sequence
  Synthetic oligonucleotide; AAG chr11 5292334 5292353 5292350 +
tcaaagatagggatgtttgt

SEQ ID NO: 16463 - DNA, 20 bp, Artificial Sequence
  Synthetic oligonucleotide; AGG chr11 5292335 5292354 5292351 +
caaagatagggatgtttgta

SEQ ID NO: 16464 - DNA, 20 bp, Artificial Sequence
  Synthetic oligonucleotide; TAG chr11 5292344 5292363 5292360 +
ggatgtttgtaaggatgaaa

SEQ ID NO: 16465 - DNA, 20 bp, Artificial Sequence
  Synthetic oligonucleotide; TAG chr11 5292361 5292380 5292377 +
aaatagaacgttttttgcgt

SEQ ID NO: 16466 - DNA, 20 bp, Artificial Sequence
  Synthetic oligonucleotide; GAG chr11 5292371 5292390 5292387 +
ttttttgcgttagtcaccgt

SEQ ID NO: 16467 - DNA, 20 bp, Artificial Sequence
  Synthetic oligonucleotide; AGG chr11 5292372 5292391 5292388 +
tttttgcgttagtcaccgtg

SEQ ID NO: 16468 - DNA, 20 bp, Artificial Sequence
  Synthetic oligonucleotide; CGG chr11 5292380 5292399 5292396 +
ttagtcaccgtgaggatgac

SEQ ID NO: 16469 - DNA, 20 bp, Artificial Sequence
  Synthetic oligonucleotide; AAG chr11 5292385 5292404 5292401 +
caccgtgaggatgaccggta

SEQ ID NO: 16470 - DNA, 20 bp, Artificial Sequence
  Synthetic oligonucleotide; AGG chr11 5292386 5292405 5292402 +
accgtgaggatgaccggtaa

SEQ ID NO: 16471 - DNA, 20 bp, Artificial Sequence
  Synthetic oligonucleotide; CAG chr11 5292394 5292413 5292410 +
gatgaccggtaaaggcaatg

SEQ ID NO: 16472 - DNA, 20 bp, Artificial Sequence
  Synthetic oligonucleotide; GAG chr11 5292396 5292415 5292412 +
tgaccggtaaaggcaatgca

SEQ ID NO: 16473 - DNA, 20 bp, Artificial Sequence
  Synthetic oligonucleotide; AGG chr11 5292397 5292416 5292413 +
gaccggtaaaggcaatgcag

SEQ ID NO: 16474 - DNA, 20 bp, Artificial Sequence
  Synthetic oligonucleotide; TGG chr11 5292464 5292483 5292480 +
ataataattgtgtgtattca

SEQ ID NO: 16475 - DNA, 20 bp, Artificial Sequence
  Synthetic oligonucleotide; GGG chr11 5292465 5292484 5292481 +
taataattgtgtgtattcat

SEQ ID NO: 16476 - DNA, 20 bp, Artificial Sequence
  Synthetic oligonucleotide; GGG chr11 5292466 5292485 5292482 +
aataattgtgtgtattcatg

SEQ ID NO: 16477 - DNA, 20 bp, Artificial Sequence
  Synthetic oligonucleotide; TGG chr11 5292484 5292503 5292500 +
tggggtacaacatgatgctt

SEQ ID NO: 16478 - DNA, 20 bp, Artificial Sequence
  Synthetic oligonucleotide; TGG chr11 5292507 5292526 5292523 +
tgtacgtgtacaatattaaa

SEQ ID NO: 16479 - DNA, 20 bp, Artificial Sequence
  Synthetic oligonucleotide; AAG chr11 5292516 5292535 5292532 +
acaatattaaatggttaaat

SEQ ID NO: 16480 - DNA, 20 bp, Artificial Sequence
  Synthetic oligonucleotide; AGG chr11 5292517 5292536 5292533 +
caatattaaatggttaaata

SEQ ID NO: 16481 - DNA, 20 bp, Artificial Sequence
  Synthetic oligonucleotide; TGG chr11 5292559 5292578 5292575 +
cttcacatacttattttttg

SEQ ID NO: 16482 - DNA, 20 bp, Artificial Sequence
  Synthetic oligonucleotide; TGG chr11 5292600 5292619 5292616 +
acactcttcattcaaaaatc

SEQ ID NO: 16483 - DNA, 20 bp, Artificial Sequence
  Synthetic oligonucleotide; TAG chr11 5292607 5292626 5292623 +
tcattcaaaaatctggaaca

SEQ ID NO: 16484 - DNA, 20 bp, Artificial Sequence
  Synthetic oligonucleotide; CAG chr11 5292628 5292647 5292644 +
agttaaaatgtcatatgtgt

SEQ ID NO: 16485 - DNA, 20 bp, Artificial Sequence
  Synthetic oligonucleotide; AGG chr11 5292629 5292648 5292645 +
gttaaaatgtcatatgtgtc

SEQ ID NO: 16486 - DNA, 20 bp, Artificial Sequence
  Synthetic oligonucleotide; CAG chr11 5292635 5292654 5292651 +
atgtcatatgtgtcaggatg

SEQ ID NO: 16487 - DNA, 20 bp, Artificial Sequence
  Synthetic oligonucleotide; TAG chr11 5292641 5292660 5292657 +
tatgtgtcaggatgcagtaa

SEQ ID NO: 16488 - DNA, 20 bp, Artificial Sequence
  Synthetic oligonucleotide; TAG chr11 5292647 5292666 5292663 +
tcaggatgcagtaatagatt

SEQ ID NO: 16489 - DNA, 20 bp, Artificial Sequence
  Synthetic oligonucleotide; GAG chr11 5292694 5292713 5292710 +
atcatgaataatgatcaatc

SEQ ID NO: 16490 - DNA, 20 bp, Artificial Sequence
  Synthetic oligonucleotide; AGG chr11 5292695 5292714 5292711 +
tcatgaataatgatcaatcg

SEQ ID NO: 16491 - DNA, 20 bp, Artificial Sequence
  Synthetic oligonucleotide; GAG chr11 5292713 5292732 5292729 +
cgaggaaaacctatgaaaat

SEQ ID NO: 16492 - DNA, 20 bp, Artificial Sequence
  Synthetic oligonucleotide; TGG chr11 5292723 5292742 5292739 +
ctatgaaaatgagaaaattt

SEQ ID NO: 16493 - DNA, 20 bp, Artificial Sequence
  Synthetic oligonucleotide; GAG chr11 5292725 5292744 5292741 +
atgaaaatgagaaaattttg

SEQ ID NO: 16494 - DNA, 20 bp, Artificial Sequence
  Synthetic oligonucleotide; TGG chr11 5292756 5292775 5292772 +
aaaaatatcttgatcacttt

SEQ ID NO: 16495 - DNA, 20 bp, Artificial Sequence
  Synthetic oligonucleotide; GAG chr11 5292758 5292777 5292774 +
aaatatcttgatcacttttg

SEQ ID NO: 16496 - DNA, 20 bp, Artificial Sequence
  Synthetic oligonucleotide; AGG chr11 5292759 5292778 5292775 +
aatatcttgatcacttttgg

SEQ ID NO: 16497 - DNA, 20 bp, Artificial Sequence
  Synthetic oligonucleotide; CAG chr11 5292763 5292782 5292779 +
tcttgatcacttttggaggt

SEQ ID NO: 16498 - DNA, 20 bp, Artificial Sequence
  Synthetic oligonucleotide; AGG chr11 5292764 5292783 5292780 +
cttgatcacttttggaggtc

SEQ ID NO: 16499 - DNA, 20 bp, Artificial Sequence
  Synthetic oligonucleotide; CAG chr11 5292771 5292790 5292787 +
acttttggaggtcaggaatt

SEQ ID NO: 16500 - DNA, 20 bp, Artificial Sequence
  Synthetic oligonucleotide; CGG chr11 5292786 5292805 5292802 +
gaattcagattcatttttct

SEQ ID NO: 16501 - DNA, 20 bp, Artificial Sequence
  Synthetic oligonucleotide; AAG chr11 5292795 5292814 5292811 +
ttcatttttctcggcctgta

SEQ ID NO: 16502 - DNA, 20 bp, Artificial Sequence
  Synthetic oligonucleotide; TAG chr11 5292815 5292834 5292831 +
aagaacttgaaattgcatta

SEQ ID NO: 16503 - DNA, 20 bp, Artificial Sequence
  Synthetic oligonucleotide; CAG chr11 5292818 5292837 5292834 +
aacttgaaattgcattatag

SEQ ID NO: 16504 - DNA, 20 bp, Artificial Sequence
  Synthetic oligonucleotide; TAG chr11 5292825 5292844 5292841 +
aattgcattatagcagaatg

SEQ ID NO: 16505 - DNA, 20 bp, Artificial Sequence
  Synthetic oligonucleotide; AGG chr11 5292826 5292845 5292842 +
attgcattatagcagaatgt

SEQ ID NO: 16506 - DNA, 20 bp, Artificial Sequence
  Synthetic oligonucleotide; GAG chr11 5292833 5292852 5292849 +
tatagcagaatgtaggcctt

SEQ ID NO: 16507 - DNA, 20 bp, Artificial Sequence
  Synthetic oligonucleotide; TGG chr11 5292836 5292855 5292852 +
agcagaatgtaggccttgag

SEQ ID NO: 16508 - DNA, 20 bp, Artificial Sequence
  Synthetic oligonucleotide; TGG chr11 5292846 5292865 5292862 +
aggccttgagtggattgatg

SEQ ID NO: 16509 - DNA, 20 bp, Artificial Sequence
  Synthetic oligonucleotide; AAG chr11 5292849 5292868 5292865 +
ccttgagtggattgatgtgg

SEQ ID NO: 16510 - DNA, 20 bp, Artificial Sequence
  Synthetic oligonucleotide; AAG chr11 5292858 5292877 5292874 +
gattgatgtggaagcaaaac

SEQ ID NO: 16511 - DNA, 20 bp, Artificial Sequence
  Synthetic oligonucleotide; AAG chr11 5292870 5292889 5292886 +
agcaaaacaagccacaaata

SEQ ID NO: 16512 - DNA, 20 bp, Artificial Sequence
  Synthetic oligonucleotide; AAG chr11 5292916 5292935 5292932 +
tgacttgtgccattaatttt

SEQ ID NO: 16513 - DNA, 20 bp, Artificial Sequence
  Synthetic oligonucleotide; CAG chr11 5292919 5292938 5292935 +
cttgtgccattaattttaag

SEQ ID NO: 16514 - DNA, 20 bp, Artificial Sequence
  Synthetic oligonucleotide; TGG chr11 5292936 5292955 5292952 +
aagcagtttcatatgaaacg

SEQ ID NO: 16515 - DNA, 20 bp, Artificial Sequence
  Synthetic oligonucleotide; GGG chr11 5292937 5292956 5292953 +
agcagtttcatatgaaacgt

SEQ ID NO: 16516 - DNA, 20 bp, Artificial Sequence
  Synthetic oligonucleotide; CAG chr11 5292959 5292978 5292975 +
gtttctttattgctacgtca

SEQ ID NO: 16517 - DNA, 20 bp, Artificial Sequence
  Synthetic oligonucleotide; CAG chr11 5292963 5292982 5292979 +
ctttattgctacgtcacagt

SEQ ID NO: 16518 - DNA, 20 bp, Artificial Sequence
  Synthetic oligonucleotide; TGG chr11 5292973 5292992 5292989 +
acgtcacagtcagatgttca

SEQ ID NO: 16519 - DNA, 20 bp, Artificial Sequence
  Synthetic oligonucleotide; GAG chr11 5292980 5292999 5292996 +
agtcagatgttcatggtcct

SEQ ID NO: 16520 - DNA, 20 bp, Artificial Sequence
  Synthetic oligonucleotide; AAG chr11 5292994 5293013 5293010 +
ggtcctgagtgctctcctcc

SEQ ID NO: 16521 - DNA, 20 bp, Artificial Sequence
  Synthetic oligonucleotide; CAG chr11 5292997 5293016 5293013 +
cctgagtgctctcctccaag

SEQ ID NO: 16522 - DNA, 20 bp, Artificial Sequence
  Synthetic oligonucleotide; TGG chr11 5293000 5293019 5293016 +
gagtgctctcctccaagcag

SEQ ID NO: 16523 - DNA, 20 bp, Artificial Sequence
  Synthetic oligonucleotide; GGG chr11 5293001 5293020 5293017 +
agtgctctcctccaagcagt

SEQ ID NO: 16524 - DNA, 20 bp, Artificial Sequence
  Synthetic oligonucleotide; CAG chr11 5293005 5293024 5293021 +
ctctcctccaagcagtgggc

SEQ ID NO: 16525 - DNA, 20 bp, Artificial Sequence
  Synthetic oligonucleotide; AGG chr11 5293006 5293025 5293022 +
tctcctccaagcagtgggcc

SEQ ID NO: 16526 - DNA, 20 bp, Artificial Sequence
  Synthetic oligonucleotide; GAG chr11 5293008 5293027 5293024 +
tcctccaagcagtgggccag

SEQ ID NO: 16527 - DNA, 20 bp, Artificial Sequence
  Synthetic oligonucleotide; CAG chr11 5293013 5293032 5293029 +
caagcagtgggccaggagtc

SEQ ID NO: 16528 - DNA, 20 bp, Artificial Sequence
  Synthetic oligonucleotide; AGG chr11 5293014 5293033 5293030 +
aagcagtgggccaggagtcc

SEQ ID NO: 16529 - DNA, 20 bp, Artificial Sequence
  Synthetic oligonucleotide; CAG chr11 5293045 5293064 5293061 +
tgtgattgactttatcattt

SEQ ID NO: 16530 - DNA, 20 bp, Artificial Sequence
  Synthetic oligonucleotide; TAG chr11 5293069 5293088 5293085 +
atcttttactttctgccaca

SEQ ID NO: 16531 - DNA, 20 bp, Artificial Sequence
  Synthetic oligonucleotide; GAG chr11 5293071 5293090 5293087 +
cttttactttctgccacata

SEQ ID NO: 16532 - DNA, 20 bp, Artificial Sequence
  Synthetic oligonucleotide; AGG chr11 5293072 5293091 5293088 +
ttttactttctgccacatag

SEQ ID NO: 16533 - DNA, 20 bp, Artificial Sequence
  Synthetic oligonucleotide; AAG chr11 5293075 5293094 5293091 +
tactttctgccacatagagg

SEQ ID NO: 16534 - DNA, 20 bp, Artificial Sequence
  Synthetic oligonucleotide; AGG chr11 5293076 5293095 5293092 +
actttctgccacatagagga

SEQ ID NO: 16535 - DNA, 20 bp, Artificial Sequence
  Synthetic oligonucleotide; GGG chr11 5293077 5293096 5293093 +
ctttctgccacatagaggaa

SEQ ID NO: 16536 - DNA, 20 bp, Artificial Sequence
  Synthetic oligonucleotide; AAG chr11 5293081 5293100 5293097 +
ctgccacatagaggaaggga

SEQ ID NO: 16537 - DNA, 20 bp, Artificial Sequence
  Synthetic oligonucleotide; GAG chr11 5293083 5293102 5293099 +
gccacatagaggaagggaaa

SEQ ID NO: 16538 - DNA, 20 bp, Artificial Sequence
  Synthetic oligonucleotide; TAG chr11 5293091 5293110 5293107 +
gaggaagggaaagagaatga

SEQ ID NO: 16539 - DNA, 20 bp, Artificial Sequence
  Synthetic oligonucleotide; AAG chr11 5293094 5293113 5293110 +
gaagggaaagagaatgatag

SEQ ID NO: 16540 - DNA, 20 bp, Artificial Sequence
  Synthetic oligonucleotide; AGG chr11 5293095 5293114 5293111 +
aagggaaagagaatgataga

SEQ ID NO: 16541 - DNA, 20 bp, Artificial Sequence
  Synthetic oligonucleotide; GGG chr11 5293096 5293115 5293112 +
agggaaagagaatgatagaa

SEQ ID NO: 16542 - DNA, 20 bp, Artificial Sequence
  Synthetic oligonucleotide; TAG chr11 5293109 5293128 5293125 +
gatagaagggcactctgcct

SEQ ID NO: 16543 - DNA, 20 bp, Artificial Sequence
  Synthetic oligonucleotide; AGG chr11 5293110 5293129 5293126 +
atagaagggcactctgcctt

SEQ ID NO: 16544 - DNA, 20 bp, Artificial Sequence
  Synthetic oligonucleotide; GGG chr11 5293111 5293130 5293127 +
tagaagggcactctgcctta

SEQ ID NO: 16545 - DNA, 20 bp, Artificial Sequence
  Synthetic oligonucleotide; GAG chr11 5293113 5293132 5293129 +
gaagggcactctgccttagg

SEQ ID NO: 16546 - DNA, 20 bp, Artificial Sequence
  Synthetic oligonucleotide; TAG chr11 5293143 5293162 5293159 +
ttattatctccacattattt

SEQ ID NO: 16547 - DNA, 20 bp, Artificial Sequence
  Synthetic oligonucleotide; CAG chr11 5293153 5293172 5293169 +
cacattattttagtcacaac

SEQ ID NO: 16548 - DNA, 20 bp, Artificial Sequence
  Synthetic oligonucleotide; TGG chr11 5293161 5293180 5293177 +
tttagtcacaaccagtcaca

SEQ ID NO: 16549 - DNA, 20 bp, Artificial Sequence
  Synthetic oligonucleotide; AAG chr11 5293166 5293185 5293182 +
tcacaaccagtcacatggcc

SEQ ID NO: 16550 - DNA, 20 bp, Artificial Sequence
  Synthetic oligonucleotide; AAG chr11 5293177 5293196 5293193 +
cacatggccaagttaattgc

SEQ ID NO: 16551 - DNA, 20 bp, Artificial Sequence
  Synthetic oligonucleotide; AGG chr11 5293178 5293197 5293194 +
acatggccaagttaattgca

SEQ ID NO: 16552 - DNA, 20 bp, Artificial Sequence
  Synthetic oligonucleotide; GGG chr11 5293179 5293198 5293195 +
catggccaagttaattgcaa

SEQ ID NO: 16553 - DNA, 20 bp, Artificial Sequence
  Synthetic oligonucleotide; TGG chr11 5293186 5293205 5293202 +
aagttaattgcaagggctgt

SEQ ID NO: 16554 - DNA, 20 bp, Artificial Sequence
  Synthetic oligonucleotide; GAG chr11 5293197 5293216 5293213 +
aagggctgttggaaattgtt

SEQ ID NO: 16555 - DNA, 20 bp, Artificial Sequence
  Synthetic oligonucleotide; AAG chr11 5293200 5293219 5293216 +
ggctgttggaaattgttgag

SEQ ID NO: 16556 - DNA, 20 bp, Artificial Sequence
  Synthetic oligonucleotide; TAG chr11 5293213 5293232 5293229 +
tgttgagaagtatattgatt

SEQ ID NO: 16557 - DNA, 20 bp, Artificial Sequence
  Synthetic oligonucleotide; CGG chr11 5293246 5293265 5293262 +
tgtttctgacatactgtgtc

SEQ ID NO: 16558 - DNA, 20 bp, Artificial Sequence
  Synthetic oligonucleotide; TGG chr11 5293252 5293271 5293268 +
tgacatactgtgtccggaat

SEQ ID NO: 16559 - DNA, 20 bp, Artificial Sequence
  Synthetic oligonucleotide; TGG chr11 5293255 5293274 5293271 +
catactgtgtccggaattgg

SEQ ID NO: 16560 - DNA, 20 bp, Artificial Sequence
  Synthetic oligonucleotide; GGG chr11 5293256 5293275 5293272 +
atactgtgtccggaattggt

SEQ ID NO: 16561 - DNA, 20 bp, Artificial Sequence
  Synthetic oligonucleotide; TGG chr11 5293263 5293282 5293279 +
gtccggaattggtgggttct

SEQ ID NO: 16562 - DNA, 20 bp, Artificial Sequence
  Synthetic oligonucleotide; AAG chr11 5293279 5293298 5293295 +
ttcttggtttcactgacttc

SEQ ID NO: 16563 - DNA, 20 bp, Artificial Sequence
  Synthetic oligonucleotide; AAG chr11 5293286 5293305 5293302 +
tttcactgacttcaagaatg

SEQ ID NO: 16564 - DNA, 20 bp, Artificial Sequence
  Synthetic oligonucleotide; CGG chr11 5293290 5293309 5293306 +
actgacttcaagaatgaagc

SEQ ID NO: 16565 - DNA, 20 bp, Artificial Sequence
  Synthetic oligonucleotide; GGG chr11 5293291 5293310 5293307 +
ctgacttcaagaatgaagcc

SEQ ID NO: 16566 - DNA, 20 bp, Artificial Sequence
  Synthetic oligonucleotide; GGG chr11 5293292 5293311 5293308 +
tgacttcaagaatgaagccg

SEQ ID NO: 16567 - DNA, 20 bp, Artificial Sequence
  Synthetic oligonucleotide; TGG chr11 5293302 5293321 5293318 +
aatgaagccggggaccctcg

SEQ ID NO: 16568 - DNA, 20 bp, Artificial Sequence
  Synthetic oligonucleotide; GAG chr11 5293306 5293325 5293322 +
aagccggggaccctcgtggt

SEQ ID NO: 16569 - DNA, 20 bp, Artificial Sequence
  Synthetic oligonucleotide; CAG chr11 5293314 5293333 5293330 +
gaccctcgtggtgagtgtta

SEQ ID NO: 16570 - DNA, 20 bp, Artificial Sequence
  Synthetic oligonucleotide; AAG chr11 5293323 5293342 5293339 +
ggtgagtgttacagttctta

SEQ ID NO: 16571 - DNA, 20 bp, Artificial Sequence
  Synthetic oligonucleotide; AGG chr11 5293324 5293343 5293340 +
gtgagtgttacagttcttaa

SEQ ID NO: 16572 - DNA, 20 bp, Artificial Sequence
  Synthetic oligonucleotide; TGG chr11 5293336 5293355 5293352 +
gttcttaaaggctgcgtgtg

SEQ ID NO: 16573 - DNA, 20 bp, Artificial Sequence
  Synthetic oligonucleotide; GAG chr11 5293338 5293357 5293354 +
tcttaaaggctgcgtgtgtg

SEQ ID NO: 16574 - DNA, 20 bp, Artificial Sequence
  Synthetic oligonucleotide; TGG chr11 5293359 5293378 5293375 +
agtttgttcgttctgatgtt

SEQ ID NO: 16575 - DNA, 20 bp, Artificial Sequence
  Synthetic oligonucleotide; CGG chr11 5293369 5293388 5293385 +
ttctgatgtttggatgtgtt

SEQ ID NO: 16576 - DNA, 20 bp, Artificial Sequence
  Synthetic oligonucleotide; GAG chr11 5293371 5293390 5293387 +
ctgatgtttggatgtgttcg

SEQ ID NO: 16577 - DNA, 20 bp, Artificial Sequence
  Synthetic oligonucleotide; TGG chr11 5293388 5293407 5293404 +
tcggagtttcttccttctga

SEQ ID NO: 16578 - DNA, 20 bp, Artificial Sequence
  Synthetic oligonucleotide; GGG chr11 5293389 5293408 5293405 +
cggagtttcttccttctgat

SEQ ID NO: 16579 - DNA, 20 bp, Artificial Sequence
  Synthetic oligonucleotide; TGG chr11 5293396 5293415 5293412 +
tcttccttctgatgggttcg

SEQ ID NO: 16580 - DNA, 20 bp, Artificial Sequence
  Synthetic oligonucleotide; TGG chr11 5293405 5293424 5293421 +
tgatgggttcgtggtctcgc

SEQ ID NO: 16581 - DNA, 20 bp, Artificial Sequence
  Synthetic oligonucleotide; CAG chr11 5293410 5293429 5293426 +
ggttcgtggtctcgctggct

SEQ ID NO: 16582 - DNA, 20 bp, Artificial Sequence
  Synthetic oligonucleotide; AGG chr11 5293411 5293430 5293427 +
gttcgtggtctcgctggctc

SEQ ID NO: 16583 - DNA, 20 bp, Artificial Sequence
  Synthetic oligonucleotide; GAG chr11 5293413 5293432 5293429 +
tcgtggtctcgctggctcag

SEQ ID NO: 16584 - DNA, 20 bp, Artificial Sequence
  Synthetic oligonucleotide; AAG chr11 5293418 5293437 5293434 +
gtctcgctggctcaggagtg

SEQ ID NO: 16585 - DNA, 20 bp, Artificial Sequence
  Synthetic oligonucleotide; CAG chr11 5293424 5293443 5293440 +
ctggctcaggagtgaagctg

SEQ ID NO: 16586 - DNA, 20 bp, Artificial Sequence
  Synthetic oligonucleotide; CAG chr11 5293434 5293453 5293450 +
agtgaagctgcagaccttca

SEQ ID NO: 16587 - DNA, 20 bp, Artificial Sequence
  Synthetic oligonucleotide; CAG chr11 5293446 5293465 5293462 +
gaccttcacagtgaacgttc

SEQ ID NO: 16588 - DNA, 20 bp, Artificial Sequence
  Synthetic oligonucleotide; AAG chr11 5293454 5293473 5293470 +
cagtgaacgttccagctctt

SEQ ID NO: 16589 - DNA, 20 bp, Artificial Sequence
  Synthetic oligonucleotide; AGG chr11 5293455 5293474 5293471 +
agtgaacgttccagctctta

SEQ ID NO: 16590 - DNA, 20 bp, Artificial Sequence
  Synthetic oligonucleotide; CGG chr11 5293458 5293477 5293474 +
gaacgttccagctcttaagg

SEQ ID NO: 16591 - DNA, 20 bp, Artificial Sequence
  Synthetic oligonucleotide; TGG chr11 5293467 5293486 5293483 +
agctcttaaggcggcgcctc

SEQ ID NO: 16592 - DNA, 20 bp, Artificial Sequence
  Synthetic oligonucleotide; GAG chr11 5293469 5293488 5293485 +
ctcttaaggcggcgcctctg

SEQ ID NO: 16593 - DNA, 20 bp, Artificial Sequence
  Synthetic oligonucleotide; CGG chr11 5293486 5293505 5293502 +
ctggagttgttcgttcctcc

SEQ ID NO: 16594 - DNA, 20 bp, Artificial Sequence
  Synthetic oligonucleotide; TGG chr11 5293489 5293508 5293505 +
gagttgttcgttcctcccgg

SEQ ID NO: 16595 - DNA, 20 bp, Artificial Sequence
  Synthetic oligonucleotide; GGG chr11 5293490 5293509 5293506 +
agttgttcgttcctcccggt

SEQ ID NO: 16596 - DNA, 20 bp, Artificial Sequence
  Synthetic oligonucleotide; TGG chr11 5293497 5293516 5293513 +
cgttcctcccggtgggttcg

SEQ ID NO: 16597 - DNA, 20 bp, Artificial Sequence
  Synthetic oligonucleotide; TGG chr11 5293506 5293525 5293522 +
cggtgggttcgtggtctcgc

SEQ ID NO: 16598 - DNA, 20 bp, Artificial Sequence
  Synthetic oligonucleotide; AAG chr11 5293513 5293532 5293529 +
ttcgtggtctcgctggcttc

SEQ ID NO: 16599 - DNA, 20 bp, Artificial Sequence
  Synthetic oligonucleotide; GAG chr11 5293515 5293534 5293531 +
cgtggtctcgctggcttcaa

SEQ ID NO: 16600 - DNA, 20 bp, Artificial Sequence
  Synthetic oligonucleotide; AAG chr11 5293520 5293539 5293536 +
tctcgctggcttcaagagtg

SEQ ID NO: 16601 - DNA, 20 bp, Artificial Sequence
  Synthetic oligonucleotide; CAG chr11 5293526 5293545 5293542 +
tggcttcaagagtgaagctg

SEQ ID NO: 16602 - DNA, 20 bp, Artificial Sequence
  Synthetic oligonucleotide; CGG chr11 5293536 5293555 5293552 +
agtgaagctgcagaccttcg

SEQ ID NO: 16603 - DNA, 20 bp, Artificial Sequence
  Synthetic oligonucleotide; GAG chr11 5293540 5293559 5293556 +
aagctgcagaccttcgcggt

SEQ ID NO: 16604 - DNA, 20 bp, Artificial Sequence
  Synthetic oligonucleotide; CAG chr11 5293548 5293567 5293564 +
gaccttcgcggtgagcgtta

SEQ ID NO: 16605 - DNA, 20 bp, Artificial Sequence
  Synthetic oligonucleotide; AAG chr11 5293557 5293576 5293573 +
ggtgagcgttacagctcata

SEQ ID NO: 16606 - DNA, 20 bp, Artificial Sequence
  Synthetic oligonucleotide; AGG chr11 5293558 5293577 5293574 +
gtgagcgttacagctcataa

SEQ ID NO: 16607 - DNA, 20 bp, Artificial Sequence
  Synthetic oligonucleotide; CAG chr11 5293561 5293580 5293577 +
agcgttacagctcataaagg

SEQ ID NO: 16608 - DNA, 20 bp, Artificial Sequence
  Synthetic oligonucleotide; TAG chr11 5293566 5293585 5293582 +
tacagctcataaaggcagtg

SEQ ID NO: 16609 - DNA, 20 bp, Artificial Sequence
  Synthetic oligonucleotide; CAG chr11 5293576 5293595 5293592 +
aaaggcagtgtagacccaaa

SEQ ID NO: 16610 - DNA, 20 bp, Artificial Sequence
  Synthetic oligonucleotide; GAG chr11 5293580 5293599 5293596 +
gcagtgtagacccaaacagt

SEQ ID NO: 16611 - DNA, 20 bp, Artificial Sequence
  Synthetic oligonucleotide; CAG chr11 5293583 5293602 5293599 +
gtgtagacccaaacagtgag

SEQ ID NO: 16612 - DNA, 20 bp, Artificial Sequence
  Synthetic oligonucleotide; CAG chr11 5293586 5293605 5293602 +
tagacccaaacagtgagcag

SEQ ID NO: 16613 - DNA, 20 bp, Artificial Sequence
  Synthetic oligonucleotide; AAG chr11 5293590 5293609 5293606 +
cccaaacagtgagcagcagc

SEQ ID NO: 16614 - DNA, 20 bp, Artificial Sequence
  Synthetic oligonucleotide; AAG chr11 5293603 5293622 5293619 +
cagcagcaagatttattgca

SEQ ID NO: 16615 - DNA, 20 bp, Artificial Sequence
  Synthetic oligonucleotide; GAG chr11 5293605 5293624 5293621 +
gcagcaagatttattgcaaa

SEQ ID NO: 16616 - DNA, 20 bp, Artificial Sequence
  Synthetic oligonucleotide; AAG chr11 5293611 5293630 5293627 +
agatttattgcaaagagcga

SEQ ID NO: 16617 - DNA, 20 bp, Artificial Sequence
  Synthetic oligonucleotide; AAG chr11 5293618 5293637 5293634 +
ttgcaaagagcgaaagaaca

SEQ ID NO: 16618 - DNA, 20 bp, Artificial Sequence
  Synthetic oligonucleotide; CAG chr11 5293627 5293646 5293643 +
gcgaaagaacaaagcttcca

SEQ ID NO: 16619 - DNA, 20 bp, Artificial Sequence
  Synthetic oligonucleotide; TGG chr11 5293632 5293651 5293648 +
agaacaaagcttccacagtg

SEQ ID NO: 16620 - DNA, 20 bp, Artificial Sequence
  Synthetic oligonucleotide; AAG chr11 5293635 5293654 5293651 +
acaaagcttccacagtgtgg

SEQ ID NO: 16621 - DNA, 20 bp, Artificial Sequence
  Synthetic oligonucleotide; AGG chr11 5293636 5293655 5293652 +
caaagcttccacagtgtgga

SEQ ID NO: 16622 - DNA, 20 bp, Artificial Sequence
  Synthetic oligonucleotide; GGG chr11 5293637 5293656 5293653 +
aaagcttccacagtgtggaa

SEQ ID NO: 16623 - DNA, 20 bp, Artificial Sequence
  Synthetic oligonucleotide; GGG chr11 5293638 5293657 5293654 +
aagcttccacagtgtggaag

SEQ ID NO: 16624 - DNA, 20 bp, Artificial Sequence
  Synthetic oligonucleotide; GAG chr11 5293645 5293664 5293661 +
cacagtgtggaaggggaccc

SEQ ID NO: 16625 - DNA, 20 bp, Artificial Sequence
  Synthetic oligonucleotide; CGG chr11 5293648 5293667 5293664 +
agtgtggaaggggacccgag

SEQ ID NO: 16626 - DNA, 20 bp, Artificial Sequence
  Synthetic oligonucleotide; GGG chr11 5293649 5293668 5293665 +
gtgtggaaggggacccgagc

SEQ ID NO: 16627 - DNA, 20 bp, Artificial Sequence
  Synthetic oligonucleotide; TGG chr11 5293662 5293681 5293678 +
cccgagcgggttgccactgc

SEQ ID NO: 16628 - DNA, 20 bp, Artificial Sequence
  Synthetic oligonucleotide; CGG chr11 5293667 5293686 5293683 +
gcgggttgccactgctggct

SEQ ID NO: 16629 - DNA, 20 bp, Artificial Sequence
  Synthetic oligonucleotide; GGG chr11 5293668 5293687 5293684 +
cgggttgccactgctggctc

SEQ ID NO: 16630 - DNA, 20 bp, Artificial Sequence
  Synthetic oligonucleotide; CAG chr11 5293671 5293690 5293687 +
gttgccactgctggctcggg

SEQ ID NO: 16631 - DNA, 20 bp, Artificial Sequence
  Synthetic oligonucleotide; TGG chr11 5293694 5293713 5293710 +
cctgcttttattctcttatc

SEQ ID NO: 16632 - DNA, 20 bp, Artificial Sequence
  Synthetic oligonucleotide; TGG chr11 5293718 5293737 5293734 +
cccacccacatcctgctgat

SEQ ID NO: 16633 - DNA, 20 bp, Artificial Sequence
  Synthetic oligonucleotide; TAG chr11 5293721 5293740 5293737 +
acccacatcctgctgattgg

SEQ ID NO: 16634 - DNA, 20 bp, Artificial Sequence
  Synthetic oligonucleotide; GAG chr11 5293723 5293742 5293739 +
ccacatcctgctgattggta

SEQ ID NO: 16635 - DNA, 20 bp, Artificial Sequence
  Synthetic oligonucleotide; CAG chr11 5293728 5293747 5293744 +
tcctgctgattggtagagcc

SEQ ID NO: 16636 - DNA, 20 bp, Artificial Sequence
  Synthetic oligonucleotide; TGG chr11 5293731 5293750 5293747 +
tgctgattggtagagcccag

SEQ ID NO: 16637 - DNA, 20 bp, Artificial Sequence
  Synthetic oligonucleotide; CAG chr11 5293744 5293763 5293760 +
agcccagtggtctgttttga

SEQ ID NO: 16638 - DNA, 20 bp, Artificial Sequence
  Synthetic oligonucleotide; AGG chr11 5293745 5293764 5293761 +
gcccagtggtctgttttgac

SEQ ID NO: 16639 - DNA, 20 bp, Artificial Sequence
  Synthetic oligonucleotide; GGG chr11 5293746 5293765 5293762 +
cccagtggtctgttttgaca

SEQ ID NO: 16640 - DNA, 20 bp, Artificial Sequence
  Synthetic oligonucleotide; TGG chr11 5293756 5293775 5293772 +
tgttttgacagggcactgat

SEQ ID NO: 16641 - DNA, 20 bp, Artificial Sequence
  Synthetic oligonucleotide; GAG chr11 5293775 5293794 5293791 +
ttggtgcatttacaatccat

SEQ ID NO: 16642 - DNA, 20 bp, Artificial Sequence
  Synthetic oligonucleotide; TAG chr11 5293779 5293798 5293795 +
tgcatttacaatccatgagc

SEQ ID NO: 16643 - DNA, 20 bp, Artificial Sequence
  Synthetic oligonucleotide; AAG chr11 5293787 5293806 5293803 +
caatccatgagctagacaca

SEQ ID NO: 16644 - DNA, 20 bp, Artificial Sequence
  Synthetic oligonucleotide; AGG chr11 5293788 5293807 5293804 +
aatccatgagctagacacaa

SEQ ID NO: 16645 - DNA, 20 bp, Artificial Sequence
  Synthetic oligonucleotide; CAG chr11 5293807 5293826 5293823 +
aaggttctccacgtccccac

SEQ ID NO: 16646 - DNA, 20 bp, Artificial Sequence
  Synthetic oligonucleotide; TAG chr11 5293812 5293831 5293828 +
tctccacgtccccaccagat

SEQ ID NO: 16647 - DNA, 20 bp, Artificial Sequence
  Synthetic oligonucleotide; TAG chr11 5293816 5293835 5293832 +
cacgtccccaccagattagc

SEQ ID NO: 16648 - DNA, 20 bp, Artificial Sequence
  Synthetic oligonucleotide; CAG chr11 5293822 5293841 5293838 +
cccaccagattagctagata

SEQ ID NO: 16649 - DNA, 20 bp, Artificial Sequence
  Synthetic oligonucleotide; GAG chr11 5293824 5293843 5293840 +
caccagattagctagataca

SEQ ID NO: 16650 - DNA, 20 bp, Artificial Sequence
  Synthetic oligonucleotide; AAG chr11 5293837 5293856 5293853 +
agatacagagtgtccacaca

SEQ ID NO: 16651 - DNA, 20 bp, Artificial Sequence
  Synthetic oligonucleotide; AGG chr11 5293838 5293857 5293854 +
gatacagagtgtccacacaa

SEQ ID NO: 16652 - DNA, 20 bp, Artificial Sequence
  Synthetic oligonucleotide; AAG chr11 5293847 5293866 5293863 +
tgtccacacaaaggttctcc

SEQ ID NO: 16653 - DNA, 20 bp, Artificial Sequence
  Synthetic oligonucleotide; CAG chr11 5293857 5293876 5293873 +
aaggttctccaagtccccac

SEQ ID NO: 16654 - DNA, 20 bp, Artificial Sequence
  Synthetic oligonucleotide; GAG chr11 5293859 5293878 5293875 +
ggttctccaagtccccacca

SEQ ID NO: 16655 - DNA, 20 bp, Artificial Sequence
  Synthetic oligonucleotide; TAG chr11 5293862 5293881 5293878 +
tctccaagtccccaccagag

SEQ ID NO: 16656 - DNA, 20 bp, Artificial Sequence
  Synthetic oligonucleotide; TAG chr11 5293866 5293885 5293882 +
caagtccccaccagagtagc

SEQ ID NO: 16657 - DNA, 20 bp, Artificial Sequence
  Synthetic oligonucleotide; CAG chr11 5293872 5293891 5293888 +
cccaccagagtagctagata

SEQ ID NO: 16658 - DNA, 20 bp, Artificial Sequence
  Synthetic oligonucleotide; GAG chr11 5293874 5293893 5293890 +
caccagagtagctagataca

SEQ ID NO: 16659 - DNA, 20 bp, Artificial Sequence
  Synthetic oligonucleotide; TGG chr11 5293884 5293903 5293900 +
gctagatacagagtgttgat

SEQ ID NO: 16660 - DNA, 20 bp, Artificial Sequence
  Synthetic oligonucleotide; GAG chr11 5293903 5293922 5293919 +
ttggtgcattcacaaaccct

SEQ ID NO: 16661 - DNA, 20 bp, Artificial Sequence
  Synthetic oligonucleotide; TAG chr11 5293907 5293926 5293923 +
tgcattcacaaaccctgagc

SEQ ID NO: 16662 - DNA, 20 bp, Artificial Sequence
  Synthetic oligonucleotide; CAG chr11 5293913 5293932 5293929 +
cacaaaccctgagctagaca

SEQ ID NO: 16663 - DNA, 20 bp, Artificial Sequence
  Synthetic oligonucleotide; AGG chr11 5293914 5293933 5293930 +
acaaaccctgagctagacac

SEQ ID NO: 16664 - DNA, 20 bp, Artificial Sequence
  Synthetic oligonucleotide; GGG chr11 5293915 5293934 5293931 +
caaaccctgagctagacaca

SEQ ID NO: 16665 - DNA, 20 bp, Artificial Sequence
  Synthetic oligonucleotide; TGG chr11 5293925 5293944 5293941 +
gctagacacagggtgctgat

SEQ ID NO: 16666 - DNA, 20 bp, Artificial Sequence
  Synthetic oligonucleotide; GAG chr11 5293944 5293963 5293960 +
ttggtgtgtttacaaacctt

SEQ ID NO: 16667 - DNA, 20 bp, Artificial Sequence
  Synthetic oligonucleotide; TAG chr11 5293948 5293967 5293964 +
tgtgtttacaaaccttgagc

SEQ ID NO: 16668 - DNA, 20 bp, Artificial Sequence
  Synthetic oligonucleotide; CAG chr11 5293954 5293973 5293970 +
tacaaaccttgagctagata

SEQ ID NO: 16669 - DNA, 20 bp, Artificial Sequence
  Synthetic oligonucleotide; GAG chr11 5293963 5293982 5293979 +
tgagctagatacagactgcc

SEQ ID NO: 16670 - DNA, 20 bp, Artificial Sequence
  Synthetic oligonucleotide; TGG chr11 5293966 5293985 5293982 +
gctagatacagactgccgag

SEQ ID NO: 16671 - DNA, 20 bp, Artificial Sequence
  Synthetic oligonucleotide; GAG chr11 5293985 5294004 5294001 +
gtggtgtatttacaatccct

SEQ ID NO: 16672 - DNA, 20 bp, Artificial Sequence
  Synthetic oligonucleotide; TAG chr11 5293989 5294008 5294005 +
tgtatttacaatccctgagc

SEQ ID NO: 16673 - DNA, 20 bp, Artificial Sequence
  Synthetic oligonucleotide; AAG chr11 5293997 5294016 5294013 +
caatccctgagctagacata

SEQ ID NO: 16674 - DNA, 20 bp, Artificial Sequence
  Synthetic oligonucleotide; AGG chr11 5293998 5294017 5294014 +
aatccctgagctagacataa

SEQ ID NO: 16675 - DNA, 20 bp, Artificial Sequence
  Synthetic oligonucleotide; CAG chr11 5294017 5294036 5294033 +
aaggttctccacgtccccac

SEQ ID NO: 16676 - DNA, 20 bp, Artificial Sequence
  Synthetic oligonucleotide; GAG chr11 5294019 5294038 5294035 +
ggttctccacgtccccacca

SEQ ID NO: 16677 - DNA, 20 bp, Artificial Sequence
  Synthetic oligonucleotide; TAG chr11 5294022 5294041 5294038 +
tctccacgtccccaccagag

SEQ ID NO: 16678 - DNA, 20 bp, Artificial Sequence
  Synthetic oligonucleotide; TAG chr11 5294026 5294045 5294042 +
cacgtccccaccagagtagc

SEQ ID NO: 16679 - DNA, 20 bp, Artificial Sequence
  Synthetic oligonucleotide; CAG chr11 5294032 5294051 5294048 +
cccaccagagtagctagata

SEQ ID NO: 16680 - DNA, 20 bp, Artificial Sequence
  Synthetic oligonucleotide; GAG chr11 5294034 5294053 5294050 +
caccagagtagctagataca

SEQ ID NO: 16681 - DNA, 20 bp, Artificial Sequence
  Synthetic oligonucleotide; TGG chr11 5294044 5294063 5294060 +
gctagatacagagtgttgat

SEQ ID NO: 16682 - DNA, 20 bp, Artificial Sequence
  Synthetic oligonucleotide; GAG chr11 5294063 5294082 5294079 +
ttggtgcattcacaaaccct

SEQ ID NO: 16683 - DNA, 20 bp, Artificial Sequence
  Synthetic oligonucleotide; TAG chr11 5294067 5294086 5294083 +
tgcattcacaaaccctgagc

SEQ ID NO: 16684 - DNA, 20 bp, Artificial Sequence
  Synthetic oligonucleotide; CAG chr11 5294073 5294092 5294089 +
cacaaaccctgagctagaca

SEQ ID NO: 16685 - DNA, 20 bp, Artificial Sequence
  Synthetic oligonucleotide; AGG chr11 5294074 5294093 5294090 +
acaaaccctgagctagacac

SEQ ID NO: 16686 - DNA, 20 bp, Artificial Sequence
  Synthetic oligonucleotide; GGG chr11 5294075 5294094 5294091 +
caaaccctgagctagacaca

SEQ ID NO: 16687 - DNA, 20 bp, Artificial Sequence
  Synthetic oligonucleotide; TGG chr11 5294085 5294104 5294101 +
gctagacacagggtgctgat

SEQ ID NO: 16688 - DNA, 20 bp, Artificial Sequence
  Synthetic oligonucleotide; GAG chr11 5294104 5294123 5294120 +
ttggtgtgtttacaaacctt

SEQ ID NO: 16689 - DNA, 20 bp, Artificial Sequence
  Synthetic oligonucleotide; TAG chr11 5294108 5294127 5294124 +
tgtgtttacaaaccttgagc

SEQ ID NO: 16690 - DNA, 20 bp, Artificial Sequence
  Synthetic oligonucleotide; CAG chr11 5294114 5294133 5294130 +
tacaaaccttgagctagata

SEQ ID NO: 16691 - DNA, 20 bp, Artificial Sequence
  Synthetic oligonucleotide; TGG chr11 5294126 5294145 5294142 +
gctagatacagactgccgat

SEQ ID NO: 16692 - DNA, 20 bp, Artificial Sequence
  Synthetic oligonucleotide; GAG chr11 5294145 5294164 5294161 +
ttggtgtatttacaatccct

SEQ ID NO: 16693 - DNA, 20 bp, Artificial Sequence
  Synthetic oligonucleotide; TAG chr11 5294149 5294168 5294165 +
tgtatttacaatccctgagc

SEQ ID NO: 16694 - DNA, 20 bp, Artificial Sequence
  Synthetic oligonucleotide; AAG chr11 5294157 5294176 5294173 +
caatccctgagctagacata

SEQ ID NO: 16695 - DNA, 20 bp, Artificial Sequence
  Synthetic oligonucleotide; AGG chr11 5294158 5294177 5294174 +
aatccctgagctagacataa

SEQ ID NO: 16696 - DNA, 20 bp, Artificial Sequence
  Synthetic oligonucleotide; AAG chr11 5294167 5294186 5294183 +
gctagacataaaggttctcc

SEQ ID NO: 16697 - DNA, 20 bp, Artificial Sequence
  Synthetic oligonucleotide; AGG chr11 5294168 5294187 5294184 +
ctagacataaaggttctcca

SEQ ID NO: 16698 - DNA, 20 bp, Artificial Sequence
  Synthetic oligonucleotide; CAG chr11 5294177 5294196 5294193 +
aaggttctccaaggccccac

SEQ ID NO: 16699 - DNA, 20 bp, Artificial Sequence
  Synthetic oligonucleotide; GAG chr11 5294179 5294198 5294195 +
ggttctccaaggccccacca

SEQ ID NO: 16700 - DNA, 20 bp, Artificial Sequence
  Synthetic oligonucleotide; TAG chr11 5294182 5294201 5294198 +
tctccaaggccccaccagag

SEQ ID NO: 16701 - DNA, 20 bp, Artificial Sequence
  Synthetic oligonucleotide; TAG chr11 5294186 5294205 5294202 +
caaggccccaccagagtagc

SEQ ID NO: 16702 - DNA, 20 bp, Artificial Sequence
  Synthetic oligonucleotide; TAG chr11 5294190 5294209 5294206 +
gccccaccagagtagctaga

SEQ ID NO: 16703 - DNA, 20 bp, Artificial Sequence
  Synthetic oligonucleotide; GAG chr11 5294192 5294211 5294208 +
cccaccagagtagctagata

SEQ ID NO: 16704 - DNA, 20 bp, Artificial Sequence
  Synthetic oligonucleotide; TGG chr11 5294202 5294221 5294218 +
tagctagatagagtgttgat

SEQ ID NO: 16705 - DNA, 20 bp, Artificial Sequence
  Synthetic oligonucleotide; GAG chr11 5294221 5294240 5294237 +
ttggtgcattcacaaaccct

SEQ ID NO: 16706 - DNA, 20 bp, Artificial Sequence
  Synthetic oligonucleotide; TAG chr11 5294225 5294244 5294241 +
tgcattcacaaaccctgagc

SEQ ID NO: 16707 - DNA, 20 bp, Artificial Sequence
  Synthetic oligonucleotide; CAG chr11 5294231 5294250 5294247 +
cacaaaccctgagctagaca

SEQ ID NO: 16708 - DNA, 20 bp, Artificial Sequence
  Synthetic oligonucleotide; AGG chr11 5294232 5294251 5294248 +
acaaaccctgagctagacac

SEQ ID NO: 16709 - DNA, 20 bp, Artificial Sequence
  Synthetic oligonucleotide; GGG chr11 5294233 5294252 5294249 +
caaaccctgagctagacaca

SEQ ID NO: 16710 - DNA, 20 bp, Artificial Sequence
  Synthetic oligonucleotide; TGG chr11 5294243 5294262 5294259 +
gctagacacagggtgctgat

SEQ ID NO: 16711 - DNA, 20 bp, Artificial Sequence
  Synthetic oligonucleotide; GAG chr11 5294262 5294281 5294278 +
ttggtgtgtttacaaacctt

SEQ ID NO: 16712 - DNA, 20 bp, Artificial Sequence
  Synthetic oligonucleotide; TAG chr11 5294266 5294285 5294282 +
tgtgtttacaaaccttgagc

SEQ ID NO: 16713 - DNA, 20 bp, Artificial Sequence
  Synthetic oligonucleotide; CAG chr11 5294272 5294291 5294288 +
tacaaaccttgagctagata

SEQ ID NO: 16714 - DNA, 20 bp, Artificial Sequence
  Synthetic oligonucleotide; GAG chr11 5294274 5294293 5294290 +
caaaccttgagctagataca

SEQ ID NO: 16715 - DNA, 20 bp, Artificial Sequence
  Synthetic oligonucleotide; TGG chr11 5294284 5294303 5294300 +
gctagatacagagtgccaat

SEQ ID NO: 16716 - DNA, 20 bp, Artificial Sequence
  Synthetic oligonucleotide; TAG chr11 5294307 5294326 5294323 +
tgtatttacaatcccttatc

SEQ ID NO: 16717 - DNA, 20 bp, Artificial Sequence
  Synthetic oligonucleotide; AAG chr11 5294314 5294333 5294330 +
acaatcccttatctagacat

SEQ ID NO: 16718 - DNA, 20 bp, Artificial Sequence
  Synthetic oligonucleotide; AGG chr11 5294315 5294334 5294331 +
caatcccttatctagacata

SEQ ID NO: 16719 - DNA, 20 bp, Artificial Sequence
  Synthetic oligonucleotide; GGG chr11 5294316 5294335 5294332 +
aatcccttatctagacataa

SEQ ID NO: 16720 - DNA, 20 bp, Artificial Sequence
  Synthetic oligonucleotide; CAG chr11 5294332 5294351 5294348 +
ataagggttcttcgcatccc

SEQ ID NO: 16721 - DNA, 20 bp, Artificial Sequence
  Synthetic oligonucleotide; CAG chr11 5294341 5294360 5294357 +
cttcgcatccccagcaaact

SEQ ID NO: 16722 - DNA, 20 bp, Artificial Sequence
  Synthetic oligonucleotide; AGG chr11 5294342 5294361 5294358 +
ttcgcatccccagcaaactc

SEQ ID NO: 16723 - DNA, 20 bp, Artificial Sequence
  Synthetic oligonucleotide; GAG chr11 5294344 5294363 5294360 +
cgcatccccagcaaactcag

SEQ ID NO: 16724 - DNA, 20 bp, Artificial Sequence
  Synthetic oligonucleotide; TAG chr11 5294349 5294368 5294365 +
ccccagcaaactcaggagcc

SEQ ID NO: 16725 - DNA, 20 bp, Artificial Sequence
  Synthetic oligonucleotide; CGG chr11 5294353 5294372 5294369 +
agcaaactcaggagcctagc

SEQ ID NO: 16726 - DNA, 20 bp, Artificial Sequence
  Synthetic oligonucleotide; CAG chr11 5294363 5294382 5294379 +
ggagcctagccggcttcacc

SEQ ID NO: 16727 - DNA, 20 bp, Artificial Sequence
  Synthetic oligonucleotide; TGG chr11 5294366 5294385 5294382 +
gcctagccggcttcacccag

SEQ ID NO: 16728 - DNA, 20 bp, Artificial Sequence
  Synthetic oligonucleotide; TGG chr11 5294379 5294398 5294395 +
cacccagtggatcccgcacc

SEQ ID NO: 16729 - DNA, 20 bp, Artificial Sequence
  Synthetic oligonucleotide; GGG chr11 5294380 5294399 5294396 +
acccagtggatcccgcacct

SEQ ID NO: 16730 - DNA, 20 bp, Artificial Sequence
  Synthetic oligonucleotide; CAG chr11 5294386 5294405 5294402 +
tggatcccgcacctgggctg

SEQ ID NO: 16731 - DNA, 20 bp, Artificial Sequence
  Synthetic oligonucleotide; AGG chr11 5294387 5294406 5294403 +
ggatcccgcacctgggctgc

SEQ ID NO: 16732 - DNA, 20 bp, Artificial Sequence
  Synthetic oligonucleotide; GGG chr11 5294388 5294407 5294404 +
gatcccgcacctgggctgca

SEQ ID NO: 16733 - DNA, 20 bp, Artificial Sequence
  Synthetic oligonucleotide; GGG chr11 5294389 5294408 5294405 +
atcccgcacctgggctgcag

SEQ ID NO: 16734 - DNA, 20 bp, Artificial Sequence
  Synthetic oligonucleotide; GGG chr11 5294390 5294409 5294406 +
tcccgcacctgggctgcagg

SEQ ID NO: 16735 - DNA, 20 bp, Artificial Sequence
  Synthetic oligonucleotide; GAG chr11 5294392 5294411 5294408 +
ccgcacctgggctgcagggg

SEQ ID NO: 16736 - DNA, 20 bp, Artificial Sequence
  Synthetic oligonucleotide; CAG chr11 5294403 5294422 5294419 +
ctgcagggggagctgcctgc

SEQ ID NO: 16737 - DNA, 20 bp, Artificial Sequence
  Synthetic oligonucleotide; CAG chr11 5294431 5294450 5294447 +
tgccgtgcgcccgcactctt

SEQ ID NO: 16738 - DNA, 20 bp, Artificial Sequence
  Synthetic oligonucleotide; TGG chr11 5294438 5294457 5294454 +
cgcccgcactcttcagccct

SEQ ID NO: 16739 - DNA, 20 bp, Artificial Sequence
  Synthetic oligonucleotide; GGG chr11 5294439 5294458 5294455 +
gcccgcactcttcagccctt

SEQ ID NO: 16740 - DNA, 20 bp, Artificial Sequence
  Synthetic oligonucleotide; TGG chr11 5294442 5294461 5294458 +
cgcactcttcagcccttggg

SEQ ID NO: 16741 - DNA, 20 bp, Artificial Sequence
  Synthetic oligonucleotide; TGG chr11 5294449 5294468 5294465 +
ttcagcccttgggtggtcga

SEQ ID NO: 16742 - DNA, 20 bp, Artificial Sequence
  Synthetic oligonucleotide; GGG chr11 5294450 5294469 5294466 +
tcagcccttgggtggtcgat

SEQ ID NO: 16743 - DNA, 20 bp, Artificial Sequence
  Synthetic oligonucleotide; TGG chr11 5294455 5294474 5294471 +
ccttgggtggtcgatgggac

SEQ ID NO: 16744 - DNA, 20 bp, Artificial Sequence
  Synthetic oligonucleotide; GGG chr11 5294456 5294475 5294472 +
cttgggtggtcgatgggact

SEQ ID NO: 16745 - DNA, 20 bp, Artificial Sequence
  Synthetic oligonucleotide; TGG chr11 5294464 5294483 5294480 +
gtcgatgggactgggtgccc

SEQ ID NO: 16746 - DNA, 20 bp, Artificial Sequence
  Synthetic oligonucleotide; GAG chr11 5294466 5294485 5294482 +
cgatgggactgggtgccctg

SEQ ID NO: 16747 - DNA, 20 bp, Artificial Sequence
  Synthetic oligonucleotide; CAG chr11 5294469 5294488 5294485 +
tgggactgggtgccctggag

SEQ ID NO: 16748 - DNA, 20 bp, Artificial Sequence
  Synthetic oligonucleotide; AGG chr11 5294470 5294489 5294486 +
gggactgggtgccctggagc

SEQ ID NO: 16749 - DNA, 20 bp, Artificial Sequence
  Synthetic oligonucleotide; GGG chr11 5294471 5294490 5294487 +
ggactgggtgccctggagca

SEQ ID NO: 16750 - DNA, 20 bp, Artificial Sequence
  Synthetic oligonucleotide; GGG chr11 5294472 5294491 5294488 +
gactgggtgccctggagcag

SEQ ID NO: 16751 - DNA, 20 bp, Artificial Sequence
  Synthetic oligonucleotide; GGG chr11 5294473 5294492 5294489 +
actgggtgccctggagcagg

SEQ ID NO: 16752 - DNA, 20 bp, Artificial Sequence
  Synthetic oligonucleotide; CGG chr11 5294476 5294495 5294492 +
gggtgccctggagcaggggg

SEQ ID NO: 16753 - DNA, 20 bp, Artificial Sequence
  Synthetic oligonucleotide; CGG chr11 5294486 5294505 5294502 +
gagcagggggcggcgctcgt

SEQ ID NO: 16754 - DNA, 20 bp, Artificial Sequence
  Synthetic oligonucleotide; GAG chr11 5294490 5294509 5294506 +
agggggcggcgctcgtcggc

SEQ ID NO: 16755 - DNA, 20 bp, Artificial Sequence
  Synthetic oligonucleotide; AGG chr11 5294491 5294510 5294507 +
gggggcggcgctcgtcggcg

SEQ ID NO: 16756 - DNA, 20 bp, Artificial Sequence
  Synthetic oligonucleotide; CGG chr11 5294496 5294515 5294512 +
cggcgctcgtcggcgaggct

SEQ ID NO: 16757 - DNA, 20 bp, Artificial Sequence
  Synthetic oligonucleotide; GGG chr11 5294497 5294516 5294513 +
ggcgctcgtcggcgaggctc

SEQ ID NO: 16758 - DNA, 20 bp, Artificial Sequence
  Synthetic oligonucleotide; CAG chr11 5294505 5294524 5294521 +
tcggcgaggctcgggccgca

SEQ ID NO: 16759 - DNA, 20 bp, Artificial Sequence
  Synthetic oligonucleotide; AGG chr11 5294506 5294525 5294522 +
cggcgaggctcgggccgcac

SEQ ID NO: 16760 - DNA, 20 bp, Artificial Sequence
  Synthetic oligonucleotide; GAG chr11 5294508 5294527 5294524 +
gcgaggctcgggccgcacag

SEQ ID NO: 16761 - DNA, 20 bp, Artificial Sequence
  Synthetic oligonucleotide; AAG chr11 5294517 5294536 5294533 +
gggccgcacaggagcccatg

SEQ ID NO: 16762 - DNA, 20 bp, Artificial Sequence
  Synthetic oligonucleotide; AGG chr11 5294518 5294537 5294534 +
ggccgcacaggagcccatga

SEQ ID NO: 16763 - DNA, 20 bp, Artificial Sequence
  Synthetic oligonucleotide; TGG chr11 5294521 5294540 5294537 +
cgcacaggagcccatgaagg

SEQ ID NO: 16764 - DNA, 20 bp, Artificial Sequence
  Synthetic oligonucleotide; GGG chr11 5294522 5294541 5294538 +
gcacaggagcccatgaaggt

SEQ ID NO: 16765 - DNA, 20 bp, Artificial Sequence
  Synthetic oligonucleotide; GGG chr11 5294523 5294542 5294539 +
cacaggagcccatgaaggtg

SEQ ID NO: 16766 - DNA, 20 bp, Artificial Sequence
  Synthetic oligonucleotide; GAG chr11 5294525 5294544 5294541 +
caggagcccatgaaggtggg

SEQ ID NO: 16767 - DNA, 20 bp, Artificial Sequence
  Synthetic oligonucleotide; AGG chr11 5294526 5294545 5294542 +
aggagcccatgaaggtgggg

SEQ ID NO: 16768 - DNA, 20 bp, Artificial Sequence
  Synthetic oligonucleotide; CAG chr11 5294531 5294550 5294547 +
cccatgaaggtggggaggct

SEQ ID NO: 16769 - DNA, 20 bp, Artificial Sequence
  Synthetic oligonucleotide; AGG chr11 5294532 5294551 5294548 +
ccatgaaggtggggaggctc

SEQ ID NO: 16770 - DNA, 20 bp, Artificial Sequence
  Synthetic oligonucleotide; TGG chr11 5294537 5294556 5294553 +
aaggtggggaggctcaggca

SEQ ID NO: 16771 - DNA, 20 bp, Artificial Sequence
  Synthetic oligonucleotide; CAG chr11 5294547 5294566 5294563 +
ggctcaggcatggcgcgctg

SEQ ID NO: 16772 - DNA, 20 bp, Artificial Sequence
  Synthetic oligonucleotide; AGG chr11 5294548 5294567 5294564 +
gctcaggcatggcgcgctgc

SEQ ID NO: 16773 - DNA, 20 bp, Artificial Sequence
  Synthetic oligonucleotide; GAG chr11 5294555 5294574 5294571 +
catggcgcgctgcaggtccc

SEQ ID NO: 16774 - DNA, 20 bp, Artificial Sequence
  Synthetic oligonucleotide; CAG chr11 5294568 5294587 5294584 +
aggtcccgagccctgccccg

SEQ ID NO: 16775 - DNA, 20 bp, Artificial Sequence
  Synthetic oligonucleotide; AGG chr11 5294569 5294588 5294585 +
ggtcccgagccctgccccgc

SEQ ID NO: 16776 - DNA, 20 bp, Artificial Sequence
  Synthetic oligonucleotide; AAG chr11 5294572 5294591 5294588 +
cccgagccctgccccgcagg

SEQ ID NO: 16777 - DNA, 20 bp, Artificial Sequence
  Synthetic oligonucleotide; AGG chr11 5294573 5294592 5294589 +
ccgagccctgccccgcagga

SEQ ID NO: 16778 - DNA, 20 bp, Artificial Sequence
  Synthetic oligonucleotide; CAG chr11 5294576 5294595 5294592 +
agccctgccccgcaggaagg

SEQ ID NO: 16779 - DNA, 20 bp, Artificial Sequence
  Synthetic oligonucleotide; AAG chr11 5294581 5294600 5294597 +
tgccccgcaggaaggcagct

SEQ ID NO: 16780 - DNA, 20 bp, Artificial Sequence
  Synthetic oligonucleotide; AGG chr11 5294582 5294601 5294598 +
gccccgcaggaaggcagcta

SEQ ID NO: 16781 - DNA, 20 bp, Artificial Sequence
  Synthetic oligonucleotide; CGG chr11 5294587 5294606 5294603 +
gcaggaaggcagctaaggcc

SEQ ID NO: 16782 - DNA, 20 bp, Artificial Sequence
  Synthetic oligonucleotide; GAG chr11 5294591 5294610 5294607 +
gaaggcagctaaggcccggc

SEQ ID NO: 16783 - DNA, 20 bp, Artificial Sequence
  Synthetic oligonucleotide; AGG chr11 5294592 5294611 5294608 +
aaggcagctaaggcccggcg

SEQ ID NO: 16784 - DNA, 20 bp, Artificial Sequence
  Synthetic oligonucleotide; GAG chr11 5294599 5294618 5294615 +
ctaaggcccggcgaggaatt

SEQ ID NO: 16785 - DNA, 20 bp, Artificial Sequence
  Synthetic oligonucleotide; CAG chr11 5294604 5294623 5294620 +
gcccggcgaggaattgagca

SEQ ID NO: 16786 - DNA, 20 bp, Artificial Sequence
  Synthetic oligonucleotide; CAG chr11 5294607 5294626 5294623 +
cggcgaggaattgagcacag

SEQ ID NO: 16787 - DNA, 20 bp, Artificial Sequence
  Synthetic oligonucleotide; TGG chr11 5294614 5294633 5294630 +
gaattgagcacagcagctgc

SEQ ID NO: 16788 - DNA, 20 bp, Artificial Sequence
  Synthetic oligonucleotide; CAG chr11 5294619 5294638 5294635 +
gagcacagcagctgctggcc

SEQ ID NO: 16789 - DNA, 20 bp, Artificial Sequence
  Synthetic oligonucleotide; AGG chr11 5294620 5294639 5294636 +
agcacagcagctgctggccc

SEQ ID NO: 16790 - DNA, 20 bp, Artificial Sequence
  Synthetic oligonucleotide; AAG chr11 5294627 5294646 5294643 +
cagctgctggcccaggtgct

SEQ ID NO: 16791 - DNA, 20 bp, Artificial Sequence
  Synthetic oligonucleotide; CGG chr11 5294644 5294663 5294660 +
gctaagcccctcactgcccg

SEQ ID NO: 16792 - DNA, 20 bp, Artificial Sequence
  Synthetic oligonucleotide; CGG chr11 5294648 5294667 5294664 +
agcccctcactgcccgcggc

SEQ ID NO: 16793 - DNA, 20 bp, Artificial Sequence
  Synthetic oligonucleotide; TGG chr11 5294651 5294670 5294667 +
ccctcactgcccgcggccgg

SEQ ID NO: 16794 - DNA, 20 bp, Artificial Sequence
  Synthetic oligonucleotide; GGG chr11 5294652 5294671 5294668 +
cctcactgcccgcggccggt

SEQ ID NO: 16795 - DNA, 20 bp, Artificial Sequence
  Synthetic oligonucleotide; GGG chr11 5294653 5294672 5294669 +
ctcactgcccgcggccggtg

SEQ ID NO: 16796 - DNA, 20 bp, Artificial Sequence
  Synthetic oligonucleotide; CGG chr11 5294657 5294676 5294673 +
ctgcccgcggccggtggggc

SEQ ID NO: 16797 - DNA, 20 bp, Artificial Sequence
  Synthetic oligonucleotide; TGG chr11 5294661 5294680 5294677 +
ccgcggccggtggggccggc

SEQ ID NO: 16798 - DNA, 20 bp, Artificial Sequence
  Synthetic oligonucleotide; CGG chr11 5294664 5294683 5294680 +
cggccggtggggccggctgg

SEQ ID NO: 16799 - DNA, 20 bp, Artificial Sequence
  Synthetic oligonucleotide; GAG chr11 5294671 5294690 5294687 +
tggggccggctggcggctcc

SEQ ID NO: 16800 - DNA, 20 bp, Artificial Sequence
  Synthetic oligonucleotide; CGG chr11 5294676 5294695 5294692 +
ccggctggcggctccgagtg

SEQ ID NO: 16801 - DNA, 20 bp, Artificial Sequence
  Synthetic oligonucleotide; GGG chr11 5294677 5294696 5294693 +
cggctggcggctccgagtgc

SEQ ID NO: 16802 - DNA, 20 bp, Artificial Sequence
  Synthetic oligonucleotide; GGG chr11 5294678 5294697 5294694 +
ggctggcggctccgagtgcg

SEQ ID NO: 16803 - DNA, 20 bp, Artificial Sequence
  Synthetic oligonucleotide; CGG chr11 5294685 5294704 5294701 +
ggctccgagtgcggggtcct

SEQ ID NO: 16804 - DNA, 20 bp, Artificial Sequence
  Synthetic oligonucleotide; GAG chr11 5294687 5294706 5294703 +
ctccgagtgcggggtcctcg

SEQ ID NO: 16805 - DNA, 20 bp, Artificial Sequence
  Synthetic oligonucleotide; CGG chr11 5294702 5294721 5294718 +
cctcggagcccatgcccacc

SEQ ID NO: 16806 - DNA, 20 bp, Artificial Sequence
  Synthetic oligonucleotide; AAG chr11 5294714 5294733 5294730 +
tgcccacccggaactccctc

SEQ ID NO: 16807 - DNA, 20 bp, Artificial Sequence
  Synthetic oligonucleotide; CGG chr11 5294719 5294738 5294735 +
acccggaactccctcaagca

SEQ ID NO: 16808 - DNA, 20 bp, Artificial Sequence
  Synthetic oligonucleotide; CAG chr11 5294726 5294745 5294742 +
actccctcaagcacggcgca

SEQ ID NO: 16809 - DNA, 20 bp, Artificial Sequence
  Synthetic oligonucleotide; CGG chr11 5294731 5294750 5294747 +
ctcaagcacggcgcacagcc

SEQ ID NO: 16810 - DNA, 20 bp, Artificial Sequence
  Synthetic oligonucleotide; TGG chr11 5294765 5294784 5294781 +
gtctgtccctccacacctcc

SEQ ID NO: 16811 - DNA, 20 bp, Artificial Sequence
  Synthetic oligonucleotide; AAG chr11 5294769 5294788 5294785 +
gtccctccacacctcctggc

SEQ ID NO: 16812 - DNA, 20 bp, Artificial Sequence
  Synthetic oligonucleotide; GAG chr11 5294774 5294793 5294790 +
tccacacctcctggcaagct

SEQ ID NO: 16813 - DNA, 20 bp, Artificial Sequence
  Synthetic oligonucleotide; AGG chr11 5294775 5294794 5294791 +
ccacacctcctggcaagctg

SEQ ID NO: 16814 - DNA, 20 bp, Artificial Sequence
  Synthetic oligonucleotide; GGG chr11 5294776 5294795 5294792 +
cacacctcctggcaagctga

SEQ ID NO: 16815 - DNA, 20 bp, Artificial Sequence
  Synthetic oligonucleotide; GAG chr11 5294778 5294797 5294794 +
cacctcctggcaagctgagg

SEQ ID NO: 16816 - DNA, 20 bp, Artificial Sequence
  Synthetic oligonucleotide; CGG chr11 5294782 5294801 5294798 +
tcctggcaagctgagggagc

SEQ ID NO: 16817 - DNA, 20 bp, Artificial Sequence
  Synthetic oligonucleotide; TGG chr11 5294788 5294807 5294804 +
caagctgagggagccggctc

SEQ ID NO: 16818 - DNA, 20 bp, Artificial Sequence
  Synthetic oligonucleotide; TGG chr11 5294794 5294813 5294810 +
gagggagccggctctggcct

SEQ ID NO: 16819 - DNA, 20 bp, Artificial Sequence
  Synthetic oligonucleotide; CAG chr11 5294798 5294817 5294814 +
gagccggctctggccttggc

SEQ ID NO: 16820 - DNA, 20 bp, Artificial Sequence
  Synthetic oligonucleotide; CAG chr11 5294803 5294822 5294819 +
ggctctggccttggccagcc

SEQ ID NO: 16821 - DNA, 20 bp, Artificial Sequence
  Synthetic oligonucleotide; AAG chr11 5294808 5294827 5294824 +
tggccttggccagcccagaa

SEQ ID NO: 16822 - DNA, 20 bp, Artificial Sequence
  Synthetic oligonucleotide; AGG chr11 5294809 5294828 5294825 +
ggccttggccagcccagaaa

SEQ ID NO: 16823 - DNA, 20 bp, Artificial Sequence
  Synthetic oligonucleotide; GGG chr11 5294810 5294829 5294826 +
gccttggccagcccagaaaa

SEQ ID NO: 16824 - DNA, 20 bp, Artificial Sequence
  Synthetic oligonucleotide; CAG chr11 5294819 5294838 5294835 +
agcccagaaaagggctccca

SEQ ID NO: 16825 - DNA, 20 bp, Artificial Sequence
  Synthetic oligonucleotide; CAG chr11 5294824 5294843 5294840 +
agaaaagggctcccacagtg

SEQ ID NO: 16826 - DNA, 20 bp, Artificial Sequence
  Synthetic oligonucleotide; CGG chr11 5294827 5294846 5294843 +
aaagggctcccacagtgcag

SEQ ID NO: 16827 - DNA, 20 bp, Artificial Sequence
  Synthetic oligonucleotide; CGG chr11 5294831 5294850 5294847 +
ggctcccacagtgcagcggc

SEQ ID NO: 16828 - DNA, 20 bp, Artificial Sequence
  Synthetic oligonucleotide; AAG chr11 5294837 5294856 5294853 +
cacagtgcagcggccggctg

SEQ ID NO: 16829 - DNA, 20 bp, Artificial Sequence
  Synthetic oligonucleotide; AGG chr11 5294838 5294857 5294854 +
acagtgcagcggccggctga

SEQ ID NO: 16830 - DNA, 20 bp, Artificial Sequence
  Synthetic oligonucleotide; GGG chr11 5294839 5294858 5294855 +
cagtgcagcggccggctgaa

SEQ ID NO: 16831 - DNA, 20 bp, Artificial Sequence
  Synthetic oligonucleotide; AAG chr11 5294848 5294867 5294864 +
ggccggctgaagggctcctc

SEQ ID NO: 16832 - DNA, 20 bp, Artificial Sequence
  Synthetic oligonucleotide; TGG chr11 5294862 5294881 5294878 +
ctcctcaagtgccaccaatg

SEQ ID NO: 16833 - DNA, 20 bp, Artificial Sequence
  Synthetic oligonucleotide; GGG chr11 5294863 5294882 5294879 +
tcctcaagtgccaccaatgt

SEQ ID NO: 16834 - DNA, 20 bp, Artificial Sequence
  Synthetic oligonucleotide; GAG chr11 5294865 5294884 5294881 +
ctcaagtgccaccaatgtgg

SEQ ID NO: 16835 - DNA, 20 bp, Artificial Sequence
  Synthetic oligonucleotide; CAG chr11 5294870 5294889 5294886 +
gtgccaccaatgtgggagcc

SEQ ID NO: 16836 - DNA, 20 bp, Artificial Sequence
  Synthetic oligonucleotide; AGG chr11 5294871 5294890 5294887 +
tgccaccaatgtgggagccc

SEQ ID NO: 16837 - DNA, 20 bp, Artificial Sequence
  Synthetic oligonucleotide; CAG chr11 5294874 5294893 5294890 +
caccaatgtgggagcccagg

SEQ ID NO: 16838 - DNA, 20 bp, Artificial Sequence
  Synthetic oligonucleotide; GAG chr11 5294876 5294895 5294892 +
ccaatgtgggagcccaggca

SEQ ID NO: 16839 - DNA, 20 bp, Artificial Sequence
  Synthetic oligonucleotide; AGG chr11 5294877 5294896 5294893 +
caatgtgggagcccaggcag

SEQ ID NO: 16840 - DNA, 20 bp, Artificial Sequence
  Synthetic oligonucleotide; GAG chr11 5294879 5294898 5294895 +
atgtgggagcccaggcagag

SEQ ID NO: 16841 - DNA, 20 bp, Artificial Sequence
  Synthetic oligonucleotide; AGG chr11 5294880 5294899 5294896 +
tgtgggagcccaggcagagg

SEQ ID NO: 16842 - DNA, 20 bp, Artificial Sequence
  Synthetic oligonucleotide; AAG chr11 5294887 5294906 5294903 +
gcccaggcagaggaggcgcc

SEQ ID NO: 16843 - DNA, 20 bp, Artificial Sequence
  Synthetic oligonucleotide; GAG chr11 5294889 5294908 5294905 +
ccaggcagaggaggcgccaa

SEQ ID NO: 16844 - DNA, 20 bp, Artificial Sequence
  Synthetic oligonucleotide; GAG chr11 5294893 5294912 5294909 +
gcagaggaggcgccaagagc

SEQ ID NO: 16845 - DNA, 20 bp, Artificial Sequence
  Synthetic oligonucleotide; GAG chr11 5294897 5294916 5294913 +
aggaggcgccaagagcgagc

SEQ ID NO: 16846 - DNA, 20 bp, Artificial Sequence
  Synthetic oligonucleotide; AGG chr11 5294898 5294917 5294914 +
ggaggcgccaagagcgagcg

SEQ ID NO: 16847 - DNA, 20 bp, Artificial Sequence
  Synthetic oligonucleotide; GGG chr11 5294899 5294918 5294915 +
gaggcgccaagagcgagcga

SEQ ID NO: 16848 - DNA, 20 bp, Artificial Sequence
  Synthetic oligonucleotide; GAG chr11 5294906 5294925 5294922 +
caagagcgagcgagggctgt

SEQ ID NO: 16849 - DNA, 20 bp, Artificial Sequence
  Synthetic oligonucleotide; AGG chr11 5294907 5294926 5294923 +
aagagcgagcgagggctgtg

SEQ ID NO: 16850 - DNA, 20 bp, Artificial Sequence
  Synthetic oligonucleotide; CAG chr11 5294915 5294934 5294931 +
gcgagggctgtgaggactgc

SEQ ID NO: 16851 - DNA, 20 bp, Artificial Sequence
  Synthetic oligonucleotide; TAG chr11 5294946 5294965 5294962 +
cacctctcaatactaatcac

SEQ ID NO: 16852 - DNA, 20 bp, Artificial Sequence
  Synthetic oligonucleotide; TAG chr11 5294953 5294972 5294969 +
caatactaatcactagtaat

SEQ ID NO: 16853 - DNA, 20 bp, Artificial Sequence
  Synthetic oligonucleotide; CAG chr11 5294988 5295007 5295004 +
ccctgtgcttccaaaaataa

SEQ ID NO: 16854 - DNA, 20 bp, Artificial Sequence
  Synthetic oligonucleotide; AGG chr11 5294989 5295008 5295005 +
cctgtgcttccaaaaataac

SEQ ID NO: 16855 - DNA, 20 bp, Artificial Sequence
  Synthetic oligonucleotide; AAG chr11 5295010 5295029 5295026 +
ggaatattattgtaaaatca

SEQ ID NO: 16856 - DNA, 20 bp, Artificial Sequence
  Synthetic oligonucleotide; AGG chr11 5295011 5295030 5295027 +
gaatattattgtaaaatcaa

SEQ ID NO: 16857 - DNA, 20 bp, Artificial Sequence
  Synthetic oligonucleotide; AAG chr11 5295043 5295062 5295059 +
ccatatgttttattatgttt

SEQ ID NO: 16858 - DNA, 20 bp, Artificial Sequence
  Synthetic oligonucleotide; CAG chr11 5295046 5295065 5295062 +
tatgttttattatgtttaag

SEQ ID NO: 16859 - DNA, 20 bp, Artificial Sequence
  Synthetic oligonucleotide; AAG chr11 5295056 5295075 5295072 +
tatgtttaagcagtaaaaat

SEQ ID NO: 16860 - DNA, 20 bp, Artificial Sequence
  Synthetic oligonucleotide; TGG chr11 5295062 5295081 5295078 +
taagcagtaaaaataagacc

SEQ ID NO: 16861 - DNA, 20 bp, Artificial Sequence
  Synthetic oligonucleotide; GAG chr11 5295064 5295083 5295080 +
agcagtaaaaataagacctg

SEQ ID NO: 16862 - DNA, 20 bp, Artificial Sequence
  Synthetic oligonucleotide; AAG chr11 5295073 5295092 5295089 +
aataagacctggagtgcaaa

SEQ ID NO: 16863 - DNA, 20 bp, Artificial Sequence
  Synthetic oligonucleotide; TGG chr11 5295100 5295119 5295116 +
ccaaatgctgtaatacttca

SEQ ID NO: 16864 - DNA, 20 bp, Artificial Sequence
  Synthetic oligonucleotide; AAG chr11 5295108 5295127 5295124 +
tgtaatacttcatggaatct

SEQ ID NO: 16865 - DNA, 20 bp, Artificial Sequence
  Synthetic oligonucleotide; CAG chr11 5295139 5295158 5295155 +
ccccaaattatgtcttattt

SEQ ID NO: 16866 - DNA, 20 bp, Artificial Sequence
  Synthetic oligonucleotide; GAG chr11 5295141 5295160 5295157 +
ccaaattatgtcttatttca

SEQ ID NO: 16867 - DNA, 20 bp, Artificial Sequence
  Synthetic oligonucleotide; TAG chr11 5295153 5295172 5295169 +
ttatttcagagcaaataact

SEQ ID NO: 16868 - DNA, 20 bp, Artificial Sequence
  Synthetic oligonucleotide; AGG chr11 5295154 5295173 5295170 +
tatttcagagcaaataactt

SEQ ID NO: 16869 - DNA, 20 bp, Artificial Sequence
  Synthetic oligonucleotide; CAG chr11 5295200 5295219 5295216 +
attattattgtataatgatt

SEQ ID NO: 16870 - DNA, 20 bp, Artificial Sequence
  Synthetic oligonucleotide; GAG chr11 5295202 5295221 5295218 +
tattattgtataatgattca

SEQ ID NO: 16871 - DNA, 20 bp, Artificial Sequence
  Synthetic oligonucleotide; TAG chr11 5295214 5295233 5295230 +
atgattcagagcatgtattc

SEQ ID NO: 16872 - DNA, 20 bp, Artificial Sequence
  Synthetic oligonucleotide; GAG chr11 5295216 5295235 5295232 +
gattcagagcatgtattcta

SEQ ID NO: 16873 - DNA, 20 bp, Artificial Sequence
  Synthetic oligonucleotide; GAG chr11 5295230 5295249 5295246 +
attctagagccaaatatcat

SEQ ID NO: 16874 - DNA, 20 bp, Artificial Sequence
  Synthetic oligonucleotide; CAG chr11 5295251 5295270 5295267 +
agttgaattatgccctctgt

SEQ ID NO: 16875 - DNA, 20 bp, Artificial Sequence
  Synthetic oligonucleotide; TAG chr11 5295255 5295274 5295271 +
gaattatgccctctgtcagt

SEQ ID NO: 16876 - DNA, 20 bp, Artificial Sequence
  Synthetic oligonucleotide; TAG chr11 5295258 5295277 5295274 +
ttatgccctctgtcagttag

SEQ ID NO: 16877 - DNA, 20 bp, Artificial Sequence
  Synthetic oligonucleotide; TGG chr11 5295272 5295291 5295288 +
agttagtagccacttcatct

SEQ ID NO: 16878 - DNA, 20 bp, Artificial Sequence
  Synthetic oligonucleotide; TAG chr11 5295285 5295304 5295301 +
ttcatcttggaatattactt

SEQ ID NO: 16879 - DNA, 20 bp, Artificial Sequence
  Synthetic oligonucleotide; AGG chr11 5295286 5295305 5295302 +
tcatcttggaatattacttt

SEQ ID NO: 16880 - DNA, 20 bp, Artificial Sequence
  Synthetic oligonucleotide; GGG chr11 5295287 5295306 5295303 +
catcttggaatattacttta

SEQ ID NO: 16881 - DNA, 20 bp, Artificial Sequence
  Synthetic oligonucleotide; CAG chr11 5295300 5295319 5295316 +
tactttagggccctgtgcct

SEQ ID NO: 16882 - DNA, 20 bp, Artificial Sequence
  Synthetic oligonucleotide; AAG chr11 5295316 5295335 5295332 +
gcctcagtttcctcctctta

SEQ ID NO: 16883 - DNA, 20 bp, Artificial Sequence
  Synthetic oligonucleotide; AGG chr11 5295317 5295336 5295333 +
cctcagtttcctcctcttaa

SEQ ID NO: 16884 - DNA, 20 bp, Artificial Sequence
  Synthetic oligonucleotide; GGG chr11 5295318 5295337 5295334 +
ctcagtttcctcctcttaaa

SEQ ID NO: 16885 - DNA, 20 bp, Artificial Sequence
  Synthetic oligonucleotide; TAG chr11 5295329 5295348 5295345 +
cctcttaaagggtattacaa

SEQ ID NO: 16886 - DNA, 20 bp, Artificial Sequence
  Synthetic oligonucleotide; GAG chr11 5295337 5295356 5295353 +
agggtattacaatagtactt

SEQ ID NO: 16887 - DNA, 20 bp, Artificial Sequence
  Synthetic oligonucleotide; AGG chr11 5295338 5295357 5295354 +
gggtattacaatagtacttg

SEQ ID NO: 16888 - DNA, 20 bp, Artificial Sequence
  Synthetic oligonucleotide; CAG chr11 5295343 5295362 5295359 +
ttacaatagtacttgaggca

SEQ ID NO: 16889 - DNA, 20 bp, Artificial Sequence
  Synthetic oligonucleotide; GAG chr11 5295345 5295364 5295361 +
acaatagtacttgaggcaca

SEQ ID NO: 16890 - DNA, 20 bp, Artificial Sequence
  Synthetic oligonucleotide; CAG chr11 5295381 5295400 5295397 +
taaatgaaataatatatcaa

SEQ ID NO: 16891 - DNA, 20 bp, Artificial Sequence
  Synthetic oligonucleotide; TAG chr11 5295395 5295414 5295411 +
tatcaacagtgtcttgtgta

SEQ ID NO: 16892 - DNA, 20 bp, Artificial Sequence
  Synthetic oligonucleotide; AAG chr11 5295401 5295420 5295417 +
cagtgtcttgtgtatagtat

SEQ ID NO: 16893 - DNA, 20 bp, Artificial Sequence
  Synthetic oligonucleotide; TAG chr11 5295465 5295484 5295481 +
ctattacttttatactatcc

SEQ ID NO: 16894 - DNA, 20 bp, Artificial Sequence
  Synthetic oligonucleotide; TAG chr11 5295472 5295491 5295488 +
ttttatactatcctagtgtg

SEQ ID NO: 16895 - DNA, 20 bp, Artificial Sequence
  Synthetic oligonucleotide; GAG chr11 5295478 5295497 5295494 +
actatcctagtgtgtagatt

SEQ ID NO: 16896 - DNA, 20 bp, Artificial Sequence
  Synthetic oligonucleotide; AGG chr11 5295479 5295498 5295495 +
ctatcctagtgtgtagattg

SEQ ID NO: 16897 - DNA, 20 bp, Artificial Sequence
  Synthetic oligonucleotide; TAG chr11 5295485 5295504 5295501 +
tagtgtgtagattgaggatg

SEQ ID NO: 16898 - DNA, 20 bp, Artificial Sequence
  Synthetic oligonucleotide; AGG chr11 5295486 5295505 5295502 +
agtgtgtagattgaggatgt

SEQ ID NO: 16899 - DNA, 20 bp, Artificial Sequence
  Synthetic oligonucleotide; GGG chr11 5295487 5295506 5295503 +
gtgtgtagattgaggatgta

SEQ ID NO: 16900 - DNA, 20 bp, Artificial Sequence
  Synthetic oligonucleotide; GGG chr11 5295488 5295507 5295504 +
tgtgtagattgaggatgtag

SEQ ID NO: 16901 - DNA, 20 bp, Artificial Sequence
  Synthetic oligonucleotide; TAG chr11 5295493 5295512 5295509 +
agattgaggatgtaggggct

SEQ ID NO: 16902 - DNA, 20 bp, Artificial Sequence
  Synthetic oligonucleotide; GAG chr11 5295495 5295514 5295511 +
attgaggatgtaggggctta

SEQ ID NO: 16903 - DNA, 20 bp, Artificial Sequence
  Synthetic oligonucleotide; AAG chr11 5295500 5295519 5295516 +
ggatgtaggggcttagagca

SEQ ID NO: 16904 - DNA, 20 bp, Artificial Sequence
  Synthetic oligonucleotide; AAG chr11 5295508 5295527 5295524 +
gggcttagagcaaagacatg

SEQ ID NO: 16905 - DNA, 20 bp, Artificial Sequence
  Synthetic oligonucleotide; AGG chr11 5295509 5295528 5295525 +
ggcttagagcaaagacatga

SEQ ID NO: 16906 - DNA, 20 bp, Artificial Sequence
  Synthetic oligonucleotide; TGG chr11 5295519 5295538 5295535 +
aaagacatgaaggtcacata

SEQ ID NO: 16907 - DNA, 20 bp, Artificial Sequence
  Synthetic oligonucleotide; GGG chr11 5295520 5295539 5295536 +
aagacatgaaggtcacatat

SEQ ID NO: 16908 - DNA, 20 bp, Artificial Sequence
  Synthetic oligonucleotide; TAG chr11 5295523 5295542 5295539 +
acatgaaggtcacatatggg

SEQ ID NO: 16909 - DNA, 20 bp, Artificial Sequence
  Synthetic oligonucleotide; TGG chr11 5295529 5295548 5295545 +
aggtcacatatgggtagaca

SEQ ID NO: 16910 - DNA, 20 bp, Artificial Sequence
  Synthetic oligonucleotide; GGG chr11 5295530 5295549 5295546 +
ggtcacatatgggtagacat

SEQ ID NO: 16911 - DNA, 20 bp, Artificial Sequence
  Synthetic oligonucleotide; TAG chr11 5295539 5295558 5295555 +
tgggtagacatgggaataaa

SEQ ID NO: 16912 - DNA, 20 bp, Artificial Sequence
  Synthetic oligonucleotide; GAG chr11 5295544 5295563 5295560 +
agacatgggaataaatagat

SEQ ID NO: 16913 - DNA, 20 bp, Artificial Sequence
  Synthetic oligonucleotide; AAG chr11 5295558 5295577 5295574 +
atagatgagatgacattgtc

SEQ ID NO: 16914 - DNA, 20 bp, Artificial Sequence
  Synthetic oligonucleotide; AGG chr11 5295559 5295578 5295575 +
tagatgagatgacattgtca

SEQ ID NO: 16915 - DNA, 20 bp, Artificial Sequence
  Synthetic oligonucleotide; GAG chr11 5295569 5295588 5295585 +
gacattgtcaaggattacac

SEQ ID NO: 16916 - DNA, 20 bp, Artificial Sequence
  Synthetic oligonucleotide; AAG chr11 5295584 5295603 5295600 +
tacacgagtctttctctgca

SEQ ID NO: 16917 - DNA, 20 bp, Artificial Sequence
  Synthetic oligonucleotide; GAG chr11 5295588 5295607 5295604 +
cgagtctttctctgcaaagc

SEQ ID NO: 16918 - DNA, 20 bp, Artificial Sequence
  Synthetic oligonucleotide; AGG chr11 5295589 5295608 5295605 +
gagtctttctctgcaaagcg

SEQ ID NO: 16919 - DNA, 20 bp, Artificial Sequence
  Synthetic oligonucleotide; GGG chr11 5295590 5295609 5295606 +
agtctttctctgcaaagcga

SEQ ID NO: 16920 - DNA, 20 bp, Artificial Sequence
  Synthetic oligonucleotide; AAG chr11 5295593 5295612 5295609 +
ctttctctgcaaagcgaggg

SEQ ID NO: 16921 - DNA, 20 bp, Artificial Sequence
  Synthetic oligonucleotide; AGG chr11 5295594 5295613 5295610 +
tttctctgcaaagcgaggga

SEQ ID NO: 16922 - DNA, 20 bp, Artificial Sequence
  Synthetic oligonucleotide; TAG chr11 5295598 5295617 5295614 +
tctgcaaagcgagggaaggt

SEQ ID NO: 16923 - DNA, 20 bp, Artificial Sequence
  Synthetic oligonucleotide; CAG chr11 5295608 5295627 5295624 +
gagggaaggttagtctcttt

SEQ ID NO: 16924 - DNA, 20 bp, Artificial Sequence
  Synthetic oligonucleotide; GAG chr11 5295610 5295629 5295626 +
gggaaggttagtctctttca

SEQ ID NO: 16925 - DNA, 20 bp, Artificial Sequence
  Synthetic oligonucleotide; TGG chr11 5295620 5295639 5295636 +
gtctctttcagagaacatca

SEQ ID NO: 16926 - DNA, 20 bp, Artificial Sequence
  Synthetic oligonucleotide; CAG chr11 5295623 5295642 5295639 +
tctttcagagaacatcatgg

SEQ ID NO: 16927 - DNA, 20 bp, Artificial Sequence
  Synthetic oligonucleotide; AAG chr11 5295638 5295657 5295654 +
catggcagaaacattttttc

SEQ ID NO: 16928 - DNA, 20 bp, Artificial Sequence
  Synthetic oligonucleotide; GAG chr11 5295640 5295659 5295656 +
tggcagaaacattttttcaa

SEQ ID NO: 16929 - DNA, 20 bp, Artificial Sequence
  Synthetic oligonucleotide; TAG chr11 5295666 5295685 5295682 +
ccatgcattttacgtccatg

SEQ ID NO: 16930 - DNA, 20 bp, Artificial Sequence
  Synthetic oligonucleotide; AAG chr11 5295683 5295702 5295699 +
atgtagttgcaaacaatgcc

SEQ ID NO: 16931 - DNA, 20 bp, Artificial Sequence
  Synthetic oligonucleotide; TAG chr11 5295686 5295705 5295702 +
tagttgcaaacaatgccaag

SEQ ID NO: 16932 - DNA, 20 bp, Artificial Sequence
  Synthetic oligonucleotide; CAG chr11 5295699 5295718 5295715 +
tgccaagtagaactccaatc

SEQ ID NO: 16933 - DNA, 20 bp, Artificial Sequence
  Synthetic oligonucleotide; GAG chr11 5295701 5295720 5295717 +
ccaagtagaactccaatcca

SEQ ID NO: 16934 - DNA, 20 bp, Artificial Sequence
  Synthetic oligonucleotide; AAG chr11 5295706 5295725 5295722 +
tagaactccaatccagagct

SEQ ID NO: 16935 - DNA, 20 bp, Artificial Sequence
  Synthetic oligonucleotide; TGG chr11 5295709 5295728 5295725 +
aactccaatccagagctaag

SEQ ID NO: 16936 - DNA, 20 bp, Artificial Sequence
  Synthetic oligonucleotide; GGG chr11 5295710 5295729 5295726 +
actccaatccagagctaagt

SEQ ID NO: 16937 - DNA, 20 bp, Artificial Sequence
  Synthetic oligonucleotide; GGG chr11 5295711 5295730 5295727 +
ctccaatccagagctaagtg

SEQ ID NO: 16938 - DNA, 20 bp, Artificial Sequence
  Synthetic oligonucleotide; TGG chr11 5295717 5295736 5295733 +
tccagagctaagtggggctg

SEQ ID NO: 16939 - DNA, 20 bp, Artificial Sequence
  Synthetic oligonucleotide; GGG chr11 5295718 5295737 5295734 +
ccagagctaagtggggctgt

SEQ ID NO: 16940 - DNA, 20 bp, Artificial Sequence
  Synthetic oligonucleotide; TGG chr11 5295738 5295757 5295754 +
gggaactatgtaccaattga

SEQ ID NO: 16941 - DNA, 20 bp, Artificial Sequence
  Synthetic oligonucleotide; CAG chr11 5295759 5295778 5295775 +
ggacatgctgctttttgact

SEQ ID NO: 16942 - DNA, 20 bp, Artificial Sequence
  Synthetic oligonucleotide; GAG chr11 5295761 5295780 5295777 +
acatgctgctttttgactca

SEQ ID NO: 16943 - DNA, 20 bp, Artificial Sequence
  Synthetic oligonucleotide; AGG chr11 5295762 5295781 5295778 +
catgctgctttttgactcag

SEQ ID NO: 16944 - DNA, 20 bp, Artificial Sequence
  Synthetic oligonucleotide; TGG chr11 5295765 5295784 5295781 +
gctgctttttgactcagagg

SEQ ID NO: 16945 - DNA, 20 bp, Artificial Sequence
  Synthetic oligonucleotide; AAG chr11 5295770 5295789 5295786 +
tttttgactcagaggtggat

SEQ ID NO: 16946 - DNA, 20 bp, Artificial Sequence
  Synthetic oligonucleotide; GAG chr11 5295772 5295791 5295788 +
tttgactcagaggtggataa

SEQ ID NO: 16947 - DNA, 20 bp, Artificial Sequence
  Synthetic oligonucleotide; TAG chr11 5295793 5295812 5295809 +
agacaaaactcttttcttct

SEQ ID NO: 16948 - DNA, 20 bp, Artificial Sequence
  Synthetic oligonucleotide; AAG chr11 5295806 5295825 5295822 +
ttcttcttagatgtactaaa

SEQ ID NO: 16949 - DNA, 20 bp, Artificial Sequence
  Synthetic oligonucleotide; TAG chr11 5295809 5295828 5295825 +
ttcttagatgtactaaaaag

SEQ ID NO: 16950 - DNA, 20 bp, Artificial Sequence
  Synthetic oligonucleotide; TAG chr11 5295813 5295832 5295829 +
tagatgtactaaaaagtagt

SEQ ID NO: 16951 - DNA, 20 bp, Artificial Sequence
  Synthetic oligonucleotide; TGG chr11 5295818 5295837 5295834 +
gtactaaaaagtagttagtc

SEQ ID NO: 16952 - DNA, 20 bp, Artificial Sequence
  Synthetic oligonucleotide; AAG chr11 5295821 5295840 5295837 +
ctaaaaagtagttagtctgg

SEQ ID NO: 16953 - DNA, 20 bp, Artificial Sequence
  Synthetic oligonucleotide; TAG chr11 5295828 5295847 5295844 +
gtagttagtctggaagtatt

SEQ ID NO: 16954 - DNA, 20 bp, Artificial Sequence
  Synthetic oligonucleotide; AAG chr11 5295831 5295850 5295847 +
gttagtctggaagtatttag

SEQ ID NO: 16955 - DNA, 20 bp, Artificial Sequence
  Synthetic oligonucleotide; AGG chr11 5295832 5295851 5295848 +
ttagtctggaagtatttaga

SEQ ID NO: 16956 - DNA, 20 bp, Artificial Sequence
  Synthetic oligonucleotide; TGG chr11 5295838 5295857 5295854 +
tggaagtatttagaaggctt

SEQ ID NO: 16957 - DNA, 20 bp, Artificial Sequence
  Synthetic oligonucleotide; GAG chr11 5295840 5295859 5295856 +
gaagtatttagaaggctttg

SEQ ID NO: 16958 - DNA, 20 bp, Artificial Sequence
  Synthetic oligonucleotide; GAG chr11 5295842 5295861 5295858 +
agtatttagaaggctttgga

SEQ ID NO: 16959 - DNA, 20 bp, Artificial Sequence
  Synthetic oligonucleotide; AGG chr11 5295843 5295862 5295859 +
gtatttagaaggctttggag

SEQ ID NO: 16960 - DNA, 20 bp, Artificial Sequence
  Synthetic oligonucleotide; CAG chr11 5295859 5295878 5295875 +
ggagaggaatgtgattttat

SEQ ID NO: 16961 - DNA, 20 bp, Artificial Sequence
  Synthetic oligonucleotide; AGG chr11 5295860 5295879 5295876 +
gagaggaatgtgattttatc

SEQ ID NO: 16962 - DNA, 20 bp, Artificial Sequence
  Synthetic oligonucleotide; TAG chr11 5295874 5295893 5295890 +
tttatcaggtaaatcaaaaa

SEQ ID NO: 16963 - DNA, 20 bp, Artificial Sequence
  Synthetic oligonucleotide; GAG chr11 5295876 5295895 5295892 +
tatcaggtaaatcaaaaata

SEQ ID NO: 16964 - DNA, 20 bp, Artificial Sequence
  Synthetic oligonucleotide; AGG chr11 5295877 5295896 5295893 +
atcaggtaaatcaaaaatag

SEQ ID NO: 16965 - DNA, 20 bp, Artificial Sequence
  Synthetic oligonucleotide; AAG chr11 5295890 5295909 5295906 +
aaaatagaggctatttctga

SEQ ID NO: 16966 - DNA, 20 bp, Artificial Sequence
  Synthetic oligonucleotide; AAG chr11 5295893 5295912 5295909 +
atagaggctatttctgaaag

SEQ ID NO: 16967 - DNA, 20 bp, Artificial Sequence
  Synthetic oligonucleotide; TAG chr11 5295900 5295919 5295916 +
ctatttctgaaagaagcaac

SEQ ID NO: 16968 - DNA, 20 bp, Artificial Sequence
  Synthetic oligonucleotide; AAG chr11 5295907 5295926 5295923 +
tgaaagaagcaactagaacc

SEQ ID NO: 16969 - DNA, 20 bp, Artificial Sequence
  Synthetic oligonucleotide; CAG chr11 5295917 5295936 5295933 +
aactagaaccaagttacaca

SEQ ID NO: 16970 - DNA, 20 bp, Artificial Sequence
  Synthetic oligonucleotide; TAG chr11 5295951 5295970 5295967 +
aatgtacatatatttttgac

SEQ ID NO: 16971 - DNA, 20 bp, Artificial Sequence
  Synthetic oligonucleotide; GAG chr11 5295953 5295972 5295969 +
tgtacatatatttttgacta

SEQ ID NO: 16972 - DNA, 20 bp, Artificial Sequence
  Synthetic oligonucleotide; TAG chr11 5295956 5295975 5295972 +
acatatatttttgactagag

SEQ ID NO: 16973 - DNA, 20 bp, Artificial Sequence
  Synthetic oligonucleotide; CAG chr11 5295986 5296005 5296002 +
aaatttgtataaaatatttg

SEQ ID NO: 16974 - DNA, 20 bp, Artificial Sequence
  Synthetic oligonucleotide; AGG chr11 5295987 5296006 5296003 +
aatttgtataaaatatttgc

SEQ ID NO: 16975 - DNA, 20 bp, Artificial Sequence
  Synthetic oligonucleotide; AAG chr11 5295991 5296010 5296007 +
tgtataaaatatttgcaggt

SEQ ID NO: 16976 - DNA, 20 bp, Artificial Sequence
  Synthetic oligonucleotide; TAG chr11 5295995 5296014 5296011 +
taaaatatttgcaggtaagt

SEQ ID NO: 16977 - DNA, 20 bp, Artificial Sequence
  Synthetic oligonucleotide; AGG chr11 5295996 5296015 5296012 +
aaaatatttgcaggtaagtt

SEQ ID NO: 16978 - DNA, 20 bp, Artificial Sequence
  Synthetic oligonucleotide; GAG chr11 5296012 5296031 5296028 +
agttaggtaatgcaacattt

SEQ ID NO: 16979 - DNA, 20 bp, Artificial Sequence
  Synthetic oligonucleotide; AAG chr11 5296020 5296039 5296036 +
aatgcaacatttgagactct

SEQ ID NO: 16980 - DNA, 20 bp, Artificial Sequence
  Synthetic oligonucleotide; TGG chr11 5296027 5296046 5296043 +
catttgagactctaagtttg

SEQ ID NO: 16981 - DNA, 20 bp, Artificial Sequence
  Synthetic oligonucleotide; GGG chr11 5296028 5296047 5296044 +
atttgagactctaagtttgt

SEQ ID NO: 16982 - DNA, 20 bp, Artificial Sequence
  Synthetic oligonucleotide; TAG chr11 5296036 5296055 5296052 +
ctctaagtttgtgggaaact

SEQ ID NO: 16983 - DNA, 20 bp, Artificial Sequence
  Synthetic oligonucleotide; CAG chr11 5296047 5296066 5296063 +
tgggaaacttagaactgttt

SEQ ID NO: 16984 - DNA, 20 bp, Artificial Sequence
  Synthetic oligonucleotide; CAG chr11 5296097 5296116 5296113 +
aatgctatgaaatgattttg

SEQ ID NO: 16985 - DNA, 20 bp, Artificial Sequence
  Synthetic oligonucleotide; GAG chr11 5296108 5296127 5296124 +
atgattttgcagatttttct

SEQ ID NO: 16986 - DNA, 20 bp, Artificial Sequence
  Synthetic oligonucleotide; TAG chr11 5296118 5296137 5296134 +
agatttttctgagatgttta

SEQ ID NO: 16987 - DNA, 20 bp, Artificial Sequence
  Synthetic oligonucleotide; AAG chr11 5296125 5296144 5296141 +
tctgagatgtttatagtgat

SEQ ID NO: 16988 - DNA, 20 bp, Artificial Sequence
  Synthetic oligonucleotide; GAG chr11 5296129 5296148 5296145 +
agatgtttatagtgataagt

SEQ ID NO: 16989 - DNA, 20 bp, Artificial Sequence
  Synthetic oligonucleotide; TAG chr11 5296143 5296162 5296159 +
ataagtgagaatatatgaca

SEQ ID NO: 16990 - DNA, 20 bp, Artificial Sequence
  Synthetic oligonucleotide; CAG chr11 5296224 5296243 5296240 +
tatctctttgtaacttacca

SEQ ID NO: 16991 - DNA, 20 bp, Artificial Sequence
  Synthetic oligonucleotide; CAG chr11 5296227 5296246 5296243 +
ctctttgtaacttaccacag

SEQ ID NO: 16992 - DNA, 20 bp, Artificial Sequence
  Synthetic oligonucleotide; AAG chr11 5296249 5296268 5296265 +
gatttgtattattttatgtg

SEQ ID NO: 16993 - DNA, 20 bp, Artificial Sequence
  Synthetic oligonucleotide; CAG chr11 5296257 5296276 5296273 +
ttattttatgtgaagaaact

SEQ ID NO: 16994 - DNA, 20 bp, Artificial Sequence
  Synthetic oligonucleotide; TGG chr11 5296264 5296283 5296280 +
atgtgaagaaactcagaata

SEQ ID NO: 16995 - DNA, 20 bp, Artificial Sequence
  Synthetic oligonucleotide; GAG chr11 5296266 5296285 5296282 +
gtgaagaaactcagaatatg

SEQ ID NO: 16996 - DNA, 20 bp, Artificial Sequence
  Synthetic oligonucleotide; AAG chr11 5296298 5296317 5296314 +
tctcaaattatcacttttat

SEQ ID NO: 16997 - DNA, 20 bp, Artificial Sequence
  Synthetic oligonucleotide; AGG chr11 5296299 5296318 5296315 +
ctcaaattatcacttttata

SEQ ID NO: 16998 - DNA, 20 bp, Artificial Sequence
  Synthetic oligonucleotide; CAG chr11 5296339 5296358 5296355 +
cttattttctttatgtaaac

SEQ ID NO: 16999 - DNA, 20 bp, Artificial Sequence
  Synthetic oligonucleotide; AAG chr11 5296368 5296387 5296384 +
atctcttctcattttctatc

SEQ ID NO: 17000 - DNA, 20 bp, Artificial Sequence
  Synthetic oligonucleotide; AGG chr11 5296369 5296388 5296385 +
tctcttctcattttctatca

SEQ ID NO: 17001 - DNA, 20 bp, Artificial Sequence
  Synthetic oligonucleotide; TAG chr11 5296377 5296396 5296393 +
cattttctatcaaggattaa

SEQ ID NO: 17002 - DNA, 20 bp, Artificial Sequence
  Synthetic oligonucleotide; CAG chr11 5296427 5296446 5296443 +
tctccaactttttgtatcta

SEQ ID NO: 17003 - DNA, 20 bp, Artificial Sequence
  Synthetic oligonucleotide; AGG chr11 5296428 5296447 5296444 +
ctccaactttttgtatctac

SEQ ID NO: 17004 - DNA, 20 bp, Artificial Sequence
  Synthetic oligonucleotide; AAG chr11 5296454 5296473 5296470 +
ctaccttcatttatatttta

SEQ ID NO: 17005 - DNA, 20 bp, Artificial Sequence
  Synthetic oligonucleotide; TAG chr11 5296457 5296476 5296473 +
ccttcatttatattttaaag

SEQ ID NO: 17006 - DNA, 20 bp, Artificial Sequence
  Synthetic oligonucleotide; AGG chr11 5296458 5296477 5296474 +
cttcatttatattttaaagt

SEQ ID NO: 17007 - DNA, 20 bp, Artificial Sequence
  Synthetic oligonucleotide; GAG chr11 5296462 5296481 5296478 +
atttatattttaaagtaggt

SEQ ID NO: 17008 - DNA, 20 bp, Artificial Sequence
  Synthetic oligonucleotide; AAG chr11 5296485 5296504 5296501 +
caaatgcattttaacactcc

SEQ ID NO: 17009 - DNA, 20 bp, Artificial Sequence
  Synthetic oligonucleotide; TAG chr11 5296489 5296508 5296505 +
tgcattttaacactccaaga

SEQ ID NO: 17010 - DNA, 20 bp, Artificial Sequence
  Synthetic oligonucleotide; TAG chr11 5296495 5296514 5296511 +
ttaacactccaagatagatt

SEQ ID NO: 17011 - DNA, 20 bp, Artificial Sequence
  Synthetic oligonucleotide; CAG chr11 5296513 5296532 5296529 +
tttagattaaaacatctaac

SEQ ID NO: 17012 - DNA, 20 bp, Artificial Sequence
  Synthetic oligonucleotide; AGG chr11 5296514 5296533 5296530 +
ttagattaaaacatctaacc

SEQ ID NO: 17013 - DNA, 20 bp, Artificial Sequence
  Synthetic oligonucleotide; GAG chr11 5296577 5296596 5296593 +
ttccgttattgtaacatgat

SEQ ID NO: 17014 - DNA, 20 bp, Artificial Sequence
  Synthetic oligonucleotide; AGG chr11 5296578 5296597 5296594 +
tccgttattgtaacatgatg

SEQ ID NO: 17015 - DNA, 20 bp, Artificial Sequence
  Synthetic oligonucleotide; GAG chr11 5296580 5296599 5296596 +
cgttattgtaacatgatgag

SEQ ID NO: 17016 - DNA, 20 bp, Artificial Sequence
  Synthetic oligonucleotide; TGG chr11 5296586 5296605 5296602 +
tgtaacatgatgaggagaca

SEQ ID NO: 17017 - DNA, 20 bp, Artificial Sequence
  Synthetic oligonucleotide; AAG chr11 5296590 5296609 5296606 +
acatgatgaggagacatgga

SEQ ID NO: 17018 - DNA, 20 bp, Artificial Sequence
  Synthetic oligonucleotide; AAG chr11 5296618 5296637 5296634 +
ttctgctaatttctccttta

SEQ ID NO: 17019 - DNA, 20 bp, Artificial Sequence
  Synthetic oligonucleotide; TAG chr11 5296632 5296651 5296648 +
cctttaaagtcacttcacat

SEQ ID NO: 17020 - DNA, 20 bp, Artificial Sequence
  Synthetic oligonucleotide; GAG chr11 5296650 5296669 5296666 +
attagttatctcttacatat

SEQ ID NO: 17021 - DNA, 20 bp, Artificial Sequence
  Synthetic oligonucleotide; TGG chr11 5296657 5296676 5296673 +
atctcttacatatgagtccc

SEQ ID NO: 17022 - DNA, 20 bp, Artificial Sequence
  Synthetic oligonucleotide; CAG chr11 5296660 5296679 5296676 +
tcttacatatgagtccctgg

SEQ ID NO: 17023 - DNA, 20 bp, Artificial Sequence
  Synthetic oligonucleotide; CAG chr11 5296666 5296685 5296682 +
atatgagtccctggcagtgt

SEQ ID NO: 17024 - DNA, 20 bp, Artificial Sequence
  Synthetic oligonucleotide; AAG chr11 5296694 5296713 5296710 +
cattccttttcatgacccta

SEQ ID NO: 17025 - DNA, 20 bp, Artificial Sequence
  Synthetic oligonucleotide; TAG chr11 5296726 5296745 5296742 +
aaatatactgcatttttcta

SEQ ID NO: 17026 - DNA, 20 bp, Artificial Sequence
  Synthetic oligonucleotide; TGG chr11 5296752 5296771 5296768 +
atttcaacctacacaaatta

SEQ ID NO: 17027 - DNA, 20 bp, Artificial Sequence
  Synthetic oligonucleotide; GGG chr11 5296753 5296772 5296769 +
tttcaacctacacaaattat

SEQ ID NO: 17028 - DNA, 20 bp, Artificial Sequence
  Synthetic oligonucleotide; TAG chr11 5296778 5296797 5296794 +
tgcatgcctttatccctaat

SEQ ID NO: 17029 - DNA, 20 bp, Artificial Sequence
  Synthetic oligonucleotide; AGG chr11 5296779 5296798 5296795 +
gcatgcctttatccctaatt

SEQ ID NO: 17030 - DNA, 20 bp, Artificial Sequence
  Synthetic oligonucleotide; CAG chr11 5296787 5296806 5296803 +
ttatccctaattaggctaca

SEQ ID NO: 17031 - DNA, 20 bp, Artificial Sequence
  Synthetic oligonucleotide; TAG chr11 5296800 5296819 5296816 +
ggctacacagctgtttaaat

SEQ ID NO: 17032 - DNA, 20 bp, Artificial Sequence
  Synthetic oligonucleotide; AGG chr11 5296801 5296820 5296817 +
gctacacagctgtttaaatt

SEQ ID NO: 17033 - DNA, 20 bp, Artificial Sequence
  Synthetic oligonucleotide; CAG chr11 5296809 5296828 5296825 +
gctgtttaaattaggaatta

SEQ ID NO: 17034 - DNA, 20 bp, Artificial Sequence
  Synthetic oligonucleotide; CAG chr11 5296819 5296838 5296835 +
ttaggaattacagatttcgc

SEQ ID NO: 17035 - DNA, 20 bp, Artificial Sequence
  Synthetic oligonucleotide; CAG chr11 5296840 5296859 5296856 +
agataattgtatatctgata

SEQ ID NO: 17036 - DNA, 20 bp, Artificial Sequence
  Synthetic oligonucleotide; TAG chr11 5296845 5296864 5296861 +
attgtatatctgatacagat

SEQ ID NO: 17037 - DNA, 20 bp, Artificial Sequence
  Synthetic oligonucleotide; AGG chr11 5296846 5296865 5296862 +
ttgtatatctgatacagatt

SEQ ID NO: 17038 - DNA, 20 bp, Artificial Sequence
  Synthetic oligonucleotide; TGG chr11 5296863 5296882 5296879 +
attaggcatttaataaattt

SEQ ID NO: 17039 - DNA, 20 bp, Artificial Sequence
  Synthetic oligonucleotide; TAG chr11 5296870 5296889 5296886 +
atttaataaattttggtgaa

SEQ ID NO: 17040 - DNA, 20 bp, Artificial Sequence
  Synthetic oligonucleotide; AGG chr11 5296871 5296890 5296887 +
tttaataaattttggtgaat

SEQ ID NO: 17041 - DNA, 20 bp, Artificial Sequence
  Synthetic oligonucleotide; CAG chr11 5296904 5296923 5296920 +
attgttcctcaaacatttgt

SEQ ID NO: 17042 - DNA, 20 bp, Artificial Sequence
  Synthetic oligonucleotide; GAG chr11 5296932 5296951 5296948 +
cactatgatacctacttatt

SEQ ID NO: 17043 - DNA, 20 bp, Artificial Sequence
  Synthetic oligonucleotide; AAG chr11 5296939 5296958 5296955 +
atacctacttattgagaatc

SEQ ID NO: 17044 - DNA, 20 bp, Artificial Sequence
  Synthetic oligonucleotide; TAG chr11 5296946 5296965 5296962 +
cttattgagaatcaagtaaa

SEQ ID NO: 17045 - DNA, 20 bp, Artificial Sequence
  Synthetic oligonucleotide; GAG chr11 5296948 5296967 5296964 +
tattgagaatcaagtaaata

SEQ ID NO: 17046 - DNA, 20 bp, Artificial Sequence
  Synthetic oligonucleotide; CAG chr11 5296956 5296975 5296972 +
atcaagtaaatagagatatt

SEQ ID NO: 17047 - DNA, 20 bp, Artificial Sequence
  Synthetic oligonucleotide; CAG chr11 5296967 5296986 5296983 +
agagatattcagacacatta

SEQ ID NO: 17048 - DNA, 20 bp, Artificial Sequence
  Synthetic oligonucleotide; GAG chr11 5296969 5296988 5296985 +
agatattcagacacattaca

SEQ ID NO: 17049 - DNA, 20 bp, Artificial Sequence
  Synthetic oligonucleotide; AAG chr11 5296972 5296991 5296988 +
tattcagacacattacagag

SEQ ID NO: 17050 - DNA, 20 bp, Artificial Sequence
  Synthetic oligonucleotide; AAG chr11 5296993 5297012 5297009 +
agtatatacttacaaactca

SEQ ID NO: 17051 - DNA, 20 bp, Artificial Sequence
  Synthetic oligonucleotide; TAG chr11 5297009 5297028 5297025 +
ctcaaagtatttgacacccc

SEQ ID NO: 17052 - DNA, 20 bp, Artificial Sequence
  Synthetic oligonucleotide; AGG chr11 5297010 5297029 5297026 +
tcaaagtatttgacacccct

SEQ ID NO: 17053 - DNA, 20 bp, Artificial Sequence
  Synthetic oligonucleotide; CAG chr11 5297036 5297055 5297052 +
atgaaacacttttgaatata

SEQ ID NO: 17054 - DNA, 20 bp, Artificial Sequence
  Synthetic oligonucleotide; CAG chr11 5297083 5297102 5297099 +
ataaacattgccaatgcatg

SEQ ID NO: 17055 - DNA, 20 bp, Artificial Sequence
  Synthetic oligonucleotide; AAG chr11 5297087 5297106 5297103 +
acattgccaatgcatgcaga

SEQ ID NO: 17056 - DNA, 20 bp, Artificial Sequence
  Synthetic oligonucleotide; AAG chr11 5297090 5297109 5297106 +
ttgccaatgcatgcagaaag

SEQ ID NO: 17057 - DNA, 20 bp, Artificial Sequence
  Synthetic oligonucleotide; TGG chr11 5297100 5297119 5297116 +
atgcagaaagaagcttaatg

SEQ ID NO: 17058 - DNA, 20 bp, Artificial Sequence
  Synthetic oligonucleotide; TAG chr11 5297127 5297146 5297143 +
tacatatactttcatgaaca

SEQ ID NO: 17059 - DNA, 20 bp, Artificial Sequence
  Synthetic oligonucleotide; TAG chr11 5297157 5297176 5297173 +
aacatcctttccctttctgt

SEQ ID NO: 17060 - DNA, 20 bp, Artificial Sequence
  Synthetic oligonucleotide; GAG chr11 5297159 5297178 5297175 +
catcctttccctttctgtta

SEQ ID NO: 17061 - DNA, 20 bp, Artificial Sequence
  Synthetic oligonucleotide; TGG chr11 5297184 5297203 5297200 +
acctgccttcatccatccct

SEQ ID NO: 17062 - DNA, 20 bp, Artificial Sequence
  Synthetic oligonucleotide; GAG chr11 5297199 5297218 5297215 +
tcccttggatatgatacctt

SEQ ID NO: 17063 - DNA, 20 bp, Artificial Sequence
  Synthetic oligonucleotide; CAG chr11 5297226 5297245 5297242 +
ccccacacccaaatcttcaa

SEQ ID NO: 17064 - DNA, 20 bp, Artificial Sequence
  Synthetic oligonucleotide; CAG chr11 5297230 5297249 5297246 +
acacccaaatcttcaacaga

SEQ ID NO: 17065 - DNA, 20 bp, Artificial Sequence
  Synthetic oligonucleotide; AAG chr11 5297240 5297259 5297256 +
cttcaacagacagaaatgta

SEQ ID NO: 17066 - DNA, 20 bp, Artificial Sequence
  Synthetic oligonucleotide; TAG chr11 5297260 5297279 5297276 +
aagtcccgtttaatgtgtga

SEQ ID NO: 17067 - DNA, 20 bp, Artificial Sequence
  Synthetic oligonucleotide; CAG chr11 5297283 5297302 5297299 +
atgaactaaatattctatct

SEQ ID NO: 17068 - DNA, 20 bp, Artificial Sequence
  Synthetic oligonucleotide; CAG chr11 5297297 5297316 5297313 +
ctatctcagtattcatctga

SEQ ID NO: 17069 - DNA, 20 bp, Artificial Sequence
  Synthetic oligonucleotide; TAG chr11 5297302 5297321 5297318 +
tcagtattcatctgacagca

SEQ ID NO: 17070 - DNA, 20 bp, Artificial Sequence
  Synthetic oligonucleotide; AGG chr11 5297303 5297322 5297319 +
cagtattcatctgacagcat

SEQ ID NO: 17071 - DNA, 20 bp, Artificial Sequence
  Synthetic oligonucleotide; AAG chr11 5297306 5297325 5297322 +
tattcatctgacagcatagg

SEQ ID NO: 17072 - DNA, 20 bp, Artificial Sequence
  Synthetic oligonucleotide; AGG chr11 5297307 5297326 5297323 +
attcatctgacagcatagga

SEQ ID NO: 17073 - DNA, 20 bp, Artificial Sequence
  Synthetic oligonucleotide; GAG chr11 5297309 5297328 5297325 +
tcatctgacagcataggaag

SEQ ID NO: 17074 - DNA, 20 bp, Artificial Sequence
  Synthetic oligonucleotide; GAG chr11 5297311 5297330 5297327 +
atctgacagcataggaagga

SEQ ID NO: 17075 - DNA, 20 bp, Artificial Sequence
  Synthetic oligonucleotide; TGG chr11 5297354 5297373 5297370 +
taccacatattgtgtttcta

SEQ ID NO: 17076 - DNA, 20 bp, Artificial Sequence
  Synthetic oligonucleotide; CAG chr11 5297363 5297382 5297379 +
ttgtgtttctatggccgaat

SEQ ID NO: 17077 - DNA, 20 bp, Artificial Sequence
  Synthetic oligonucleotide; TAG chr11 5297368 5297387 5297384 +
tttctatggccgaatcagct

SEQ ID NO: 17078 - DNA, 20 bp, Artificial Sequence
  Synthetic oligonucleotide; AGG chr11 5297369 5297388 5297385 +
ttctatggccgaatcagctt

SEQ ID NO: 17079 - DNA, 20 bp, Artificial Sequence
  Synthetic oligonucleotide; TGG chr11 5297384 5297403 5297400 +
agcttaggttctacattgtg

SEQ ID NO: 17080 - DNA, 20 bp, Artificial Sequence
  Synthetic oligonucleotide; TGG chr11 5297390 5297409 5297406 +
ggttctacattgtgtggttt

SEQ ID NO: 17081 - DNA, 20 bp, Artificial Sequence
  Synthetic oligonucleotide; AAG chr11 5297413 5297432 5297429 +
ataaattacttaacctacct

SEQ ID NO: 17082 - DNA, 20 bp, Artificial Sequence
  Synthetic oligonucleotide; AAG chr11 5297417 5297436 5297433 +
attacttaacctacctaagt

SEQ ID NO: 17083 - DNA, 20 bp, Artificial Sequence
  Synthetic oligonucleotide; AGG chr11 5297418 5297437 5297434 +
ttacttaacctacctaagta

SEQ ID NO: 17084 - DNA, 20 bp, Artificial Sequence
  Synthetic oligonucleotide; CAG chr11 5297432 5297451 5297448 +
taagtaaggcacctacgtgt

SEQ ID NO: 17085 - DNA, 20 bp, Artificial Sequence
  Synthetic oligonucleotide; TAG chr11 5297447 5297466 5297463 +
cgtgtcagtctcttcatgtg

SEQ ID NO: 17086 - DNA, 20 bp, Artificial Sequence
  Synthetic oligonucleotide; CAG chr11 5297451 5297470 5297467 +
tcagtctcttcatgtgtagt

SEQ ID NO: 17087 - DNA, 20 bp, Artificial Sequence
  Synthetic oligonucleotide; AGG chr11 5297452 5297471 5297468 +
cagtctcttcatgtgtagtc

SEQ ID NO: 17088 - DNA, 20 bp, Artificial Sequence
  Synthetic oligonucleotide; AAG chr11 5297467 5297486 5297483 +
tagtcaggaattataatgaa

SEQ ID NO: 17089 - DNA, 20 bp, Artificial Sequence
  Synthetic oligonucleotide; AAG chr11 5297477 5297496 5297493 +
ttataatgaaaagtaactcg

SEQ ID NO: 17090 - DNA, 20 bp, Artificial Sequence
  Synthetic oligonucleotide; CAG chr11 5297495 5297514 5297511 +
cgaagtatttttgtgataat

SEQ ID NO: 17091 - DNA, 20 bp, Artificial Sequence
  Synthetic oligonucleotide; TAG chr11 5297499 5297518 5297515 +
gtatttttgtgataatcagt

SEQ ID NO: 17092 - DNA, 20 bp, Artificial Sequence
  Synthetic oligonucleotide; AAG chr11 5297521 5297540 5297537 +
gataaaaatgtgaacctctt

SEQ ID NO: 17093 - DNA, 20 bp, Artificial Sequence
  Synthetic oligonucleotide; TAG chr11 5297528 5297547 5297544 +
atgtgaacctcttaagacac

SEQ ID NO: 17094 - DNA, 20 bp, Artificial Sequence
  Synthetic oligonucleotide; GAG chr11 5297588 5297607 5297604 +
attatatactgaactcatgt

SEQ ID NO: 17095 - DNA, 20 bp, Artificial Sequence
  Synthetic oligonucleotide; AGG chr11 5297589 5297608 5297605 +
ttatatactgaactcatgtg

SEQ ID NO: 17096 - DNA, 20 bp, Artificial Sequence
  Synthetic oligonucleotide; CAG chr11 5297595 5297614 5297611 +
actgaactcatgtgaggatc

SEQ ID NO: 17097 - DNA, 20 bp, Artificial Sequence
  Synthetic oligonucleotide; TAG chr11 5297608 5297627 5297624 +
gaggatccagtttctatatc

SEQ ID NO: 17098 - DNA, 20 bp, Artificial Sequence
  Synthetic oligonucleotide; AGG chr11 5297609 5297628 5297625 +
aggatccagtttctatatct

SEQ ID NO: 17099 - DNA, 20 bp, Artificial Sequence
  Synthetic oligonucleotide; TAG chr11 5297627 5297646 5297643 +
ctaggcttttcaaactacct

SEQ ID NO: 17100 - DNA, 20 bp, Artificial Sequence
  Synthetic oligonucleotide; GAG chr11 5297629 5297648 5297645 +
aggcttttcaaactacctta

SEQ ID NO: 17101 - DNA, 20 bp, Artificial Sequence
  Synthetic oligonucleotide; TAG chr11 5297654 5297673 5297670 +
atacttgtatatcttccttg

SEQ ID NO: 17102 - DNA, 20 bp, Artificial Sequence
  Synthetic oligonucleotide; AGG chr11 5297655 5297674 5297671 +
tacttgtatatcttccttgt

SEQ ID NO: 17103 - DNA, 20 bp, Artificial Sequence
  Synthetic oligonucleotide; TAG chr11 5297660 5297679 5297676 +
gtatatcttccttgtaggta

SEQ ID NO: 17104 - DNA, 20 bp, Artificial Sequence
  Synthetic oligonucleotide; GAG chr11 5297662 5297681 5297678 +
atatcttccttgtaggtata

SEQ ID NO: 17105 - DNA, 20 bp, Artificial Sequence
  Synthetic oligonucleotide; CAG chr11 5297679 5297698 5297695 +
atagagtaaaatactaactt

SEQ ID NO: 17106 - DNA, 20 bp, Artificial Sequence
  Synthetic oligonucleotide; AGG chr11 5297680 5297699 5297696 +
tagagtaaaatactaacttc

SEQ ID NO: 17107 - DNA, 20 bp, Artificial Sequence
  Synthetic oligonucleotide; TAG chr11 5297685 5297704 5297701 +
taaaatactaacttcaggtt

SEQ ID NO: 17108 - DNA, 20 bp, Artificial Sequence
  Synthetic oligonucleotide; AAG chr11 5297722 5297741 5297738 +
catattataatttacattgc

SEQ ID NO: 17109 - DNA, 20 bp, Artificial Sequence
  Synthetic oligonucleotide; TGG chr11 5297745 5297764 5297761 +
ttttattttctgttccttat

SEQ ID NO: 17110 - DNA, 20 bp, Artificial Sequence
  Synthetic oligonucleotide; TGG chr11 5297758 5297777 5297774 +
tccttattggtcaatacttt

SEQ ID NO: 17111 - DNA, 20 bp, Artificial Sequence
  Synthetic oligonucleotide; CAG chr11 5297764 5297783 5297780 +
ttggtcaatacttttggatc

SEQ ID NO: 17112 - DNA, 20 bp, Artificial Sequence
  Synthetic oligonucleotide; TGG chr11 5297778 5297797 5297794 +
tggatccagctgttcaactg

SEQ ID NO: 17113 - DNA, 20 bp, Artificial Sequence
  Synthetic oligonucleotide; AAG chr11 5297801 5297820 5297817 +
taacacttgataataatgcc

SEQ ID NO: 17114 - DNA, 20 bp, Artificial Sequence
  Synthetic oligonucleotide; GAG chr11 5297803 5297822 5297819 +
acacttgataataatgccaa

SEQ ID NO: 17115 - DNA, 20 bp, Artificial Sequence
  Synthetic oligonucleotide; AGG chr11 5297804 5297823 5297820 +
cacttgataataatgccaag

SEQ ID NO: 17116 - DNA, 20 bp, Artificial Sequence
  Synthetic oligonucleotide; TGG chr11 5297808 5297827 5297824 +
tgataataatgccaagaggc

SEQ ID NO: 17117 - DNA, 20 bp, Artificial Sequence
  Synthetic oligonucleotide; GGG chr11 5297809 5297828 5297825 +
gataataatgccaagaggct

SEQ ID NO: 17118 - DNA, 20 bp, Artificial Sequence
  Synthetic oligonucleotide; GGG chr11 5297810 5297829 5297826 +
ataataatgccaagaggctg

SEQ ID NO: 17119 - DNA, 20 bp, Artificial Sequence
  Synthetic oligonucleotide; GAG chr11 5297814 5297833 5297830 +
taatgccaagaggctggggt

SEQ ID NO: 17120 - DNA, 20 bp, Artificial Sequence
  Synthetic oligonucleotide; AAG chr11 5297821 5297840 5297837 +
aagaggctggggtgagctat

SEQ ID NO: 17121 - DNA, 20 bp, Artificial Sequence
  Synthetic oligonucleotide; GAG chr11 5297823 5297842 5297839 +
gaggctggggtgagctataa

SEQ ID NO: 17122 - DNA, 20 bp, Artificial Sequence
  Synthetic oligonucleotide; AGG chr11 5297824 5297843 5297840 +
aggctggggtgagctataag

SEQ ID NO: 17123 - DNA, 20 bp, Artificial Sequence
  Synthetic oligonucleotide; GAG chr11 5297826 5297845 5297842 +
gctggggtgagctataagag

SEQ ID NO: 17124 - DNA, 20 bp, Artificial Sequence
  Synthetic oligonucleotide; AAG chr11 5297831 5297850 5297847 +
ggtgagctataagaggagtc

SEQ ID NO: 17125 - DNA, 20 bp, Artificial Sequence
  Synthetic oligonucleotide; AGG chr11 5297832 5297851 5297848 +
gtgagctataagaggagtca

SEQ ID NO: 17126 - DNA, 20 bp, Artificial Sequence
  Synthetic oligonucleotide; CAG chr11 5297840 5297859 5297856 +
taagaggagtcaaggctaat

SEQ ID NO: 17127 - DNA, 20 bp, Artificial Sequence
  Synthetic oligonucleotide; CAG chr11 5297845 5297864 5297861 +
ggagtcaaggctaatcagta

SEQ ID NO: 17128 - DNA, 20 bp, Artificial Sequence
  Synthetic oligonucleotide; AAG chr11 5297849 5297868 5297865 +
tcaaggctaatcagtacagc

SEQ ID NO: 17129 - DNA, 20 bp, Artificial Sequence
  Synthetic oligonucleotide; GAG chr11 5297851 5297870 5297867 +
aaggctaatcagtacagcaa

SEQ ID NO: 17130 - DNA, 20 bp, Artificial Sequence
  Synthetic oligonucleotide; AGG chr11 5297852 5297871 5297868 +
aggctaatcagtacagcaag

SEQ ID NO: 17131 - DNA, 20 bp, Artificial Sequence
  Synthetic oligonucleotide; AAG chr11 5297862 5297881 5297878 +
gtacagcaagaggaatgaat

SEQ ID NO: 17132 - DNA, 20 bp, Artificial Sequence
  Synthetic oligonucleotide; AAG chr11 5297865 5297884 5297881 +
cagcaagaggaatgaataag

SEQ ID NO: 17133 - DNA, 20 bp, Artificial Sequence
  Synthetic oligonucleotide; TAG chr11 5297869 5297888 5297885 +
aagaggaatgaataagaagc

SEQ ID NO: 17134 - DNA, 20 bp, Artificial Sequence
  Synthetic oligonucleotide; AAG chr11 5297875 5297894 5297891 +
aatgaataagaagctagata

SEQ ID NO: 17135 - DNA, 20 bp, Artificial Sequence
  Synthetic oligonucleotide; AGG chr11 5297876 5297895 5297892 +
atgaataagaagctagataa

SEQ ID NO: 17136 - DNA, 20 bp, Artificial Sequence
  Synthetic oligonucleotide; GGG chr11 5297877 5297896 5297893 +
tgaataagaagctagataaa

SEQ ID NO: 17137 - DNA, 20 bp, Artificial Sequence
  Synthetic oligonucleotide; CGG chr11 5297882 5297901 5297898 +
aagaagctagataaagggaa

SEQ ID NO: 17138 - DNA, 20 bp, Artificial Sequence
  Synthetic oligonucleotide; TGG chr11 5297887 5297906 5297903 +
gctagataaagggaacggcg

SEQ ID NO: 17139 - DNA, 20 bp, Artificial Sequence
  Synthetic oligonucleotide; GGG chr11 5297888 5297907 5297904 +
ctagataaagggaacggcgt

SEQ ID NO: 17140 - DNA, 20 bp, Artificial Sequence
  Synthetic oligonucleotide; GAG chr11 5297890 5297909 5297906 +
agataaagggaacggcgtgg

SEQ ID NO: 17141 - DNA, 20 bp, Artificial Sequence
  Synthetic oligonucleotide; AGG chr11 5297891 5297910 5297907 +
gataaagggaacggcgtggg

SEQ ID NO: 17142 - DNA, 20 bp, Artificial Sequence
  Synthetic oligonucleotide; GGG chr11 5297892 5297911 5297908 +
ataaagggaacggcgtggga

SEQ ID NO: 17143 - DNA, 20 bp, Artificial Sequence
  Synthetic oligonucleotide; GAG chr11 5297903 5297922 5297919 +
ggcgtgggagggtgtttcct

SEQ ID NO: 17144 - DNA, 20 bp, Artificial Sequence
  Synthetic oligonucleotide; AGG chr11 5297904 5297923 5297920 +
gcgtgggagggtgtttcctg

SEQ ID NO: 17145 - DNA, 20 bp, Artificial Sequence
  Synthetic oligonucleotide; GGG chr11 5297905 5297924 5297921 +
cgtgggagggtgtttcctga

SEQ ID NO: 17146 - DNA, 20 bp, Artificial Sequence
  Synthetic oligonucleotide; GAG chr11 5297917 5297936 5297933 +
tttcctgagggaatattcat

SEQ ID NO: 17147 - DNA, 20 bp, Artificial Sequence
  Synthetic oligonucleotide; CAG chr11 5297925 5297944 5297941 +
gggaatattcatgagacaaa

SEQ ID NO: 17148 - DNA, 20 bp, Artificial Sequence
  Synthetic oligonucleotide; GAG chr11 5297927 5297946 5297943 +
gaatattcatgagacaaaca

SEQ ID NO: 17149 - DNA, 20 bp, Artificial Sequence
  Synthetic oligonucleotide; AAG chr11 5297934 5297953 5297950 +
catgagacaaacagagaata

SEQ ID NO: 17150 - DNA, 20 bp, Artificial Sequence
  Synthetic oligonucleotide; AAG chr11 5297942 5297961 5297958 +
aaacagagaataaagaaatg

SEQ ID NO: 17151 - DNA, 20 bp, Artificial Sequence
  Synthetic oligonucleotide; AGG chr11 5297943 5297962 5297959 +
aacagagaataaagaaatga

SEQ ID NO: 17152 - DNA, 20 bp, Artificial Sequence
  Synthetic oligonucleotide; GGG chr11 5297944 5297963 5297960 +
acagagaataaagaaatgaa

SEQ ID NO: 17153 - DNA, 20 bp, Artificial Sequence
  Synthetic oligonucleotide; TAG chr11 5297962 5297981 5297978 +
aagggaatgtaaatataata

SEQ ID NO: 17154 - DNA, 20 bp, Artificial Sequence
  Synthetic oligonucleotide; AGG chr11 5297963 5297982 5297979 +
agggaatgtaaatataatat

SEQ ID NO: 17155 - DNA, 20 bp, Artificial Sequence
  Synthetic oligonucleotide; AAG chr11 5297979 5297998 5297995 +
atataggcatgttaatatac

SEQ ID NO: 17156 - DNA, 20 bp, Artificial Sequence
  Synthetic oligonucleotide; TAG chr11 5297989 5298008 5298005 +
gttaatatacaagtgatttc

SEQ ID NO: 17157 - DNA, 20 bp, Artificial Sequence
  Synthetic oligonucleotide; AAG chr11 5297993 5298012 5298009 +
atatacaagtgatttctaga

SEQ ID NO: 17158 - DNA, 20 bp, Artificial Sequence
  Synthetic oligonucleotide; AAG chr11 5298005 5298024 5298021 +
tttctagaaagtgcatgaat

SEQ ID NO: 17159 - DNA, 20 bp, Artificial Sequence
  Synthetic oligonucleotide; CAG chr11 5298009 5298028 5298025 +
tagaaagtgcatgaataaga

SEQ ID NO: 17160 - DNA, 20 bp, Artificial Sequence
  Synthetic oligonucleotide; TAG chr11 5298013 5298032 5298029 +
aagtgcatgaataagacagc

SEQ ID NO: 17161 - DNA, 20 bp, Artificial Sequence
  Synthetic oligonucleotide; AAG chr11 5298017 5298036 5298033 +
gcatgaataagacagctaga

SEQ ID NO: 17162 - DNA, 20 bp, Artificial Sequence
  Synthetic oligonucleotide; TAG chr11 5298021 5298040 5298037 +
gaataagacagctagaaaga

SEQ ID NO: 17163 - DNA, 20 bp, Artificial Sequence
  Synthetic oligonucleotide; AAG chr11 5298025 5298044 5298041 +
aagacagctagaaagataga

SEQ ID NO: 17164 - DNA, 20 bp, Artificial Sequence
  Synthetic oligonucleotide; TGG chr11 5298031 5298050 5298047 +
gctagaaagatagaaagacc

SEQ ID NO: 17165 - DNA, 20 bp, Artificial Sequence
  Synthetic oligonucleotide; CAG chr11 5298056 5298075 5298072 +
cttaaaatgtgaatgtgaaa

SEQ ID NO: 17166 - DNA, 20 bp, Artificial Sequence
  Synthetic oligonucleotide; TGG chr11 5298062 5298081 5298078 +
atgtgaatgtgaaacagttc

SEQ ID NO: 17167 - DNA, 20 bp, Artificial Sequence
  Synthetic oligonucleotide; GAG chr11 5298067 5298086 5298083 +
aatgtgaaacagttctggct

SEQ ID NO: 17168 - DNA, 20 bp, Artificial Sequence
  Synthetic oligonucleotide; GAG chr11 5298069 5298088 5298085 +
tgtgaaacagttctggctga

SEQ ID NO: 17169 - DNA, 20 bp, Artificial Sequence
  Synthetic oligonucleotide; CAG chr11 5298080 5298099 5298096 +
tctggctgagagaaatatct

SEQ ID NO: 17170 - DNA, 20 bp, Artificial Sequence
  Synthetic oligonucleotide; AGG chr11 5298081 5298100 5298097 +
ctggctgagagaaatatctc

SEQ ID NO: 17171 - DNA, 20 bp, Artificial Sequence
  Synthetic oligonucleotide; TGG chr11 5298086 5298105 5298102 +
tgagagaaatatctcaggaa

SEQ ID NO: 17172 - DNA, 20 bp, Artificial Sequence
  Synthetic oligonucleotide; CAG chr11 5298097 5298116 5298113 +
tctcaggaatggccatgttc

SEQ ID NO: 17173 - DNA, 20 bp, Artificial Sequence
  Synthetic oligonucleotide; AGG chr11 5298098 5298117 5298114 +
ctcaggaatggccatgttcc

SEQ ID NO: 17174 - DNA, 20 bp, Artificial Sequence
  Synthetic oligonucleotide; CAG chr11 5298104 5298123 5298120 +
aatggccatgttccaggctt

SEQ ID NO: 17175 - DNA, 20 bp, Artificial Sequence
  Synthetic oligonucleotide; AGG chr11 5298105 5298124 5298121 +
atggccatgttccaggcttc

SEQ ID NO: 17176 - DNA, 20 bp, Artificial Sequence
  Synthetic oligonucleotide; GGG chr11 5298106 5298125 5298122 +
tggccatgttccaggcttca

SEQ ID NO: 17177 - DNA, 20 bp, Artificial Sequence
  Synthetic oligonucleotide; TAG chr11 5298109 5298128 5298125 +
ccatgttccaggcttcaggg

SEQ ID NO: 17178 - DNA, 20 bp, Artificial Sequence
  Synthetic oligonucleotide; AGG chr11 5298110 5298129 5298126 +
catgttccaggcttcagggt

SEQ ID NO: 17179 - DNA, 20 bp, Artificial Sequence
  Synthetic oligonucleotide; CAG chr11 5298121 5298140 5298137 +
cttcagggtaggacccatgc

SEQ ID NO: 17180 - DNA, 20 bp, Artificial Sequence
  Synthetic oligonucleotide; AGG chr11 5298122 5298141 5298138 +
ttcagggtaggacccatgcc

SEQ ID NO: 17181 - DNA, 20 bp, Artificial Sequence
  Synthetic oligonucleotide; GGG chr11 5298123 5298142 5298139 +
tcagggtaggacccatgcca

SEQ ID NO: 17182 - DNA, 20 bp, Artificial Sequence
  Synthetic oligonucleotide; TAG chr11 5298174 5298193 5298190 +
ctgcctcctgtccctatcat

SEQ ID NO: 17183 - DNA, 20 bp, Artificial Sequence
  Synthetic oligonucleotide; AGG chr11 5298175 5298194 5298191 +
tgcctcctgtccctatcatt

SEQ ID NO: 17184 - DNA, 20 bp, Artificial Sequence
  Synthetic oligonucleotide; GAG chr11 5298177 5298196 5298193 +
cctcctgtccctatcattag

SEQ ID NO: 17185 - DNA, 20 bp, Artificial Sequence
  Synthetic oligonucleotide; AGG chr11 5298178 5298197 5298194 +
ctcctgtccctatcattagg

SEQ ID NO: 17186 - DNA, 20 bp, Artificial Sequence
  Synthetic oligonucleotide; CAG chr11 5298182 5298201 5298198 +
tgtccctatcattaggaggc

SEQ ID NO: 17187 - DNA, 20 bp, Artificial Sequence
  Synthetic oligonucleotide; AGG chr11 5298183 5298202 5298199 +
gtccctatcattaggaggcc

SEQ ID NO: 17188 - DNA, 20 bp, Artificial Sequence
  Synthetic oligonucleotide; GGG chr11 5298184 5298203 5298200 +
tccctatcattaggaggcca

SEQ ID NO: 17189 - DNA, 20 bp, Artificial Sequence
  Synthetic oligonucleotide; TGG chr11 5298187 5298206 5298203 +
ctatcattaggaggccaggg

SEQ ID NO: 17190 - DNA, 20 bp, Artificial Sequence
  Synthetic oligonucleotide; GGG chr11 5298188 5298207 5298204 +
tatcattaggaggccagggt

SEQ ID NO: 17191 - DNA, 20 bp, Artificial Sequence
  Synthetic oligonucleotide; GAG chr11 5298190 5298209 5298206 +
tcattaggaggccagggtgg

SEQ ID NO: 17192 - DNA, 20 bp, Artificial Sequence
  Synthetic oligonucleotide; AGG chr11 5298191 5298210 5298207 +
cattaggaggccagggtggg

SEQ ID NO: 17193 - DNA, 20 bp, Artificial Sequence
  Synthetic oligonucleotide; GAG chr11 5298201 5298220 5298217 +
ccagggtgggaggattgctt

SEQ ID NO: 17194 - DNA, 20 bp, Artificial Sequence
  Synthetic oligonucleotide; AGG chr11 5298202 5298221 5298218 +
cagggtgggaggattgcttg

SEQ ID NO: 17195 - DNA, 20 bp, Artificial Sequence
  Synthetic oligonucleotide; TAG chr11 5298206 5298225 5298222 +
gtgggaggattgcttgaggt

SEQ ID NO: 17196 - DNA, 20 bp, Artificial Sequence
  Synthetic oligonucleotide; AGG chr11 5298207 5298226 5298223 +
tgggaggattgcttgaggtt

SEQ ID NO: 17197 - DNA, 20 bp, Artificial Sequence
  Synthetic oligonucleotide; TGG chr11 5298213 5298232 5298229 +
gattgcttgaggttaggaat

SEQ ID NO: 17198 - DNA, 20 bp, Artificial Sequence
  Synthetic oligonucleotide; GAG chr11 5298215 5298234 5298231 +
ttgcttgaggttaggaattg

SEQ ID NO: 17199 - DNA, 20 bp, Artificial Sequence
  Synthetic oligonucleotide; GAG chr11 5298217 5298236 5298233 +
gcttgaggttaggaattgga

SEQ ID NO: 17200 - DNA, 20 bp, Artificial Sequence
  Synthetic oligonucleotide; CAG chr11 5298220 5298239 5298236 +
tgaggttaggaattggagag

SEQ ID NO: 17201 - DNA, 20 bp, Artificial Sequence
  Synthetic oligonucleotide; CGG chr11 5298226 5298245 5298242 +
taggaattggagagcagcct

SEQ ID NO: 17202 - DNA, 20 bp, Artificial Sequence
  Synthetic oligonucleotide; TAG chr11 5298269 5298288 5298285 +
tttacaaaaaataaaaacat

SEQ ID NO: 17203 - DNA, 20 bp, Artificial Sequence
  Synthetic oligonucleotide; TAG chr11 5298273 5298292 5298289 +
caaaaaataaaaacattagc

SEQ ID NO: 17204 - DNA, 20 bp, Artificial Sequence
  Synthetic oligonucleotide; AGG chr11 5298274 5298293 5298290 +
aaaaaataaaaacattagct

SEQ ID NO: 17205 - DNA, 20 bp, Artificial Sequence
  Synthetic oligonucleotide; CAG chr11 5298279 5298298 5298295 +
ataaaaacattagctaggtg

SEQ ID NO: 17206 - DNA, 20 bp, Artificial Sequence
  Synthetic oligonucleotide; TGG chr11 5298282 5298301 5298298 +
aaaacattagctaggtgcag

SEQ ID NO: 17207 - DNA, 20 bp, Artificial Sequence
  Synthetic oligonucleotide; TAG chr11 5298295 5298314 5298311 +
ggtgcagtggcataaacctg

SEQ ID NO: 17208 - DNA, 20 bp, Artificial Sequence
  Synthetic oligonucleotide; TAG chr11 5298301 5298320 5298317 +
gtggcataaacctgtagtcc

SEQ ID NO: 17209 - DNA, 20 bp, Artificial Sequence
  Synthetic oligonucleotide; AGG chr11 5298302 5298321 5298318 +
tggcataaacctgtagtcct

SEQ ID NO: 17210 - DNA, 20 bp, Artificial Sequence
  Synthetic oligonucleotide; AAG chr11 5298313 5298332 5298329 +
tgtagtcctaggtactcaaa

SEQ ID NO: 17211 - DNA, 20 bp, Artificial Sequence
  Synthetic oligonucleotide; GAG chr11 5298318 5298337 5298334 +
tcctaggtactcaaaaagct

SEQ ID NO: 17212 - DNA, 20 bp, Artificial Sequence
  Synthetic oligonucleotide; AGG chr11 5298319 5298338 5298335 +
cctaggtactcaaaaagctg

SEQ ID NO: 17213 - DNA, 20 bp, Artificial Sequence
  Synthetic oligonucleotide; AAG chr11 5298322 5298341 5298338 +
aggtactcaaaaagctgagg

SEQ ID NO: 17214 - DNA, 20 bp, Artificial Sequence
  Synthetic oligonucleotide; AAG chr11 5298325 5298344 5298341 +
tactcaaaaagctgaggaag

SEQ ID NO: 17215 - DNA, 20 bp, Artificial Sequence
  Synthetic oligonucleotide; AGG chr11 5298326 5298345 5298342 +
actcaaaaagctgaggaaga

SEQ ID NO: 17216 - DNA, 20 bp, Artificial Sequence
  Synthetic oligonucleotide; GAG chr11 5298336 5298355 5298352 +
ctgaggaagaaggattgctt

SEQ ID NO: 17217 - DNA, 20 bp, Artificial Sequence
  Synthetic oligonucleotide; CAG chr11 5298341 5298360 5298357 +
gaagaaggattgcttgagcc

SEQ ID NO: 17218 - DNA, 20 bp, Artificial Sequence
  Synthetic oligonucleotide; AGG chr11 5298342 5298361 5298358 +
aagaaggattgcttgagccc

SEQ ID NO: 17219 - DNA, 20 bp, Artificial Sequence
  Synthetic oligonucleotide; AAG chr11 5298350 5298369 5298366 +
ttgcttgagcccaggatttc

SEQ ID NO: 17220 - DNA, 20 bp, Artificial Sequence
  Synthetic oligonucleotide; AGG chr11 5298351 5298370 5298367 +
tgcttgagcccaggatttca

SEQ ID NO: 17221 - DNA, 20 bp, Artificial Sequence
  Synthetic oligonucleotide; CAG chr11 5298357 5298376 5298373 +
agcccaggatttcaaggctg

SEQ ID NO: 17222 - DNA, 20 bp, Artificial Sequence
  Synthetic oligonucleotide; GAG chr11 5298361 5298380 5298377 +
caggatttcaaggctgcagt

SEQ ID NO: 17223 - DNA, 20 bp, Artificial Sequence
  Synthetic oligonucleotide; TGG chr11 5298370 5298389 5298386 +
aaggctgcagtgagctgtga

SEQ ID NO: 17224 - DNA, 20 bp, Artificial Sequence
  Synthetic oligonucleotide; CAG chr11 5298386 5298405 5298402 +
gtgatggcaccactgcactc

SEQ ID NO: 17225 - DNA, 20 bp, Artificial Sequence
  Synthetic oligonucleotide; TGG chr11 5298391 5298410 5298407 +
ggcaccactgcactccagcc

SEQ ID NO: 17226 - DNA, 20 bp, Artificial Sequence
  Synthetic oligonucleotide; GGG chr11 5298392 5298411 5298408 +
gcaccactgcactccagcct

SEQ ID NO: 17227 - DNA, 20 bp, Artificial Sequence
  Synthetic oligonucleotide; CAG chr11 5298398 5298417 5298414 +
ctgcactccagcctgggcaa

SEQ ID NO: 17228 - DNA, 20 bp, Artificial Sequence
  Synthetic oligonucleotide; GAG chr11 5298400 5298419 5298416 +
gcactccagcctgggcaaca

SEQ ID NO: 17229 - DNA, 20 bp, Artificial Sequence
  Synthetic oligonucleotide; AAG chr11 5298404 5298423 5298420 +
tccagcctgggcaacagagc

SEQ ID NO: 17230 - DNA, 20 bp, Artificial Sequence
  Synthetic oligonucleotide; AAG chr11 5298444 5298463 5298460 +
aaataaataaataaataaat

SEQ ID NO: 17231 - DNA, 20 bp, Artificial Sequence
  Synthetic oligonucleotide; TAG chr11 5298450 5298469 5298466 +
ataaataaataaataagctt

SEQ ID NO: 17232 - DNA, 20 bp, Artificial Sequence
  Synthetic oligonucleotide; CAG chr11 5298459 5298478 5298475 +
taaataagctttagccacac

SEQ ID NO: 17233 - DNA, 20 bp, Artificial Sequence
  Synthetic oligonucleotide; AAG chr11 5298464 5298483 5298480 +
aagctttagccacaccagac

SEQ ID NO: 17234 - DNA, 20 bp, Artificial Sequence
  Synthetic oligonucleotide; AAG chr11 5298485 5298504 5298501 +
agtaacattgtgtattttta

SEQ ID NO: 17235 - DNA, 20 bp, Artificial Sequence
  Synthetic oligonucleotide; AGG chr11 5298486 5298505 5298502 +
gtaacattgtgtatttttaa

SEQ ID NO: 17236 - DNA, 20 bp, Artificial Sequence
  Synthetic oligonucleotide; TGG chr11 5298505 5298524 5298521 +
aaggactgcattaataaatt

SEQ ID NO: 17237 - DNA, 20 bp, Artificial Sequence
  Synthetic oligonucleotide; GGG chr11 5298506 5298525 5298522 +
aggactgcattaataaattt

SEQ ID NO: 17238 - DNA, 20 bp, Artificial Sequence
  Synthetic oligonucleotide; GGG chr11 5298507 5298526 5298523 +
ggactgcattaataaatttg

SEQ ID NO: 17239 - DNA, 20 bp, Artificial Sequence
  Synthetic oligonucleotide; GGG chr11 5298508 5298527 5298524 +
gactgcattaataaatttgg

SEQ ID NO: 17240 - DNA, 20 bp, Artificial Sequence
  Synthetic oligonucleotide; CAG chr11 5298515 5298534 5298531 +
ttaataaatttgggggttta

SEQ ID NO: 17241 - DNA, 20 bp, Artificial Sequence
  Synthetic oligonucleotide; TGG chr11 5298520 5298539 5298536 +
aaatttgggggtttacagaa

SEQ ID NO: 17242 - DNA, 20 bp, Artificial Sequence
  Synthetic oligonucleotide; CAG chr11 5298523 5298542 5298539 +
tttgggggtttacagaatgg

SEQ ID NO: 17243 - DNA, 20 bp, Artificial Sequence
  Synthetic oligonucleotide; AGG chr11 5298524 5298543 5298540 +
ttgggggtttacagaatggc

SEQ ID NO: 17244 - DNA, 20 bp, Artificial Sequence
  Synthetic oligonucleotide; TAG chr11 5298527 5298546 5298543 +
ggggtttacagaatggcagg

SEQ ID NO: 17245 - DNA, 20 bp, Artificial Sequence
  Synthetic oligonucleotide; TGG chr11 5298537 5298556 5298553 +
gaatggcaggtagttatcct

SEQ ID NO: 17246 - DNA, 20 bp, Artificial Sequence
  Synthetic oligonucleotide; GGG chr11 5298538 5298557 5298554 +
aatggcaggtagttatcctt

SEQ ID NO: 17247 - DNA, 20 bp, Artificial Sequence
  Synthetic oligonucleotide; AAG chr11 5298541 5298560 5298557 +
ggcaggtagttatccttggg

SEQ ID NO: 17248 - DNA, 20 bp, Artificial Sequence
  Synthetic oligonucleotide; TGG chr11 5298556 5298575 5298572 +
ttgggaagacaatatgctga

SEQ ID NO: 17249 - DNA, 20 bp, Artificial Sequence
  Synthetic oligonucleotide; GGG chr11 5298557 5298576 5298573 +
tgggaagacaatatgctgat

SEQ ID NO: 17250 - DNA, 20 bp, Artificial Sequence
  Synthetic oligonucleotide; GGG chr11 5298558 5298577 5298574 +
gggaagacaatatgctgatg

SEQ ID NO: 17251 - DNA, 20 bp, Artificial Sequence
  Synthetic oligonucleotide; CAG chr11 5298590 5298609 5298606 +
tactgccctgactaaactca

SEQ ID NO: 17252 - DNA, 20 bp, Artificial Sequence
  Synthetic oligonucleotide; CAG chr11 5298598 5298617 5298614 +
tgactaaactcacagtatga

SEQ ID NO: 17253 - DNA, 20 bp, Artificial Sequence
  Synthetic oligonucleotide; GAG chr11 5298600 5298619 5298616 +
actaaactcacagtatgaca

SEQ ID NO: 17254 - DNA, 20 bp, Artificial Sequence
  Synthetic oligonucleotide; CAG chr11 5298631 5298650 5298647 +
gtgctgacttgataattcct

SEQ ID NO: 17255 - DNA, 20 bp, Artificial Sequence
  Synthetic oligonucleotide; GAG chr11 5298633 5298652 5298649 +
gctgacttgataattcctca

SEQ ID NO: 17256 - DNA, 20 bp, Artificial Sequence
  Synthetic oligonucleotide; CAG chr11 5298636 5298655 5298652 +
gacttgataattcctcagag

SEQ ID NO: 17257 - DNA, 20 bp, Artificial Sequence
  Synthetic oligonucleotide; AAG chr11 5298645 5298664 5298661 +
attcctcagagcagatctct

SEQ ID NO: 17258 - DNA, 20 bp, Artificial Sequence
  Synthetic oligonucleotide; GAG chr11 5298647 5298666 5298663 +
tcctcagagcagatctctaa

SEQ ID NO: 17259 - DNA, 20 bp, Artificial Sequence
  Synthetic oligonucleotide; GAG chr11 5298649 5298668 5298665 +
ctcagagcagatctctaaga

SEQ ID NO: 17260 - DNA, 20 bp, Artificial Sequence
  Synthetic oligonucleotide; TAG chr11 5298656 5298675 5298672 +
cagatctctaagagagctta

SEQ ID NO: 17261 - DNA, 20 bp, Artificial Sequence
  Synthetic oligonucleotide; AAG chr11 5298677 5298696 5298693 +
agacacaacgcctgcttcac

SEQ ID NO: 17262 - DNA, 20 bp, Artificial Sequence
  Synthetic oligonucleotide; AGG chr11 5298678 5298697 5298694 +
gacacaacgcctgcttcaca

SEQ ID NO: 17263 - DNA, 20 bp, Artificial Sequence
  Synthetic oligonucleotide; AAG chr11 5298686 5298705 5298702 +
gcctgcttcacaaggttctc

SEQ ID NO: 17264 - DNA, 20 bp, Artificial Sequence
  Synthetic oligonucleotide; TGG chr11 5298691 5298710 5298707 +
cttcacaaggttctcaagta

SEQ ID NO: 17265 - DNA, 20 bp, Artificial Sequence
  Synthetic oligonucleotide; CAG chr11 5298703 5298722 5298719 +
ctcaagtatggcaaacttgt

SEQ ID NO: 17266 - DNA, 20 bp, Artificial Sequence
  Synthetic oligonucleotide; CAG chr11 5298707 5298726 5298723 +
agtatggcaaacttgtcagt

SEQ ID NO: 17267 - DNA, 20 bp, Artificial Sequence
  Synthetic oligonucleotide; AGG chr11 5298708 5298727 5298724 +
gtatggcaaacttgtcagtc

SEQ ID NO: 17268 - DNA, 20 bp, Artificial Sequence
  Synthetic oligonucleotide; GGG chr11 5298709 5298728 5298725 +
tatggcaaacttgtcagtca

SEQ ID NO: 17269 - DNA, 20 bp, Artificial Sequence
  Synthetic oligonucleotide; GAG chr11 5298713 5298732 5298729 +
gcaaacttgtcagtcagggt

SEQ ID NO: 17270 - DNA, 20 bp, Artificial Sequence
  Synthetic oligonucleotide; GAG chr11 5298719 5298738 5298735 +
ttgtcagtcagggtgagact

SEQ ID NO: 17271 - DNA, 20 bp, Artificial Sequence
  Synthetic oligonucleotide; AGG chr11 5298720 5298739 5298736 +
tgtcagtcagggtgagactg

SEQ ID NO: 17272 - DNA, 20 bp, Artificial Sequence
  Synthetic oligonucleotide; GAG chr11 5298725 5298744 5298741 +
gtcagggtgagactgaggat

SEQ ID NO: 17273 - DNA, 20 bp, Artificial Sequence
  Synthetic oligonucleotide; AGG chr11 5298726 5298745 5298742 +
tcagggtgagactgaggatg

SEQ ID NO: 17274 - DNA, 20 bp, Artificial Sequence
  Synthetic oligonucleotide; AAG chr11 5298732 5298751 5298748 +
tgagactgaggatgaggtct

SEQ ID NO: 17275 - DNA, 20 bp, Artificial Sequence
  Synthetic oligonucleotide; GAG chr11 5298734 5298753 5298750 +
agactgaggatgaggtctaa

SEQ ID NO: 17276 - DNA, 20 bp, Artificial Sequence
  Synthetic oligonucleotide; TGG chr11 5298744 5298763 5298760 +
tgaggtctaagagacttgtc

SEQ ID NO: 17277 - DNA, 20 bp, Artificial Sequence
  Synthetic oligonucleotide; AAG chr11 5298747 5298766 5298763 +
ggtctaagagacttgtctgg

SEQ ID NO: 17278 - DNA, 20 bp, Artificial Sequence
  Synthetic oligonucleotide; AAG chr11 5298764 5298783 5298780 +
tggaagctgcacttgtttga

SEQ ID NO: 17279 - DNA, 20 bp, Artificial Sequence
  Synthetic oligonucleotide; AGG chr11 5298765 5298784 5298781 +
ggaagctgcacttgtttgaa

SEQ ID NO: 17280 - DNA, 20 bp, Artificial Sequence
  Synthetic oligonucleotide; CAG chr11 5298783 5298802 5298799 +
aaaggacactgattttactt

SEQ ID NO: 17281 - DNA, 20 bp, Artificial Sequence
  Synthetic oligonucleotide; TGG chr11 5298786 5298805 5298802 +
ggacactgattttacttcag

SEQ ID NO: 17282 - DNA, 20 bp, Artificial Sequence
  Synthetic oligonucleotide; TGG chr11 5298814 5298833 5298830 +
taaatgtccttatatatcac

SEQ ID NO: 17283 - DNA, 20 bp, Artificial Sequence
  Synthetic oligonucleotide; CAG chr11 5298819 5298838 5298835 +
gtccttatatatcactggat

SEQ ID NO: 17284 - DNA, 20 bp, Artificial Sequence
  Synthetic oligonucleotide; CAG chr11 5298822 5298841 5298838 +
cttatatatcactggatcag

SEQ ID NO: 17285 - DNA, 20 bp, Artificial Sequence
  Synthetic oligonucleotide; AGG chr11 5298823 5298842 5298839 +
ttatatatcactggatcagc

SEQ ID NO: 17286 - DNA, 20 bp, Artificial Sequence
  Synthetic oligonucleotide; TGG chr11 5298826 5298845 5298842 +
tatatcactggatcagcagg

SEQ ID NO: 17287 - DNA, 20 bp, Artificial Sequence
  Synthetic oligonucleotide; AAG chr11 5298848 5298867 5298864 +
gatgctgacttaataattga

SEQ ID NO: 17288 - DNA, 20 bp, Artificial Sequence
  Synthetic oligonucleotide; AGG chr11 5298849 5298868 5298865 +
atgctgacttaataattgaa

SEQ ID NO: 17289 - DNA, 20 bp, Artificial Sequence
  Synthetic oligonucleotide; AAG chr11 5298863 5298882 5298879 +
attgaaaggattttcaaact

SEQ ID NO: 17290 - DNA, 20 bp, Artificial Sequence
  Synthetic oligonucleotide; AAG chr11 5298866 5298885 5298882 +
gaaaggattttcaaactaag

SEQ ID NO: 17291 - DNA, 20 bp, Artificial Sequence
  Synthetic oligonucleotide; TAG chr11 5298886 5298905 5298902 +
aagttgtaaaatataatata

SEQ ID NO: 17292 - DNA, 20 bp, Artificial Sequence
  Synthetic oligonucleotide; AGG chr11 5298887 5298906 5298903 +
agttgtaaaatataatatat

SEQ ID NO: 17293 - DNA, 20 bp, Artificial Sequence
  Synthetic oligonucleotide; AAG chr11 5298935 5298954 5298951 +
gcataaatatacatttactt

SEQ ID NO: 17294 - DNA, 20 bp, Artificial Sequence
  Synthetic oligonucleotide; GAG chr11 5298943 5298962 5298959 +
atacatttacttaagaaaat

SEQ ID NO: 17295 - DNA, 20 bp, Artificial Sequence
  Synthetic oligonucleotide; CAG chr11 5298992 5299011 5299008 +
ttgatttttgactattgata

SEQ ID NO: 17296 - DNA, 20 bp, Artificial Sequence
  Synthetic oligonucleotide; AGG chr11 5298993 5299012 5299009 +
tgatttttgactattgatac

SEQ ID NO: 17297 - DNA, 20 bp, Artificial Sequence
  Synthetic oligonucleotide; AAG chr11 5299003 5299022 5299019 +
ctattgatacaggctgttta

SEQ ID NO: 17298 - DNA, 20 bp, Artificial Sequence
  Synthetic oligonucleotide; TAG chr11 5299011 5299030 5299027 +
acaggctgtttaaagatcaa

SEQ ID NO: 17299 - DNA, 20 bp, Artificial Sequence
  Synthetic oligonucleotide; AGG chr11 5299012 5299031 5299028 +
caggctgtttaaagatcaat

SEQ ID NO: 17300 - DNA, 20 bp, Artificial Sequence
  Synthetic oligonucleotide; GAG chr11 5299052 5299071 5299068 +
gtcatcccttgctaacatat

SEQ ID NO: 17301 - DNA, 20 bp, Artificial Sequence
  Synthetic oligonucleotide; GAG chr11 5299062 5299081 5299078 +
gctaacatatgagtaaactt

SEQ ID NO: 17302 - DNA, 20 bp, Artificial Sequence
  Synthetic oligonucleotide; TAG chr11 5299103 5299122 5299119 +
cacttcttcttatttataat

SEQ ID NO: 17303 - DNA, 20 bp, Artificial Sequence
  Synthetic oligonucleotide; TAG chr11 5299120 5299139 5299136 +
aattagatacctctgtttct

SEQ ID NO: 17304 - DNA, 20 bp, Artificial Sequence
  Synthetic oligonucleotide; CAG chr11 5299146 5299165 5299162 +
tcgctatcataccttatttt

SEQ ID NO: 17305 - DNA, 20 bp, Artificial Sequence
  Synthetic oligonucleotide; AAG chr11 5299161 5299180 5299177 +
attttcagcacatcgcccct

SEQ ID NO: 17306 - DNA, 20 bp, Artificial Sequence
  Synthetic oligonucleotide; TAG chr11 5299191 5299210 5299207 +
tacacatttacacattgttg

SEQ ID NO: 17307 - DNA, 20 bp, Artificial Sequence
  Synthetic oligonucleotide; AGG chr11 5299192 5299211 5299208 +
acacatttacacattgttgt

SEQ ID NO: 17308 - DNA, 20 bp, Artificial Sequence
  Synthetic oligonucleotide; AAG chr11 5299214 5299233 5299230 +
gctgtcttcttataacaatc

SEQ ID NO: 17309 - DNA, 20 bp, Artificial Sequence
  Synthetic oligonucleotide; CAG chr11 5299221 5299240 5299237 +
tcttataacaatcaagaaaa

SEQ ID NO: 17310 - DNA, 20 bp, Artificial Sequence
  Synthetic oligonucleotide; CAG chr11 5299318 5299337 5299334 +
cgctatgttttttactctta

SEQ ID NO: 17311 - DNA, 20 bp, Artificial Sequence
  Synthetic oligonucleotide; CAG chr11 5299330 5299349 5299346 +
tactcttacagacatccttt

SEQ ID NO: 17312 - DNA, 20 bp, Artificial Sequence
  Synthetic oligonucleotide; TGG chr11 5299333 5299352 5299349 +
tcttacagacatcctttcag

SEQ ID NO: 17313 - DNA, 20 bp, Artificial Sequence
  Synthetic oligonucleotide; TAG chr11 5299340 5299359 5299356 +
gacatcctttcagtggtcaa

SEQ ID NO: 17314 - DNA, 20 bp, Artificial Sequence
  Synthetic oligonucleotide; GAG chr11 5299342 5299361 5299358 +
catcctttcagtggtcaata

SEQ ID NO: 17315 - DNA, 20 bp, Artificial Sequence
  Synthetic oligonucleotide; CAG chr11 5299348 5299367 5299364 +
ttcagtggtcaatagagatg

SEQ ID NO: 17316 - DNA, 20 bp, Artificial Sequence
  Synthetic oligonucleotide; TAG chr11 5299363 5299382 5299379 +
agatgcagctttcctaaatg

SEQ ID NO: 17317 - DNA, 20 bp, Artificial Sequence
  Synthetic oligonucleotide; TAG chr11 5299375 5299394 5299391 +
cctaaatgtagtttgtatgt

SEQ ID NO: 17318 - DNA, 20 bp, Artificial Sequence
  Synthetic oligonucleotide; TAG chr11 5299392 5299411 5299408 +
tgttagcacaatgtgcattt

SEQ ID NO: 17319 - DNA, 20 bp, Artificial Sequence
  Synthetic oligonucleotide; AAG chr11 5299406 5299425 5299422 +
gcattttagaccaaacaaca

SEQ ID NO: 17320 - DNA, 20 bp, Artificial Sequence
  Synthetic oligonucleotide; AGG chr11 5299407 5299426 5299423 +
cattttagaccaaacaacaa

SEQ ID NO: 17321 - DNA, 20 bp, Artificial Sequence
  Synthetic oligonucleotide; CAG chr11 5299414 5299433 5299430 +
gaccaaacaacaaaggcaac

SEQ ID NO: 17322 - DNA, 20 bp, Artificial Sequence
  Synthetic oligonucleotide; TAG chr11 5299434 5299453 5299450 +
cagaaaacgacgtttctaaa

SEQ ID NO: 17323 - DNA, 20 bp, Artificial Sequence
  Synthetic oligonucleotide; TGG chr11 5299459 5299478 5299475 +
taaactctgtatgccaactt

SEQ ID NO: 17324 - DNA, 20 bp, Artificial Sequence
  Synthetic oligonucleotide; CAG chr11 5299486 5299505 5299502 +
acaaataaataaattttaca

SEQ ID NO: 17325 - DNA, 20 bp, Artificial Sequence
  Synthetic oligonucleotide; GAG chr11 5299488 5299507 5299504 +
aaataaataaattttacaca

SEQ ID NO: 17326 - DNA, 20 bp, Artificial Sequence
  Synthetic oligonucleotide; AAG chr11 5299539 5299558 5299555 +
ccccccacgtcctactttca

SEQ ID NO: 17327 - DNA, 20 bp, Artificial Sequence
  Synthetic oligonucleotide; CAG chr11 5299579 5299598 5299595 +
cgcacaataactgaatcctt

SEQ ID NO: 17328 - DNA, 20 bp, Artificial Sequence
  Synthetic oligonucleotide; AGG chr11 5299580 5299599 5299596 +
gcacaataactgaatccttc

SEQ ID NO: 17329 - DNA, 20 bp, Artificial Sequence
  Synthetic oligonucleotide; GAG chr11 5299582 5299601 5299598 +
acaataactgaatccttcag

SEQ ID NO: 17330 - DNA, 20 bp, Artificial Sequence
  Synthetic oligonucleotide; TAG chr11 5299585 5299604 5299601 +
ataactgaatccttcaggag

SEQ ID NO: 17331 - DNA, 20 bp, Artificial Sequence
  Synthetic oligonucleotide; TAG chr11 5299596 5299615 5299612 +
cttcaggagtagtcatttat

SEQ ID NO: 17332 - DNA, 20 bp, Artificial Sequence
  Synthetic oligonucleotide; TGG chr11 5299622 5299641 5299638 +
ttatttttcctgcatccaaa

SEQ ID NO: 17333 - DNA, 20 bp, Artificial Sequence
  Synthetic oligonucleotide; GGG chr11 5299623 5299642 5299639 +
tatttttcctgcatccaaat

SEQ ID NO: 17334 - DNA, 20 bp, Artificial Sequence
  Synthetic oligonucleotide; TGG chr11 5299636 5299655 5299652 +
tccaaatgggccttctaatt

SEQ ID NO: 17335 - DNA, 20 bp, Artificial Sequence
  Synthetic oligonucleotide; GAG chr11 5299638 5299657 5299654 +
caaatgggccttctaatttg

SEQ ID NO: 17336 - DNA, 20 bp, Artificial Sequence
  Synthetic oligonucleotide; TAG chr11 5299656 5299675 5299672 +
tggagaaatactgcattatt

SEQ ID NO: 17337 - DNA, 20 bp, Artificial Sequence
  Synthetic oligonucleotide; TAG chr11 5299662 5299681 5299678 +
aatactgcattatttagctt

SEQ ID NO: 17338 - DNA, 20 bp, Artificial Sequence
  Synthetic oligonucleotide; CAG chr11 5299669 5299688 5299685 +
cattatttagctttagtttt

SEQ ID NO: 17339 - DNA, 20 bp, Artificial Sequence
  Synthetic oligonucleotide; AAG chr11 5299673 5299692 5299689 +
atttagctttagttttcagt

SEQ ID NO: 17340 - DNA, 20 bp, Artificial Sequence
  Synthetic oligonucleotide; TGG chr11 5299695 5299714 5299711 +
gtattttcttatcaaatctc

SEQ ID NO: 17341 - DNA, 20 bp, Artificial Sequence
  Synthetic oligonucleotide; CAG chr11 5299706 5299725 5299722 +
tcaaatctctggaatatttt

SEQ ID NO: 17342 - DNA, 20 bp, Artificial Sequence
  Synthetic oligonucleotide; GAG chr11 5299708 5299727 5299724 +
aaatctctggaatattttca

SEQ ID NO: 17343 - DNA, 20 bp, Artificial Sequence
  Synthetic oligonucleotide; CAG chr11 5299722 5299741 5299738 +
ttttcagagtgctcactgtc

SEQ ID NO: 17344 - DNA, 20 bp, Artificial Sequence
  Synthetic oligonucleotide; AAG chr11 5299742 5299761 5299758 +
cagatgtaaaataaatatga

SEQ ID NO: 17345 - DNA, 20 bp, Artificial Sequence
  Synthetic oligonucleotide; AAG chr11 5299752 5299771 5299768 +
ataaatatgaaagatttctt

SEQ ID NO: 17346 - DNA, 20 bp, Artificial Sequence
  Synthetic oligonucleotide; AAG chr11 5299757 5299776 5299773 +
tatgaaagatttcttaagtg

SEQ ID NO: 17347 - DNA, 20 bp, Artificial Sequence
  Synthetic oligonucleotide; CAG chr11 5299760 5299779 5299776 +
gaaagatttcttaagtgaag

SEQ ID NO: 17348 - DNA, 20 bp, Artificial Sequence
  Synthetic oligonucleotide; GAG chr11 5299762 5299781 5299778 +
aagatttcttaagtgaagca

SEQ ID NO: 17349 - DNA, 20 bp, Artificial Sequence
  Synthetic oligonucleotide; GAG chr11 5299764 5299783 5299780 +
gatttcttaagtgaagcaga

SEQ ID NO: 17350 - DNA, 20 bp, Artificial Sequence
  Synthetic oligonucleotide; TAG chr11 5299771 5299790 5299787 +
taagtgaagcagagagaatt

SEQ ID NO: 17351 - DNA, 20 bp, Artificial Sequence
  Synthetic oligonucleotide; TGG chr11 5299776 5299795 5299792 +
gaagcagagagaatttagaa

SEQ ID NO: 17352 - DNA, 20 bp, Artificial Sequence
  Synthetic oligonucleotide; TGG chr11 5299792 5299811 5299808 +
agaatggaataattatatac

SEQ ID NO: 17353 - DNA, 20 bp, Artificial Sequence
  Synthetic oligonucleotide; GGG chr11 5299793 5299812 5299809 +
gaatggaataattatatact

SEQ ID NO: 17354 - DNA, 20 bp, Artificial Sequence
  Synthetic oligonucleotide; TGG chr11 5299805 5299824 5299821 +
tatatactgggttctgaaca

SEQ ID NO: 17355 - DNA, 20 bp, Artificial Sequence
  Synthetic oligonucleotide; CAG chr11 5299817 5299836 5299833 +
tctgaacatggactttcaat

SEQ ID NO: 17356 - DNA, 20 bp, Artificial Sequence
  Synthetic oligonucleotide; AAG chr11 5299822 5299841 5299838 +
acatggactttcaatcagaa

SEQ ID NO: 17357 - DNA, 20 bp, Artificial Sequence
  Synthetic oligonucleotide; TAG chr11 5299832 5299851 5299848 +
tcaatcagaaaagaaaatat

SEQ ID NO: 17358 - DNA, 20 bp, Artificial Sequence
  Synthetic oligonucleotide; AAG chr11 5299835 5299854 5299851 +
atcagaaaagaaaatattag

SEQ ID NO: 17359 - DNA, 20 bp, Artificial Sequence
  Synthetic oligonucleotide; AAG chr11 5299839 5299858 5299855 +
gaaaagaaaatattagaagc

SEQ ID NO: 17360 - DNA, 20 bp, Artificial Sequence
  Synthetic oligonucleotide; GAG chr11 5299848 5299867 5299864 +
atattagaagcaagctcaac

SEQ ID NO: 17361 - DNA, 20 bp, Artificial Sequence
  Synthetic oligonucleotide; TGG chr11 5299862 5299881 5299878 +
ctcaacgagaacttaaaaat

SEQ ID NO: 17362 - DNA, 20 bp, Artificial Sequence
  Synthetic oligonucleotide; AAG chr11 5299865 5299884 5299881 +
aacgagaacttaaaaattgg

SEQ ID NO: 17363 - DNA, 20 bp, Artificial Sequence
  Synthetic oligonucleotide; CAG chr11 5299871 5299890 5299887 +
aacttaaaaattggaagaaa

SEQ ID NO: 17364 - DNA, 20 bp, Artificial Sequence
  Synthetic oligonucleotide; CAG chr11 5299874 5299893 5299890 +
ttaaaaattggaagaaacag

SEQ ID NO: 17365 - DNA, 20 bp, Artificial Sequence
  Synthetic oligonucleotide; CAG chr11 5299881 5299900 5299897 +
ttggaagaaacagcagtctt

SEQ ID NO: 17366 - DNA, 20 bp, Artificial Sequence
  Synthetic oligonucleotide; GAG chr11 5299883 5299902 5299899 +
ggaagaaacagcagtcttca

SEQ ID NO: 17367 - DNA, 20 bp, Artificial Sequence
  Synthetic oligonucleotide; GAG chr11 5299885 5299904 5299901 +
aagaaacagcagtcttcaga

SEQ ID NO: 17368 - DNA, 20 bp, Artificial Sequence
  Synthetic oligonucleotide; AGG chr11 5299886 5299905 5299902 +
agaaacagcagtcttcagag

SEQ ID NO: 17369 - DNA, 20 bp, Artificial Sequence
  Synthetic oligonucleotide; GAG chr11 5299905 5299924 5299921 +
gaggaatgaatgcaactttt

SEQ ID NO: 17370 - DNA, 20 bp, Artificial Sequence
  Synthetic oligonucleotide; TAG chr11 5299910 5299929 5299926 +
atgaatgcaacttttgagat

SEQ ID NO: 17371 - DNA, 20 bp, Artificial Sequence
  Synthetic oligonucleotide; AAG chr11 5299921 5299940 5299937 +
ttttgagattagtttcctat

SEQ ID NO: 17372 - DNA, 20 bp, Artificial Sequence
  Synthetic oligonucleotide; AGG chr11 5299922 5299941 5299938 +
tttgagattagtttcctata

SEQ ID NO: 17373 - DNA, 20 bp, Artificial Sequence
  Synthetic oligonucleotide; GAG chr11 5299924 5299943 5299940 +
tgagattagtttcctataag

SEQ ID NO: 17374 - DNA, 20 bp, Artificial Sequence
  Synthetic oligonucleotide; CAG chr11 5299929 5299948 5299945 +
ttagtttcctataaggagat

SEQ ID NO: 17375 - DNA, 20 bp, Artificial Sequence
  Synthetic oligonucleotide; TAG chr11 5299942 5299961 5299958 +
aggagatcagctgcaaatac

SEQ ID NO: 17376 - DNA, 20 bp, Artificial Sequence
  Synthetic oligonucleotide; CAG chr11 5299947 5299966 5299963 +
atcagctgcaaatactagcg

SEQ ID NO: 17377 - DNA, 20 bp, Artificial Sequence
  Synthetic oligonucleotide; TAG chr11 5299953 5299972 5299969 +
tgcaaatactagcgcagaac

SEQ ID NO: 17378 - DNA, 20 bp, Artificial Sequence
  Synthetic oligonucleotide; CAG chr11 5299956 5299975 5299972 +
aaatactagcgcagaactag

SEQ ID NO: 17379 - DNA, 20 bp, Artificial Sequence
  Synthetic oligonucleotide; TAG chr11 5299959 5299978 5299975 +
tactagcgcagaactagcag

SEQ ID NO: 17380 - DNA, 20 bp, Artificial Sequence
  Synthetic oligonucleotide; AAG chr11 5299965 5299984 5299981 +
cgcagaactagcagtagatg

SEQ ID NO: 17381 - DNA, 20 bp, Artificial Sequence
  Synthetic oligonucleotide; TAG chr11 5299993 5300012 5300009 +
gtcatcccctgttacactaa

SEQ ID NO: 17382 - DNA, 20 bp, Artificial Sequence
  Synthetic oligonucleotide; AAG chr11 5299997 5300016 5300013 +
tcccctgttacactaatagc

SEQ ID NO: 17383 - DNA, 20 bp, Artificial Sequence
  Synthetic oligonucleotide; TGG chr11 5300000 5300019 5300016 +
cctgttacactaatagcaag

SEQ ID NO: 17384 - DNA, 20 bp, Artificial Sequence
  Synthetic oligonucleotide; TAG chr11 5300003 5300022 5300019 +
gttacactaatagcaagtgg

SEQ ID NO: 17385 - DNA, 20 bp, Artificial Sequence
  Synthetic oligonucleotide; CGG chr11 5300010 5300029 5300026 +
taatagcaagtggtagactg

SEQ ID NO: 17386 - DNA, 20 bp, Artificial Sequence
  Synthetic oligonucleotide; CAG chr11 5300015 5300034 5300031 +
gcaagtggtagactgcggtt

SEQ ID NO: 17387 - DNA, 20 bp, Artificial Sequence
  Synthetic oligonucleotide; CAG chr11 5300028 5300047 5300044 +
tgcggttcagacccaatgaa

SEQ ID NO: 17388 - DNA, 20 bp, Artificial Sequence
  Synthetic oligonucleotide; AAG chr11 5300035 5300054 5300051 +
cagacccaatgaacagcata

SEQ ID NO: 17389 - DNA, 20 bp, Artificial Sequence
  Synthetic oligonucleotide; AAG chr11 5300054 5300073 5300070 +
aaagacttacaaacactttg

SEQ ID NO: 17390 - DNA, 20 bp, Artificial Sequence
  Synthetic oligonucleotide; AAG chr11 5300057 5300076 5300073 +
gacttacaaacactttgaag

SEQ ID NO: 17391 - DNA, 20 bp, Artificial Sequence
  Synthetic oligonucleotide; AAG chr11 5300064 5300083 5300080 +
aaacactttgaagaagattg

SEQ ID NO: 17392 - DNA, 20 bp, Artificial Sequence
  Synthetic oligonucleotide; AGG chr11 5300065 5300084 5300081 +
aacactttgaagaagattga

SEQ ID NO: 17393 - DNA, 20 bp, Artificial Sequence
  Synthetic oligonucleotide; AAG chr11 5300068 5300087 5300084 +
actttgaagaagattgaagg

SEQ ID NO: 17394 - DNA, 20 bp, Artificial Sequence
  Synthetic oligonucleotide; CAG chr11 5300083 5300102 5300099 +
gaaggaagaaactattccat

SEQ ID NO: 17395 - DNA, 20 bp, Artificial Sequence
  Synthetic oligonucleotide; AAG chr11 5300120 5300139 5300136 +
aatataacattacctttgcc

SEQ ID NO: 17396 - DNA, 20 bp, Artificial Sequence
  Synthetic oligonucleotide; AAG chr11 5300154 5300173 5300170 +
attatcaaaactatttcatg

SEQ ID NO: 17397 - DNA, 20 bp, Artificial Sequence
  Synthetic oligonucleotide; AAG chr11 5300162 5300181 5300178 +
aactatttcatgaagtgaaa

SEQ ID NO: 17398 - DNA, 20 bp, Artificial Sequence
  Synthetic oligonucleotide; GAG chr11 5300169 5300188 5300185 +
tcatgaagtgaaaaagtctc

SEQ ID NO: 17399 - DNA, 20 bp, Artificial Sequence
  Synthetic oligonucleotide; GAG chr11 5300183 5300202 5300199 +
agtctcgagattttttatgt

SEQ ID NO: 17400 - DNA, 20 bp, Artificial Sequence
  Synthetic oligonucleotide; AAG chr11 5300186 5300205 5300202 +
ctcgagattttttatgtgag

SEQ ID NO: 17401 - DNA, 20 bp, Artificial Sequence
  Synthetic oligonucleotide; AAG chr11 5300190 5300209 5300206 +
agattttttatgtgagaagc

SEQ ID NO: 17402 - DNA, 20 bp, Artificial Sequence
  Synthetic oligonucleotide; GAG chr11 5300192 5300211 5300208 +
attttttatgtgagaagcaa

SEQ ID NO: 17403 - DNA, 20 bp, Artificial Sequence
  Synthetic oligonucleotide; AGG chr11 5300193 5300212 5300209 +
ttttttatgtgagaagcaag

SEQ ID NO: 17404 - DNA, 20 bp, Artificial Sequence
  Synthetic oligonucleotide; GGG chr11 5300194 5300213 5300210 +
tttttatgtgagaagcaaga

SEQ ID NO: 17405 - DNA, 20 bp, Artificial Sequence
  Synthetic oligonucleotide; GGG chr11 5300195 5300214 5300211 +
ttttatgtgagaagcaagag

SEQ ID NO: 17406 - DNA, 20 bp, Artificial Sequence
  Synthetic oligonucleotide; TAG chr11 5300201 5300220 5300217 +
gtgagaagcaagaggggaaa

SEQ ID NO: 17407 - DNA, 20 bp, Artificial Sequence
  Synthetic oligonucleotide; TGG chr11 5300207 5300226 5300223 +
agcaagaggggaaatagaaa

SEQ ID NO: 17408 - DNA, 20 bp, Artificial Sequence
  Synthetic oligonucleotide; GGG chr11 5300208 5300227 5300224 +
gcaagaggggaaatagaaat

SEQ ID NO: 17409 - DNA, 20 bp, Artificial Sequence
  Synthetic oligonucleotide; TGG chr11 5300211 5300230 5300227 +
agaggggaaatagaaatggg

SEQ ID NO: 17410 - DNA, 20 bp, Artificial Sequence
  Synthetic oligonucleotide; TAG chr11 5300229 5300248 5300245 +
ggtggtgatatctaaattta

SEQ ID NO: 17411 - DNA, 20 bp, Artificial Sequence
  Synthetic oligonucleotide; TGG chr11 5300233 5300252 5300249 +
gtgatatctaaatttatagt

SEQ ID NO: 17412 - DNA, 20 bp, Artificial Sequence
  Synthetic oligonucleotide; CAG chr11 5300246 5300265 5300262 +
ttatagttggttattttttt

SEQ ID NO: 17413 - DNA, 20 bp, Artificial Sequence
  Synthetic oligonucleotide; AAG chr11 5300249 5300268 5300265 +
tagttggttatttttttcag

SEQ ID NO: 17414 - DNA, 20 bp, Artificial Sequence
  Synthetic oligonucleotide; CAG chr11 5300260 5300279 5300276 +
ttttttcagaagaaaaatgt

SEQ ID NO: 17415 - DNA, 20 bp, Artificial Sequence
  Synthetic oligonucleotide; AGG chr11 5300261 5300280 5300277 +
tttttcagaagaaaaatgtc

SEQ ID NO: 17416 - DNA, 20 bp, Artificial Sequence
  Synthetic oligonucleotide; GAG chr11 5300263 5300282 5300279 +
tttcagaagaaaaatgtcag

SEQ ID NO: 17417 - DNA, 20 bp, Artificial Sequence
  Synthetic oligonucleotide; TAG chr11 5300272 5300291 5300288 +
aaaaatgtcaggagacaaaa

SEQ ID NO: 17418 - DNA, 20 bp, Artificial Sequence
  Synthetic oligonucleotide; AAG chr11 5300276 5300295 5300292 +
atgtcaggagacaaaataga

SEQ ID NO: 17419 - DNA, 20 bp, Artificial Sequence
  Synthetic oligonucleotide; TGG chr11 5300280 5300299 5300296 +
caggagacaaaatagaaagc

SEQ ID NO: 17420 - DNA, 20 bp, Artificial Sequence
  Synthetic oligonucleotide; AAG chr11 5300284 5300303 5300300 +
agacaaaatagaaagctgga

SEQ ID NO: 17421 - DNA, 20 bp, Artificial Sequence
  Synthetic oligonucleotide; AAG chr11 5300287 5300306 5300303 +
caaaatagaaagctggaaag

SEQ ID NO: 17422 - DNA, 20 bp, Artificial Sequence
  Synthetic oligonucleotide; AAG chr11 5300293 5300312 5300309 +
agaaagctggaaagaagaaa

SEQ ID NO: 17423 - DNA, 20 bp, Artificial Sequence
  Synthetic oligonucleotide; AAG chr11 5300300 5300319 5300316 +
tggaaagaagaaaaagtatt

SEQ ID NO: 17424 - DNA, 20 bp, Artificial Sequence
  Synthetic oligonucleotide; TAG chr11 5300304 5300323 5300320 +
aagaagaaaaagtattaagt

SEQ ID NO: 17425 - DNA, 20 bp, Artificial Sequence
  Synthetic oligonucleotide; CAG chr11 5300310 5300329 5300326 +
aaaaagtattaagttagttt

SEQ ID NO: 17426 - DNA, 20 bp, Artificial Sequence
  Synthetic oligonucleotide; CAG chr11 5300313 5300332 5300329 +
aagtattaagttagtttcag

SEQ ID NO: 17427 - DNA, 20 bp, Artificial Sequence
  Synthetic oligonucleotide; TGG chr11 5300320 5300339 5300336 +
aagttagtttcagcagacaa

SEQ ID NO: 17428 - DNA, 20 bp, Artificial Sequence
  Synthetic oligonucleotide; GGG chr11 5300321 5300340 5300337 +
agttagtttcagcagacaat

SEQ ID NO: 17429 - DNA, 20 bp, Artificial Sequence
  Synthetic oligonucleotide; AAG chr11 5300324 5300343 5300340 +
tagtttcagcagacaatggg

SEQ ID NO: 17430 - DNA, 20 bp, Artificial Sequence
  Synthetic oligonucleotide; AAG chr11 5300327 5300346 5300343 +
tttcagcagacaatgggaag

SEQ ID NO: 17431 - DNA, 20 bp, Artificial Sequence
  Synthetic oligonucleotide; AGG chr11 5300328 5300347 5300344 +
ttcagcagacaatgggaaga

SEQ ID NO: 17432 - DNA, 20 bp, Artificial Sequence
  Synthetic oligonucleotide; CGG chr11 5300335 5300354 5300351 +
gacaatgggaagaaggaaaa

SEQ ID NO: 17433 - DNA, 20 bp, Artificial Sequence
  Synthetic oligonucleotide; GGG chr11 5300336 5300355 5300352 +
acaatgggaagaaggaaaac

SEQ ID NO: 17434 - DNA, 20 bp, Artificial Sequence
  Synthetic oligonucleotide; GGG chr11 5300337 5300356 5300353 +
caatgggaagaaggaaaacg

SEQ ID NO: 17435 - DNA, 20 bp, Artificial Sequence
  Synthetic oligonucleotide; TGG chr11 5300341 5300360 5300357 +
gggaagaaggaaaacggggc

SEQ ID NO: 17436 - DNA, 20 bp, Artificial Sequence
  Synthetic oligonucleotide; GGG chr11 5300342 5300361 5300358 +
ggaagaaggaaaacggggct

SEQ ID NO: 17437 - DNA, 20 bp, Artificial Sequence
  Synthetic oligonucleotide; TGG chr11 5300350 5300369 5300366 +
gaaaacggggctgggatatc

SEQ ID NO: 17438 - DNA, 20 bp, Artificial Sequence
  Synthetic oligonucleotide; GAG chr11 5300360 5300379 5300376 +
ctgggatatctggcttccac

SEQ ID NO: 17439 - DNA, 20 bp, Artificial Sequence
  Synthetic oligonucleotide; AAG chr11 5300368 5300387 5300384 +
tctggcttccacgagatgat

SEQ ID NO: 17440 - DNA, 20 bp, Artificial Sequence
  Synthetic oligonucleotide; TAG chr11 5300390 5300409 5300406 +
gaaatgtgtttgctgctatt

SEQ ID NO: 17441 - DNA, 20 bp, Artificial Sequence
  Synthetic oligonucleotide; TAG chr11 5300397 5300416 5300413 +
gtttgctgctatttagctgt

SEQ ID NO: 17442 - DNA, 20 bp, Artificial Sequence
  Synthetic oligonucleotide; TAG chr11 5300418 5300437 5300434 +
agtctgtatcacacgccttt

SEQ ID NO: 17443 - DNA, 20 bp, Artificial Sequence
  Synthetic oligonucleotide; TAG chr11 5300421 5300440 5300437 +
ctgtatcacacgccttttag

SEQ ID NO: 17444 - DNA, 20 bp, Artificial Sequence
  Synthetic oligonucleotide; CAG chr11 5300434 5300453 5300450 +
cttttagtagtaaaatatgc

SEQ ID NO: 17445 - DNA, 20 bp, Artificial Sequence
  Synthetic oligonucleotide; AAG chr11 5300443 5300462 5300459 +
gtaaaatatgccagtctact

SEQ ID NO: 17446 - DNA, 20 bp, Artificial Sequence
  Synthetic oligonucleotide; AGG chr11 5300444 5300463 5300460 +
taaaatatgccagtctacta

SEQ ID NO: 17447 - DNA, 20 bp, Artificial Sequence
  Synthetic oligonucleotide; GGG chr11 5300445 5300464 5300461 +
aaaatatgccagtctactaa

SEQ ID NO: 17448 - DNA, 20 bp, Artificial Sequence
  Synthetic oligonucleotide; GAG chr11 5300462 5300481 5300478 +
taagggaaattacatttcat

SEQ ID NO: 17449 - DNA, 20 bp, Artificial Sequence
  Synthetic oligonucleotide; AAG chr11 5300466 5300485 5300482 +
ggaaattacatttcatgagt

SEQ ID NO: 17450 - DNA, 20 bp, Artificial Sequence
  Synthetic oligonucleotide; AAG chr11 5300476 5300495 5300492 +
tttcatgagtaagcttccta

SEQ ID NO: 17451 - DNA, 20 bp, Artificial Sequence
  Synthetic oligonucleotide; TAG chr11 5300482 5300501 5300498 +
gagtaagcttcctaaagttc

SEQ ID NO: 17452 - DNA, 20 bp, Artificial Sequence
  Synthetic oligonucleotide; TAG chr11 5300497 5300516 5300513 +
agttctagatatttgctgtt

SEQ ID NO: 17453 - DNA, 20 bp, Artificial Sequence
  Synthetic oligonucleotide; AAG chr11 5300508 5300527 5300524 +
tttgctgtttagcctcacac

SEQ ID NO: 17454 - DNA, 20 bp, Artificial Sequence
  Synthetic oligonucleotide; AAG chr11 5300525 5300544 5300541 +
cacaagtttgcttactaatc

SEQ ID NO: 17455 - DNA, 20 bp, Artificial Sequence
  Synthetic oligonucleotide; AAG chr11 5300529 5300548 5300545 +
agtttgcttactaatcaagc

SEQ ID NO: 17456 - DNA, 20 bp, Artificial Sequence
  Synthetic oligonucleotide; CAG chr11 5300540 5300559 5300556 +
taatcaagcaagatcctttt

SEQ ID NO: 17457 - DNA, 20 bp, Artificial Sequence
  Synthetic oligonucleotide; GAG chr11 5300542 5300561 5300558 +
atcaagcaagatccttttca

SEQ ID NO: 17458 - DNA, 20 bp, Artificial Sequence
  Synthetic oligonucleotide; TAG chr11 5300549 5300568 5300565 +
aagatccttttcagagtaac

SEQ ID NO: 17459 - DNA, 20 bp, Artificial Sequence
  Synthetic oligonucleotide; AAG chr11 5300557 5300576 5300573 +
tttcagagtaactagtttca

SEQ ID NO: 17460 - DNA, 20 bp, Artificial Sequence
  Synthetic oligonucleotide; TGG chr11 5300562 5300581 5300578 +
gagtaactagtttcaaagta

SEQ ID NO: 17461 - DNA, 20 bp, Artificial Sequence
  Synthetic oligonucleotide; GAG chr11 5300564 5300583 5300580 +
gtaactagtttcaaagtatg

SEQ ID NO: 17462 - DNA, 20 bp, Artificial Sequence
  Synthetic oligonucleotide; AAG chr11 5300606 5300625 5300622 +
ttattcaaattcacctttat

SEQ ID NO: 17463 - DNA, 20 bp, Artificial Sequence
  Synthetic oligonucleotide; TAG chr11 5300645 5300664 5300661 +
tccaactgcacatttttctt

SEQ ID NO: 17464 - DNA, 20 bp, Artificial Sequence
  Synthetic oligonucleotide; AAG chr11 5300666 5300685 5300682 +
agatgaactgtatttgaccc

SEQ ID NO: 17465 - DNA, 20 bp, Artificial Sequence
  Synthetic oligonucleotide; TAG chr11 5300675 5300694 5300691 +
gtatttgacccaagctgctt

SEQ ID NO: 17466 - DNA, 20 bp, Artificial Sequence
  Synthetic oligonucleotide; TAG chr11 5300707 5300726 5300723 +
cttgactatttctgaaatca

SEQ ID NO: 17467 - DNA, 20 bp, Artificial Sequence
  Synthetic oligonucleotide; TGG chr11 5300722 5300741 5300738 +
aatcatagttactcttcttt

SEQ ID NO: 17468 - DNA, 20 bp, Artificial Sequence
  Synthetic oligonucleotide; CAG chr11 5300763 5300782 5300779 +
cttcctgtattctttttctt

SEQ ID NO: 17469 - DNA, 20 bp, Artificial Sequence
  Synthetic oligonucleotide; TGG chr11 5300772 5300791 5300788 +
ttctttttcttcagcatcac

SEQ ID NO: 17470 - DNA, 20 bp, Artificial Sequence
  Synthetic oligonucleotide; TAG chr11 5300789 5300808 5300805 +
cactggcattccctctttat

SEQ ID NO: 17471 - DNA, 20 bp, Artificial Sequence
  Synthetic oligonucleotide; AGG chr11 5300790 5300809 5300806 +
actggcattccctctttatt

SEQ ID NO: 17472 - DNA, 20 bp, Artificial Sequence
  Synthetic oligonucleotide; CAG chr11 5300860 5300879 5300876 +
taaaaatttctcgctcacat

SEQ ID NO: 17473 - DNA, 20 bp, Artificial Sequence
  Synthetic oligonucleotide; GAG chr11 5300899 5300918 5300915 +
ttaaaattgaatctaactct

SEQ ID NO: 17474 - DNA, 20 bp, Artificial Sequence
  Synthetic oligonucleotide; AGG chr11 5300900 5300919 5300916 +
taaaattgaatctaactctg

SEQ ID NO: 17475 - DNA, 20 bp, Artificial Sequence
  Synthetic oligonucleotide; AAG chr11 5300909 5300928 5300925 +
atctaactctgaggaaaaaa

SEQ ID NO: 17476 - DNA, 20 bp, Artificial Sequence
  Synthetic oligonucleotide; TGG chr11 5300914 5300933 5300930 +
actctgaggaaaaaaaagtg

SEQ ID NO: 17477 - DNA, 20 bp, Artificial Sequence
  Synthetic oligonucleotide; CAG chr11 5300926 5300945 5300942 +
aaaaagtgtggatataaaac

SEQ ID NO: 17478 - DNA, 20 bp, Artificial Sequence
  Synthetic oligonucleotide; AGG chr11 5300927 5300946 5300943 +
aaaagtgtggatataaaacc

SEQ ID NO: 17479 - DNA, 20 bp, Artificial Sequence
  Synthetic oligonucleotide; GGG chr11 5300928 5300947 5300944 +
aaagtgtggatataaaacca

SEQ ID NO: 17480 - DNA, 20 bp, Artificial Sequence
  Synthetic oligonucleotide; CAG chr11 5300939 5300958 5300955 +
ataaaaccagggttcctttt

SEQ ID NO: 17481 - DNA, 20 bp, Artificial Sequence
  Synthetic oligonucleotide; TGG chr11 5300945 5300964 5300961 +
ccagggttccttttcagtaa

SEQ ID NO: 17482 - DNA, 20 bp, Artificial Sequence
  Synthetic oligonucleotide; GGG chr11 5300946 5300965 5300962 +
cagggttccttttcagtaat

SEQ ID NO: 17483 - DNA, 20 bp, Artificial Sequence
  Synthetic oligonucleotide; GAG chr11 5300948 5300967 5300964 +
gggttccttttcagtaatgg

SEQ ID NO: 17484 - DNA, 20 bp, Artificial Sequence
  Synthetic oligonucleotide; GAG chr11 5300950 5300969 5300966 +
gttccttttcagtaatggga

SEQ ID NO: 17485 - DNA, 20 bp, Artificial Sequence
  Synthetic oligonucleotide; AGG chr11 5300951 5300970 5300967 +
ttccttttcagtaatgggag

SEQ ID NO: 17486 - DNA, 20 bp, Artificial Sequence
  Synthetic oligonucleotide; CAG chr11 5300956 5300975 5300972 +
tttcagtaatgggagaggcc

SEQ ID NO: 17487 - DNA, 20 bp, Artificial Sequence
  Synthetic oligonucleotide; TAG chr11 5300965 5300984 5300981 +
tgggagaggcccagaaatcc

SEQ ID NO: 17488 - DNA, 20 bp, Artificial Sequence
  Synthetic oligonucleotide; GAG chr11 5300967 5300986 5300983 +
ggagaggcccagaaatccta

SEQ ID NO: 17489 - DNA, 20 bp, Artificial Sequence
  Synthetic oligonucleotide; GAG chr11 5300975 5300994 5300991 +
ccagaaatcctagagatctt

SEQ ID NO: 17490 - DNA, 20 bp, Artificial Sequence
  Synthetic oligonucleotide; AAG chr11 5300988 5301007 5301004 +
agatcttgagattctgaaat

SEQ ID NO: 17491 - DNA, 20 bp, Artificial Sequence
  Synthetic oligonucleotide; AGG chr11 5300989 5301008 5301005 +
gatcttgagattctgaaata

SEQ ID NO: 17492 - DNA, 20 bp, Artificial Sequence
  Synthetic oligonucleotide; GGG chr11 5300990 5301009 5301006 +
atcttgagattctgaaataa

SEQ ID NO: 17493 - DNA, 20 bp, Artificial Sequence
  Synthetic oligonucleotide; AAG chr11 5300996 5301015 5301012 +
agattctgaaataagggctc

SEQ ID NO: 17494 - DNA, 20 bp, Artificial Sequence
  Synthetic oligonucleotide; CAG chr11 5301011 5301030 5301027 +
ggctcaagccctactctgcc

SEQ ID NO: 17495 - DNA, 20 bp, Artificial Sequence
  Synthetic oligonucleotide; TAG chr11 5301018 5301037 5301034 +
gccctactctgcccagaaaa

SEQ ID NO: 17496 - DNA, 20 bp, Artificial Sequence
  Synthetic oligonucleotide; AGG chr11 5301019 5301038 5301035 +
ccctactctgcccagaaaat

SEQ ID NO: 17497 - DNA, 20 bp, Artificial Sequence
  Synthetic oligonucleotide; TGG chr11 5301047 5301066 5301063 +
aatgcttctttgaatctgct

SEQ ID NO: 17498 - DNA, 20 bp, Artificial Sequence
  Synthetic oligonucleotide; TAG chr11 5301068 5301087 5301084 +
ggtcttgatgctataaatga

SEQ ID NO: 17499 - DNA, 20 bp, Artificial Sequence
  Synthetic oligonucleotide; AGG chr11 5301069 5301088 5301085 +
gtcttgatgctataaatgat

SEQ ID NO: 17500 - DNA, 20 bp, Artificial Sequence
  Synthetic oligonucleotide; TGG chr11 5301081 5301100 5301097 +
taaatgataggattcacgaa

SEQ ID NO: 17501 - DNA, 20 bp, Artificial Sequence
  Synthetic oligonucleotide; GAG chr11 5301083 5301102 5301099 +
aatgataggattcacgaatg

SEQ ID NO: 17502 - DNA, 20 bp, Artificial Sequence
  Synthetic oligonucleotide; AGG chr11 5301084 5301103 5301100 +
atgataggattcacgaatgg

SEQ ID NO: 17503 - DNA, 20 bp, Artificial Sequence
  Synthetic oligonucleotide; AAG chr11 5301088 5301107 5301104 +
taggattcacgaatggagga

SEQ ID NO: 17504 - DNA, 20 bp, Artificial Sequence
  Synthetic oligonucleotide; GAG chr11 5301090 5301109 5301106 +
ggattcacgaatggaggaaa

SEQ ID NO: 17505 - DNA, 20 bp, Artificial Sequence
  Synthetic oligonucleotide; TGG chr11 5301097 5301116 5301113 +
cgaatggaggaaagagaaaa

SEQ ID NO: 17506 - DNA, 20 bp, Artificial Sequence
  Synthetic oligonucleotide; TAG chr11 5301103 5301122 5301119 +
gaggaaagagaaaatggaca

SEQ ID NO: 17507 - DNA, 20 bp, Artificial Sequence
  Synthetic oligonucleotide; TGG chr11 5301110 5301129 5301126 +
gagaaaatggacatagctca

SEQ ID NO: 17508 - DNA, 20 bp, Artificial Sequence
  Synthetic oligonucleotide; TGG chr11 5301116 5301135 5301132 +
atggacatagctcatggtaa

SEQ ID NO: 17509 - DNA, 20 bp, Artificial Sequence
  Synthetic oligonucleotide; GGG chr11 5301117 5301136 5301133 +
tggacatagctcatggtaat

SEQ ID NO: 17510 - DNA, 20 bp, Artificial Sequence
  Synthetic oligonucleotide; GGG chr11 5301118 5301137 5301134 +
ggacatagctcatggtaatg

SEQ ID NO: 17511 - DNA, 20 bp, Artificial Sequence
  Synthetic oligonucleotide; GAG chr11 5301128 5301147 5301144 +
catggtaatggggaccacat

SEQ ID NO: 17512 - DNA, 20 bp, Artificial Sequence
  Synthetic oligonucleotide; AGG chr11 5301129 5301148 5301145 +
atggtaatggggaccacatg

SEQ ID NO: 17513 - DNA, 20 bp, Artificial Sequence
  Synthetic oligonucleotide; CAG chr11 5301162 5301181 5301178 +
ccaaacctgtgaatgaatga

SEQ ID NO: 17514 - DNA, 20 bp, Artificial Sequence
  Synthetic oligonucleotide; CAG chr11 5301173 5301192 5301189 +
aatgaatgacagtcccatca

SEQ ID NO: 17515 - DNA, 20 bp, Artificial Sequence
  Synthetic oligonucleotide; TAG chr11 5301189 5301208 5301205 +
atcacagtgatgtgaaatac

SEQ ID NO: 17516 - DNA, 20 bp, Artificial Sequence
  Synthetic oligonucleotide; AGG chr11 5301190 5301209 5301206 +
tcacagtgatgtgaaatact

SEQ ID NO: 17517 - DNA, 20 bp, Artificial Sequence
  Synthetic oligonucleotide; CAG chr11 5301196 5301215 5301212 +
tgatgtgaaatactaggaca

SEQ ID NO: 17518 - DNA, 20 bp, Artificial Sequence
  Synthetic oligonucleotide; TGG chr11 5301205 5301224 5301221 +
atactaggacacagctaata

SEQ ID NO: 17519 - DNA, 20 bp, Artificial Sequence
  Synthetic oligonucleotide; GGG chr11 5301206 5301225 5301222 +
tactaggacacagctaatat

SEQ ID NO: 17520 - DNA, 20 bp, Artificial Sequence
  Synthetic oligonucleotide; GAG chr11 5301208 5301227 5301224 +
ctaggacacagctaatatgg

SEQ ID NO: 17521 - DNA, 20 bp, Artificial Sequence
  Synthetic oligonucleotide; AAG chr11 5301215 5301234 5301231 +
acagctaatatgggagacac

SEQ ID NO: 17522 - DNA, 20 bp, Artificial Sequence
  Synthetic oligonucleotide; GAG chr11 5301222 5301241 5301238 +
atatgggagacacaagtgtt

SEQ ID NO: 17523 - DNA, 20 bp, Artificial Sequence
  Synthetic oligonucleotide; GAG chr11 5301224 5301243 5301240 +
atgggagacacaagtgttga

SEQ ID NO: 17524 - DNA, 20 bp, Artificial Sequence
  Synthetic oligonucleotide; TAG chr11 5301230 5301249 5301246 +
gacacaagtgttgagagatt

SEQ ID NO: 17525 - DNA, 20 bp, Artificial Sequence
  Synthetic oligonucleotide; CAG chr11 5301245 5301264 5301261 +
agatttagcttcctcttgtc

SEQ ID NO: 17526 - DNA, 20 bp, Artificial Sequence
  Synthetic oligonucleotide; GAG chr11 5301270 5301289 5301286 +
gcaatgcccatcactgtctt

SEQ ID NO: 17527 - DNA, 20 bp, Artificial Sequence
  Synthetic oligonucleotide; AGG chr11 5301271 5301290 5301287 +
caatgcccatcactgtcttg

SEQ ID NO: 17528 - DNA, 20 bp, Artificial Sequence
  Synthetic oligonucleotide; TAG chr11 5301276 5301295 5301292 +
cccatcactgtcttgaggat

SEQ ID NO: 17529 - DNA, 20 bp, Artificial Sequence
  Synthetic oligonucleotide; AAG chr11 5301284 5301303 5301300 +
tgtcttgaggattagtatat

SEQ ID NO: 17530 - DNA, 20 bp, Artificial Sequence
  Synthetic oligonucleotide; AAG chr11 5301289 5301308 5301305 +
tgaggattagtatataagaa

SEQ ID NO: 17531 - DNA, 20 bp, Artificial Sequence
  Synthetic oligonucleotide; TAG chr11 5301300 5301319 5301316 +
atataagaaaagatgatgat

SEQ ID NO: 17532 - DNA, 20 bp, Artificial Sequence
  Synthetic oligonucleotide; GAG chr11 5301302 5301321 5301318 +
ataagaaaagatgatgatta

SEQ ID NO: 17533 - DNA, 20 bp, Artificial Sequence
  Synthetic oligonucleotide; AAG chr11 5301313 5301332 5301329 +
tgatgattagagcatctaaa

SEQ ID NO: 17534 - DNA, 20 bp, Artificial Sequence
  Synthetic oligonucleotide; CAG chr11 5301317 5301336 5301333 +
gattagagcatctaaaaaga

SEQ ID NO: 17535 - DNA, 20 bp, Artificial Sequence
  Synthetic oligonucleotide; AAG chr11 5301323 5301342 5301339 +
agcatctaaaaagacagtca

SEQ ID NO: 17536 - DNA, 20 bp, Artificial Sequence
  Synthetic oligonucleotide; AAG chr11 5301326 5301345 5301342 +
atctaaaaagacagtcaaag

SEQ ID NO: 17537 - DNA, 20 bp, Artificial Sequence
  Synthetic oligonucleotide; TGG chr11 5301339 5301358 5301355 +
gtcaaagaagtctgaataat

SEQ ID NO: 17538 - DNA, 20 bp, Artificial Sequence
  Synthetic oligonucleotide; CAG chr11 5301365 5301384 5301381 +
tatgtgattaaacgtgatat

SEQ ID NO: 17539 - DNA, 20 bp, Artificial Sequence
  Synthetic oligonucleotide; CAG chr11 5301370 5301389 5301386 +
gattaaacgtgatatcagca

SEQ ID NO: 17540 - DNA, 20 bp, Artificial Sequence
  Synthetic oligonucleotide; AGG chr11 5301371 5301390 5301387 +
attaaacgtgatatcagcac

SEQ ID NO: 17541 - DNA, 20 bp, Artificial Sequence
  Synthetic oligonucleotide; GAG chr11 5301375 5301394 5301391 +
aacgtgatatcagcacaggc

SEQ ID NO: 17542 - DNA, 20 bp, Artificial Sequence
  Synthetic oligonucleotide; TGG chr11 5301394 5301413 5301410 +
cgagttttatgacatcttga

SEQ ID NO: 17543 - DNA, 20 bp, Artificial Sequence
  Synthetic oligonucleotide; GAG chr11 5301396 5301415 5301412 +
agttttatgacatcttgatg

SEQ ID NO: 17544 - DNA, 20 bp, Artificial Sequence
  Synthetic oligonucleotide; AGG chr11 5301397 5301416 5301413 +
gttttatgacatcttgatgg

SEQ ID NO: 17545 - DNA, 20 bp, Artificial Sequence
  Synthetic oligonucleotide; AAG chr11 5301412 5301431 5301428 +
gatggaggcaaaatgtgtgc

SEQ ID NO: 17546 - DNA, 20 bp, Artificial Sequence
  Synthetic oligonucleotide; GAG chr11 5301414 5301433 5301430 +
tggaggcaaaatgtgtgcaa

SEQ ID NO: 17547 - DNA, 20 bp, Artificial Sequence
  Synthetic oligonucleotide; AGG chr11 5301415 5301434 5301431 +
ggaggcaaaatgtgtgcaag

SEQ ID NO: 17548 - DNA, 20 bp, Artificial Sequence
  Synthetic oligonucleotide; GGG chr11 5301416 5301435 5301432 +
gaggcaaaatgtgtgcaaga

SEQ ID NO: 17549 - DNA, 20 bp, Artificial Sequence
  Synthetic oligonucleotide; CGG chr11 5301421 5301440 5301437 +
aaaatgtgtgcaagagggca

SEQ ID NO: 17550 - DNA, 20 bp, Artificial Sequence
  Synthetic oligonucleotide; GGG chr11 5301422 5301441 5301438 +
aaatgtgtgcaagagggcac

SEQ ID NO: 17551 - DNA, 20 bp, Artificial Sequence
  Synthetic oligonucleotide; TGG chr11 5301435 5301454 5301451 +
agggcacgggaaccacaata

SEQ ID NO: 17552 - DNA, 20 bp, Artificial Sequence
  Synthetic oligonucleotide; GGG chr11 5301436 5301455 5301452 +
gggcacgggaaccacaatat

SEQ ID NO: 17553 - DNA, 20 bp, Artificial Sequence
  Synthetic oligonucleotide; TAG chr11 5301439 5301458 5301455 +
cacgggaaccacaatatggg

SEQ ID NO: 17554 - DNA, 20 bp, Artificial Sequence
  Synthetic oligonucleotide; CAG chr11 5301442 5301461 5301458 +
gggaaccacaatatgggtag

SEQ ID NO: 17555 - DNA, 20 bp, Artificial Sequence
  Synthetic oligonucleotide; TAG chr11 5301445 5301464 5301461 +
aaccacaatatgggtagcag

SEQ ID NO: 17556 - DNA, 20 bp, Artificial Sequence
  Synthetic oligonucleotide; GAG chr11 5301447 5301466 5301463 +
ccacaatatgggtagcagta

SEQ ID NO: 17557 - DNA, 20 bp, Artificial Sequence
  Synthetic oligonucleotide; AAG chr11 5301453 5301472 5301469 +
tatgggtagcagtagagtga

SEQ ID NO: 17558 - DNA, 20 bp, Artificial Sequence
  Synthetic oligonucleotide; TGG chr11 5301461 5301480 5301477 +
gcagtagagtgaaagaatta

SEQ ID NO: 17559 - DNA, 20 bp, Artificial Sequence
  Synthetic oligonucleotide; GGG chr11 5301462 5301481 5301478 +
cagtagagtgaaagaattat

SEQ ID NO: 17560 - DNA, 20 bp, Artificial Sequence
  Synthetic oligonucleotide; TGG chr11 5301470 5301489 5301486 +
tgaaagaattatgggcaaaa

SEQ ID NO: 17561 - DNA, 20 bp, Artificial Sequence
  Synthetic oligonucleotide; CAG chr11 5301489 5301508 5301505 +
atggacataaaacctctcat

SEQ ID NO: 17562 - DNA, 20 bp, Artificial Sequence
  Synthetic oligonucleotide; CAG chr11 5301498 5301517 5301514 +
aaacctctcatcagtacccc

SEQ ID NO: 17563 - DNA, 20 bp, Artificial Sequence
  Synthetic oligonucleotide; CGG chr11 5301517 5301536 5301533 +
ccagtcctatgttcatcact

SEQ ID NO: 17564 - DNA, 20 bp, Artificial Sequence
  Synthetic oligonucleotide; GGG chr11 5301518 5301537 5301534 +
cagtcctatgttcatcactc

SEQ ID NO: 17565 - DNA, 20 bp, Artificial Sequence
  Synthetic oligonucleotide; TGG chr11 5301524 5301543 5301540 +
tatgttcatcactcgggaat

SEQ ID NO: 17566 - DNA, 20 bp, Artificial Sequence
  Synthetic oligonucleotide; AAG chr11 5301528 5301547 5301544 +
ttcatcactcgggaattggt

SEQ ID NO: 17567 - DNA, 20 bp, Artificial Sequence
  Synthetic oligonucleotide; CAG chr11 5301535 5301554 5301551 +
ctcgggaattggtaagaatg

SEQ ID NO: 17568 - DNA, 20 bp, Artificial Sequence
  Synthetic oligonucleotide; CAG chr11 5301546 5301565 5301562 +
gtaagaatgcagttgtacct

SEQ ID NO: 17569 - DNA, 20 bp, Artificial Sequence
  Synthetic oligonucleotide; TGG chr11 5301549 5301568 5301565 +
agaatgcagttgtacctcag

SEQ ID NO: 17570 - DNA, 20 bp, Artificial Sequence
  Synthetic oligonucleotide; CGG chr11 5301556 5301575 5301572 +
agttgtacctcagtggtgtg

SEQ ID NO: 17571 - DNA, 20 bp, Artificial Sequence
  Synthetic oligonucleotide; TGG chr11 5301560 5301579 5301576 +
gtacctcagtggtgtgcgga

SEQ ID NO: 17572 - DNA, 20 bp, Artificial Sequence
  Synthetic oligonucleotide; CAG chr11 5301571 5301590 5301587 +
gtgtgcggatggcaatgaaa

SEQ ID NO: 17573 - DNA, 20 bp, Artificial Sequence
  Synthetic oligonucleotide; TAG chr11 5301577 5301596 5301593 +
ggatggcaatgaaacagtca

SEQ ID NO: 17574 - DNA, 20 bp, Artificial Sequence
  Synthetic oligonucleotide; AGG chr11 5301578 5301597 5301594 +
gatggcaatgaaacagtcat

SEQ ID NO: 17575 - DNA, 20 bp, Artificial Sequence
  Synthetic oligonucleotide; AAG chr11 5301588 5301607 5301604 +
aaacagtcataggccaaaac

SEQ ID NO: 17576 - DNA, 20 bp, Artificial Sequence
  Synthetic oligonucleotide; AAG chr11 5301592 5301611 5301608 +
agtcataggccaaaacaagc

SEQ ID NO: 17577 - DNA, 20 bp, Artificial Sequence
  Synthetic oligonucleotide; TGG chr11 5301611 5301630 5301627 +
caagatacctgattctacaa

SEQ ID NO: 17578 - DNA, 20 bp, Artificial Sequence
  Synthetic oligonucleotide; CAG chr11 5301615 5301634 5301631 +
atacctgattctacaatggc

SEQ ID NO: 17579 - DNA, 20 bp, Artificial Sequence
  Synthetic oligonucleotide; AAG chr11 5301628 5301647 5301644 +
caatggccagtgaatgaatg

SEQ ID NO: 17580 - DNA, 20 bp, Artificial Sequence
  Synthetic oligonucleotide; AGG chr11 5301629 5301648 5301645 +
aatggccagtgaatgaatga

SEQ ID NO: 17581 - DNA, 20 bp, Artificial Sequence
  Synthetic oligonucleotide; TGG chr11 5301634 5301653 5301650 +
ccagtgaatgaatgaaggat

SEQ ID NO: 17582 - DNA, 20 bp, Artificial Sequence
  Synthetic oligonucleotide; GGG chr11 5301635 5301654 5301651 +
cagtgaatgaatgaaggatt

SEQ ID NO: 17583 - DNA, 20 bp, Artificial Sequence
  Synthetic oligonucleotide; CAG chr11 5301643 5301662 5301659 +
gaatgaaggattgggtgaaa

SEQ ID NO: 17584 - DNA, 20 bp, Artificial Sequence
  Synthetic oligonucleotide; AGG chr11 5301644 5301663 5301660 +
aatgaaggattgggtgaaac

SEQ ID NO: 17585 - DNA, 20 bp, Artificial Sequence
  Synthetic oligonucleotide; CAG chr11 5301647 5301666 5301663 +
gaaggattgggtgaaacagg

SEQ ID NO: 17586 - DNA, 20 bp, Artificial Sequence
  Synthetic oligonucleotide; TGG chr11 5301652 5301671 5301668 +
attgggtgaaacaggcagca

SEQ ID NO: 17587 - DNA, 20 bp, Artificial Sequence
  Synthetic oligonucleotide; GGG chr11 5301653 5301672 5301669 +
ttgggtgaaacaggcagcat

SEQ ID NO: 17588 - DNA, 20 bp, Artificial Sequence
  Synthetic oligonucleotide; TGG chr11 5301667 5301686 5301683 +
cagcatgggcaatctccctc

SEQ ID NO: 17589 - DNA, 20 bp, Artificial Sequence
  Synthetic oligonucleotide; TAG chr11 5301672 5301691 5301688 +
tgggcaatctccctctggtc

SEQ ID NO: 17590 - DNA, 20 bp, Artificial Sequence
  Synthetic oligonucleotide; CAG chr11 5301675 5301694 5301691 +
gcaatctccctctggtctag

SEQ ID NO: 17591 - DNA, 20 bp, Artificial Sequence
  Synthetic oligonucleotide; CAG chr11 5301678 5301697 5301694 +
atctccctctggtctagcag

SEQ ID NO: 17592 - DNA, 20 bp, Artificial Sequence
  Synthetic oligonucleotide; AGG chr11 5301679 5301698 5301695 +
tctccctctggtctagcagc

SEQ ID NO: 17593 - DNA, 20 bp, Artificial Sequence
  Synthetic oligonucleotide; CAG chr11 5301687 5301706 5301703 +
tggtctagcagcaggacacc

SEQ ID NO: 17594 - DNA, 20 bp, Artificial Sequence
  Synthetic oligonucleotide; AGG chr11 5301688 5301707 5301704 +
ggtctagcagcaggacaccc

SEQ ID NO: 17595 - DNA, 20 bp, Artificial Sequence
  Synthetic oligonucleotide; TGG chr11 5301695 5301714 5301711 +
cagcaggacacccaggactg

SEQ ID NO: 17596 - DNA, 20 bp, Artificial Sequence
  Synthetic oligonucleotide; GGG chr11 5301696 5301715 5301712 +
agcaggacacccaggactgt

SEQ ID NO: 17597 - DNA, 20 bp, Artificial Sequence
  Synthetic oligonucleotide; TAG chr11 5301704 5301723 5301720 +
acccaggactgtgggcattg

SEQ ID NO: 17598 - DNA, 20 bp, Artificial Sequence
  Synthetic oligonucleotide; AAG chr11 5301720 5301739 5301736 +
attgtagtgaatgtcatccc

SEQ ID NO: 17599 - DNA, 20 bp, Artificial Sequence
  Synthetic oligonucleotide; AGG chr11 5301721 5301740 5301737 +
ttgtagtgaatgtcatccca

SEQ ID NO: 17600 - DNA, 20 bp, Artificial Sequence
  Synthetic oligonucleotide; CAG chr11 5301735 5301754 5301751 +
atcccaaggtccgtgtctgc

SEQ ID NO: 17601 - DNA, 20 bp, Artificial Sequence
  Synthetic oligonucleotide; TAG chr11 5301740 5301759 5301756 +
aaggtccgtgtctgccagca

SEQ ID NO: 17602 - DNA, 20 bp, Artificial Sequence
  Synthetic oligonucleotide; CAG chr11 5301744 5301763 5301760 +
tccgtgtctgccagcatagc

SEQ ID NO: 17603 - DNA, 20 bp, Artificial Sequence
  Synthetic oligonucleotide; AGG chr11 5301745 5301764 5301761 +
ccgtgtctgccagcatagcc

SEQ ID NO: 17604 - DNA, 20 bp, Artificial Sequence
  Synthetic oligonucleotide; AAG chr11 5301748 5301767 5301764 +
tgtctgccagcatagccagg

SEQ ID NO: 17605 - DNA, 20 bp, Artificial Sequence
  Synthetic oligonucleotide; TAG chr11 5301751 5301770 5301767 +
ctgccagcatagccaggaag

SEQ ID NO: 17606 - DNA, 20 bp, Artificial Sequence
  Synthetic oligonucleotide; TGG chr11 5301758 5301777 5301774 +
catagccaggaagtagtaca

SEQ ID NO: 17607 - DNA, 20 bp, Artificial Sequence
  Synthetic oligonucleotide; GGG chr11 5301759 5301778 5301775 +
atagccaggaagtagtacat

SEQ ID NO: 17608 - DNA, 20 bp, Artificial Sequence
  Synthetic oligonucleotide; TGG chr11 5301766 5301785 5301782 +
ggaagtagtacatgggctca

SEQ ID NO: 17609 - DNA, 20 bp, Artificial Sequence
  Synthetic oligonucleotide; GAG chr11 5301768 5301787 5301784 +
aagtagtacatgggctcatg

SEQ ID NO: 17610 - DNA, 20 bp, Artificial Sequence
  Synthetic oligonucleotide; AGG chr11 5301769 5301788 5301785 +
agtagtacatgggctcatgg

SEQ ID NO: 17611 - DNA, 20 bp, Artificial Sequence
  Synthetic oligonucleotide; GAG chr11 5301789 5301808 5301805 +
aggctgtgatcattccaaat

SEQ ID NO: 17612 - DNA, 20 bp, Artificial Sequence
  Synthetic oligonucleotide; AGG chr11 5301790 5301809 5301806 +
ggctgtgatcattccaaatg

SEQ ID NO: 17613 - DNA, 20 bp, Artificial Sequence
  Synthetic oligonucleotide; AAG chr11 5301795 5301814 5301811 +
tgatcattccaaatgaggac

SEQ ID NO: 17614 - DNA, 20 bp, Artificial Sequence
  Synthetic oligonucleotide; AAG chr11 5301798 5301817 5301814 +
tcattccaaatgaggacaag

SEQ ID NO: 17615 - DNA, 20 bp, Artificial Sequence
  Synthetic oligonucleotide; GAG chr11 5301800 5301819 5301816 +
attccaaatgaggacaagaa

SEQ ID NO: 17616 - DNA, 20 bp, Artificial Sequence
  Synthetic oligonucleotide; AAG chr11 5301816 5301835 5301832 +
agaagagtgccatttccaaa

SEQ ID NO: 17617 - DNA, 20 bp, Artificial Sequence
  Synthetic oligonucleotide; AGG chr11 5301817 5301836 5301833 +
gaagagtgccatttccaaaa

SEQ ID NO: 17618 - DNA, 20 bp, Artificial Sequence
  Synthetic oligonucleotide; CGG chr11 5301821 5301840 5301837 +
agtgccatttccaaaaagga

SEQ ID NO: 17619 - DNA, 20 bp, Artificial Sequence
  Synthetic oligonucleotide; GAG chr11 5301823 5301842 5301839 +
tgccatttccaaaaaggacg

SEQ ID NO: 17620 - DNA, 20 bp, Artificial Sequence
  Synthetic oligonucleotide; AAG chr11 5301826 5301845 5301842 +
catttccaaaaaggacggag

SEQ ID NO: 17621 - DNA, 20 bp, Artificial Sequence
  Synthetic oligonucleotide; TAG chr11 5301829 5301848 5301845 +
ttccaaaaaggacggagaag

SEQ ID NO: 17622 - DNA, 20 bp, Artificial Sequence
  Synthetic oligonucleotide; AAG chr11 5301838 5301857 5301854 +
ggacggagaagtagatgaca

SEQ ID NO: 17623 - DNA, 20 bp, Artificial Sequence
  Synthetic oligonucleotide; AAG chr11 5301841 5301860 5301857 +
cggagaagtagatgacaaag

SEQ ID NO: 17624 - DNA, 20 bp, Artificial Sequence
  Synthetic oligonucleotide; AGG chr11 5301842 5301861 5301858 +
ggagaagtagatgacaaaga

SEQ ID NO: 17625 - DNA, 20 bp, Artificial Sequence
  Synthetic oligonucleotide; TAG chr11 5301848 5301867 5301864 +
gtagatgacaaagaaggaca

SEQ ID NO: 17626 - DNA, 20 bp, Artificial Sequence
  Synthetic oligonucleotide; GAG chr11 5301850 5301869 5301866 +
agatgacaaagaaggacata

SEQ ID NO: 17627 - DNA, 20 bp, Artificial Sequence
  Synthetic oligonucleotide; CGG chr11 5301856 5301875 5301872 +
caaagaaggacatagagatc

SEQ ID NO: 17628 - DNA, 20 bp, Artificial Sequence
  Synthetic oligonucleotide; TAG chr11 5301859 5301878 5301875 +
agaaggacatagagatccgg

SEQ ID NO: 17629 - DNA, 20 bp, Artificial Sequence
  Synthetic oligonucleotide; GAG chr11 5301874 5301893 5301890 +
tccggtagtgaactgcctct

SEQ ID NO: 17630 - DNA, 20 bp, Artificial Sequence
  Synthetic oligonucleotide; AAG chr11 5301880 5301899 5301896 +
agtgaactgcctctgagccc

SEQ ID NO: 17631 - DNA, 20 bp, Artificial Sequence
  Synthetic oligonucleotide; AAG chr11 5301883 5301902 5301899 +
gaactgcctctgagcccaag

SEQ ID NO: 17632 - DNA, 20 bp, Artificial Sequence
  Synthetic oligonucleotide; CAG chr11 5301887 5301906 5301903 +
tgcctctgagcccaagaagc

SEQ ID NO: 17633 - DNA, 20 bp, Artificial Sequence
  Synthetic oligonucleotide; CAG chr11 5301891 5301910 5301907 +
tctgagcccaagaagccagt

SEQ ID NO: 17634 - DNA, 20 bp, Artificial Sequence
  Synthetic oligonucleotide; AAG chr11 5301895 5301914 5301911 +
agcccaagaagccagtcagc

SEQ ID NO: 17635 - DNA, 20 bp, Artificial Sequence
  Synthetic oligonucleotide; AAG chr11 5301898 5301917 5301914 +
ccaagaagccagtcagcaag

SEQ ID NO: 17636 - DNA, 20 bp, Artificial Sequence
  Synthetic oligonucleotide; AGG chr11 5301899 5301918 5301915 +
caagaagccagtcagcaaga

SEQ ID NO: 17637 - DNA, 20 bp, Artificial Sequence
  Synthetic oligonucleotide; GGG chr11 5301900 5301919 5301916 +
aagaagccagtcagcaagaa

SEQ ID NO: 17638 - DNA, 20 bp, Artificial Sequence
  Synthetic oligonucleotide; GGG chr11 5301901 5301920 5301917 +
agaagccagtcagcaagaag

SEQ ID NO: 17639 - DNA, 20 bp, Artificial Sequence
  Synthetic oligonucleotide; CAG chr11 5301905 5301924 5301921 +
gccagtcagcaagaaggggc

SEQ ID NO: 17640 - DNA, 20 bp, Artificial Sequence
  Synthetic oligonucleotide; TGG chr11 5301926 5301945 5301942 +
agcactgttgttataccaca

SEQ ID NO: 17641 - DNA, 20 bp, Artificial Sequence
  Synthetic oligonucleotide; TAG chr11 5301929 5301948 5301945 +
actgttgttataccacatgg

SEQ ID NO: 17642 - DNA, 20 bp, Artificial Sequence
  Synthetic oligonucleotide; AGG chr11 5301930 5301949 5301946 +
ctgttgttataccacatggt

SEQ ID NO: 17643 - DNA, 20 bp, Artificial Sequence
  Synthetic oligonucleotide; CAG chr11 5301938 5301957 5301954 +
ataccacatggtaggttttg

SEQ ID NO: 17644 - DNA, 20 bp, Artificial Sequence
  Synthetic oligonucleotide; AGG chr11 5301939 5301958 5301955 +
taccacatggtaggttttgc

SEQ ID NO: 17645 - DNA, 20 bp, Artificial Sequence
  Synthetic oligonucleotide; TGG chr11 5301942 5301961 5301958 +
cacatggtaggttttgcagg

SEQ ID NO: 17646 - DNA, 20 bp, Artificial Sequence
  Synthetic oligonucleotide; GAG chr11 5301944 5301963 5301960 +
catggtaggttttgcaggtg

SEQ ID NO: 17647 - DNA, 20 bp, Artificial Sequence
  Synthetic oligonucleotide; AAG chr11 5301947 5301966 5301963 +
ggtaggttttgcaggtggag

SEQ ID NO: 17648 - DNA, 20 bp, Artificial Sequence
  Synthetic oligonucleotide; TAG chr11 5301958 5301977 5301974 +
caggtggagaagatattttt

SEQ ID NO: 17649 - DNA, 20 bp, Artificial Sequence
  Synthetic oligonucleotide; AGG chr11 5301959 5301978 5301975 +
aggtggagaagatatttttt

SEQ ID NO: 17650 - DNA, 20 bp, Artificial Sequence
  Synthetic oligonucleotide; GGG chr11 5301960 5301979 5301976 +
ggtggagaagatatttttta

SEQ ID NO: 17651 - DNA, 20 bp, Artificial Sequence
  Synthetic oligonucleotide; GGG chr11 5301961 5301980 5301977 +
gtggagaagatattttttag

SEQ ID NO: 17652 - DNA, 20 bp, Artificial Sequence
  Synthetic oligonucleotide; AAG chr11 5301976 5301995 5301992 +
tttaggggtgatgacctcca

SEQ ID NO: 17653 - DNA, 20 bp, Artificial Sequence
  Synthetic oligonucleotide; CAG chr11 5301982 5302001 5301998 +
ggtgatgacctccaaagatg

SEQ ID NO: 17654 - DNA, 20 bp, Artificial Sequence
  Synthetic oligonucleotide; TAG chr11 5302013 5302032 5302029 +
tttctctcacaatcttcttg

SEQ ID NO: 17655 - DNA, 20 bp, Artificial Sequence
  Synthetic oligonucleotide; CAG chr11 5302024 5302043 5302040 +
atcttcttgtagcacatcat

SEQ ID NO: 17656 - DNA, 20 bp, Artificial Sequence
  Synthetic oligonucleotide; AGG chr11 5302025 5302044 5302041 +
tcttcttgtagcacatcatc

SEQ ID NO: 17657 - DNA, 20 bp, Artificial Sequence
  Synthetic oligonucleotide; TGG chr11 5302060 5302079 5302076 +
tcaaaacttaaatatttttc

SEQ ID NO: 17658 - DNA, 20 bp, Artificial Sequence
  Synthetic oligonucleotide; AAG chr11 5302087 5302106 5302103 +
tctcatacttaattaattgt

SEQ ID NO: 17659 - DNA, 20 bp, Artificial Sequence
  Synthetic oligonucleotide; AAG chr11 5302101 5302120 5302117 +
aattgtaagcctgtactcac

SEQ ID NO: 17660 - DNA, 20 bp, Artificial Sequence
  Synthetic oligonucleotide; AGG chr11 5302102 5302121 5302118 +
attgtaagcctgtactcaca

SEQ ID NO: 17661 - DNA, 20 bp, Artificial Sequence
  Synthetic oligonucleotide; TAG chr11 5302113 5302132 5302129 +
gtactcacaaggcctttccc

SEQ ID NO: 17662 - DNA, 20 bp, Artificial Sequence
  Synthetic oligonucleotide; TGG chr11 5302137 5302156 5302153 +
ataacaaataacaaaaatca

SEQ ID NO: 17663 - DNA, 20 bp, Artificial Sequence
  Synthetic oligonucleotide; CAG chr11 5302141 5302160 5302157 +
caaataacaaaaatcatggt

SEQ ID NO: 17664 - DNA, 20 bp, Artificial Sequence
  Synthetic oligonucleotide; AAG chr11 5302167 5302186 5302183 +
aataattccaattcactatg

SEQ ID NO: 17665 - DNA, 20 bp, Artificial Sequence
  Synthetic oligonucleotide; TAG chr11 5302215 5302234 5302231 +
tcatcttacgtctgtgctca

SEQ ID NO: 17666 - DNA, 20 bp, Artificial Sequence
  Synthetic oligonucleotide; TGG chr11 5302228 5302247 5302244 +
gtgctcatagccttgactct

SEQ ID NO: 17667 - DNA, 20 bp, Artificial Sequence
  Synthetic oligonucleotide; TAG chr11 5302238 5302257 5302254 +
ccttgactcttggtcccaaa

SEQ ID NO: 17668 - DNA, 20 bp, Artificial Sequence
  Synthetic oligonucleotide; AGG chr11 5302239 5302258 5302255 +
cttgactcttggtcccaaat

SEQ ID NO: 17669 - DNA, 20 bp, Artificial Sequence
  Synthetic oligonucleotide; TGG chr11 5302302 5302321 5302318 +
tcctcctattatttatcata

SEQ ID NO: 17670 - DNA, 20 bp, Artificial Sequence
  Synthetic oligonucleotide; GGG chr11 5302303 5302322 5302319 +
cctcctattatttatcatat

SEQ ID NO: 17671 - DNA, 20 bp, Artificial Sequence
  Synthetic oligonucleotide; AAG chr11 5302326 5302345 5302342 +
cccttactgtgttactatcc

SEQ ID NO: 17672 - DNA, 20 bp, Artificial Sequence
  Synthetic oligonucleotide; GAG chr11 5302331 5302350 5302347 +
actgtgttactatccaagtt

SEQ ID NO: 17673 - DNA, 20 bp, Artificial Sequence
  Synthetic oligonucleotide; CAG chr11 5302335 5302354 5302351 +
tgttactatccaagttgagt

SEQ ID NO: 17674 - DNA, 20 bp, Artificial Sequence
  Synthetic oligonucleotide; TGG chr11 5302363 5302382 5302379 +
attttttctcttgaaactaa

SEQ ID NO: 17675 - DNA, 20 bp, Artificial Sequence
  Synthetic oligonucleotide; GGG chr11 5302364 5302383 5302380 +
ttttttctcttgaaactaat

SEQ ID NO: 17676 - DNA, 20 bp, Artificial Sequence
  Synthetic oligonucleotide; CAG chr11 5302368 5302387 5302384 +
ttctcttgaaactaatggga

SEQ ID NO: 17677 - DNA, 20 bp, Artificial Sequence
  Synthetic oligonucleotide; TAG chr11 5302378 5302397 5302394 +
actaatgggacagctgtatt

SEQ ID NO: 17678 - DNA, 20 bp, Artificial Sequence
  Synthetic oligonucleotide; AGG chr11 5302379 5302398 5302395 +
ctaatgggacagctgtattt

SEQ ID NO: 17679 - DNA, 20 bp, Artificial Sequence
  Synthetic oligonucleotide; GAG chr11 5302392 5302411 5302408 +
tgtatttaggattaaccact

SEQ ID NO: 17680 - DNA, 20 bp, Artificial Sequence
  Synthetic oligonucleotide; AGG chr11 5302393 5302412 5302409 +
gtatttaggattaaccactg

SEQ ID NO: 17681 - DNA, 20 bp, Artificial Sequence
  Synthetic oligonucleotide; TAG chr11 5302411 5302430 5302427 +
tgaggaaaatgcttattcaa

SEQ ID NO: 17682 - DNA, 20 bp, Artificial Sequence
  Synthetic oligonucleotide; GAG chr11 5302422 5302441 5302438 +
cttattcaatagaaatgact

SEQ ID NO: 17683 - DNA, 20 bp, Artificial Sequence
  Synthetic oligonucleotide; AAG chr11 5302452 5302471 5302468 +
gtgatcaatgttgctatctc

SEQ ID NO: 17684 - DNA, 20 bp, Artificial Sequence
  Synthetic oligonucleotide; TGG chr11 5302455 5302474 5302471 +
atcaatgttgctatctcaag

SEQ ID NO: 17685 - DNA, 20 bp, Artificial Sequence
  Synthetic oligonucleotide; AAG chr11 5302467 5302486 5302483 +
atctcaagtggactgtgaat

SEQ ID NO: 17686 - DNA, 20 bp, Artificial Sequence
  Synthetic oligonucleotide; AAG chr11 5302470 5302489 5302486 +
tcaagtggactgtgaataag

SEQ ID NO: 17687 - DNA, 20 bp, Artificial Sequence
  Synthetic oligonucleotide; GAG chr11 5302472 5302491 5302488 +
aagtggactgtgaataagaa

SEQ ID NO: 17688 - DNA, 20 bp, Artificial Sequence
  Synthetic oligonucleotide; CAG chr11 5302479 5302498 5302495 +
ctgtgaataagaagagaacc

SEQ ID NO: 17689 - DNA, 20 bp, Artificial Sequence
  Synthetic oligonucleotide; TGG chr11 5302484 5302503 5302500 +
aataagaagagaacccagcc

SEQ ID NO: 17690 - DNA, 20 bp, Artificial Sequence
  Synthetic oligonucleotide; GGG chr11 5302485 5302504 5302501 +
ataagaagagaacccagcct

SEQ ID NO: 17691 - DNA, 20 bp, Artificial Sequence
  Synthetic oligonucleotide; TAG chr11 5302493 5302512 5302509 +
agaacccagcctgggcaaca

SEQ ID NO: 17692 - DNA, 20 bp, Artificial Sequence
  Synthetic oligonucleotide; TAG chr11 5302497 5302516 5302513 +
cccagcctgggcaacatagc

SEQ ID NO: 17693 - DNA, 20 bp, Artificial Sequence
  Synthetic oligonucleotide; AAG chr11 5302522 5302541 5302538 +
cctgcctccaccaaaaaaaa

SEQ ID NO: 17694 - DNA, 20 bp, Artificial Sequence
  Synthetic oligonucleotide; AAG chr11 5302527 5302546 5302543 +
ctccaccaaaaaaaaaagaa

SEQ ID NO: 17695 - DNA, 20 bp, Artificial Sequence
  Synthetic oligonucleotide; TAG chr11 5302538 5302557 5302554 +
aaaaaagaaaagataaaaat

SEQ ID NO: 17696 - DNA, 20 bp, Artificial Sequence
  Synthetic oligonucleotide; TGG chr11 5302542 5302561 5302558 +
aagaaaagataaaaattagc

SEQ ID NO: 17697 - DNA, 20 bp, Artificial Sequence
  Synthetic oligonucleotide; GGG chr11 5302543 5302562 5302559 +
agaaaagataaaaattagct

SEQ ID NO: 17698 - DNA, 20 bp, Artificial Sequence
  Synthetic oligonucleotide; CAG chr11 5302548 5302567 5302564 +
agataaaaattagctgggca

SEQ ID NO: 17699 - DNA, 20 bp, Artificial Sequence
  Synthetic oligonucleotide; AGG chr11 5302549 5302568 5302565 +
gataaaaattagctgggcac

SEQ ID NO: 17700 - DNA, 20 bp, Artificial Sequence
  Synthetic oligonucleotide; GGG chr11 5302550 5302569 5302566 +
ataaaaattagctgggcaca

SEQ ID NO: 17701 - DNA, 20 bp, Artificial Sequence
  Synthetic oligonucleotide; GGG chr11 5302551 5302570 5302567 +
taaaaattagctgggcacag

SEQ ID NO: 17702 - DNA, 20 bp, Artificial Sequence
  Synthetic oligonucleotide; GAG chr11 5302566 5302585 5302582 +
cacaggggcacacatcacct

SEQ ID NO: 17703 - DNA, 20 bp, Artificial Sequence
  Synthetic oligonucleotide; CAG chr11 5302571 5302590 5302587 +
gggcacacatcacctgagcc

SEQ ID NO: 17704 - DNA, 20 bp, Artificial Sequence
  Synthetic oligonucleotide; AGG chr11 5302572 5302591 5302588 +
ggcacacatcacctgagccc

SEQ ID NO: 17705 - DNA, 20 bp, Artificial Sequence
  Synthetic oligonucleotide; GAG chr11 5302580 5302599 5302596 +
tcacctgagcccaggactgt

SEQ ID NO: 17706 - DNA, 20 bp, Artificial Sequence
  Synthetic oligonucleotide; AGG chr11 5302581 5302600 5302597 +
cacctgagcccaggactgtg

SEQ ID NO: 17707 - DNA, 20 bp, Artificial Sequence
  Synthetic oligonucleotide; CAG chr11 5302587 5302606 5302603 +
agcccaggactgtgaggctg

SEQ ID NO: 17708 - DNA, 20 bp, Artificial Sequence
  Synthetic oligonucleotide; AGG chr11 5302588 5302607 5302604 +
gcccaggactgtgaggctgc

SEQ ID NO: 17709 - DNA, 20 bp, Artificial Sequence
  Synthetic oligonucleotide; GGG chr11 5302589 5302608 5302605 +
cccaggactgtgaggctgca

SEQ ID NO: 17710 - DNA, 20 bp, Artificial Sequence
  Synthetic oligonucleotide; GAG chr11 5302591 5302610 5302607 +
caggactgtgaggctgcagg

SEQ ID NO: 17711 - DNA, 20 bp, Artificial Sequence
  Synthetic oligonucleotide; CAG chr11 5302603 5302622 5302619 +
gctgcagggagctatgattg

SEQ ID NO: 17712 - DNA, 20 bp, Artificial Sequence
  Synthetic oligonucleotide; CAG chr11 5302616 5302635 5302632 +
atgattgcagcactgctctc

SEQ ID NO: 17713 - DNA, 20 bp, Artificial Sequence
  Synthetic oligonucleotide; TGG chr11 5302621 5302640 5302637 +
tgcagcactgctctccagcc

SEQ ID NO: 17714 - DNA, 20 bp, Artificial Sequence
  Synthetic oligonucleotide; GGG chr11 5302622 5302641 5302638 +
gcagcactgctctccagcct

SEQ ID NO: 17715 - DNA, 20 bp, Artificial Sequence
  Synthetic oligonucleotide; CGG chr11 5302628 5302647 5302644 +
ctgctctccagcctgggcaa

SEQ ID NO: 17716 - DNA, 20 bp, Artificial Sequence
  Synthetic oligonucleotide; GAG chr11 5302630 5302649 5302646 +
gctctccagcctgggcaacg

SEQ ID NO: 17717 - DNA, 20 bp, Artificial Sequence
  Synthetic oligonucleotide; CAG chr11 5302634 5302653 5302650 +
tccagcctgggcaacggagt

SEQ ID NO: 17718 - DNA, 20 bp, Artificial Sequence
  Synthetic oligonucleotide; AAG chr11 5302674 5302693 5302690 +
aataaaataaaataaaacga

SEQ ID NO: 17719 - DNA, 20 bp, Artificial Sequence
  Synthetic oligonucleotide; GAG chr11 5302696 5302715 5302712 +
gaaaataactcatctattgt

SEQ ID NO: 17720 - DNA, 20 bp, Artificial Sequence
  Synthetic oligonucleotide; CAG chr11 5302705 5302724 5302721 +
tcatctattgtgagtttcca

SEQ ID NO: 17721 - DNA, 20 bp, Artificial Sequence
  Synthetic oligonucleotide; AAG chr11 5302726 5302745 5302742 +
agaaatctgaacacctgaac

SEQ ID NO: 17722 - DNA, 20 bp, Artificial Sequence
  Synthetic oligonucleotide; TGG chr11 5302729 5302748 5302745 +
aatctgaacacctgaacaag

SEQ ID NO: 17723 - DNA, 20 bp, Artificial Sequence
  Synthetic oligonucleotide; GGG chr11 5302730 5302749 5302746 +
atctgaacacctgaacaagt

SEQ ID NO: 17724 - DNA, 20 bp, Artificial Sequence
  Synthetic oligonucleotide; AAG chr11 5302735 5302754 5302751 +
aacacctgaacaagtgggta

SEQ ID NO: 17725 - DNA, 20 bp, Artificial Sequence
  Synthetic oligonucleotide; TAG chr11 5302739 5302758 5302755 +
cctgaacaagtgggtaaagt

SEQ ID NO: 17726 - DNA, 20 bp, Artificial Sequence
  Synthetic oligonucleotide; TAG chr11 5302753 5302772 5302769 +
taaagttagtaaactcattt

SEQ ID NO: 17727 - DNA, 20 bp, Artificial Sequence
  Synthetic oligonucleotide; AAG chr11 5302757 5302776 5302773 +
gttagtaaactcattttaga

SEQ ID NO: 17728 - DNA, 20 bp, Artificial Sequence
  Synthetic oligonucleotide; AGG chr11 5302758 5302777 5302774 +
ttagtaaactcattttagaa

SEQ ID NO: 17729 - DNA, 20 bp, Artificial Sequence
  Synthetic oligonucleotide; CAG chr11 5302771 5302790 5302787 +
tttagaaaggtgtaattact

SEQ ID NO: 17730 - DNA, 20 bp, Artificial Sequence
  Synthetic oligonucleotide; TGG chr11 5302774 5302793 5302790 +
agaaaggtgtaattactcag

SEQ ID NO: 17731 - DNA, 20 bp, Artificial Sequence
  Synthetic oligonucleotide; TGG chr11 5302780 5302799 5302796 +
gtgtaattactcagtggact

SEQ ID NO: 17732 - DNA, 20 bp, Artificial Sequence
  Synthetic oligonucleotide; GGG chr11 5302781 5302800 5302797 +
tgtaattactcagtggactt

SEQ ID NO: 17733 - DNA, 20 bp, Artificial Sequence
  Synthetic oligonucleotide; CAG chr11 5302787 5302806 5302803 +
tactcagtggacttgggact

SEQ ID NO: 17734 - DNA, 20 bp, Artificial Sequence
  Synthetic oligonucleotide; AAG chr11 5302791 5302810 5302807 +
cagtggacttgggactcagc

SEQ ID NO: 17735 - DNA, 20 bp, Artificial Sequence
  Synthetic oligonucleotide; AAG chr11 5302810 5302829 5302826 +
caagttccctatgctgcaaa

SEQ ID NO: 17736 - DNA, 20 bp, Artificial Sequence
  Synthetic oligonucleotide; GAG chr11 5302816 5302835 5302832 +
ccctatgctgcaaaaagtct

SEQ ID NO: 17737 - DNA, 20 bp, Artificial Sequence
  Synthetic oligonucleotide; TGG chr11 5302822 5302841 5302838 +
gctgcaaaaagtctgagttt

SEQ ID NO: 17738 - DNA, 20 bp, Artificial Sequence
  Synthetic oligonucleotide; TAG chr11 5302830 5302849 5302846 +
aagtctgagttttggcacat

SEQ ID NO: 17739 - DNA, 20 bp, Artificial Sequence
  Synthetic oligonucleotide; AGG chr11 5302831 5302850 5302847 +
agtctgagttttggcacatt

SEQ ID NO: 17740 - DNA, 20 bp, Artificial Sequence
  Synthetic oligonucleotide; GGG chr11 5302832 5302851 5302848 +
gtctgagttttggcacatta

SEQ ID NO: 17741 - DNA, 20 bp, Artificial Sequence
  Synthetic oligonucleotide; TAG chr11 5302848 5302867 5302864 +
attagggacaaacatgaaaa

SEQ ID NO: 17742 - DNA, 20 bp, Artificial Sequence
  Synthetic oligonucleotide; AGG chr11 5302849 5302868 5302865 +
ttagggacaaacatgaaaat

SEQ ID NO: 17743 - DNA, 20 bp, Artificial Sequence
  Synthetic oligonucleotide; GAG chr11 5302851 5302870 5302867 +
agggacaaacatgaaaatag

SEQ ID NO: 17744 - DNA, 20 bp, Artificial Sequence
  Synthetic oligonucleotide; TGG chr11 5302862 5302881 5302878 +
tgaaaataggagactcatgt

SEQ ID NO: 17745 - DNA, 20 bp, Artificial Sequence
  Synthetic oligonucleotide; AAG chr11 5302865 5302884 5302881 +
aaataggagactcatgttgg

SEQ ID NO: 17746 - DNA, 20 bp, Artificial Sequence
  Synthetic oligonucleotide; CGG chr11 5302875 5302894 5302891 +
ctcatgttggaagctcataa

SEQ ID NO: 17747 - DNA, 20 bp, Artificial Sequence
  Synthetic oligonucleotide; AAG chr11 5302887 5302906 5302903 +
gctcataacggaaatatttt

SEQ ID NO: 17748 - DNA, 20 bp, Artificial Sequence
  Synthetic oligonucleotide; AGG chr11 5302888 5302907 5302904 +
ctcataacggaaatatttta

SEQ ID NO: 17749 - DNA, 20 bp, Artificial Sequence
  Synthetic oligonucleotide; GAG chr11 5302906 5302925 5302922 +
taaggacatacttctacaat

SEQ ID NO: 17750 - DNA, 20 bp, Artificial Sequence
  Synthetic oligonucleotide; AGG chr11 5302907 5302926 5302923 +
aaggacatacttctacaatg

SEQ ID NO: 17751 - DNA, 20 bp, Artificial Sequence
  Synthetic oligonucleotide; GGG chr11 5302908 5302927 5302924 +
aggacatacttctacaatga

SEQ ID NO: 17752 - DNA, 20 bp, Artificial Sequence
  Synthetic oligonucleotide; AAG chr11 5302920 5302939 5302936 +
tacaatgagggcctccacaa

SEQ ID NO: 17753 - DNA, 20 bp, Artificial Sequence
  Synthetic oligonucleotide; TAG chr11 5302935 5302954 5302951 +
cacaaaagcctaatacttgt

SEQ ID NO: 17754 - DNA, 20 bp, Artificial Sequence
  Synthetic oligonucleotide; GAG chr11 5302937 5302956 5302953 +
caaaagcctaatacttgtta

SEQ ID NO: 17755 - DNA, 20 bp, Artificial Sequence
  Synthetic oligonucleotide; TAG chr11 5302943 5302962 5302959 +
cctaatacttgttagagtca

SEQ ID NO: 17756 - DNA, 20 bp, Artificial Sequence
  Synthetic oligonucleotide; AAG chr11 5302952 5302971 5302968 +
tgttagagtcatagattcgt

SEQ ID NO: 17757 - DNA, 20 bp, Artificial Sequence
  Synthetic oligonucleotide; AAG chr11 5302967 5302986 5302983 +
ttcgtaagtatgttgatctg

SEQ ID NO: 17758 - DNA, 20 bp, Artificial Sequence
  Synthetic oligonucleotide; AGG chr11 5302968 5302987 5302984 +
tcgtaagtatgttgatctga

SEQ ID NO: 17759 - DNA, 20 bp, Artificial Sequence
  Synthetic oligonucleotide; GGG chr11 5302969 5302988 5302985 +
cgtaagtatgttgatctgaa

SEQ ID NO: 17760 - DNA, 20 bp, Artificial Sequence
  Synthetic oligonucleotide; TAG chr11 5302975 5302994 5302991 +
tatgttgatctgaagggcaa

SEQ ID NO: 17761 - DNA, 20 bp, Artificial Sequence
  Synthetic oligonucleotide; CGG chr11 5302984 5303003 5303000 +
ctgaagggcaatagtaatat

SEQ ID NO: 17762 - DNA, 20 bp, Artificial Sequence
  Synthetic oligonucleotide; AAG chr11 5302987 5303006 5303003 +
aagggcaatagtaatatcgg

SEQ ID NO: 17763 - DNA, 20 bp, Artificial Sequence
  Synthetic oligonucleotide; TGG chr11 5302991 5303010 5303007 +
gcaatagtaatatcggaagt

SEQ ID NO: 17764 - DNA, 20 bp, Artificial Sequence
  Synthetic oligonucleotide; GAG chr11 5302999 5303018 5303015 +
aatatcggaagttggtaatt

SEQ ID NO: 17765 - DNA, 20 bp, Artificial Sequence
  Synthetic oligonucleotide; CAG chr11 5303021 5303040 5303037 +
gttaataaacttcacacaac

SEQ ID NO: 17766 - DNA, 20 bp, Artificial Sequence
  Synthetic oligonucleotide; TAG chr11 5303027 5303046 5303043 +
aaacttcacacaaccagttc

SEQ ID NO: 17767 - DNA, 20 bp, Artificial Sequence
  Synthetic oligonucleotide; AGG chr11 5303028 5303047 5303044 +
aacttcacacaaccagttct

SEQ ID NO: 17768 - DNA, 20 bp, Artificial Sequence
  Synthetic oligonucleotide; GGG chr11 5303029 5303048 5303045 +
acttcacacaaccagttcta

SEQ ID NO: 17769 - DNA, 20 bp, Artificial Sequence
  Synthetic oligonucleotide; AAG chr11 5303034 5303053 5303050 +
acacaaccagttctagggaa

SEQ ID NO: 17770 - DNA, 20 bp, Artificial Sequence
  Synthetic oligonucleotide; AAG chr11 5303039 5303058 5303055 +
accagttctagggaaaagat

SEQ ID NO: 17771 - DNA, 20 bp, Artificial Sequence
  Synthetic oligonucleotide; CAG chr11 5303048 5303067 5303064 +
agggaaaagataagcactcc

SEQ ID NO: 17772 - DNA, 20 bp, Artificial Sequence
  Synthetic oligonucleotide; GAG chr11 5303050 5303069 5303066 +
ggaaaagataagcactccca

SEQ ID NO: 17773 - DNA, 20 bp, Artificial Sequence
  Synthetic oligonucleotide; GAG chr11 5303052 5303071 5303068 +
aaaagataagcactcccaga

SEQ ID NO: 17774 - DNA, 20 bp, Artificial Sequence
  Synthetic oligonucleotide; CGG chr11 5303061 5303080 5303077 +
gcactcccagagagaaaata

SEQ ID NO: 17775 - DNA, 20 bp, Artificial Sequence
  Synthetic oligonucleotide; TGG chr11 5303079 5303098 5303095 +
tacggcaactatgttgctga

SEQ ID NO: 17776 - DNA, 20 bp, Artificial Sequence
  Synthetic oligonucleotide; GAG chr11 5303081 5303100 5303097 +
cggcaactatgttgctgatg

SEQ ID NO: 17777 - DNA, 20 bp, Artificial Sequence
  Synthetic oligonucleotide; CAG chr11 5303093 5303112 5303109 +
tgctgatggagacaatctta

SEQ ID NO: 17778 - DNA, 20 bp, Artificial Sequence
  Synthetic oligonucleotide; AAG chr11 5303120 5303139 5303136 +
tctaatcattatgaatctgt

SEQ ID NO: 17779 - DNA, 20 bp, Artificial Sequence
  Synthetic oligonucleotide; GAG chr11 5303132 5303151 5303148 +
gaatctgtaagactcgtatt

SEQ ID NO: 17780 - DNA, 20 bp, Artificial Sequence
  Synthetic oligonucleotide; AAG chr11 5303145 5303164 5303161 +
tcgtattgagaaaaattcac

SEQ ID NO: 17781 - DNA, 20 bp, Artificial Sequence
  Synthetic oligonucleotide; AGG chr11 5303146 5303165 5303162 +
cgtattgagaaaaattcaca

SEQ ID NO: 17782 - DNA, 20 bp, Artificial Sequence
  Synthetic oligonucleotide; TAG chr11 5303156 5303175 5303172 +
aaaattcacaaggatcctca

SEQ ID NO: 17783 - DNA, 20 bp, Artificial Sequence
  Synthetic oligonucleotide; AGG chr11 5303157 5303176 5303173 +
aaattcacaaggatcctcat

SEQ ID NO: 17784 - DNA, 20 bp, Artificial Sequence
  Synthetic oligonucleotide; GGG chr11 5303158 5303177 5303174 +
aattcacaaggatcctcata

SEQ ID NO: 17785 - DNA, 20 bp, Artificial Sequence
  Synthetic oligonucleotide; AAG chr11 5303168 5303187 5303184 +
gatcctcatagggaactatg

SEQ ID NO: 17786 - DNA, 20 bp, Artificial Sequence
  Synthetic oligonucleotide; AAG chr11 5303218 5303237 5303234 +
tttataattacacttttaca

SEQ ID NO: 17787 - DNA, 20 bp, Artificial Sequence
  Synthetic oligonucleotide; AAG chr11 5303223 5303242 5303239 +
aattacacttttacaaagtc

SEQ ID NO: 17788 - DNA, 20 bp, Artificial Sequence
  Synthetic oligonucleotide; AAG chr11 5303246 5303265 5303262 +
atttttgttgttgtgatacc

SEQ ID NO: 17789 - DNA, 20 bp, Artificial Sequence
  Synthetic oligonucleotide; TAG chr11 5303257 5303276 5303273 +
tgtgataccaagaaattttg

SEQ ID NO: 17790 - DNA, 20 bp, Artificial Sequence
  Synthetic oligonucleotide; CAG chr11 5303260 5303279 5303276 +
gataccaagaaattttgtag

SEQ ID NO: 17791 - DNA, 20 bp, Artificial Sequence
  Synthetic oligonucleotide; AGG chr11 5303261 5303280 5303277 +
ataccaagaaattttgtagc

SEQ ID NO: 17792 - DNA, 20 bp, Artificial Sequence
  Synthetic oligonucleotide; TGG chr11 5303269 5303288 5303285 +
aaattttgtagcaggtttat

SEQ ID NO: 17793 - DNA, 20 bp, Artificial Sequence
  Synthetic oligonucleotide; GGG chr11 5303270 5303289 5303286 +
aattttgtagcaggtttatt

SEQ ID NO: 17794 - DNA, 20 bp, Artificial Sequence
  Synthetic oligonucleotide; AAG chr11 5303279 5303298 5303295 +
gcaggtttattgggaaaaca

SEQ ID NO: 17795 - DNA, 20 bp, Artificial Sequence
  Synthetic oligonucleotide; GAG chr11 5303281 5303300 5303297 +
aggtttattgggaaaacaaa

SEQ ID NO: 17796 - DNA, 20 bp, Artificial Sequence
  Synthetic oligonucleotide; AAG chr11 5303290 5303309 5303306 +
gggaaaacaaagagaactac

SEQ ID NO: 17797 - DNA, 20 bp, Artificial Sequence
  Synthetic oligonucleotide; AGG chr11 5303291 5303310 5303307 +
ggaaaacaaagagaactaca

SEQ ID NO: 17798 - DNA, 20 bp, Artificial Sequence
  Synthetic oligonucleotide; GGG chr11 5303292 5303311 5303308 +
gaaaacaaagagaactacaa

SEQ ID NO: 17799 - DNA, 20 bp, Artificial Sequence
  Synthetic oligonucleotide; CAG chr11 5303300 5303319 5303316 +
agagaactacaagggaaact

SEQ ID NO: 17800 - DNA, 20 bp, Artificial Sequence
  Synthetic oligonucleotide; CAG chr11 5303336 5303355 5303352 +
caattgattctgtatgtgtc

SEQ ID NO: 17801 - DNA, 20 bp, Artificial Sequence
  Synthetic oligonucleotide; GAG chr11 5303338 5303357 5303354 +
attgattctgtatgtgtcca

SEQ ID NO: 17802 - DNA, 20 bp, Artificial Sequence
  Synthetic oligonucleotide; AAG chr11 5303390 5303409 5303406 +
tattactaccgacacctttg

SEQ ID NO: 17803 - DNA, 20 bp, Artificial Sequence
  Synthetic oligonucleotide; CAG chr11 5303400 5303419 5303416 +
gacacctttgaagtgtaatt

SEQ ID NO: 17804 - DNA, 20 bp, Artificial Sequence
  Synthetic oligonucleotide; AAG chr11 5303411 5303430 5303427 +
agtgtaattcagtaaaaatg

SEQ ID NO: 17805 - DNA, 20 bp, Artificial Sequence
  Synthetic oligonucleotide; TAG chr11 5303455 5303474 5303471 +
ttttattttataaaaaccta

SEQ ID NO: 17806 - DNA, 20 bp, Artificial Sequence
  Synthetic oligonucleotide; CAG chr11 5303480 5303499 5303496 +
acaataataattatatgttt

SEQ ID NO: 17807 - DNA, 20 bp, Artificial Sequence
  Synthetic oligonucleotide; TGG chr11 5303488 5303507 5303504 +
aattatatgtttcagaattt

SEQ ID NO: 17808 - DNA, 20 bp, Artificial Sequence
  Synthetic oligonucleotide; TAG chr11 5303495 5303514 5303511 +
tgtttcagaattttggcaca

SEQ ID NO: 17809 - DNA, 20 bp, Artificial Sequence
  Synthetic oligonucleotide; AAG chr11 5303513 5303532 5303529 +
catagtaacatctctaatat

SEQ ID NO: 17810 - DNA, 20 bp, Artificial Sequence
  Synthetic oligonucleotide; TGG chr11 5303523 5303542 5303539 +
tctctaatataagcaattat

SEQ ID NO: 17811 - DNA, 20 bp, Artificial Sequence
  Synthetic oligonucleotide; TGG chr11 5303526 5303545 5303542 +
ctaatataagcaattattgg

SEQ ID NO: 17812 - DNA, 20 bp, Artificial Sequence
  Synthetic oligonucleotide; GAG chr11 5303528 5303547 5303544 +
aatataagcaattattggtg

SEQ ID NO: 17813 - DNA, 20 bp, Artificial Sequence
  Synthetic oligonucleotide; GAG chr11 5303530 5303549 5303546 +
tataagcaattattggtgga

SEQ ID NO: 17814 - DNA, 20 bp, Artificial Sequence
  Synthetic oligonucleotide; GAG chr11 5303532 5303551 5303548 +
taagcaattattggtggaga

SEQ ID NO: 17815 - DNA, 20 bp, Artificial Sequence
  Synthetic oligonucleotide; TGG chr11 5303536 5303555 5303552 +
caattattggtggagagaga

SEQ ID NO: 17816 - DNA, 20 bp, Artificial Sequence
  Synthetic oligonucleotide; CAG chr11 5303540 5303559 5303556 +
tattggtggagagagatgga

SEQ ID NO: 17817 - DNA, 20 bp, Artificial Sequence
  Synthetic oligonucleotide; GAG chr11 5303542 5303561 5303558 +
ttggtggagagagatggaca

SEQ ID NO: 17818 - DNA, 20 bp, Artificial Sequence
  Synthetic oligonucleotide; AGG chr11 5303543 5303562 5303559 +
tggtggagagagatggacag

SEQ ID NO: 17819 - DNA, 20 bp, Artificial Sequence
  Synthetic oligonucleotide; AAG chr11 5303547 5303566 5303563 +
ggagagagatggacagagga

SEQ ID NO: 17820 - DNA, 20 bp, Artificial Sequence
  Synthetic oligonucleotide; AGG chr11 5303548 5303567 5303564 +
gagagagatggacagaggaa

SEQ ID NO: 17821 - DNA, 20 bp, Artificial Sequence
  Synthetic oligonucleotide; AAG chr11 5303554 5303573 5303570 +
gatggacagaggaaaggtga

SEQ ID NO: 17822 - DNA, 20 bp, Artificial Sequence
  Synthetic oligonucleotide; AGG chr11 5303555 5303574 5303571 +
atggacagaggaaaggtgaa

SEQ ID NO: 17823 - DNA, 20 bp, Artificial Sequence
  Synthetic oligonucleotide; AAG chr11 5303566 5303585 5303582 +
aaaggtgaaaggacttttga

SEQ ID NO: 17824 - DNA, 20 bp, Artificial Sequence
  Synthetic oligonucleotide; AGG chr11 5303567 5303586 5303583 +
aaggtgaaaggacttttgaa

SEQ ID NO: 17825 - DNA, 20 bp, Artificial Sequence
  Synthetic oligonucleotide; GGG chr11 5303568 5303587 5303584 +
aggtgaaaggacttttgaaa

SEQ ID NO: 17826 - DNA, 20 bp, Artificial Sequence
  Synthetic oligonucleotide; CAG chr11 5303580 5303599 5303596 +
ttttgaaagggctgctactt

SEQ ID NO: 17827 - DNA, 20 bp, Artificial Sequence
  Synthetic oligonucleotide; AGG chr11 5303581 5303600 5303597 +
tttgaaagggctgctacttc

SEQ ID NO: 17828 - DNA, 20 bp, Artificial Sequence
  Synthetic oligonucleotide; GGG chr11 5303582 5303601 5303598 +
ttgaaagggctgctacttca

SEQ ID NO: 17829 - DNA, 20 bp, Artificial Sequence
  Synthetic oligonucleotide; GGG chr11 5303583 5303602 5303599 +
tgaaagggctgctacttcag

SEQ ID NO: 17830 - DNA, 20 bp, Artificial Sequence
  Synthetic oligonucleotide; CAG chr11 5303608 5303627 5303624 +
actgttgataacaaaaatgt

SEQ ID NO: 17831 - DNA, 20 bp, Artificial Sequence
  Synthetic oligonucleotide; TAG chr11 5303613 5303632 5303629 +
tgataacaaaaatgtcagtc

SEQ ID NO: 17832 - DNA, 20 bp, Artificial Sequence
  Synthetic oligonucleotide; AGG chr11 5303614 5303633 5303630 +
gataacaaaaatgtcagtct

SEQ ID NO: 17833 - DNA, 20 bp, Artificial Sequence
  Synthetic oligonucleotide; CAG chr11 5303622 5303641 5303638 +
aaatgtcagtctaggcactg

SEQ ID NO: 17834 - DNA, 20 bp, Artificial Sequence
  Synthetic oligonucleotide; TAG chr11 5303625 5303644 5303641 +
tgtcagtctaggcactgcag

SEQ ID NO: 17835 - DNA, 20 bp, Artificial Sequence
  Synthetic oligonucleotide; CAG chr11 5303628 5303647 5303644 +
cagtctaggcactgcagtag

SEQ ID NO: 17836 - DNA, 20 bp, Artificial Sequence
  Synthetic oligonucleotide; GAG chr11 5303630 5303649 5303646 +
gtctaggcactgcagtagca

SEQ ID NO: 17837 - DNA, 20 bp, Artificial Sequence
  Synthetic oligonucleotide; TGG chr11 5303645 5303664 5303661 +
tagcagagactatgttcata

SEQ ID NO: 17838 - DNA, 20 bp, Artificial Sequence
  Synthetic oligonucleotide; TAG chr11 5303697 5303716 5303713 +
ccactgaattatgacctgca

SEQ ID NO: 17839 - DNA, 20 bp, Artificial Sequence
  Synthetic oligonucleotide; TGG chr11 5303709 5303728 5303725 +
gacctgcatagtgcttaatg

SEQ ID NO: 17840 - DNA, 20 bp, Artificial Sequence
  Synthetic oligonucleotide; CAG chr11 5303712 5303731 5303728 +
ctgcatagtgcttaatgtgg

SEQ ID NO: 17841 - DNA, 20 bp, Artificial Sequence
  Synthetic oligonucleotide; CAG chr11 5303731 5303750 5303747 +
gcagaacttatctaccgcca

SEQ ID NO: 17842 - DNA, 20 bp, Artificial Sequence
  Synthetic oligonucleotide; AGG chr11 5303732 5303751 5303748 +
cagaacttatctaccgccac

SEQ ID NO: 17843 - DNA, 20 bp, Artificial Sequence
  Synthetic oligonucleotide; GAG chr11 5303734 5303753 5303750 +
gaacttatctaccgccacag

SEQ ID NO: 17844 - DNA, 20 bp, Artificial Sequence
  Synthetic oligonucleotide; AAG chr11 5303755 5303774 5303771 +
agtgatgtgtatatcattat

SEQ ID NO: 17845 - DNA, 20 bp, Artificial Sequence
  Synthetic oligonucleotide; AAG chr11 5303786 5303805 5303802 +
accttccaatgttgccttat

SEQ ID NO: 17846 - DNA, 20 bp, Artificial Sequence
  Synthetic oligonucleotide; GAG chr11 5303788 5303807 5303804 +
cttccaatgttgccttataa

SEQ ID NO: 17847 - DNA, 20 bp, Artificial Sequence
  Synthetic oligonucleotide; TGG chr11 5303793 5303812 5303809 +
aatgttgccttataagagaa

SEQ ID NO: 17848 - DNA, 20 bp, Artificial Sequence
  Synthetic oligonucleotide; CAG chr11 5303818 5303837 5303834 +
taatgccaaaatttgttgta

SEQ ID NO: 17849 - DNA, 20 bp, Artificial Sequence
  Synthetic oligonucleotide; AGG chr11 5303819 5303838 5303835 +
aatgccaaaatttgttgtac

SEQ ID NO: 17850 - DNA, 20 bp, Artificial Sequence
  Synthetic oligonucleotide; AAG chr11 5303824 5303843 5303840 +
caaaatttgttgtacaggat

SEQ ID NO: 17851 - DNA, 20 bp, Artificial Sequence
  Synthetic oligonucleotide; GAG chr11 5303826 5303845 5303842 +
aaatttgttgtacaggataa

SEQ ID NO: 17852 - DNA, 20 bp, Artificial Sequence
  Synthetic oligonucleotide; TGG chr11 5303842 5303861 5303858 +
ataagagctaaccacttatt

SEQ ID NO: 17853 - DNA, 20 bp, Artificial Sequence
  Synthetic oligonucleotide; CAG chr11 5303858 5303877 5303874 +
tatttggatctactgtcacc

SEQ ID NO: 17854 - DNA, 20 bp, Artificial Sequence
  Synthetic oligonucleotide; TGG chr11 5303865 5303884 5303881 +
atctactgtcacccagataa

SEQ ID NO: 17855 - DNA, 20 bp, Artificial Sequence
  Synthetic oligonucleotide; CAG chr11 5303870 5303889 5303886 +
ctgtcacccagataatggac

SEQ ID NO: 17856 - DNA, 20 bp, Artificial Sequence
  Synthetic oligonucleotide; TGG chr11 5303874 5303893 5303890 +
cacccagataatggaccaga

SEQ ID NO: 17857 - DNA, 20 bp, Artificial Sequence
  Synthetic oligonucleotide; GAG chr11 5303876 5303895 5303892 +
cccagataatggaccagatg

SEQ ID NO: 17858 - DNA, 20 bp, Artificial Sequence
  Synthetic oligonucleotide; AGG chr11 5303877 5303896 5303893 +
ccagataatggaccagatgg

SEQ ID NO: 17859 - DNA, 20 bp, Artificial Sequence
  Synthetic oligonucleotide; AAG chr11 5303880 5303899 5303896 +
gataatggaccagatggagg

SEQ ID NO: 17860 - DNA, 20 bp, Artificial Sequence
  Synthetic oligonucleotide; CGG chr11 5303884 5303903 5303900 +
atggaccagatggaggaagc

SEQ ID NO: 17861 - DNA, 20 bp, Artificial Sequence
  Synthetic oligonucleotide; GAG chr11 5303886 5303905 5303902 +
ggaccagatggaggaagccg

SEQ ID NO: 17862 - DNA, 20 bp, Artificial Sequence
  Synthetic oligonucleotide; AGG chr11 5303887 5303906 5303903 +
gaccagatggaggaagccgg

SEQ ID NO: 17863 - DNA, 20 bp, Artificial Sequence
  Synthetic oligonucleotide; GAG chr11 5303889 5303908 5303905 +
ccagatggaggaagccggag

SEQ ID NO: 17864 - DNA, 20 bp, Artificial Sequence
  Synthetic oligonucleotide; AGG chr11 5303890 5303909 5303906 +
cagatggaggaagccggagg

SEQ ID NO: 17865 - DNA, 20 bp, Artificial Sequence
  Synthetic oligonucleotide; TAG chr11 5303912 5303931 5303928 +
gcctgattattcttaaacta

SEQ ID NO: 17866 - DNA, 20 bp, Artificial Sequence
  Synthetic oligonucleotide; GAG chr11 5303932 5303951 5303948 +
tagtcgtgttttcaaaacct

SEQ ID NO: 17867 - DNA, 20 bp, Artificial Sequence
  Synthetic oligonucleotide; TGG chr11 5303942 5303961 5303958 +
ttcaaaacctgagctgcgtt

SEQ ID NO: 17868 - DNA, 20 bp, Artificial Sequence
  Synthetic oligonucleotide; GGG chr11 5303943 5303962 5303959 +
tcaaaacctgagctgcgttt

SEQ ID NO: 17869 - DNA, 20 bp, Artificial Sequence
  Synthetic oligonucleotide; CGG chr11 5303951 5303970 5303967 +
tgagctgcgtttgggacatg

SEQ ID NO: 17870 - DNA, 20 bp, Artificial Sequence
  Synthetic oligonucleotide; CAG chr11 5303959 5303978 5303975 +
gtttgggacatgcggatgca

SEQ ID NO: 17871 - DNA, 20 bp, Artificial Sequence
  Synthetic oligonucleotide; AGG chr11 5303960 5303979 5303976 +
tttgggacatgcggatgcac

SEQ ID NO: 17872 - DNA, 20 bp, Artificial Sequence
  Synthetic oligonucleotide; GGG chr11 5303961 5303980 5303977 +
ttgggacatgcggatgcaca

SEQ ID NO: 17873 - DNA, 20 bp, Artificial Sequence
  Synthetic oligonucleotide; TGG chr11 5303980 5303999 5303996 +
agggttttattaaaactgtg

SEQ ID NO: 17874 - DNA, 20 bp, Artificial Sequence
  Synthetic oligonucleotide; TGG chr11 5303990 5304009 5304006 +
taaaactgtgtggtaattac

SEQ ID NO: 17875 - DNA, 20 bp, Artificial Sequence
  Synthetic oligonucleotide; GGG chr11 5303991 5304010 5304007 +
aaaactgtgtggtaattact

SEQ ID NO: 17876 - DNA, 20 bp, Artificial Sequence
  Synthetic oligonucleotide; GGG chr11 5303992 5304011 5304008 +
aaactgtgtggtaattactg

SEQ ID NO: 17877 - DNA, 20 bp, Artificial Sequence
  Synthetic oligonucleotide; TAG chr11 5303998 5304017 5304014 +
tgtggtaattactggggaaa

SEQ ID NO: 17878 - DNA, 20 bp, Artificial Sequence
  Synthetic oligonucleotide; AAG chr11 5304015 5304034 5304031 +
aaatagttaatacaatttat

SEQ ID NO: 17879 - DNA, 20 bp, Artificial Sequence
  Synthetic oligonucleotide; AAG chr11 5304035 5304054 5304051 +
aagtatattttattgaccta

SEQ ID NO: 17880 - DNA, 20 bp, Artificial Sequence
  Synthetic oligonucleotide; TAG chr11 5304039 5304058 5304055 +
atattttattgacctaaaga

SEQ ID NO: 17881 - DNA, 20 bp, Artificial Sequence
  Synthetic oligonucleotide; CAG chr11 5304060 5304079 5304076 +
agccctctatttaacatctg

SEQ ID NO: 17882 - DNA, 20 bp, Artificial Sequence
  Synthetic oligonucleotide; TAG chr11 5304067 5304086 5304083 +
tatttaacatctgcagtctc

SEQ ID NO: 17883 - DNA, 20 bp, Artificial Sequence
  Synthetic oligonucleotide; CAG chr11 5304075 5304094 5304091 +
atctgcagtctctagcaaaa

SEQ ID NO: 17884 - DNA, 20 bp, Artificial Sequence
  Synthetic oligonucleotide; TGG chr11 5304084 5304103 5304100 +
ctctagcaaaacagctacgc

SEQ ID NO: 17885 - DNA, 20 bp, Artificial Sequence
  Synthetic oligonucleotide; TGG chr11 5304097 5304116 5304113 +
gctacgctggcatttaattg

SEQ ID NO: 17886 - DNA, 20 bp, Artificial Sequence
  Synthetic oligonucleotide; TGG chr11 5304106 5304125 5304122 +
gcatttaattgtggcaaatt

SEQ ID NO: 17887 - DNA, 20 bp, Artificial Sequence
  Synthetic oligonucleotide; TAG chr11 5304109 5304128 5304125 +
tttaattgtggcaaatttgg

SEQ ID NO: 17888 - DNA, 20 bp, Artificial Sequence
  Synthetic oligonucleotide; CAG chr11 5304115 5304134 5304131 +
tgtggcaaatttggtagtac

SEQ ID NO: 17889 - DNA, 20 bp, Artificial Sequence
  Synthetic oligonucleotide; CAG chr11 5304143 5304162 5304159 +
gtccacatacccaaatattc

SEQ ID NO: 17890 - DNA, 20 bp, Artificial Sequence
  Synthetic oligonucleotide; AGG chr11 5304144 5304163 5304160 +
tccacatacccaaatattcc

SEQ ID NO: 17891 - DNA, 20 bp, Artificial Sequence
  Synthetic oligonucleotide; GGG chr11 5304145 5304164 5304161 +
ccacatacccaaatattcca

SEQ ID NO: 17892 - DNA, 20 bp, Artificial Sequence
  Synthetic oligonucleotide; GAG chr11 5304147 5304166 5304163 +
acatacccaaatattccagg

SEQ ID NO: 17893 - DNA, 20 bp, Artificial Sequence
  Synthetic oligonucleotide; TAG chr11 5304152 5304171 5304168 +
cccaaatattccagggagaa

SEQ ID NO: 17894 - DNA, 20 bp, Artificial Sequence
  Synthetic oligonucleotide; TAG chr11 5304164 5304183 5304180 +
agggagaatagttgccctaa

SEQ ID NO: 17895 - DNA, 20 bp, Artificial Sequence
  Synthetic oligonucleotide; TAG chr11 5304169 5304188 5304185 +
gaatagttgccctaatagtt

SEQ ID NO: 17896 - DNA, 20 bp, Artificial Sequence
  Synthetic oligonucleotide; AGG chr11 5304170 5304189 5304186 +
aatagttgccctaatagttt

SEQ ID NO: 17897 - DNA, 20 bp, Artificial Sequence
  Synthetic oligonucleotide; GGG chr11 5304171 5304190 5304187 +
atagttgccctaatagttta

SEQ ID NO: 17898 - DNA, 20 bp, Artificial Sequence
  Synthetic oligonucleotide; GAG chr11 5304173 5304192 5304189 +
agttgccctaatagtttagg

SEQ ID NO: 17899 - DNA, 20 bp, Artificial Sequence
  Synthetic oligonucleotide; TAG chr11 5304181 5304200 5304197 +
taatagtttagggagtctcc

SEQ ID NO: 17900 - DNA, 20 bp, Artificial Sequence
  Synthetic oligonucleotide; AAG chr11 5304201 5304220 5304217 +
tagaatgtgatacatgacaa

SEQ ID NO: 17901 - DNA, 20 bp, Artificial Sequence
  Synthetic oligonucleotide; GAG chr11 5304205 5304224 5304221 +
atgtgatacatgacaaaagt

SEQ ID NO: 17902 - DNA, 20 bp, Artificial Sequence
  Synthetic oligonucleotide; GAG chr11 5304207 5304226 5304223 +
gtgatacatgacaaaagtga

SEQ ID NO: 17903 - DNA, 20 bp, Artificial Sequence
  Synthetic oligonucleotide; TAG chr11 5304219 5304238 5304235 +
aaaagtgagagtcataactt

SEQ ID NO: 17904 - DNA, 20 bp, Artificial Sequence
  Synthetic oligonucleotide; TGG chr11 5304222 5304241 5304238 +
agtgagagtcataactttag

SEQ ID NO: 17905 - DNA, 20 bp, Artificial Sequence
  Synthetic oligonucleotide; CAG chr11 5304238 5304257 5304254 +
ttagtggaatttatcactct

SEQ ID NO: 17906 - DNA, 20 bp, Artificial Sequence
  Synthetic oligonucleotide; AGG chr11 5304239 5304258 5304255 +
tagtggaatttatcactctc

SEQ ID NO: 17907 - DNA, 20 bp, Artificial Sequence
  Synthetic oligonucleotide; AAG chr11 5304243 5304262 5304259 +
ggaatttatcactctcaggc

SEQ ID NO: 17908 - DNA, 20 bp, Artificial Sequence
  Synthetic oligonucleotide; TAG chr11 5304248 5304267 5304264 +
ttatcactctcaggcaagca

SEQ ID NO: 17909 - DNA, 20 bp, Artificial Sequence
  Synthetic oligonucleotide; GAG chr11 5304250 5304269 5304266 +
atcactctcaggcaagcata

SEQ ID NO: 17910 - DNA, 20 bp, Artificial Sequence
  Synthetic oligonucleotide; AGG chr11 5304251 5304270 5304267 +
tcactctcaggcaagcatag

SEQ ID NO: 17911 - DNA, 20 bp, Artificial Sequence
  Synthetic oligonucleotide; GAG chr11 5304260 5304279 5304276 +
ggcaagcatagaggccccct

SEQ ID NO: 17912 - DNA, 20 bp, Artificial Sequence
  Synthetic oligonucleotide; AGG chr11 5304261 5304280 5304277 +
gcaagcatagaggccccctg

SEQ ID NO: 17913 - DNA, 20 bp, Artificial Sequence
  Synthetic oligonucleotide; GGG chr11 5304262 5304281 5304278 +
caagcatagaggccccctga

SEQ ID NO: 17914 - DNA, 20 bp, Artificial Sequence
  Synthetic oligonucleotide; TGG chr11 5304278 5304297 5304294 +
ctgagggatgcaaaaatgac

SEQ ID NO: 17915 - DNA, 20 bp, Artificial Sequence
  Synthetic oligonucleotide; GAG chr11 5304305 5304324 5304321 +
ctgttctcttgcccctttct

SEQ ID NO: 17916 - DNA, 20 bp, Artificial Sequence
  Synthetic oligonucleotide; TGG chr11 5304314 5304333 5304330 +
tgcccctttctgagtgcctt

SEQ ID NO: 17917 - DNA, 20 bp, Artificial Sequence
  Synthetic oligonucleotide; CAG chr11 5304330 5304349 5304346 +
cctttggactgattctttga

SEQ ID NO: 17918 - DNA, 20 bp, Artificial Sequence
  Synthetic oligonucleotide; CAG chr11 5304342 5304361 5304358 +
ttctttgacagcaactatcc

SEQ ID NO: 17919 - DNA, 20 bp, Artificial Sequence
  Synthetic oligonucleotide; GAG chr11 5304344 5304363 5304360 +
ctttgacagcaactatccca

SEQ ID NO: 17920 - DNA, 20 bp, Artificial Sequence
  Synthetic oligonucleotide; AAG chr11 5304352 5304371 5304368 +
gcaactatcccagagtcctc

SEQ ID NO: 17921 - DNA, 20 bp, Artificial Sequence
  Synthetic oligonucleotide; GAG chr11 5304354 5304373 5304370 +
aactatcccagagtcctcaa

SEQ ID NO: 17922 - DNA, 20 bp, Artificial Sequence
  Synthetic oligonucleotide; AAG chr11 5304363 5304382 5304379 +
agagtcctcaagagtttctg

SEQ ID NO: 17923 - DNA, 20 bp, Artificial Sequence
  Synthetic oligonucleotide; AGG chr11 5304364 5304383 5304380 +
gagtcctcaagagtttctga

SEQ ID NO: 17924 - DNA, 20 bp, Artificial Sequence
  Synthetic oligonucleotide; TAG chr11 5304372 5304391 5304388 +
aagagtttctgaaggtaaca

SEQ ID NO: 17925 - DNA, 20 bp, Artificial Sequence
  Synthetic oligonucleotide; CAG chr11 5304385 5304404 5304401 +
ggtaacatagatccatcatc

SEQ ID NO: 17926 - DNA, 20 bp, Artificial Sequence
  Synthetic oligonucleotide; GAG chr11 5304387 5304406 5304403 +
taacatagatccatcatcca

SEQ ID NO: 17927 - DNA, 20 bp, Artificial Sequence
  Synthetic oligonucleotide; AAG chr11 5304416 5304435 5304432 +
caacttgccatgctgacaaa

SEQ ID NO: 17928 - DNA, 20 bp, Artificial Sequence
  Synthetic oligonucleotide; TAG chr11 5304421 5304440 5304437 +
tgccatgctgacaaaaagct

SEQ ID NO: 17929 - DNA, 20 bp, Artificial Sequence
  Synthetic oligonucleotide; AGG chr11 5304422 5304441 5304438 +
gccatgctgacaaaaagctt

SEQ ID NO: 17930 - DNA, 20 bp, Artificial Sequence
  Synthetic oligonucleotide; CAG chr11 5304432 5304451 5304448 +
caaaaagcttaggaactgtt

SEQ ID NO: 17931 - DNA, 20 bp, Artificial Sequence
  Synthetic oligonucleotide; AGG chr11 5304433 5304452 5304449 +
aaaaagcttaggaactgttc

SEQ ID NO: 17932 - DNA, 20 bp, Artificial Sequence
  Synthetic oligonucleotide; AAG chr11 5304448 5304467 5304464 +
tgttcaggaaaccatttata

SEQ ID NO: 17933 - DNA, 20 bp, Artificial Sequence
  Synthetic oligonucleotide; GAG chr11 5304465 5304484 5304481 +
ataaagacataaactaaaat

SEQ ID NO: 17934 - DNA, 20 bp, Artificial Sequence
  Synthetic oligonucleotide; AAG chr11 5304468 5304487 5304484 +
aagacataaactaaaatgag

SEQ ID NO: 17935 - DNA, 20 bp, Artificial Sequence
  Synthetic oligonucleotide; AAG chr11 5304476 5304495 5304492 +
aactaaaatgagaagacaaa

SEQ ID NO: 17936 - DNA, 20 bp, Artificial Sequence
  Synthetic oligonucleotide; GAG chr11 5304478 5304497 5304494 +
ctaaaatgagaagacaaaaa

SEQ ID NO: 17937 - DNA, 20 bp, Artificial Sequence
  Synthetic oligonucleotide; AAG chr11 5304487 5304506 5304503 +
gaagacaaaaagagaatatt

SEQ ID NO: 17938 - DNA, 20 bp, Artificial Sequence
  Synthetic oligonucleotide; AAG chr11 5304502 5304521 5304518 +
atattaagatcgtgttaaaa

SEQ ID NO: 17939 - DNA, 20 bp, Artificial Sequence
  Synthetic oligonucleotide; CAG chr11 5304507 5304526 5304523 +
aagatcgtgttaaaaaagaa

SEQ ID NO: 17940 - DNA, 20 bp, Artificial Sequence
  Synthetic oligonucleotide; TAG chr11 5304519 5304538 5304535 +
aaaaagaacagtcttccgtt

SEQ ID NO: 17941 - DNA, 20 bp, Artificial Sequence
  Synthetic oligonucleotide; CAG chr11 5304525 5304544 5304541 +
aacagtcttccgtttagttc

SEQ ID NO: 17942 - DNA, 20 bp, Artificial Sequence
  Synthetic oligonucleotide; AAG chr11 5304537 5304556 5304553 +
tttagttccagataatctgc

SEQ ID NO: 17943 - DNA, 20 bp, Artificial Sequence
  Synthetic oligonucleotide; CAG chr11 5304553 5304572 5304569 +
ctgcaagtgccctgtacaat

SEQ ID NO: 17944 - DNA, 20 bp, Artificial Sequence
  Synthetic oligonucleotide; TAG chr11 5304611 5304630 5304627 +
gccccaaaattgtgttccta

SEQ ID NO: 17945 - DNA, 20 bp, Artificial Sequence
  Synthetic oligonucleotide; AAG chr11 5304614 5304633 5304630 +
ccaaaattgtgttcctatag

SEQ ID NO: 17946 - DNA, 20 bp, Artificial Sequence
  Synthetic oligonucleotide; AAG chr11 5304648 5304667 5304664 +
tataccaaaataaatattta

SEQ ID NO: 17947 - DNA, 20 bp, Artificial Sequence
  Synthetic oligonucleotide; TGG chr11 5304662 5304681 5304678 +
tatttaaagtcaactgacaa

SEQ ID NO: 17948 - DNA, 20 bp, Artificial Sequence
  Synthetic oligonucleotide; GGG chr11 5304663 5304682 5304679 +
atttaaagtcaactgacaat

SEQ ID NO: 17949 - DNA, 20 bp, Artificial Sequence
  Synthetic oligonucleotide; AAG chr11 5304666 5304685 5304682 +
taaagtcaactgacaatggg

SEQ ID NO: 17950 - DNA, 20 bp, Artificial Sequence
  Synthetic oligonucleotide; GAG chr11 5304673 5304692 5304689 +
aactgacaatgggaagccat

SEQ ID NO: 17951 - DNA, 20 bp, Artificial Sequence
  Synthetic oligonucleotide; AAG chr11 5304679 5304698 5304695 +
caatgggaagccatgagatg

SEQ ID NO: 17952 - DNA, 20 bp, Artificial Sequence
  Synthetic oligonucleotide; CAG chr11 5304702 5304721 5304718 +
acaaaatatctgaaaaatct

SEQ ID NO: 17953 - DNA, 20 bp, Artificial Sequence
  Synthetic oligonucleotide; AAG chr11 5304710 5304729 5304726 +
tctgaaaaatctcagctttt

SEQ ID NO: 17954 - DNA, 20 bp, Artificial Sequence
  Synthetic oligonucleotide; AAG chr11 5304735 5304754 5304751 +
acttttttatatcttacctt

SEQ ID NO: 17955 - DNA, 20 bp, Artificial Sequence
  Synthetic oligonucleotide; TGG chr11 5304750 5304769 5304766 +
accttaagtacaaattaaaa

SEQ ID NO: 17956 - DNA, 20 bp, Artificial Sequence
  Synthetic oligonucleotide; AAG chr11 5304753 5304772 5304769 +
ttaagtacaaattaaaatgg

SEQ ID NO: 17957 - DNA, 20 bp, Artificial Sequence
  Synthetic oligonucleotide; GAG chr11 5304755 5304774 5304771 +
aagtacaaattaaaatggaa

SEQ ID NO: 17958 - DNA, 20 bp, Artificial Sequence
  Synthetic oligonucleotide; AGG chr11 5304756 5304775 5304772 +
agtacaaattaaaatggaag

SEQ ID NO: 17959 - DNA, 20 bp, Artificial Sequence
  Synthetic oligonucleotide; TGG chr11 5304759 5304778 5304775 +
acaaattaaaatggaagagg

SEQ ID NO: 17960 - DNA, 20 bp, Artificial Sequence
  Synthetic oligonucleotide; CAG chr11 5304763 5304782 5304779 +
attaaaatggaagaggtggc

SEQ ID NO: 17961 - DNA, 20 bp, Artificial Sequence
  Synthetic oligonucleotide; AGG chr11 5304764 5304783 5304780 +
ttaaaatggaagaggtggcc

SEQ ID NO: 17962 - DNA, 20 bp, Artificial Sequence
  Synthetic oligonucleotide; CAG chr11 5304769 5304788 5304785 +
atggaagaggtggccaggca

SEQ ID NO: 17963 - DNA, 20 bp, Artificial Sequence
  Synthetic oligonucleotide; GAG chr11 5304771 5304790 5304787 +
ggaagaggtggccaggcaca

SEQ ID NO: 17964 - DNA, 20 bp, Artificial Sequence
  Synthetic oligonucleotide; AGG chr11 5304772 5304791 5304788 +
gaagaggtggccaggcacag

SEQ ID NO: 17965 - DNA, 20 bp, Artificial Sequence
  Synthetic oligonucleotide; TAG chr11 5304791 5304810 5304807 +
gaggctcatgcctgtaatcc

SEQ ID NO: 17966 - DNA, 20 bp, Artificial Sequence
  Synthetic oligonucleotide; TGG chr11 5304799 5304818 5304815 +
tgcctgtaatcctagcactt

SEQ ID NO: 17967 - DNA, 20 bp, Artificial Sequence
  Synthetic oligonucleotide; AAG chr11 5304802 5304821 5304818 +
ctgtaatcctagcactttgg

SEQ ID NO: 17968 - DNA, 20 bp, Artificial Sequence
  Synthetic oligonucleotide; AGG chr11 5304803 5304822 5304819 +
tgtaatcctagcactttgga

SEQ ID NO: 17969 - DNA, 20 bp, Artificial Sequence
  Synthetic oligonucleotide; GAG chr11 5304808 5304827 5304824 +
tcctagcactttggaaggct

SEQ ID NO: 17970 - DNA, 20 bp, Artificial Sequence
  Synthetic oligonucleotide; AGG chr11 5304809 5304828 5304825 +
cctagcactttggaaggctg

SEQ ID NO: 17971 - DNA, 20 bp, Artificial Sequence
  Synthetic oligonucleotide; TGG chr11 5304812 5304831 5304828 +
agcactttggaaggctgagg

SEQ ID NO: 17972 - DNA, 20 bp, Artificial Sequence
  Synthetic oligonucleotide; GAG chr11 5304820 5304839 5304836 +
ggaaggctgaggtggatcac

SEQ ID NO: 17973 - DNA, 20 bp, Artificial Sequence
  Synthetic oligonucleotide; AGG chr11 5304821 5304840 5304837 +
gaaggctgaggtggatcacg

SEQ ID NO: 17974 - DNA, 20 bp, Artificial Sequence
  Synthetic oligonucleotide; CAG chr11 5304825 5304844 5304841 +
gctgaggtggatcacgaggt

SEQ ID NO: 17975 - DNA, 20 bp, Artificial Sequence
  Synthetic oligonucleotide; CAG chr11 5304828 5304847 5304844 +
gaggtggatcacgaggtcag

SEQ ID NO: 17976 - DNA, 20 bp, Artificial Sequence
  Synthetic oligonucleotide; GAG chr11 5304834 5304853 5304850 +
gatcacgaggtcagcagttt

SEQ ID NO: 17977 - DNA, 20 bp, Artificial Sequence
  Synthetic oligonucleotide; TAG chr11 5304839 5304858 5304855 +
cgaggtcagcagtttgagac

SEQ ID NO: 17978 - DNA, 20 bp, Artificial Sequence
  Synthetic oligonucleotide; TGG chr11 5304844 5304863 5304860 +
tcagcagtttgagactagcc

SEQ ID NO: 17979 - DNA, 20 bp, Artificial Sequence
  Synthetic oligonucleotide; TGG chr11 5304853 5304872 5304869 +
tgagactagcctggccaaca

SEQ ID NO: 17980 - DNA, 20 bp, Artificial Sequence
  Synthetic oligonucleotide; TAG chr11 5304888 5304907 5304904 +
tctactaaaaatacaaaaat

SEQ ID NO: 17981 - DNA, 20 bp, Artificial Sequence
  Synthetic oligonucleotide; TGG chr11 5304892 5304911 5304908 +
ctaaaaatacaaaaattagc

SEQ ID NO: 17982 - DNA, 20 bp, Artificial Sequence
  Synthetic oligonucleotide; GGG chr11 5304893 5304912 5304909 +
taaaaatacaaaaattagct

SEQ ID NO: 17983 - DNA, 20 bp, Artificial Sequence
  Synthetic oligonucleotide; TGG chr11 5304898 5304917 5304914 +
atacaaaaattagctgggtg

SEQ ID NO: 17984 - DNA, 20 bp, Artificial Sequence
  Synthetic oligonucleotide; TGG chr11 5304901 5304920 5304917 +
caaaaattagctgggtgtgg

SEQ ID NO: 17985 - DNA, 20 bp, Artificial Sequence
  Synthetic oligonucleotide; GAG chr11 5304905 5304924 5304921 +
aattagctgggtgtggtggt

SEQ ID NO: 17986 - DNA, 20 bp, Artificial Sequence
  Synthetic oligonucleotide; CAG chr11 5304920 5304939 5304936 +
gtggtgagcgcctgtaatcc

SEQ ID NO: 17987 - DNA, 20 bp, Artificial Sequence
  Synthetic oligonucleotide; CGG chr11 5304928 5304947 5304944 +
cgcctgtaatcccagctact

SEQ ID NO: 17988 - DNA, 20 bp, Artificial Sequence
  Synthetic oligonucleotide; GGG chr11 5304929 5304948 5304945 +
gcctgtaatcccagctactc

SEQ ID NO: 17989 - DNA, 20 bp, Artificial Sequence
  Synthetic oligonucleotide; GAG chr11 5304931 5304950 5304947 +
ctgtaatcccagctactcgg

SEQ ID NO: 17990 - DNA, 20 bp, Artificial Sequence
  Synthetic oligonucleotide; AGG chr11 5304932 5304951 5304948 +
tgtaatcccagctactcggg

SEQ ID NO: 17991 - DNA, 20 bp, Artificial Sequence
  Synthetic oligonucleotide; GAG chr11 5304937 5304956 5304953 +
tcccagctactcgggaggct

SEQ ID NO: 17992 - DNA, 20 bp, Artificial Sequence
  Synthetic oligonucleotide; AGG chr11 5304938 5304957 5304954 +
cccagctactcgggaggctg

SEQ ID NO: 17993 - DNA, 20 bp, Artificial Sequence
  Synthetic oligonucleotide; CAG chr11 5304941 5304960 5304957 +
agctactcgggaggctgagg

SEQ ID NO: 17994 - DNA, 20 bp, Artificial Sequence
  Synthetic oligonucleotide; AGG chr11 5304942 5304961 5304958 +
gctactcgggaggctgaggc

SEQ ID NO: 17995 - DNA, 20 bp, Artificial Sequence
  Synthetic oligonucleotide; GAG chr11 5304944 5304963 5304960 +
tactcgggaggctgaggcag

SEQ ID NO: 17996 - DNA, 20 bp, Artificial Sequence
  Synthetic oligonucleotide; TGG chr11 5304964 5304983 5304980 +
gagaattgctttaaaaaaac

SEQ ID NO: 17997 - DNA, 20 bp, Artificial Sequence
  Synthetic oligonucleotide; GGG chr11 5304965 5304984 5304981 +
agaattgctttaaaaaaact

SEQ ID NO: 17998 - DNA, 20 bp, Artificial Sequence
  Synthetic oligonucleotide; GGG chr11 5304966 5304985 5304982 +
gaattgctttaaaaaaactg

SEQ ID NO: 17999 - DNA, 20 bp, Artificial Sequence
  Synthetic oligonucleotide; GAG chr11 5304968 5304987 5304984 +
attgctttaaaaaaactggg

SEQ ID NO: 18000 - DNA, 20 bp, Artificial Sequence
  Synthetic oligonucleotide; CAG chr11 5304971 5304990 5304987 +
gctttaaaaaaactggggag

SEQ ID NO: 18001 - DNA, 20 bp, Artificial Sequence
  Synthetic oligonucleotide; GAG chr11 5304973 5304992 5304989 +
tttaaaaaaactggggagca

SEQ ID NO: 18002 - DNA, 20 bp, Artificial Sequence
  Synthetic oligonucleotide; AGG chr11 5304974 5304993 5304990 +
ttaaaaaaactggggagcag

SEQ ID NO: 18003 - DNA, 20 bp, Artificial Sequence
  Synthetic oligonucleotide; CAG chr11 5304983 5305002 5304999 +
ctggggagcagaggtcgtcg

SEQ ID NO: 18004 - DNA, 20 bp, Artificial Sequence
  Synthetic oligonucleotide; GAG chr11 5304987 5305006 5305003 +
ggagcagaggtcgtcgcagt

SEQ ID NO: 18005 - DNA, 20 bp, Artificial Sequence
  Synthetic oligonucleotide; AAG chr11 5304992 5305011 5305008 +
agaggtcgtcgcagtgagcc

SEQ ID NO: 18006 - DNA, 20 bp, Artificial Sequence
  Synthetic oligonucleotide; CAG chr11 5305012 5305031 5305028 +
aagattgtgccactgcacta

SEQ ID NO: 18007 - DNA, 20 bp, Artificial Sequence
  Synthetic oligonucleotide; TGG chr11 5305017 5305036 5305033 +
tgtgccactgcactacagcc

SEQ ID NO: 18008 - DNA, 20 bp, Artificial Sequence
  Synthetic oligonucleotide; GGG chr11 5305018 5305037 5305034 +
gtgccactgcactacagcct

SEQ ID NO: 18009 - DNA, 20 bp, Artificial Sequence
  Synthetic oligonucleotide; AAG chr11 5305026 5305045 5305042 +
gcactacagcctgggcgaca

SEQ ID NO: 18010 - DNA, 20 bp, Artificial Sequence
  Synthetic oligonucleotide; AAG chr11 5305030 5305049 5305046 +
tacagcctgggcgacaaagc

SEQ ID NO: 18011 - DNA, 20 bp, Artificial Sequence
  Synthetic oligonucleotide; AGG chr11 5305031 5305050 5305047 +
acagcctgggcgacaaagca

SEQ ID NO: 18012 - DNA, 20 bp, Artificial Sequence
  Synthetic oligonucleotide; AAG chr11 5305059 5305078 5305075 +
tctcaaaaaaaaaaaaaaaa

SEQ ID NO: 18013 - DNA, 20 bp, Artificial Sequence
  Synthetic oligonucleotide; AGG chr11 5305060 5305079 5305076 +
ctcaaaaaaaaaaaaaaaaa

SEQ ID NO: 18014 - DNA, 20 bp, Artificial Sequence
  Synthetic oligonucleotide; TGG chr11 5305065 5305084 5305081 +
aaaaaaaaaaaaaaaaggtt

SEQ ID NO: 18015 - DNA, 20 bp, Artificial Sequence
  Synthetic oligonucleotide; GAG chr11 5305067 5305086 5305083 +
aaaaaaaaaaaaaaggtttg

SEQ ID NO: 18016 - DNA, 20 bp, Artificial Sequence
  Synthetic oligonucleotide; GAG chr11 5305069 5305088 5305085 +
aaaaaaaaaaaaggtttgga

SEQ ID NO: 18017 - DNA, 20 bp, Artificial Sequence
  Synthetic oligonucleotide; TGG chr11 5305078 5305097 5305094 +
aaaggtttggagagaaacat

SEQ ID NO: 18018 - DNA, 20 bp, Artificial Sequence
  Synthetic oligonucleotide; GGG chr11 5305079 5305098 5305095 +
aaggtttggagagaaacatt

SEQ ID NO: 18019 - DNA, 20 bp, Artificial Sequence
  Synthetic oligonucleotide; TAG chr11 5305086 5305105 5305102 +
ggagagaaacattgggaaac

SEQ ID NO: 18020 - DNA, 20 bp, Artificial Sequence
  Synthetic oligonucleotide; AGG chr11 5305087 5305106 5305103 +
gagagaaacattgggaaact

SEQ ID NO: 18021 - DNA, 20 bp, Artificial Sequence
  Synthetic oligonucleotide; CAG chr11 5305104 5305123 5305120 +
actaggacaaattttgctct

SEQ ID NO: 18022 - DNA, 20 bp, Artificial Sequence
  Synthetic oligonucleotide; AAG chr11 5305111 5305130 5305127 +
caaattttgctctcagtaaa

SEQ ID NO: 18023 - DNA, 20 bp, Artificial Sequence
  Synthetic oligonucleotide; AAG chr11 5305115 5305134 5305131 +
ttttgctctcagtaaaaaga

SEQ ID NO: 18024 - DNA, 20 bp, Artificial Sequence
  Synthetic oligonucleotide; AAG chr11 5305124 5305143 5305140 +
cagtaaaaagaaagatctca

SEQ ID NO: 18025 - DNA, 20 bp, Artificial Sequence
  Synthetic oligonucleotide; AGG chr11 5305125 5305144 5305141 +
agtaaaaagaaagatctcaa

SEQ ID NO: 18026 - DNA, 20 bp, Artificial Sequence
  Synthetic oligonucleotide; GAG chr11 5305127 5305146 5305143 +
taaaaagaaagatctcaaag

SEQ ID NO: 18027 - DNA, 20 bp, Artificial Sequence
  Synthetic oligonucleotide; TAG chr11 5305131 5305150 5305147 +
aagaaagatctcaaaggaga

SEQ ID NO: 18028 - DNA, 20 bp, Artificial Sequence
  Synthetic oligonucleotide; AAG chr11 5305137 5305156 5305153 +
gatctcaaaggagatagaca

SEQ ID NO: 18029 - DNA, 20 bp, Artificial Sequence
  Synthetic oligonucleotide; AAG chr11 5305140 5305159 5305156 +
ctcaaaggagatagacaaag

SEQ ID NO: 18030 - DNA, 20 bp, Artificial Sequence
  Synthetic oligonucleotide; CAG chr11 5305143 5305162 5305159 +
aaaggagatagacaaagaag

SEQ ID NO: 18031 - DNA, 20 bp, Artificial Sequence
  Synthetic oligonucleotide; AGG chr11 5305144 5305163 5305160 +
aaggagatagacaaagaagc

SEQ ID NO: 18032 - DNA, 20 bp, Artificial Sequence
  Synthetic oligonucleotide; CAG chr11 5305149 5305168 5305165 +
gatagacaaagaagcaggca

SEQ ID NO: 18033 - DNA, 20 bp, Artificial Sequence
  Synthetic oligonucleotide; AAG chr11 5305156 5305175 5305172 +
aaagaagcaggcacagatgt

SEQ ID NO: 18034 - DNA, 20 bp, Artificial Sequence
  Synthetic oligonucleotide; GAG chr11 5305158 5305177 5305174 +
agaagcaggcacagatgtaa

SEQ ID NO: 18035 - DNA, 20 bp, Artificial Sequence
  Synthetic oligonucleotide; AGG chr11 5305159 5305178 5305175 +
gaagcaggcacagatgtaag

SEQ ID NO: 18036 - DNA, 20 bp, Artificial Sequence
  Synthetic oligonucleotide; TAG chr11 5305163 5305182 5305179 +
caggcacagatgtaagagga

SEQ ID NO: 18037 - DNA, 20 bp, Artificial Sequence
  Synthetic oligonucleotide; AAG chr11 5305168 5305187 5305184 +
acagatgtaagaggatagca

SEQ ID NO: 18038 - DNA, 20 bp, Artificial Sequence
  Synthetic oligonucleotide; AAG chr11 5305200 5305219 5305216 +
atttacaaaaaaacaatgaa

SEQ ID NO: 18039 - DNA, 20 bp, Artificial Sequence
  Synthetic oligonucleotide; AGG chr11 5305201 5305220 5305217 +
tttacaaaaaaacaatgaaa

SEQ ID NO: 18040 - DNA, 20 bp, Artificial Sequence
  Synthetic oligonucleotide; GGG chr11 5305202 5305221 5305218 +
ttacaaaaaaacaatgaaaa

SEQ ID NO: 18041 - DNA, 20 bp, Artificial Sequence
  Synthetic oligonucleotide; AAG chr11 5305205 5305224 5305221 +
caaaaaaacaatgaaaaggg

SEQ ID NO: 18042 - DNA, 20 bp, Artificial Sequence
  Synthetic oligonucleotide; TAG chr11 5305212 5305231 5305228 +
acaatgaaaagggaagttta

SEQ ID NO: 18043 - DNA, 20 bp, Artificial Sequence
  Synthetic oligonucleotide; AGG chr11 5305213 5305232 5305229 +
caatgaaaagggaagtttat

SEQ ID NO: 18044 - DNA, 20 bp, Artificial Sequence
  Synthetic oligonucleotide; GAG chr11 5305215 5305234 5305231 +
atgaaaagggaagtttatag

SEQ ID NO: 18045 - DNA, 20 bp, Artificial Sequence
  Synthetic oligonucleotide; TGG chr11 5305218 5305237 5305234 +
aaaagggaagtttataggag

SEQ ID NO: 18046 - DNA, 20 bp, Artificial Sequence
  Synthetic oligonucleotide; TGG chr11 5305227 5305246 5305243 +
gtttataggagtggatacta

SEQ ID NO: 18047 - DNA, 20 bp, Artificial Sequence
  Synthetic oligonucleotide; TAG chr11 5305230 5305249 5305246 +
tataggagtggatactatgg

SEQ ID NO: 18048 - DNA, 20 bp, Artificial Sequence
  Synthetic oligonucleotide; AGG chr11 5305231 5305250 5305247 +
ataggagtggatactatggt

SEQ ID NO: 18049 - DNA, 20 bp, Artificial Sequence
  Synthetic oligonucleotide; TAG chr11 5305238 5305257 5305254 +
tggatactatggtaggttaa

SEQ ID NO: 18050 - DNA, 20 bp, Artificial Sequence
  Synthetic oligonucleotide; TAG chr11 5305250 5305269 5305266 +
taggttaatagtgaaaaata

SEQ ID NO: 18051 - DNA, 20 bp, Artificial Sequence
  Synthetic oligonucleotide; TAG chr11 5305274 5305293 5305290 +
attatcaattaatataaaca

SEQ ID NO: 18052 - DNA, 20 bp, Artificial Sequence
  Synthetic oligonucleotide; GAG chr11 5305276 5305295 5305292 +
tatcaattaatataaacata

SEQ ID NO: 18053 - DNA, 20 bp, Artificial Sequence
  Synthetic oligonucleotide; AGG chr11 5305277 5305296 5305293 +
atcaattaatataaacatag

SEQ ID NO: 18054 - DNA, 20 bp, Artificial Sequence
  Synthetic oligonucleotide; TGG chr11 5305291 5305310 5305307 +
acatagaggtgttgattgtt

SEQ ID NO: 18055 - DNA, 20 bp, Artificial Sequence
  Synthetic oligonucleotide; GGG chr11 5305292 5305311 5305308 +
catagaggtgttgattgttt

SEQ ID NO: 18056 - DNA, 20 bp, Artificial Sequence
  Synthetic oligonucleotide; GGG chr11 5305293 5305312 5305309 +
atagaggtgttgattgtttg

SEQ ID NO: 18057 - DNA, 20 bp, Artificial Sequence
  Synthetic oligonucleotide; TAG chr11 5305300 5305319 5305316 +
tgttgattgtttggggcaac

SEQ ID NO: 18058 - DNA, 20 bp, Artificial Sequence
  Synthetic oligonucleotide; AGG chr11 5305301 5305320 5305317 +
gttgattgtttggggcaact

SEQ ID NO: 18059 - DNA, 20 bp, Artificial Sequence
  Synthetic oligonucleotide; TGG chr11 5305308 5305327 5305324 +
gtttggggcaactaggtctt

SEQ ID NO: 18060 - DNA, 20 bp, Artificial Sequence
  Synthetic oligonucleotide; TGG chr11 5305334 5305353 5305350 +
tattgacaatttcaacataa

SEQ ID NO: 18061 - DNA, 20 bp, Artificial Sequence
  Synthetic oligonucleotide; CAG chr11 5305337 5305356 5305353 +
tgacaatttcaacataatgg

SEQ ID NO: 18062 - DNA, 20 bp, Artificial Sequence
  Synthetic oligonucleotide; GAG chr11 5305361 5305380 5305377 +
aatgaatgcctaatgactgt

SEQ ID NO: 18063 - DNA, 20 bp, Artificial Sequence
  Synthetic oligonucleotide; AAG chr11 5305369 5305388 5305385 +
cctaatgactgtgagacaaa

SEQ ID NO: 18064 - DNA, 20 bp, Artificial Sequence
  Synthetic oligonucleotide; GAG chr11 5305373 5305392 5305389 +
atgactgtgagacaaaaagt

SEQ ID NO: 18065 - DNA, 20 bp, Artificial Sequence
  Synthetic oligonucleotide; CAG chr11 5305383 5305402 5305399 +
gacaaaaagtgagtaaaaaa

SEQ ID NO: 18066 - DNA, 20 bp, Artificial Sequence
  Synthetic oligonucleotide; TGG chr11 5305387 5305406 5305403 +
aaaagtgagtaaaaaacagc

SEQ ID NO: 18067 - DNA, 20 bp, Artificial Sequence
  Synthetic oligonucleotide; GGG chr11 5305388 5305407 5305404 +
aaagtgagtaaaaaacagct

SEQ ID NO: 18068 - DNA, 20 bp, Artificial Sequence
  Synthetic oligonucleotide; CGG chr11 5305393 5305412 5305409 +
gagtaaaaaacagctgggca

SEQ ID NO: 18069 - DNA, 20 bp, Artificial Sequence
  Synthetic oligonucleotide; TGG chr11 5305396 5305415 5305412 +
taaaaaacagctgggcacgg

SEQ ID NO: 18070 - DNA, 20 bp, Artificial Sequence
  Synthetic oligonucleotide; CAG chr11 5305415 5305434 5305431 +
gtggctcatgcctataatcc

SEQ ID NO: 18071 - DNA, 20 bp, Artificial Sequence
  Synthetic oligonucleotide; TGG chr11 5305423 5305442 5305439 +
tgcctataatcccagcactt

SEQ ID NO: 18072 - DNA, 20 bp, Artificial Sequence
  Synthetic oligonucleotide; GGG chr11 5305424 5305443 5305440 +
gcctataatcccagcacttt

SEQ ID NO: 18073 - DNA, 20 bp, Artificial Sequence
  Synthetic oligonucleotide; GAG chr11 5305426 5305445 5305442 +
ctataatcccagcactttgg

SEQ ID NO: 18074 - DNA, 20 bp, Artificial Sequence
  Synthetic oligonucleotide; AGG chr11 5305427 5305446 5305443 +
tataatcccagcactttggg

SEQ ID NO: 18075 - DNA, 20 bp, Artificial Sequence
  Synthetic oligonucleotide; GAG chr11 5305432 5305451 5305448 +
tcccagcactttgggaggcc

SEQ ID NO: 18076 - DNA, 20 bp, Artificial Sequence
  Synthetic oligonucleotide; AGG chr11 5305433 5305452 5305449 +
cccagcactttgggaggccg

SEQ ID NO: 18077 - DNA, 20 bp, Artificial Sequence
  Synthetic oligonucleotide; GAG chr11 5305435 5305454 5305451 +
cagcactttgggaggccgag

SEQ ID NO: 18078 - DNA, 20 bp, Artificial Sequence
  Synthetic oligonucleotide; AGG chr11 5305436 5305455 5305452 +
agcactttgggaggccgagg

SEQ ID NO: 18079 - DNA, 20 bp, Artificial Sequence
  Synthetic oligonucleotide; GGG chr11 5305437 5305456 5305453 +
gcactttgggaggccgagga

SEQ ID NO: 18080 - DNA, 20 bp, Artificial Sequence
  Synthetic oligonucleotide; TGG chr11 5305440 5305459 5305456 +
ctttgggaggccgaggaggg

SEQ ID NO: 18081 - DNA, 20 bp, Artificial Sequence
  Synthetic oligonucleotide; GAG chr11 5305450 5305469 5305466 +
ccgaggagggtggatcactt

SEQ ID NO: 18082 - DNA, 20 bp, Artificial Sequence
  Synthetic oligonucleotide; CAG chr11 5305455 5305474 5305471 +
gagggtggatcacttgagtt

SEQ ID NO: 18083 - DNA, 20 bp, Artificial Sequence
  Synthetic oligonucleotide; AGG chr11 5305456 5305475 5305472 +
agggtggatcacttgagttc

SEQ ID NO: 18084 - DNA, 20 bp, Artificial Sequence
  Synthetic oligonucleotide; GAG chr11 5305458 5305477 5305474 +
ggtggatcacttgagttcag

SEQ ID NO: 18085 - DNA, 20 bp, Artificial Sequence
  Synthetic oligonucleotide; GAG chr11 5305464 5305483 5305480 +
tcacttgagttcaggagttc

SEQ ID NO: 18086 - DNA, 20 bp, Artificial Sequence
  Synthetic oligonucleotide; CAG chr11 5305469 5305488 5305485 +
tgagttcaggagttcgagac

SEQ ID NO: 18087 - DNA, 20 bp, Artificial Sequence
  Synthetic oligonucleotide; TGG chr11 5305473 5305492 5305489 +
ttcaggagttcgagaccagc

SEQ ID NO: 18088 - DNA, 20 bp, Artificial Sequence
  Synthetic oligonucleotide; GGG chr11 5305474 5305493 5305490 +
tcaggagttcgagaccagct

SEQ ID NO: 18089 - DNA, 20 bp, Artificial Sequence
  Synthetic oligonucleotide; TGG chr11 5305483 5305502 5305499 +
cgagaccagctgggccaaca

SEQ ID NO: 18090 - DNA, 20 bp, Artificial Sequence
  Synthetic oligonucleotide; AAG chr11 5305518 5305537 5305534 +
actactataattacaaaaat

SEQ ID NO: 18091 - DNA, 20 bp, Artificial Sequence
  Synthetic oligonucleotide; CAG chr11 5305522 5305541 5305538 +
ctataattacaaaaataagc

SEQ ID NO: 18092 - DNA, 20 bp, Artificial Sequence
  Synthetic oligonucleotide; AGG chr11 5305523 5305542 5305539 +
tataattacaaaaataagcc

SEQ ID NO: 18093 - DNA, 20 bp, Artificial Sequence
  Synthetic oligonucleotide; TGG chr11 5305528 5305547 5305544 +
ttacaaaaataagccaggtg

SEQ ID NO: 18094 - DNA, 20 bp, Artificial Sequence
  Synthetic oligonucleotide; TGG chr11 5305531 5305550 5305547 +
caaaaataagccaggtgtgg

SEQ ID NO: 18095 - DNA, 20 bp, Artificial Sequence
  Synthetic oligonucleotide; CAG chr11 5305550 5305569 5305566 +
gtggcacatgatcataatcc

SEQ ID NO: 18096 - DNA, 20 bp, Artificial Sequence
  Synthetic oligonucleotide; TGG chr11 5305559 5305578 5305575 +
gatcataatcccagctactc

SEQ ID NO: 18097 - DNA, 20 bp, Artificial Sequence
  Synthetic oligonucleotide; GAG chr11 5305561 5305580 5305577 +
tcataatcccagctactctg

SEQ ID NO: 18098 - DNA, 20 bp, Artificial Sequence
  Synthetic oligonucleotide; AGG chr11 5305562 5305581 5305578 +
cataatcccagctactctgg

SEQ ID NO: 18099 - DNA, 20 bp, Artificial Sequence
  Synthetic oligonucleotide; GAG chr11 5305567 5305586 5305583 +
tcccagctactctggaggct

SEQ ID NO: 18100 - DNA, 20 bp, Artificial Sequence
  Synthetic oligonucleotide; AGG chr11 5305568 5305587 5305584 +
cccagctactctggaggctg

SEQ ID NO: 18101 - DNA, 20 bp, Artificial Sequence
  Synthetic oligonucleotide; GAG chr11 5305574 5305593 5305590 +
tactctggaggctgaggcat

SEQ ID NO: 18102 - DNA, 20 bp, Artificial Sequence
  Synthetic oligonucleotide; TGG chr11 5305591 5305610 5305607 +
catgagaatcccctgaaccc

SEQ ID NO: 18103 - DNA, 20 bp, Artificial Sequence
  Synthetic oligonucleotide; TGG chr11 5305594 5305613 5305610 +
gagaatcccctgaaccctgg

SEQ ID NO: 18104 - DNA, 20 bp, Artificial Sequence
  Synthetic oligonucleotide; GAG chr11 5305596 5305615 5305612 +
gaatcccctgaaccctggtg

SEQ ID NO: 18105 - DNA, 20 bp, Artificial Sequence
  Synthetic oligonucleotide; AGG chr11 5305597 5305616 5305613 +
aatcccctgaaccctggtgg

SEQ ID NO: 18106 - DNA, 20 bp, Artificial Sequence
  Synthetic oligonucleotide; GAG chr11 5305599 5305618 5305615 +
tcccctgaaccctggtggag

SEQ ID NO: 18107 - DNA, 20 bp, Artificial Sequence
  Synthetic oligonucleotide; AGG chr11 5305600 5305619 5305616 +
cccctgaaccctggtggagg

SEQ ID NO: 18108 - DNA, 20 bp, Artificial Sequence
  Synthetic oligonucleotide; CAG chr11 5305606 5305625 5305622 +
aaccctggtggaggaggtcg

SEQ ID NO: 18109 - DNA, 20 bp, Artificial Sequence
  Synthetic oligonucleotide; GAG chr11 5305610 5305629 5305626 +
ctggtggaggaggtcgcagt

SEQ ID NO: 18110 - DNA, 20 bp, Artificial Sequence
  Synthetic oligonucleotide; GAG chr11 5305615 5305634 5305631 +
ggaggaggtcgcagtgagct

SEQ ID NO: 18111 - DNA, 20 bp, Artificial Sequence
  Synthetic oligonucleotide; TAG chr11 5305635 5305654 5305651 +
gagatcgcaccactgcactc

SEQ ID NO: 18112 - DNA, 20 bp, Artificial Sequence
  Synthetic oligonucleotide; TGG chr11 5305640 5305659 5305656 +
cgcaccactgcactctagcc

SEQ ID NO: 18113 - DNA, 20 bp, Artificial Sequence
  Synthetic oligonucleotide; GGG chr11 5305641 5305660 5305657 +
gcaccactgcactctagcct

SEQ ID NO: 18114 - DNA, 20 bp, Artificial Sequence
  Synthetic oligonucleotide; CAG chr11 5305647 5305666 5305663 +
ctgcactctagcctgggcaa

SEQ ID NO: 18115 - DNA, 20 bp, Artificial Sequence
  Synthetic oligonucleotide; GAG chr11 5305649 5305668 5305665 +
gcactctagcctgggcaaca

SEQ ID NO: 18116 - DNA, 20 bp, Artificial Sequence
  Synthetic oligonucleotide; AAG chr11 5305664 5305683 5305680 +
caacagagaaaaatctgtta

SEQ ID NO: 18117 - DNA, 20 bp, Artificial Sequence
  Synthetic oligonucleotide; GAG chr11 5305666 5305685 5305682 +
acagagaaaaatctgttaaa

SEQ ID NO: 18118 - DNA, 20 bp, Artificial Sequence
  Synthetic oligonucleotide; GAG chr11 5305668 5305687 5305684 +
agagaaaaatctgttaaaga

SEQ ID NO: 18119 - DNA, 20 bp, Artificial Sequence
  Synthetic oligonucleotide; GAG chr11 5305670 5305689 5305686 +
agaaaaatctgttaaagaga

SEQ ID NO: 18120 - DNA, 20 bp, Artificial Sequence
  Synthetic oligonucleotide; GAG chr11 5305672 5305691 5305688 +
aaaaatctgttaaagagaga

SEQ ID NO: 18121 - DNA, 20 bp, Artificial Sequence
  Synthetic oligonucleotide; GAG chr11 5305674 5305693 5305690 +
aaatctgttaaagagagaga

SEQ ID NO: 18122 - DNA, 20 bp, Artificial Sequence
  Synthetic oligonucleotide; AAG chr11 5305679 5305698 5305695 +
tgttaaagagagagagagaa

SEQ ID NO: 18123 - DNA, 20 bp, Artificial Sequence
  Synthetic oligonucleotide; AAG chr11 5305684 5305703 5305700 +
aagagagagagagaaaagaa

SEQ ID NO: 18124 - DNA, 20 bp, Artificial Sequence
  Synthetic oligonucleotide; GAG chr11 5305688 5305707 5305704 +
gagagagagaaaagaaaagt

SEQ ID NO: 18125 - DNA, 20 bp, Artificial Sequence
  Synthetic oligonucleotide; AAG chr11 5305699 5305718 5305715 +
aagaaaagtgagtaaaaaac

SEQ ID NO: 18126 - DNA, 20 bp, Artificial Sequence
  Synthetic oligonucleotide; AAG chr11 5305703 5305722 5305719 +
aaagtgagtaaaaaacaaga

SEQ ID NO: 18127 - DNA, 20 bp, Artificial Sequence
  Synthetic oligonucleotide; AAG chr11 5305708 5305727 5305724 +
gagtaaaaaacaagaaagta

SEQ ID NO: 18128 - DNA, 20 bp, Artificial Sequence
  Synthetic oligonucleotide; TGG chr11 5305739 5305758 5305755 +
ttattttatttatattgtta

SEQ ID NO: 18129 - DNA, 20 bp, Artificial Sequence
  Synthetic oligonucleotide; GAG chr11 5305743 5305762 5305759 +
tttatttatattgttatggt

SEQ ID NO: 18130 - DNA, 20 bp, Artificial Sequence
  Synthetic oligonucleotide; AGG chr11 5305744 5305763 5305760 +
ttatttatattgttatggtg

SEQ ID NO: 18131 - DNA, 20 bp, Artificial Sequence
  Synthetic oligonucleotide; GAG chr11 5305752 5305771 5305768 +
attgttatggtgaggaaatt

SEQ ID NO: 18132 - DNA, 20 bp, Artificial Sequence
  Synthetic oligonucleotide; TAG chr11 5305758 5305777 5305774 +
atggtgaggaaattgagcct

SEQ ID NO: 18133 - DNA, 20 bp, Artificial Sequence
  Synthetic oligonucleotide; AAG chr11 5305763 5305782 5305779 +
gaggaaattgagccttagac

SEQ ID NO: 18134 - DNA, 20 bp, Artificial Sequence
  Synthetic oligonucleotide; AAG chr11 5305768 5305787 5305784 +
aattgagccttagacaagtt

SEQ ID NO: 18135 - DNA, 20 bp, Artificial Sequence
  Synthetic oligonucleotide; TAG chr11 5305775 5305794 5305791 +
ccttagacaagttaagcaat

SEQ ID NO: 18136 - DNA, 20 bp, Artificial Sequence
  Synthetic oligonucleotide; AAG chr11 5305781 5305800 5305797 +
acaagttaagcaattagcct

SEQ ID NO: 18137 - DNA, 20 bp, Artificial Sequence
  Synthetic oligonucleotide; AAG chr11 5305808 5305827 5305824 +
cgcaactaatatgtgtcata

SEQ ID NO: 18138 - DNA, 20 bp, Artificial Sequence
  Synthetic oligonucleotide; AGG chr11 5305809 5305828 5305825 +
gcaactaatatgtgtcataa

SEQ ID NO: 18139 - DNA, 20 bp, Artificial Sequence
  Synthetic oligonucleotide; CAG chr11 5305822 5305841 5305838 +
gtcataaaggaattcaaaca

SEQ ID NO: 18140 - DNA, 20 bp, Artificial Sequence
  Synthetic oligonucleotide; AGG chr11 5305823 5305842 5305839 +
tcataaaggaattcaaacac

SEQ ID NO: 18141 - DNA, 20 bp, Artificial Sequence
  Synthetic oligonucleotide; AAG chr11 5305845 5305864 5305861 +
gtttatctaacccaaaaccc

SEQ ID NO: 18142 - DNA, 20 bp, Artificial Sequence
  Synthetic oligonucleotide; TGG chr11 5305876 5305895 5305892 +
ctcaaccaatgtccatcaaa

SEQ ID NO: 18143 - DNA, 20 bp, Artificial Sequence
  Synthetic oligonucleotide; TGG chr11 5305882 5305901 5305898 +
caatgtccatcaaatggaaa

SEQ ID NO: 18144 - DNA, 20 bp, Artificial Sequence
  Synthetic oligonucleotide; TGG chr11 5305913 5305932 5305929 +
gcttcccgtatttgaatcct

SEQ ID NO: 18145 - DNA, 20 bp, Artificial Sequence
  Synthetic oligonucleotide; GAG chr11 5305928 5305947 5305944 +
atccttggcttttcttacct

SEQ ID NO: 18146 - DNA, 20 bp, Artificial Sequence
  Synthetic oligonucleotide; CAG chr11 5305934 5305953 5305950 +
ggcttttcttacctgagcca

SEQ ID NO: 18147 - DNA, 20 bp, Artificial Sequence
  Synthetic oligonucleotide; CGG chr11 5305948 5305967 5305964 +
gagccacagttttctctttg

SEQ ID NO: 18148 - DNA, 20 bp, Artificial Sequence
  Synthetic oligonucleotide; GAG chr11 5305956 5305975 5305972 +
gttttctctttgcggtttct

SEQ ID NO: 18149 - DNA, 20 bp, Artificial Sequence
  Synthetic oligonucleotide; TGG chr11 5305973 5305992 5305989 +
tctgagcatgacctgaatat

SEQ ID NO: 18150 - DNA, 20 bp, Artificial Sequence
  Synthetic oligonucleotide; CAG chr11 5305992 5306011 5306008 +
ttggttgtttgctatatcct

SEQ ID NO: 18151 - DNA, 20 bp, Artificial Sequence
  Synthetic oligonucleotide; GAG chr11 5306015 5306034 5306031 +
tatttactcttaattctgat

SEQ ID NO: 18152 - DNA, 20 bp, Artificial Sequence
  Synthetic oligonucleotide; GAG chr11 5306017 5306036 5306033 +
tttactcttaattctgatga

SEQ ID NO: 18153 - DNA, 20 bp, Artificial Sequence
  Synthetic oligonucleotide; AAG chr11 5306046 5306065 5306062 +
ttgttacacaaacaactctc

SEQ ID NO: 18154 - DNA, 20 bp, Artificial Sequence
  Synthetic oligonucleotide; AGG chr11 5306047 5306066 5306063 +
tgttacacaaacaactctca

SEQ ID NO: 18155 - DNA, 20 bp, Artificial Sequence
  Synthetic oligonucleotide; GGG chr11 5306048 5306067 5306064 +
gttacacaaacaactctcaa

SEQ ID NO: 18156 - DNA, 20 bp, Artificial Sequence
  Synthetic oligonucleotide; GGG chr11 5306049 5306068 5306065 +
ttacacaaacaactctcaag

SEQ ID NO: 18157 - DNA, 20 bp, Artificial Sequence
  Synthetic oligonucleotide; TAG chr11 5306058 5306077 5306074 +
caactctcaaggggttattc

SEQ ID NO: 18158 - DNA, 20 bp, Artificial Sequence
  Synthetic oligonucleotide; TAG chr11 5306073 5306092 5306089 +
tattctagctcatttccaca

SEQ ID NO: 18159 - DNA, 20 bp, Artificial Sequence
  Synthetic oligonucleotide; AGG chr11 5306074 5306093 5306090 +
attctagctcatttccacat

SEQ ID NO: 18160 - DNA, 20 bp, Artificial Sequence
  Synthetic oligonucleotide; TGG chr11 5306082 5306101 5306098 +
tcatttccacataggatatt

SEQ ID NO: 18161 - DNA, 20 bp, Artificial Sequence
  Synthetic oligonucleotide; GGG chr11 5306083 5306102 5306099 +
catttccacataggatattt

SEQ ID NO: 18162 - DNA, 20 bp, Artificial Sequence
  Synthetic oligonucleotide; TAG chr11 5306088 5306107 5306104 +
ccacataggatatttgggaa

SEQ ID NO: 18163 - DNA, 20 bp, Artificial Sequence
  Synthetic oligonucleotide; TGG chr11 5306123 5306142 5306139 +
ttctcttttcctccccaacc

SEQ ID NO: 18164 - DNA, 20 bp, Artificial Sequence
  Synthetic oligonucleotide; GGG chr11 5306124 5306143 5306140 +
tctcttttcctccccaacct

SEQ ID NO: 18165 - DNA, 20 bp, Artificial Sequence
  Synthetic oligonucleotide; AAG chr11 5306128 5306147 5306144 +
ttttcctccccaacctggga

SEQ ID NO: 18166 - DNA, 20 bp, Artificial Sequence
  Synthetic oligonucleotide; TGG chr11 5306134 5306153 5306150 +
tccccaacctgggaaagatc

SEQ ID NO: 18167 - DNA, 20 bp, Artificial Sequence
  Synthetic oligonucleotide; GGG chr11 5306135 5306154 5306151 +
ccccaacctgggaaagatct

SEQ ID NO: 18168 - DNA, 20 bp, Artificial Sequence
  Synthetic oligonucleotide; TGG chr11 5306148 5306167 5306164 +
aagatctgggccattgaaac

SEQ ID NO: 18169 - DNA, 20 bp, Artificial Sequence
  Synthetic oligonucleotide; TGG chr11 5306157 5306176 5306173 +
gccattgaaactggtcccca

SEQ ID NO: 18170 - DNA, 20 bp, Artificial Sequence
  Synthetic oligonucleotide; TGG chr11 5306175 5306194 5306191 +
catggcctttattttttctt

SEQ ID NO: 18171 - DNA, 20 bp, Artificial Sequence
  Synthetic oligonucleotide; AAG chr11 5306178 5306197 5306194 +
ggcctttattttttctttgg

SEQ ID NO: 18172 - DNA, 20 bp, Artificial Sequence
  Synthetic oligonucleotide; AGG chr11 5306179 5306198 5306195 +
gcctttattttttctttgga

SEQ ID NO: 18173 - DNA, 20 bp, Artificial Sequence
  Synthetic oligonucleotide; GAG chr11 5306181 5306200 5306197 +
ctttattttttctttggaag

SEQ ID NO: 18174 - DNA, 20 bp, Artificial Sequence
  Synthetic oligonucleotide; GAG chr11 5306183 5306202 5306199 +
ttattttttctttggaagga

SEQ ID NO: 18175 - DNA, 20 bp, Artificial Sequence
  Synthetic oligonucleotide; AAG chr11 5306191 5306210 5306207 +
tctttggaaggagagtctct

SEQ ID NO: 18176 - DNA, 20 bp, Artificial Sequence
  Synthetic oligonucleotide; GAG chr11 5306193 5306212 5306209 +
tttggaaggagagtctctaa

SEQ ID NO: 18177 - DNA, 20 bp, Artificial Sequence
  Synthetic oligonucleotide; AAG chr11 5306196 5306215 5306212 +
ggaaggagagtctctaagag

SEQ ID NO: 18178 - DNA, 20 bp, Artificial Sequence
  Synthetic oligonucleotide; CAG chr11 5306214 5306233 5306230 +
agaagttgtgtctctaacat

SEQ ID NO: 18179 - DNA, 20 bp, Artificial Sequence
  Synthetic oligonucleotide; GAG chr11 5306219 5306238 5306235 +
ttgtgtctctaacatcagat

SEQ ID NO: 18180 - DNA, 20 bp, Artificial Sequence
  Synthetic oligonucleotide; AGG chr11 5306220 5306239 5306236 +
tgtgtctctaacatcagatg

SEQ ID NO: 18181 - DNA, 20 bp, Artificial Sequence
  Synthetic oligonucleotide; GAG chr11 5306235 5306254 5306251 +
agatgaggcatgaccgaaat

SEQ ID NO: 18182 - DNA, 20 bp, Artificial Sequence
  Synthetic oligonucleotide; AAG chr11 5306246 5306265 5306262 +
gaccgaaatgagtcactctc

SEQ ID NO: 18183 - DNA, 20 bp, Artificial Sequence
  Synthetic oligonucleotide; TGG chr11 5306257 5306276 5306273 +
gtcactctcaagtgttccat

SEQ ID NO: 18184 - DNA, 20 bp, Artificial Sequence
  Synthetic oligonucleotide; TAG chr11 5306263 5306282 5306279 +
ctcaagtgttccattggtct

SEQ ID NO: 18185 - DNA, 20 bp, Artificial Sequence
  Synthetic oligonucleotide; GAG chr11 5306265 5306284 5306281 +
caagtgttccattggtctta

SEQ ID NO: 18186 - DNA, 20 bp, Artificial Sequence
  Synthetic oligonucleotide; TGG chr11 5306268 5306287 5306284 +
gtgttccattggtcttagag

SEQ ID NO: 18187 - DNA, 20 bp, Artificial Sequence
  Synthetic oligonucleotide; GGG chr11 5306269 5306288 5306285 +
tgttccattggtcttagagt

SEQ ID NO: 18188 - DNA, 20 bp, Artificial Sequence
  Synthetic oligonucleotide; AAG chr11 5306272 5306291 5306288 +
tccattggtcttagagtggg

SEQ ID NO: 18189 - DNA, 20 bp, Artificial Sequence
  Synthetic oligonucleotide; CAG chr11 5306277 5306296 5306293 +
tggtcttagagtgggaagac

SEQ ID NO: 18190 - DNA, 20 bp, Artificial Sequence
  Synthetic oligonucleotide; AAG chr11 5306310 5306329 5306326 +
tttgtaaatgttaacatttg

SEQ ID NO: 18191 - DNA, 20 bp, Artificial Sequence
  Synthetic oligonucleotide; GAG chr11 5306372 5306391 5306388 +
caaccctttacaaaatcctt

SEQ ID NO: 18192 - DNA, 20 bp, Artificial Sequence
  Synthetic oligonucleotide; CAG chr11 5306411 5306430 5306427 +
tcgtcttgatgattattcat

SEQ ID NO: 18193 - DNA, 20 bp, Artificial Sequence
  Synthetic oligonucleotide; GAG chr11 5306461 5306480 5306477 +
aaaactcactaccctaccct

SEQ ID NO: 18194 - DNA, 20 bp, Artificial Sequence
  Synthetic oligonucleotide; TGG chr11 5306484 5306503 5306500 +
ctatctcattcatatatatg

SEQ ID NO: 18195 - DNA, 20 bp, Artificial Sequence
  Synthetic oligonucleotide; GGG chr11 5306485 5306504 5306501 +
tatctcattcatatatatgt

SEQ ID NO: 18196 - DNA, 20 bp, Artificial Sequence
  Synthetic oligonucleotide; TAG chr11 5306503 5306522 5306519 +
gtgggtttcatttaattatt

SEQ ID NO: 18197 - DNA, 20 bp, Artificial Sequence
  Synthetic oligonucleotide; TGG chr11 5306518 5306537 5306534 +
ttatttagtatatgtatata

SEQ ID NO: 18198 - DNA, 20 bp, Artificial Sequence
  Synthetic oligonucleotide; TAG chr11 5306546 5306565 5306562 +
actatcaatatatgtatgca

SEQ ID NO: 18199 - DNA, 20 bp, Artificial Sequence
  Synthetic oligonucleotide; AGG chr11 5306547 5306566 5306563 +
ctatcaatatatgtatgcat

SEQ ID NO: 18200 - DNA, 20 bp, Artificial Sequence
  Synthetic oligonucleotide; CAG chr11 5306580 5306599 5306596 +
tgtgtgtatatatatattca

SEQ ID NO: 18201 - DNA, 20 bp, Artificial Sequence
  Synthetic oligonucleotide; CAG chr11 5306584 5306603 5306600 +
tgtatatatatattcacaga

SEQ ID NO: 18202 - DNA, 20 bp, Artificial Sequence
  Synthetic oligonucleotide; GAG chr11 5306586 5306605 5306602 +
tatatatatattcacagaca

SEQ ID NO: 18203 - DNA, 20 bp, Artificial Sequence
  Synthetic oligonucleotide; CAG chr11 5306590 5306609 5306606 +
tatatattcacagacagaga

SEQ ID NO: 18204 - DNA, 20 bp, Artificial Sequence
  Synthetic oligonucleotide; GAG chr11 5306594 5306613 5306610 +
tattcacagacagagacagt

SEQ ID NO: 18205 - DNA, 20 bp, Artificial Sequence
  Synthetic oligonucleotide; GAG chr11 5306596 5306615 5306612 +
ttcacagacagagacagtga

SEQ ID NO: 18206 - DNA, 20 bp, Artificial Sequence
  Synthetic oligonucleotide; GAG chr11 5306598 5306617 5306614 +
cacagacagagacagtgaga

SEQ ID NO: 18207 - DNA, 20 bp, Artificial Sequence
  Synthetic oligonucleotide; GAG chr11 5306600 5306619 5306616 +
cagacagagacagtgagaga

SEQ ID NO: 18208 - DNA, 20 bp, Artificial Sequence
  Synthetic oligonucleotide; GAG chr11 5306602 5306621 5306618 +
gacagagacagtgagagaga

SEQ ID NO: 18209 - DNA, 20 bp, Artificial Sequence
  Synthetic oligonucleotide; GAG chr11 5306604 5306623 5306620 +
cagagacagtgagagagaga

SEQ ID NO: 18210 - DNA, 20 bp, Artificial Sequence
  Synthetic oligonucleotide; GAG chr11 5306606 5306625 5306622 +
gagacagtgagagagagaga

SEQ ID NO: 18211 - DNA, 20 bp, Artificial Sequence
  Synthetic oligonucleotide; TAG chr11 5306651 5306670 5306667 +
taatatctactccttatatt

SEQ ID NO: 18212 - DNA, 20 bp, Artificial Sequence
  Synthetic oligonucleotide; AGG chr11 5306652 5306671 5306668 +
aatatctactccttatattt

SEQ ID NO: 18213 - DNA, 20 bp, Artificial Sequence
  Synthetic oligonucleotide; CAG chr11 5306664 5306683 5306680 +
ttatatttaggtctgatctc

SEQ ID NO: 18214 - DNA, 20 bp, Artificial Sequence
  Synthetic oligonucleotide; TAG chr11 5306685 5306704 5306701 +
agaataaaataaccatatat

SEQ ID NO: 18215 - DNA, 20 bp, Artificial Sequence
  Synthetic oligonucleotide; TAG chr11 5306715 5306734 5306731 +
attcatacataatttttttc

SEQ ID NO: 18216 - DNA, 20 bp, Artificial Sequence
  Synthetic oligonucleotide; AAG chr11 5306725 5306744 5306741 +
aatttttttctagatgtata

SEQ ID NO: 18217 - DNA, 20 bp, Artificial Sequence
  Synthetic oligonucleotide; AAG chr11 5306748 5306767 5306764 +
atatctgcattaaaaaccct

SEQ ID NO: 18218 - DNA, 20 bp, Artificial Sequence
  Synthetic oligonucleotide; TGG chr11 5306764 5306783 5306780 +
ccctaagacttctttcctga

SEQ ID NO: 18219 - DNA, 20 bp, Artificial Sequence
  Synthetic oligonucleotide; GGG chr11 5306765 5306784 5306781 +
cctaagacttctttcctgat

SEQ ID NO: 18220 - DNA, 20 bp, Artificial Sequence
  Synthetic oligonucleotide; CAG chr11 5306782 5306801 5306798 +
gatgggtgaaccaatatcaa

SEQ ID NO: 18221 - DNA, 20 bp, Artificial Sequence
  Synthetic oligonucleotide; CAG chr11 5306865 5306884 5306881 +
ccttattgaacataataatc

SEQ ID NO: 18222 - DNA, 20 bp, Artificial Sequence
  Synthetic oligonucleotide; TAG chr11 5306880 5306899 5306896 +
taatccagatgttgtcatat

SEQ ID NO: 18223 - DNA, 20 bp, Artificial Sequence
  Synthetic oligonucleotide; TGG chr11 5306909 5306928 5306925 +
tctgaaatctcttttttcat

SEQ ID NO: 18224 - DNA, 20 bp, Artificial Sequence
  Synthetic oligonucleotide; GAG chr11 5306922 5306941 5306938 +
ttttcattggattatgtgct

SEQ ID NO: 18225 - DNA, 20 bp, Artificial Sequence
  Synthetic oligonucleotide; AAG chr11 5306934 5306953 5306950 +
tatgtgctgagtttctattt

SEQ ID NO: 18226 - DNA, 20 bp, Artificial Sequence
  Synthetic oligonucleotide; TAG chr11 5306937 5306956 5306953 +
gtgctgagtttctatttaag

SEQ ID NO: 18227 - DNA, 20 bp, Artificial Sequence
  Synthetic oligonucleotide; AAG chr11 5306943 5306962 5306959 +
agtttctatttaagtagtct

SEQ ID NO: 18228 - DNA, 20 bp, Artificial Sequence
  Synthetic oligonucleotide; CAG chr11 5306952 5306971 5306968 +
ttaagtagtctaagatcgtg

SEQ ID NO: 18229 - DNA, 20 bp, Artificial Sequence
  Synthetic oligonucleotide; CAG chr11 5307000 5307019 5307016 +
atctcaaaacatgtcaaatt

SEQ ID NO: 18230 - DNA, 20 bp, Artificial Sequence
  Synthetic oligonucleotide; CAG chr11 5307008 5307027 5307024 +
acatgtcaaattcagtcttt

SEQ ID NO: 18231 - DNA, 20 bp, Artificial Sequence
  Synthetic oligonucleotide; TAG chr11 5307019 5307038 5307035 +
tcagtctttcagatttaaaa

SEQ ID NO: 18232 - DNA, 20 bp, Artificial Sequence
  Synthetic oligonucleotide; CAG chr11 5307061 5307080 5307077 +
cataatatatgtgacactcg

SEQ ID NO: 18233 - DNA, 20 bp, Artificial Sequence
  Synthetic oligonucleotide; AAG chr11 5307065 5307084 5307081 +
atatatgtgacactcgcagc

SEQ ID NO: 18234 - DNA, 20 bp, Artificial Sequence
  Synthetic oligonucleotide; TAG chr11 5307098 5307117 5307114 +
tactatcacctgtttatact

SEQ ID NO: 18235 - DNA, 20 bp, Artificial Sequence
  Synthetic oligonucleotide; AGG chr11 5307099 5307118 5307115 +
actatcacctgtttatactt

SEQ ID NO: 18236 - DNA, 20 bp, Artificial Sequence
  Synthetic oligonucleotide; GGG chr11 5307100 5307119 5307116 +
ctatcacctgtttatactta

SEQ ID NO: 18237 - DNA, 20 bp, Artificial Sequence
  Synthetic oligonucleotide; GGG chr11 5307101 5307120 5307117 +
tatcacctgtttatacttag

SEQ ID NO: 18238 - DNA, 20 bp, Artificial Sequence
  Synthetic oligonucleotide; CAG chr11 5307133 5307152 5307149 +
taaatatcctctcatatatt

SEQ ID NO: 18239 - DNA, 20 bp, Artificial Sequence
  Synthetic oligonucleotide; AGG chr11 5307134 5307153 5307150 +
aaatatcctctcatatattc

SEQ ID NO: 18240 - DNA, 20 bp, Artificial Sequence
  Synthetic oligonucleotide; AAG chr11 5307138 5307157 5307154 +
atcctctcatatattcaggt

SEQ ID NO: 18241 - DNA, 20 bp, Artificial Sequence
  Synthetic oligonucleotide; TAG chr11 5307161 5307180 5307177 +
attttgccaaaacgtgattt

SEQ ID NO: 18242 - DNA, 20 bp, Artificial Sequence
  Synthetic oligonucleotide; AGG chr11 5307162 5307181 5307178 +
ttttgccaaaacgtgatttt

SEQ ID NO: 18243 - DNA, 20 bp, Artificial Sequence
  Synthetic oligonucleotide; CAG chr11 5307170 5307189 5307186 +
aaacgtgattttaggtcata

SEQ ID NO: 18244 - DNA, 20 bp, Artificial Sequence
  Synthetic oligonucleotide; CAG chr11 5307187 5307206 5307203 +
atacagcaataaatgcattc

SEQ ID NO: 18245 - DNA, 20 bp, Artificial Sequence
  Synthetic oligonucleotide; CAG chr11 5307201 5307220 5307217 +
gcattccagaattcattttg

SEQ ID NO: 18246 - DNA, 20 bp, Artificial Sequence
  Synthetic oligonucleotide; TAG chr11 5307217 5307236 5307233 +
tttgcagaacctgttgattc

SEQ ID NO: 18247 - DNA, 20 bp, Artificial Sequence
  Synthetic oligonucleotide; TAG chr11 5307225 5307244 5307241 +
acctgttgattctagacttg

SEQ ID NO: 18248 - DNA, 20 bp, Artificial Sequence
  Synthetic oligonucleotide; AAG chr11 5307230 5307249 5307246 +
ttgattctagacttgtagct

SEQ ID NO: 18249 - DNA, 20 bp, Artificial Sequence
  Synthetic oligonucleotide; AAG chr11 5307233 5307252 5307249 +
attctagacttgtagctaag

SEQ ID NO: 18250 - DNA, 20 bp, Artificial Sequence
  Synthetic oligonucleotide; CGG chr11 5307239 5307258 5307255 +
gacttgtagctaagaagtga

SEQ ID NO: 18251 - DNA, 20 bp, Artificial Sequence
  Synthetic oligonucleotide; TGG chr11 5307244 5307263 5307260 +
gtagctaagaagtgacggct

SEQ ID NO: 18252 - DNA, 20 bp, Artificial Sequence
  Synthetic oligonucleotide; AAG chr11 5307264 5307283 5307280 +
tggtaaataaccatatcata

SEQ ID NO: 18253 - DNA, 20 bp, Artificial Sequence
  Synthetic oligonucleotide; CAG chr11 5307268 5307287 5307284 +
aaataaccatatcataaagt

SEQ ID NO: 18254 - DNA, 20 bp, Artificial Sequence
  Synthetic oligonucleotide; CAG chr11 5307286 5307305 5307302 +
gtcagttctctttgtactca

SEQ ID NO: 18255 - DNA, 20 bp, Artificial Sequence
  Synthetic oligonucleotide; AAG chr11 5307306 5307325 5307322 +
cagtaaaacaaaacttctga

SEQ ID NO: 18256 - DNA, 20 bp, Artificial Sequence
  Synthetic oligonucleotide; AAG chr11 5307314 5307333 5307330 +
caaaacttctgaaagatttt

SEQ ID NO: 18257 - DNA, 20 bp, Artificial Sequence
  Synthetic oligonucleotide; GAG chr11 5307318 5307337 5307334 +
acttctgaaagattttaagt

SEQ ID NO: 18258 - DNA, 20 bp, Artificial Sequence
  Synthetic oligonucleotide; CAG chr11 5307330 5307349 5307346 +
ttttaagtgagtgacatttt

SEQ ID NO: 18259 - DNA, 20 bp, Artificial Sequence
  Synthetic oligonucleotide; TGG chr11 5307342 5307361 5307358 +
gacattttcagtgcttaaaa

SEQ ID NO: 18260 - DNA, 20 bp, Artificial Sequence
  Synthetic oligonucleotide; GAG chr11 5307344 5307363 5307360 +
cattttcagtgcttaaaatg

SEQ ID NO: 18261 - DNA, 20 bp, Artificial Sequence
  Synthetic oligonucleotide; TAG chr11 5307356 5307375 5307372 +
ttaaaatggagcttaacata

SEQ ID NO: 18262 - DNA, 20 bp, Artificial Sequence
  Synthetic oligonucleotide; TGG chr11 5307359 5307378 5307375 +
aaatggagcttaacatatag

SEQ ID NO: 18263 - DNA, 20 bp, Artificial Sequence
  Synthetic oligonucleotide; GGG chr11 5307360 5307379 5307376 +
aatggagcttaacatatagt

SEQ ID NO: 18264 - DNA, 20 bp, Artificial Sequence
  Synthetic oligonucleotide; CAG chr11 5307367 5307386 5307383 +
cttaacatatagtgggtgct

SEQ ID NO: 18265 - DNA, 20 bp, Artificial Sequence
  Synthetic oligonucleotide; AAG chr11 5307371 5307390 5307387 +
acatatagtgggtgctcagt

SEQ ID NO: 18266 - DNA, 20 bp, Artificial Sequence
  Synthetic oligonucleotide; TAG chr11 5307377 5307396 5307393 +
agtgggtgctcagtaagtac

SEQ ID NO: 18267 - DNA, 20 bp, Artificial Sequence
  Synthetic oligonucleotide; AAG chr11 5307382 5307401 5307398 +
gtgctcagtaagtactagtt

SEQ ID NO: 18268 - DNA, 20 bp, Artificial Sequence
  Synthetic oligonucleotide; AAG chr11 5307409 5307428 5307425 +
tgaatgctattcttgtgatc

SEQ ID NO: 18269 - DNA, 20 bp, Artificial Sequence
  Synthetic oligonucleotide; TGG chr11 5307416 5307435 5307432 +
tattcttgtgatcaagccat

SEQ ID NO: 18270 - DNA, 20 bp, Artificial Sequence
  Synthetic oligonucleotide; TAG chr11 5307424 5307443 5307440 +
tgatcaagccattggttttg

SEQ ID NO: 18271 - DNA, 20 bp, Artificial Sequence
  Synthetic oligonucleotide; TAG chr11 5307435 5307454 5307451 +
ttggttttgtagccaaattg

SEQ ID NO: 18272 - DNA, 20 bp, Artificial Sequence
  Synthetic oligonucleotide; AAG chr11 5307468 5307487 5307484 +
cctctacatctgtttgtaat

SEQ ID NO: 18273 - DNA, 20 bp, Artificial Sequence
  Synthetic oligonucleotide; TAG chr11 5307476 5307495 5307492 +
tctgtttgtaataagattac

SEQ ID NO: 18274 - DNA, 20 bp, Artificial Sequence
  Synthetic oligonucleotide; AAG chr11 5307482 5307501 5307498 +
tgtaataagattactagttc

SEQ ID NO: 18275 - DNA, 20 bp, Artificial Sequence
  Synthetic oligonucleotide; TAG chr11 5307521 5307540 5307537 +
atctccttttctttattgtt

SEQ ID NO: 18276 - DNA, 20 bp, Artificial Sequence
  Synthetic oligonucleotide; TGG chr11 5307556 5307575 5307572 +
tctaatttttacatcaatca

SEQ ID NO: 18277 - DNA, 20 bp, Artificial Sequence
  Synthetic oligonucleotide; CAG chr11 5307561 5307580 5307577 +
tttttacatcaatcatggtt

SEQ ID NO: 18278 - DNA, 20 bp, Artificial Sequence
  Synthetic oligonucleotide; GAG chr11 5307563 5307582 5307579 +
tttacatcaatcatggttca

SEQ ID NO: 18279 - DNA, 20 bp, Artificial Sequence
  Synthetic oligonucleotide; AAG chr11 5307585 5307604 5307601 +
gaaaaatccataacaacatc

SEQ ID NO: 18280 - DNA, 20 bp, Artificial Sequence
  Synthetic oligonucleotide; AAG chr11 5307588 5307607 5307604 +
aaatccataacaacatcaag

SEQ ID NO: 18281 - DNA, 20 bp, Artificial Sequence
  Synthetic oligonucleotide; AAG chr11 5307592 5307611 5307608 +
ccataacaacatcaagaaga

SEQ ID NO: 18282 - DNA, 20 bp, Artificial Sequence
  Synthetic oligonucleotide; AAG chr11 5307603 5307622 5307619 +
tcaagaagaaagattttttg

SEQ ID NO: 18283 - DNA, 20 bp, Artificial Sequence
  Synthetic oligonucleotide; GAG chr11 5307796 5307815 5307812 +
tcttttctttcctctctttt

SEQ ID NO: 18284 - DNA, 20 bp, Artificial Sequence
  Synthetic oligonucleotide; CAG chr11 5307800 5307819 5307816 +
ttctttcctctcttttgaga

SEQ ID NO: 18285 - DNA, 20 bp, Artificial Sequence
  Synthetic oligonucleotide; CAG chr11 5307820 5307839 5307836 +
cagtgtcttgctctgtcacc

SEQ ID NO: 18286 - DNA, 20 bp, Artificial Sequence
  Synthetic oligonucleotide; AGG chr11 5307821 5307840 5307837 +
agtgtcttgctctgtcaccc

SEQ ID NO: 18287 - DNA, 20 bp, Artificial Sequence
  Synthetic oligonucleotide; GAG chr11 5307823 5307842 5307839 +
tgtcttgctctgtcacccag

SEQ ID NO: 18288 - DNA, 20 bp, Artificial Sequence
  Synthetic oligonucleotide; AGG chr11 5307824 5307843 5307840 +
gtcttgctctgtcacccagg

SEQ ID NO: 18289 - DNA, 20 bp, Artificial Sequence
  Synthetic oligonucleotide; GGG chr11 5307825 5307844 5307841 +
tcttgctctgtcacccagga

SEQ ID NO: 18290 - DNA, 20 bp, Artificial Sequence
  Synthetic oligonucleotide; GAG chr11 5307827 5307846 5307843 +
ttgctctgtcacccaggagg

SEQ ID NO: 18291 - DNA, 20 bp, Artificial Sequence
  Synthetic oligonucleotide; CAG chr11 5307832 5307851 5307848 +
ctgtcacccaggagggagtg

SEQ ID NO: 18292 - DNA, 20 bp, Artificial Sequence
  Synthetic oligonucleotide; TGG chr11 5307835 5307854 5307851 +
tcacccaggagggagtgcag

SEQ ID NO: 18293 - DNA, 20 bp, Artificial Sequence
  Synthetic oligonucleotide; GAG chr11 5307839 5307858 5307855 +
ccaggagggagtgcagtggt

SEQ ID NO: 18294 - DNA, 20 bp, Artificial Sequence
  Synthetic oligonucleotide; TAG chr11 5307846 5307865 5307862 +
ggagtgcagtggtgagatca

SEQ ID NO: 18295 - DNA, 20 bp, Artificial Sequence
  Synthetic oligonucleotide; CAG chr11 5307856 5307875 5307872 +
ggtgagatcatagtttactg

SEQ ID NO: 18296 - DNA, 20 bp, Artificial Sequence
  Synthetic oligonucleotide; AAG chr11 5307863 5307882 5307879 +
tcatagtttactgcagcctc

SEQ ID NO: 18297 - DNA, 20 bp, Artificial Sequence
  Synthetic oligonucleotide; TAG chr11 5307870 5307889 5307886 +
ttactgcagcctcaagcttt

SEQ ID NO: 18298 - DNA, 20 bp, Artificial Sequence
  Synthetic oligonucleotide; AGG chr11 5307871 5307890 5307887 +
tactgcagcctcaagctttt

SEQ ID NO: 18299 - DNA, 20 bp, Artificial Sequence
  Synthetic oligonucleotide; AAG chr11 5307877 5307896 5307893 +
agcctcaagcttttaggctt

SEQ ID NO: 18300 - DNA, 20 bp, Artificial Sequence
  Synthetic oligonucleotide; CAG chr11 5307894 5307913 5307910 +
cttaagtgatttttacacct

SEQ ID NO: 18301 - DNA, 20 bp, Artificial Sequence
  Synthetic oligonucleotide; TAG chr11 5307906 5307925 5307922 +
ttacacctcagcctcccaaa

SEQ ID NO: 18302 - DNA, 20 bp, Artificial Sequence
  Synthetic oligonucleotide; GAG chr11 5307921 5307940 5307937 +
ccaaatagctgtgaccacat

SEQ ID NO: 18303 - DNA, 20 bp, Artificial Sequence
  Synthetic oligonucleotide; AAG chr11 5307924 5307943 5307940 +
aatagctgtgaccacatgag

SEQ ID NO: 18304 - DNA, 20 bp, Artificial Sequence
  Synthetic oligonucleotide; GAG chr11 5307926 5307945 5307942 +
tagctgtgaccacatgagaa

SEQ ID NO: 18305 - DNA, 20 bp, Artificial Sequence
  Synthetic oligonucleotide; TAG chr11 5307953 5307972 5307969 +
ttatgtgtttttttccttct

SEQ ID NO: 18306 - DNA, 20 bp, Artificial Sequence
  Synthetic oligonucleotide; TGG chr11 5307961 5307980 5307977 +
ttttttccttcttagtactt

SEQ ID NO: 18307 - DNA, 20 bp, Artificial Sequence
  Synthetic oligonucleotide; AAG chr11 5307968 5307987 5307984 +
cttcttagtactttggctgc

SEQ ID NO: 18308 - DNA, 20 bp, Artificial Sequence
  Synthetic oligonucleotide; GAG chr11 5307972 5307991 5307988 +
ttagtactttggctgcaagt

SEQ ID NO: 18309 - DNA, 20 bp, Artificial Sequence
  Synthetic oligonucleotide; AAG chr11 5307979 5307998 5307995 +
tttggctgcaagtgagtctc

SEQ ID NO: 18310 - DNA, 20 bp, Artificial Sequence
  Synthetic oligonucleotide; AGG chr11 5307980 5307999 5307996 +
ttggctgcaagtgagtctca

SEQ ID NO: 18311 - DNA, 20 bp, Artificial Sequence
  Synthetic oligonucleotide; AAG chr11 5307984 5308003 5308000 +
ctgcaagtgagtctcaaggt

SEQ ID NO: 18312 - DNA, 20 bp, Artificial Sequence
  Synthetic oligonucleotide; TGG chr11 5308003 5308022 5308019 +
taagatgttttaaccactta

SEQ ID NO: 18313 - DNA, 20 bp, Artificial Sequence
  Synthetic oligonucleotide; AAG chr11 5308032 5308051 5308048 +
tattctcccattccaatgaa

SEQ ID NO: 18314 - DNA, 20 bp, Artificial Sequence
  Synthetic oligonucleotide; AAG chr11 5308074 5308093 5308090 +
tgttgatgtctaaatacacc

SEQ ID NO: 18315 - DNA, 20 bp, Artificial Sequence
  Synthetic oligonucleotide; TAG chr11 5308112 5308131 5308128 +
gatctatctatactactaaa

SEQ ID NO: 18316 - DNA, 20 bp, Artificial Sequence
  Synthetic oligonucleotide; TAG chr11 5308116 5308135 5308132 +
tatctatactactaaatagc

SEQ ID NO: 18317 - DNA, 20 bp, Artificial Sequence
  Synthetic oligonucleotide; AAG chr11 5308132 5308151 5308148 +
tagctagaccaatacatgaa

SEQ ID NO: 18318 - DNA, 20 bp, Artificial Sequence
  Synthetic oligonucleotide; AAG chr11 5308153 5308172 5308169 +
agaaactcttattctcaata

SEQ ID NO: 18319 - DNA, 20 bp, Artificial Sequence
  Synthetic oligonucleotide; CAG chr11 5308180 5308199 5308196 +
gtaccccaacaataatatat

SEQ ID NO: 18320 - DNA, 20 bp, Artificial Sequence
  Synthetic oligonucleotide; CAG chr11 5308219 5308238 5308235 +
ttatcttctttgtgtcttat

SEQ ID NO: 18321 - DNA, 20 bp, Artificial Sequence
  Synthetic oligonucleotide; TAG chr11 5308235 5308254 5308251 +
ttatcagttatgttaccata

SEQ ID NO: 18322 - DNA, 20 bp, Artificial Sequence
  Synthetic oligonucleotide; AGG chr11 5308236 5308255 5308252 +
tatcagttatgttaccatat

SEQ ID NO: 18323 - DNA, 20 bp, Artificial Sequence
  Synthetic oligonucleotide; AAG chr11 5308239 5308258 5308255 +
cagttatgttaccatatagg

SEQ ID NO: 18324 - DNA, 20 bp, Artificial Sequence
  Synthetic oligonucleotide; GAG chr11 5308241 5308260 5308257 +
gttatgttaccatataggaa

SEQ ID NO: 18325 - DNA, 20 bp, Artificial Sequence
  Synthetic oligonucleotide; AAG chr11 5308245 5308264 5308261 +
tgttaccatataggaagaga

SEQ ID NO: 18326 - DNA, 20 bp, Artificial Sequence
  Synthetic oligonucleotide; AAG chr11 5308256 5308275 5308272 +
aggaagagaaagaaaattat

SEQ ID NO: 18327 - DNA, 20 bp, Artificial Sequence
  Synthetic oligonucleotide; AAG chr11 5308291 5308310 5308307 +
gtaccatctcacatctatgc

SEQ ID NO: 18328 - DNA, 20 bp, Artificial Sequence
  Synthetic oligonucleotide; AGG chr11 5308292 5308311 5308308 +
taccatctcacatctatgca

SEQ ID NO: 18329 - DNA, 20 bp, Artificial Sequence
  Synthetic oligonucleotide; TAG chr11 5308299 5308318 5308315 +
tcacatctatgcaaggcaaa

SEQ ID NO: 18330 - DNA, 20 bp, Artificial Sequence
  Synthetic oligonucleotide; AGG chr11 5308300 5308319 5308316 +
cacatctatgcaaggcaaat

SEQ ID NO: 18331 - DNA, 20 bp, Artificial Sequence
  Synthetic oligonucleotide; TAG chr11 5308308 5308327 5308324 +
tgcaaggcaaataggactaa

SEQ ID NO: 18332 - DNA, 20 bp, Artificial Sequence
  Synthetic oligonucleotide; CAG chr11 5308313 5308332 5308329 +
ggcaaataggactaatagta

SEQ ID NO: 18333 - DNA, 20 bp, Artificial Sequence
  Synthetic oligonucleotide; AGG chr11 5308314 5308333 5308330 +
gcaaataggactaatagtac

SEQ ID NO: 18334 - DNA, 20 bp, Artificial Sequence
  Synthetic oligonucleotide; GGG chr11 5308315 5308334 5308331 +
caaataggactaatagtaca

SEQ ID NO: 18335 - DNA, 20 bp, Artificial Sequence
  Synthetic oligonucleotide; AAG chr11 5308320 5308339 5308336 +
aggactaatagtacagggac

SEQ ID NO: 18336 - DNA, 20 bp, Artificial Sequence
  Synthetic oligonucleotide; AGG chr11 5308321 5308340 5308337 +
ggactaatagtacagggaca

SEQ ID NO: 18337 - DNA, 20 bp, Artificial Sequence
  Synthetic oligonucleotide; AAG chr11 5308328 5308347 5308344 +
tagtacagggacaaggctga

SEQ ID NO: 18338 - DNA, 20 bp, Artificial Sequence
  Synthetic oligonucleotide; AGG chr11 5308329 5308348 5308345 +
agtacagggacaaggctgaa

SEQ ID NO: 18339 - DNA, 20 bp, Artificial Sequence
  Synthetic oligonucleotide; GAG chr11 5308331 5308350 5308347 +
tacagggacaaggctgaaag

SEQ ID NO: 18340 - DNA, 20 bp, Artificial Sequence
  Synthetic oligonucleotide; AAG chr11 5308341 5308360 5308357 +
aggctgaaaggagacatttt

SEQ ID NO: 18341 - DNA, 20 bp, Artificial Sequence
  Synthetic oligonucleotide; AGG chr11 5308342 5308361 5308358 +
ggctgaaaggagacatttta

SEQ ID NO: 18342 - DNA, 20 bp, Artificial Sequence
  Synthetic oligonucleotide; AAG chr11 5308348 5308367 5308364 +
aaggagacattttaaggttg

SEQ ID NO: 18343 - DNA, 20 bp, Artificial Sequence
  Synthetic oligonucleotide; AGG chr11 5308349 5308368 5308365 +
aggagacattttaaggttga

SEQ ID NO: 18344 - DNA, 20 bp, Artificial Sequence
  Synthetic oligonucleotide; CAG chr11 5308356 5308375 5308372 +
attttaaggttgaaggtatg

SEQ ID NO: 18345 - DNA, 20 bp, Artificial Sequence
  Synthetic oligonucleotide; TGG chr11 5308373 5308392 5308389 +
atgcagtaaaacttgttttc

SEQ ID NO: 18346 - DNA, 20 bp, Artificial Sequence
  Synthetic oligonucleotide; GAG chr11 5308375 5308394 5308391 +
gcagtaaaacttgttttctg

SEQ ID NO: 18347 - DNA, 20 bp, Artificial Sequence
  Synthetic oligonucleotide; AAG chr11 5308388 5308407 5308404 +
ttttctggagattacgttga

SEQ ID NO: 18348 - DNA, 20 bp, Artificial Sequence
  Synthetic oligonucleotide; AAG chr11 5308391 5308410 5308407 +
tctggagattacgttgaaag

SEQ ID NO: 18349 - DNA, 20 bp, Artificial Sequence
  Synthetic oligonucleotide; CAG chr11 5308397 5308416 5308413 +
gattacgttgaaagaagtta

SEQ ID NO: 18350 - DNA, 20 bp, Artificial Sequence
  Synthetic oligonucleotide; CAG chr11 5308401 5308420 5308417 +
acgttgaaagaagttacagt

SEQ ID NO: 18351 - DNA, 20 bp, Artificial Sequence
  Synthetic oligonucleotide; GAG chr11 5308414 5308433 5308430 +
ttacagtcagtcaatctaat

SEQ ID NO: 18352 - DNA, 20 bp, Artificial Sequence
  Synthetic oligonucleotide; AGG chr11 5308415 5308434 5308431 +
tacagtcagtcaatctaatg

SEQ ID NO: 18353 - DNA, 20 bp, Artificial Sequence
  Synthetic oligonucleotide; TAG chr11 5308421 5308440 5308437 +
cagtcaatctaatgaggttg

SEQ ID NO: 18354 - DNA, 20 bp, Artificial Sequence
  Synthetic oligonucleotide; AAG chr11 5308424 5308443 5308440 +
tcaatctaatgaggttgtag

SEQ ID NO: 18355 - DNA, 20 bp, Artificial Sequence
  Synthetic oligonucleotide; AAG chr11 5308438 5308457 5308454 +
ttgtagaagatgaaacaact

SEQ ID NO: 18356 - DNA, 20 bp, Artificial Sequence
  Synthetic oligonucleotide; TGG chr11 5308442 5308461 5308458 +
agaagatgaaacaactaagc

SEQ ID NO: 18357 - DNA, 20 bp, Artificial Sequence
  Synthetic oligonucleotide; TGG chr11 5308451 5308470 5308467 +
aacaactaagctggtgctcc

SEQ ID NO: 18358 - DNA, 20 bp, Artificial Sequence
  Synthetic oligonucleotide; AAG chr11 5308473 5308492 5308489 +
gtaatgacttgatacctgcg

SEQ ID NO: 18359 - DNA, 20 bp, Artificial Sequence
  Synthetic oligonucleotide; TAG chr11 5308490 5308509 5308506 +
gcgaagtgtctaaatatgta

SEQ ID NO: 18360 - DNA, 20 bp, Artificial Sequence
  Synthetic oligonucleotide; GAG chr11 5308492 5308511 5308508 +
gaagtgtctaaatatgtata

SEQ ID NO: 18361 - DNA, 20 bp, Artificial Sequence
  Synthetic oligonucleotide; AGG chr11 5308493 5308512 5308509 +
aagtgtctaaatatgtatag

SEQ ID NO: 18362 - DNA, 20 bp, Artificial Sequence
  Synthetic oligonucleotide; GAG chr11 5308495 5308514 5308511 +
gtgtctaaatatgtatagag

SEQ ID NO: 18363 - DNA, 20 bp, Artificial Sequence
  Synthetic oligonucleotide; TAG chr11 5308507 5308526 5308523 +
gtatagaggagttgataata

SEQ ID NO: 18364 - DNA, 20 bp, Artificial Sequence
  Synthetic oligonucleotide; TGG chr11 5308523 5308542 5308539 +
aatatagaccaattgcactt

SEQ ID NO: 18365 - DNA, 20 bp, Artificial Sequence
  Synthetic oligonucleotide; GGG chr11 5308524 5308543 5308540 +
atatagaccaattgcacttt

SEQ ID NO: 18366 - DNA, 20 bp, Artificial Sequence
  Synthetic oligonucleotide; GAG chr11 5308535 5308554 5308551 +
ttgcactttgggcccctgct

SEQ ID NO: 18367 - DNA, 20 bp, Artificial Sequence
  Synthetic oligonucleotide; AAG chr11 5308539 5308558 5308555 +
actttgggcccctgctgagt

SEQ ID NO: 18368 - DNA, 20 bp, Artificial Sequence
  Synthetic oligonucleotide; TAG chr11 5308567 5308586 5308583 +
gtgtcaactaaacaaaacga

SEQ ID NO: 18369 - DNA, 20 bp, Artificial Sequence
  Synthetic oligonucleotide; AGG chr11 5308568 5308587 5308584 +
tgtcaactaaacaaaacgat

SEQ ID NO: 18370 - DNA, 20 bp, Artificial Sequence
  Synthetic oligonucleotide; AAG chr11 5308587 5308606 5308603 +
taggaaattgtatttcccca

SEQ ID NO: 18371 - DNA, 20 bp, Artificial Sequence
  Synthetic oligonucleotide; TGG chr11 5308596 5308615 5308612 +
gtatttccccaaagacattt

SEQ ID NO: 18372 - DNA, 20 bp, Artificial Sequence
  Synthetic oligonucleotide; CAG chr11 5308612 5308631 5308628 +
attttggaaacgttctcctt

SEQ ID NO: 18373 - DNA, 20 bp, Artificial Sequence
  Synthetic oligonucleotide; TGG chr11 5308621 5308640 5308637 +
acgttctccttcagcaccaa

SEQ ID NO: 18374 - DNA, 20 bp, Artificial Sequence
  Synthetic oligonucleotide; TAG chr11 5308624 5308643 5308640 +
ttctccttcagcaccaatgg

SEQ ID NO: 18375 - DNA, 20 bp, Artificial Sequence
  Synthetic oligonucleotide; TGG chr11 5308631 5308650 5308647 +
tcagcaccaatggtagcacc

SEQ ID NO: 18376 - DNA, 20 bp, Artificial Sequence
  Synthetic oligonucleotide; AAG chr11 5308653 5308672 5308669 +
gaactgaccatccaacttcc

SEQ ID NO: 18377 - DNA, 20 bp, Artificial Sequence
  Synthetic oligonucleotide; TGG chr11 5308708 5308727 5308724 +
ccaatctctttcctccatca

SEQ ID NO: 18378 - DNA, 20 bp, Artificial Sequence
  Synthetic oligonucleotide; CAG chr11 5308714 5308733 5308730 +
tctttcctccatcatggaaa

SEQ ID NO: 18379 - DNA, 20 bp, Artificial Sequence
  Synthetic oligonucleotide; AAG chr11 5308731 5308750 5308747 +
aaacagccctgcatattcaa

SEQ ID NO: 18380 - DNA, 20 bp, Artificial Sequence
  Synthetic oligonucleotide; GAG chr11 5308735 5308754 5308751 +
agccctgcatattcaaaagt

SEQ ID NO: 18381 - DNA, 20 bp, Artificial Sequence
  Synthetic oligonucleotide; CAG chr11 5308759 5308778 5308775 +
gtccctctcttatacctcgt

SEQ ID NO: 18382 - DNA, 20 bp, Artificial Sequence
  Synthetic oligonucleotide; GAG chr11 5308761 5308780 5308777 +
ccctctcttatacctcgtca

SEQ ID NO: 18383 - DNA, 20 bp, Artificial Sequence
  Synthetic oligonucleotide; GAG chr11 5308763 5308782 5308779 +
ctctcttatacctcgtcaga

SEQ ID NO: 18384 - DNA, 20 bp, Artificial Sequence
  Synthetic oligonucleotide; CAG chr11 5308797 5308816 5308813 +
gtcatattcacaatccacaa

SEQ ID NO: 18385 - DNA, 20 bp, Artificial Sequence
  Synthetic oligonucleotide; AGG chr11 5308798 5308817 5308814 +
tcatattcacaatccacaac

SEQ ID NO: 18386 - DNA, 20 bp, Artificial Sequence
  Synthetic oligonucleotide; CAG chr11 5308803 5308822 5308819 +
ttcacaatccacaacaggcc

SEQ ID NO: 18387 - DNA, 20 bp, Artificial Sequence
  Synthetic oligonucleotide; CAG chr11 5308815 5308834 5308831 +
aacaggcccagataaccgtt

SEQ ID NO: 18388 - DNA, 20 bp, Artificial Sequence
  Synthetic oligonucleotide; TGG chr11 5308824 5308843 5308840 +
agataaccgttcagtgatgc

SEQ ID NO: 18389 - DNA, 20 bp, Artificial Sequence
  Synthetic oligonucleotide; AAG chr11 5308836 5308855 5308852 +
agtgatgctggtcatcactg

SEQ ID NO: 18390 - DNA, 20 bp, Artificial Sequence
  Synthetic oligonucleotide; TAG chr11 5308840 5308859 5308856 +
atgctggtcatcactgaaga

SEQ ID NO: 18391 - DNA, 20 bp, Artificial Sequence
  Synthetic oligonucleotide; TGG chr11 5308863 5308882 5308879 +
attgaatcttcctttcttct

SEQ ID NO: 18392 - DNA, 20 bp, Artificial Sequence
  Synthetic oligonucleotide; CAG chr11 5308876 5308895 5308892 +
ttcttcttggacgtaaattg

SEQ ID NO: 18393 - DNA, 20 bp, Artificial Sequence
  Synthetic oligonucleotide; AGG chr11 5308877 5308896 5308893 +
tcttcttggacgtaaattgc

SEQ ID NO: 18394 - DNA, 20 bp, Artificial Sequence
  Synthetic oligonucleotide; AAG chr11 5308902 5308921 5308918 +
attgaaaaaactataacttg

SEQ ID NO: 18395 - DNA, 20 bp, Artificial Sequence
  Synthetic oligonucleotide; TAG chr11 5308910 5308929 5308926 +
aactataacttgaagtttca

SEQ ID NO: 18396 - DNA, 20 bp, Artificial Sequence
  Synthetic oligonucleotide; CAG chr11 5308913 5308932 5308929 +
tataacttgaagtttcatag

SEQ ID NO: 18397 - DNA, 20 bp, Artificial Sequence
  Synthetic oligonucleotide; AAG chr11 5308917 5308936 5308933 +
acttgaagtttcatagcaga

SEQ ID NO: 18398 - DNA, 20 bp, Artificial Sequence
  Synthetic oligonucleotide; TGG chr11 5308921 5308940 5308937 +
gaagtttcatagcagaaagt

SEQ ID NO: 18399 - DNA, 20 bp, Artificial Sequence
  Synthetic oligonucleotide; AAG chr11 5308937 5308956 5308953 +
aagttggcatctttctcact

SEQ ID NO: 18400 - DNA, 20 bp, Artificial Sequence
  Synthetic oligonucleotide; GAG chr11 5308943 5308962 5308959 +
gcatctttctcactaagcat

SEQ ID NO: 18401 - DNA, 20 bp, Artificial Sequence
  Synthetic oligonucleotide; CAG chr11 5308955 5308974 5308971 +
ctaagcatgagaaaaactaa

SEQ ID NO: 18402 - DNA, 20 bp, Artificial Sequence
  Synthetic oligonucleotide; GAG chr11 5308957 5308976 5308973 +
aagcatgagaaaaactaaca

SEQ ID NO: 18403 - DNA, 20 bp, Artificial Sequence
  Synthetic oligonucleotide; AAG chr11 5308970 5308989 5308986 +
actaacagagttttaatttg

SEQ ID NO: 18404 - DNA, 20 bp, Artificial Sequence
  Synthetic oligonucleotide; AGG chr11 5308971 5308990 5308987 +
ctaacagagttttaatttga

SEQ ID NO: 18405 - DNA, 20 bp, Artificial Sequence
  Synthetic oligonucleotide; GGG chr11 5308972 5308991 5308988 +
taacagagttttaatttgaa

SEQ ID NO: 18406 - DNA, 20 bp, Artificial Sequence
  Synthetic oligonucleotide; TAG chr11 5308978 5308997 5308994 +
agttttaatttgaagggcct

SEQ ID NO: 18407 - DNA, 20 bp, Artificial Sequence
  Synthetic oligonucleotide; TAG chr11 5308987 5309006 5309003 +
ttgaagggccttagccaact

SEQ ID NO: 18408 - DNA, 20 bp, Artificial Sequence
  Synthetic oligonucleotide; AAG chr11 5308993 5309012 5309009 +
ggccttagccaacttagctg

SEQ ID NO: 18409 - DNA, 20 bp, Artificial Sequence
  Synthetic oligonucleotide; AAG chr11 5309008 5309027 5309024 +
agctgaagtcccttccacct

SEQ ID NO: 18410 - DNA, 20 bp, Artificial Sequence
  Synthetic oligonucleotide; AAG chr11 5309014 5309033 5309030 +
agtcccttccacctaagata

SEQ ID NO: 18411 - DNA, 20 bp, Artificial Sequence
  Synthetic oligonucleotide; AAG chr11 5309023 5309042 5309039 +
cacctaagataaagctgtaa

SEQ ID NO: 18412 - DNA, 20 bp, Artificial Sequence
  Synthetic oligonucleotide; GAG chr11 5309025 5309044 5309041 +
cctaagataaagctgtaaaa

SEQ ID NO: 18413 - DNA, 20 bp, Artificial Sequence
  Synthetic oligonucleotide; AGG chr11 5309026 5309045 5309042 +
ctaagataaagctgtaaaag

SEQ ID NO: 18414 - DNA, 20 bp, Artificial Sequence
  Synthetic oligonucleotide; GAG chr11 5309028 5309047 5309044 +
aagataaagctgtaaaagag

SEQ ID NO: 18415 - DNA, 20 bp, Artificial Sequence
  Synthetic oligonucleotide; CAG chr11 5309031 5309050 5309047 +
ataaagctgtaaaagaggag

SEQ ID NO: 18416 - DNA, 20 bp, Artificial Sequence
  Synthetic oligonucleotide; TAG chr11 5309044 5309063 5309060 +
agaggagcagatgtataatt

SEQ ID NO: 18417 - DNA, 20 bp, Artificial Sequence
  Synthetic oligonucleotide; TGG chr11 5309051 5309070 5309067 +
cagatgtataatttagatat

SEQ ID NO: 18418 - DNA, 20 bp, Artificial Sequence
  Synthetic oligonucleotide; GAG chr11 5309053 5309072 5309069 +
gatgtataatttagatattg

SEQ ID NO: 18419 - DNA, 20 bp, Artificial Sequence
  Synthetic oligonucleotide; CAG chr11 5309056 5309075 5309072 +
gtataatttagatattggag

SEQ ID NO: 18420 - DNA, 20 bp, Artificial Sequence
  Synthetic oligonucleotide; CAG chr11 5309063 5309082 5309079 +
ttagatattggagcagcatg

SEQ ID NO: 18421 - DNA, 20 bp, Artificial Sequence
  Synthetic oligonucleotide; GAG chr11 5309082 5309101 5309098 +
gcagtatcaaaatacctcat

SEQ ID NO: 18422 - DNA, 20 bp, Artificial Sequence
  Synthetic oligonucleotide; AAG chr11 5309090 5309109 5309106 +
aaaatacctcatgagcacca

SEQ ID NO: 18423 - DNA, 20 bp, Artificial Sequence
  Synthetic oligonucleotide; AAG chr11 5309093 5309112 5309109 +
atacctcatgagcaccaaag

SEQ ID NO: 18424 - DNA, 20 bp, Artificial Sequence
  Synthetic oligonucleotide; CAG chr11 5309110 5309129 5309126 +
aagaagccatatatttttca

SEQ ID NO: 18425 - DNA, 20 bp, Artificial Sequence
  Synthetic oligonucleotide; AAG chr11 5309139 5309158 5309155 +
ttcttccaaaataacttaca

SEQ ID NO: 18426 - DNA, 20 bp, Artificial Sequence
  Synthetic oligonucleotide; CAG chr11 5309143 5309162 5309159 +
tccaaaataacttacaaaga

SEQ ID NO: 18427 - DNA, 20 bp, Artificial Sequence
  Synthetic oligonucleotide; AAG chr11 5309161 5309180 5309177 +
gacagtctttcctctgtcat

SEQ ID NO: 18428 - DNA, 20 bp, Artificial Sequence
  Synthetic oligonucleotide; CAG chr11 5309174 5309193 5309190 +
ctgtcataagaacctgcacc

SEQ ID NO: 18429 - DNA, 20 bp, Artificial Sequence
  Synthetic oligonucleotide; AGG chr11 5309175 5309194 5309191 +
tgtcataagaacctgcaccc

SEQ ID NO: 18430 - DNA, 20 bp, Artificial Sequence
  Synthetic oligonucleotide; CAG chr11 5309179 5309198 5309195 +
ataagaacctgcacccaggt

SEQ ID NO: 18431 - DNA, 20 bp, Artificial Sequence
  Synthetic oligonucleotide; AAG chr11 5309188 5309207 5309204 +
tgcacccaggtcagcaaatc

SEQ ID NO: 18432 - DNA, 20 bp, Artificial Sequence
  Synthetic oligonucleotide; TGG chr11 5309192 5309211 5309208 +
cccaggtcagcaaatcaaga

SEQ ID NO: 18433 - DNA, 20 bp, Artificial Sequence
  Synthetic oligonucleotide; CGG chr11 5309202 5309221 5309218 +
caaatcaagatggaaatgat

SEQ ID NO: 18434 - DNA, 20 bp, Artificial Sequence
  Synthetic oligonucleotide; GGG chr11 5309203 5309222 5309219 +
aaatcaagatggaaatgatc

SEQ ID NO: 18435 - DNA, 20 bp, Artificial Sequence
  Synthetic oligonucleotide; GGG chr11 5309204 5309223 5309220 +
aatcaagatggaaatgatcg

SEQ ID NO: 18436 - DNA, 20 bp, Artificial Sequence
  Synthetic oligonucleotide; TAG chr11 5309239 5309258 5309255 +
accaacacactaataaacat

SEQ ID NO: 18437 - DNA, 20 bp, Artificial Sequence
  Synthetic oligonucleotide; AGG chr11 5309240 5309259 5309256 +
ccaacacactaataaacatt

SEQ ID NO: 18438 - DNA, 20 bp, Artificial Sequence
  Synthetic oligonucleotide; TGG chr11 5309250 5309269 5309266 +
aataaacattaggaacttac

SEQ ID NO: 18439 - DNA, 20 bp, Artificial Sequence
  Synthetic oligonucleotide; GGG chr11 5309251 5309270 5309267 +
ataaacattaggaacttact

SEQ ID NO: 18440 - DNA, 20 bp, Artificial Sequence
  Synthetic oligonucleotide; GAG chr11 5309262 5309281 5309278 +
gaacttactgggcacattat

SEQ ID NO: 18441 - DNA, 20 bp, Artificial Sequence
  Synthetic oligonucleotide; CAG chr11 5309268 5309287 5309284 +
actgggcacattatgagaaa

SEQ ID NO: 18442 - DNA, 20 bp, Artificial Sequence
  Synthetic oligonucleotide; GAG chr11 5309270 5309289 5309286 +
tgggcacattatgagaaaca

SEQ ID NO: 18443 - DNA, 20 bp, Artificial Sequence
  Synthetic oligonucleotide; AGG chr11 5309271 5309290 5309287 +
gggcacattatgagaaacag

SEQ ID NO: 18444 - DNA, 20 bp, Artificial Sequence
  Synthetic oligonucleotide; GAG chr11 5309273 5309292 5309289 +
gcacattatgagaaacagag

SEQ ID NO: 18445 - DNA, 20 bp, Artificial Sequence
  Synthetic oligonucleotide; TGG chr11 5309280 5309299 5309296 +
atgagaaacagaggagtctt

SEQ ID NO: 18446 - DNA, 20 bp, Artificial Sequence
  Synthetic oligonucleotide; GGG chr11 5309281 5309300 5309297 +
tgagaaacagaggagtcttt

SEQ ID NO: 18447 - DNA, 20 bp, Artificial Sequence
  Synthetic oligonucleotide; GGG chr11 5309282 5309301 5309298 +
gagaaacagaggagtctttg

SEQ ID NO: 18448 - DNA, 20 bp, Artificial Sequence
  Synthetic oligonucleotide; GGG chr11 5309283 5309302 5309299 +
agaaacagaggagtctttgg

SEQ ID NO: 18449 - DNA, 20 bp, Artificial Sequence
  Synthetic oligonucleotide; CAG chr11 5309291 5309310 5309307 +
aggagtctttgggggataac

SEQ ID NO: 18450 - DNA, 20 bp, Artificial Sequence
  Synthetic oligonucleotide; AAG chr11 5309299 5309318 5309315 +
ttgggggataaccagatttt

SEQ ID NO: 18451 - DNA, 20 bp, Artificial Sequence
  Synthetic oligonucleotide; CAG chr11 5309317 5309336 5309333 +
ttaagatttgtgtttatact

SEQ ID NO: 18452 - DNA, 20 bp, Artificial Sequence
  Synthetic oligonucleotide; TAG chr11 5309326 5309345 5309342 +
gtgtttatactcagtatcaa

SEQ ID NO: 18453 - DNA, 20 bp, Artificial Sequence
  Synthetic oligonucleotide; TAG chr11 5309347 5309366 5309363 +
agcttaaacattgtactcaa

SEQ ID NO: 18454 - DNA, 20 bp, Artificial Sequence
  Synthetic oligonucleotide; CAG chr11 5309366 5309385 5309382 +
atagcatataattttgctta

SEQ ID NO: 18455 - DNA, 20 bp, Artificial Sequence
  Synthetic oligonucleotide; TGG chr11 5309376 5309395 5309392 +
attttgcttacagcatgcat

SEQ ID NO: 18456 - DNA, 20 bp, Artificial Sequence
  Synthetic oligonucleotide; GGG chr11 5309377 5309396 5309393 +
ttttgcttacagcatgcatt

SEQ ID NO: 18457 - DNA, 20 bp, Artificial Sequence
  Synthetic oligonucleotide; CGG chr11 5309388 5309407 5309404 +
gcatgcattgggtaaataat

SEQ ID NO: 18458 - DNA, 20 bp, Artificial Sequence
  Synthetic oligonucleotide; CAG chr11 5309405 5309424 5309421 +
aatcggttttacaattgatt

SEQ ID NO: 18459 - DNA, 20 bp, Artificial Sequence
  Synthetic oligonucleotide; AAG chr11 5309415 5309434 5309431 +
acaattgattcagtatgaaa

SEQ ID NO: 18460 - DNA, 20 bp, Artificial Sequence
  Synthetic oligonucleotide; AAG chr11 5309427 5309446 5309443 +
gtatgaaaaagttttaatac

SEQ ID NO: 18461 - DNA, 20 bp, Artificial Sequence
  Synthetic oligonucleotide; AGG chr11 5309428 5309447 5309444 +
tatgaaaaagttttaataca

SEQ ID NO: 18462 - DNA, 20 bp, Artificial Sequence
  Synthetic oligonucleotide; CAG chr11 5309436 5309455 5309452 +
agttttaatacaaggacata

SEQ ID NO: 18463 - DNA, 20 bp, Artificial Sequence
  Synthetic oligonucleotide; AAG chr11 5309466 5309485 5309482 +
gcgcctacacctattttttt

SEQ ID NO: 18464 - DNA, 20 bp, Artificial Sequence
  Synthetic oligonucleotide; TAG chr11 5309476 5309495 5309492 +
ctatttttttaagcattcca

SEQ ID NO: 18465 - DNA, 20 bp, Artificial Sequence
  Synthetic oligonucleotide; TGG chr11 5309481 5309500 5309497 +
tttttaagcattccatagat

SEQ ID NO: 18466 - DNA, 20 bp, Artificial Sequence
  Synthetic oligonucleotide; CAG chr11 5309533 5309552 5309549 +
tcccaatataaaactttact

SEQ ID NO: 18467 - DNA, 20 bp, Artificial Sequence
  Synthetic oligonucleotide; AGG chr11 5309534 5309553 5309550 +
cccaatataaaactttactc

SEQ ID NO: 18468 - DNA, 20 bp, Artificial Sequence
  Synthetic oligonucleotide; CGG chr11 5309538 5309557 5309554 +
atataaaactttactcaggc

SEQ ID NO: 18469 - DNA, 20 bp, Artificial Sequence
  Synthetic oligonucleotide; GGG chr11 5309539 5309558 5309555 +
tataaaactttactcaggcc

SEQ ID NO: 18470 - DNA, 20 bp, Artificial Sequence
  Synthetic oligonucleotide; CGG chr11 5309544 5309563 5309560 +
aactttactcaggccgggcg

SEQ ID NO: 18471 - DNA, 20 bp, Artificial Sequence
  Synthetic oligonucleotide; TGG chr11 5309547 5309566 5309563 +
tttactcaggccgggcgcgg

SEQ ID NO: 18472 - DNA, 20 bp, Artificial Sequence
  Synthetic oligonucleotide; CAG chr11 5309566 5309585 5309582 +
gtggctcacgcctgtaatcc

SEQ ID NO: 18473 - DNA, 20 bp, Artificial Sequence
  Synthetic oligonucleotide; TGG chr11 5309574 5309593 5309590 +
cgcctgtaatcccagcactt

SEQ ID NO: 18474 - DNA, 20 bp, Artificial Sequence
  Synthetic oligonucleotide; GGG chr11 5309575 5309594 5309591 +
gcctgtaatcccagcacttt

SEQ ID NO: 18475 - DNA, 20 bp, Artificial Sequence
  Synthetic oligonucleotide; GAG chr11 5309577 5309596 5309593 +
ctgtaatcccagcactttgg

SEQ ID NO: 18476 - DNA, 20 bp, Artificial Sequence
  Synthetic oligonucleotide; AGG chr11 5309578 5309597 5309594 +
tgtaatcccagcactttggg

SEQ ID NO: 18477 - DNA, 20 bp, Artificial Sequence
  Synthetic oligonucleotide; GAG chr11 5309583 5309602 5309599 +
tcccagcactttgggaggcc

SEQ ID NO: 18478 - DNA, 20 bp, Artificial Sequence
  Synthetic oligonucleotide; AGG chr11 5309584 5309603 5309600 +
cccagcactttgggaggccg

SEQ ID NO: 18479 - DNA, 20 bp, Artificial Sequence
  Synthetic oligonucleotide; CGG chr11 5309587 5309606 5309603 +
agcactttgggaggccgagg

SEQ ID NO: 18480 - DNA, 20 bp, Artificial Sequence
  Synthetic oligonucleotide; GGG chr11 5309588 5309607 5309604 +
gcactttgggaggccgaggc

SEQ ID NO: 18481 - DNA, 20 bp, Artificial Sequence
  Synthetic oligonucleotide; TGG chr11 5309591 5309610 5309607 +
ctttgggaggccgaggcggg

SEQ ID NO: 18482 - DNA, 20 bp, Artificial Sequence
  Synthetic oligonucleotide; GAG chr11 5309599 5309618 5309615 +
ggccgaggcgggtggatcac

SEQ ID NO: 18483 - DNA, 20 bp, Artificial Sequence
  Synthetic oligonucleotide; AGG chr11 5309600 5309619 5309616 +
gccgaggcgggtggatcacg

SEQ ID NO: 18484 - DNA, 20 bp, Artificial Sequence
  Synthetic oligonucleotide; CGG chr11 5309604 5309623 5309620 +
aggcgggtggatcacgaggt

SEQ ID NO: 18485 - DNA, 20 bp, Artificial Sequence
  Synthetic oligonucleotide; GGG chr11 5309605 5309624 5309621 +
ggcgggtggatcacgaggtc

SEQ ID NO: 18486 - DNA, 20 bp, Artificial Sequence
  Synthetic oligonucleotide; GAG chr11 5309607 5309626 5309623 +
cgggtggatcacgaggtcgg

SEQ ID NO: 18487 - DNA, 20 bp, Artificial Sequence
  Synthetic oligonucleotide; GAG chr11 5309613 5309632 5309629 +
gatcacgaggtcgggagatc

SEQ ID NO: 18488 - DNA, 20 bp, Artificial Sequence
  Synthetic oligonucleotide; TGG chr11 5309623 5309642 5309639 +
tcgggagatcgagaccatcc

SEQ ID NO: 18489 - DNA, 20 bp, Artificial Sequence
  Synthetic oligonucleotide; CAG chr11 5309632 5309651 5309648 +
cgagaccatcctggctaaca

SEQ ID NO: 18490 - DNA, 20 bp, Artificial Sequence
  Synthetic oligonucleotide; AAG chr11 5309656 5309675 5309672 +
gaaaccccgtctctactaaa

SEQ ID NO: 18491 - DNA, 20 bp, Artificial Sequence
  Synthetic oligonucleotide; TGG chr11 5309674 5309693 5309690 +
aaaagacaaaaaaatttgcc

SEQ ID NO: 18492 - DNA, 20 bp, Artificial Sequence
  Synthetic oligonucleotide; TGG chr11 5309679 5309698 5309695 +
acaaaaaaatttgcctggcg

SEQ ID NO: 18493 - DNA, 20 bp, Artificial Sequence
  Synthetic oligonucleotide; TGG chr11 5309682 5309701 5309698 +
aaaaaatttgcctggcgtgg

SEQ ID NO: 18494 - DNA, 20 bp, Artificial Sequence
  Synthetic oligonucleotide; CGG chr11 5309685 5309704 5309701 +
aaatttgcctggcgtggtgg

SEQ ID NO: 18495 - DNA, 20 bp, Artificial Sequence
  Synthetic oligonucleotide; GGG chr11 5309686 5309705 5309702 +
aatttgcctggcgtggtggc

SEQ ID NO: 18496 - DNA, 20 bp, Artificial Sequence
  Synthetic oligonucleotide; TAG chr11 5309695 5309714 5309711 +
ggcgtggtggcgggcgcctg

SEQ ID NO: 18497 - DNA, 20 bp, Artificial Sequence
  Synthetic oligonucleotide; CAG chr11 5309701 5309720 5309717 +
gtggcgggcgcctgtagtcc

SEQ ID NO: 18498 - DNA, 20 bp, Artificial Sequence
  Synthetic oligonucleotide; CGG chr11 5309709 5309728 5309725 +
cgcctgtagtcccagctact

SEQ ID NO: 18499 - DNA, 20 bp, Artificial Sequence
  Synthetic oligonucleotide; GGG chr11 5309710 5309729 5309726 +
gcctgtagtcccagctactc

SEQ ID NO: 18500 - DNA, 20 bp, Artificial Sequence
  Synthetic oligonucleotide; GAG chr11 5309712 5309731 5309728 +
ctgtagtcccagctactcgg

SEQ ID NO: 18501 - DNA, 20 bp, Artificial Sequence
  Synthetic oligonucleotide; AGG chr11 5309713 5309732 5309729 +
tgtagtcccagctactcggg

SEQ ID NO: 18502 - DNA, 20 bp, Artificial Sequence
  Synthetic oligonucleotide; GAG chr11 5309718 5309737 5309734 +
tcccagctactcgggaggct

SEQ ID NO: 18503 - DNA, 20 bp, Artificial Sequence
  Synthetic oligonucleotide; AGG chr11 5309719 5309738 5309735 +
cccagctactcgggaggctg

SEQ ID NO: 18504 - DNA, 20 bp, Artificial Sequence
  Synthetic oligonucleotide; CAG chr11 5309722 5309741 5309738 +
agctactcgggaggctgagg

SEQ ID NO: 18505 - DNA, 20 bp, Artificial Sequence
  Synthetic oligonucleotide; AGG chr11 5309723 5309742 5309739 +
gctactcgggaggctgaggc

SEQ ID NO: 18506 - DNA, 20 bp, Artificial Sequence
  Synthetic oligonucleotide; GAG chr11 5309725 5309744 5309741 +
tactcgggaggctgaggcag

SEQ ID NO: 18507 - DNA, 20 bp, Artificial Sequence
  Synthetic oligonucleotide; TGG chr11 5309730 5309749 5309746 +
gggaggctgaggcaggagaa

SEQ ID NO: 18508 - DNA, 20 bp, Artificial Sequence
  Synthetic oligonucleotide; CGG chr11 5309741 5309760 5309757 +
gcaggagaatggcgtgaacc

SEQ ID NO: 18509 - DNA, 20 bp, Artificial Sequence
  Synthetic oligonucleotide; GGG chr11 5309742 5309761 5309758 +
caggagaatggcgtgaaccc

SEQ ID NO: 18510 - DNA, 20 bp, Artificial Sequence
  Synthetic oligonucleotide; GAG chr11 5309744 5309763 5309760 +
ggagaatggcgtgaacccgg

SEQ ID NO: 18511 - DNA, 20 bp, Artificial Sequence
  Synthetic oligonucleotide; AGG chr11 5309745 5309764 5309761 +
gagaatggcgtgaacccggg

SEQ ID NO: 18512 - DNA, 20 bp, Artificial Sequence
  Synthetic oligonucleotide; CAG chr11 5309748 5309767 5309764 +
aatggcgtgaacccgggagg

SEQ ID NO: 18513 - DNA, 20 bp, Artificial Sequence
  Synthetic oligonucleotide; GAG chr11 5309750 5309769 5309766 +
tggcgtgaacccgggaggca

SEQ ID NO: 18514 - DNA, 20 bp, Artificial Sequence
  Synthetic oligonucleotide; CAG chr11 5309757 5309776 5309773 +
aacccgggaggcagagcttg

SEQ ID NO: 18515 - DNA, 20 bp, Artificial Sequence
  Synthetic oligonucleotide; GAG chr11 5309761 5309780 5309777 +
cgggaggcagagcttgcagt

SEQ ID NO: 18516 - DNA, 20 bp, Artificial Sequence
  Synthetic oligonucleotide; GAG chr11 5309766 5309785 5309782 +
ggcagagcttgcagtgagct

SEQ ID NO: 18517 - DNA, 20 bp, Artificial Sequence
  Synthetic oligonucleotide; CAG chr11 5309786 5309805 5309802 +
gagatcacgccactgcactc

SEQ ID NO: 18518 - DNA, 20 bp, Artificial Sequence
  Synthetic oligonucleotide; TGG chr11 5309791 5309810 5309807 +
cacgccactgcactccagcc

SEQ ID NO: 18519 - DNA, 20 bp, Artificial Sequence
  Synthetic oligonucleotide; GGG chr11 5309792 5309811 5309808 +
acgccactgcactccagcct

SEQ ID NO: 18520 - DNA, 20 bp, Artificial Sequence
  Synthetic oligonucleotide; CAG chr11 5309798 5309817 5309814 +
ctgcactccagcctgggcga

SEQ ID NO: 18521 - DNA, 20 bp, Artificial Sequence
  Synthetic oligonucleotide; GAG chr11 5309800 5309819 5309816 +
gcactccagcctgggcgaca

SEQ ID NO: 18522 - DNA, 20 bp, Artificial Sequence
  Synthetic oligonucleotide; GAG chr11 5309804 5309823 5309820 +
tccagcctgggcgacagagc

SEQ ID NO: 18523 - DNA, 20 bp, Artificial Sequence
  Synthetic oligonucleotide; AAG chr11 5309834 5309853 5309850 +
ctcaaaaacaaaacaaaaca

SEQ ID NO: 18524 - DNA, 20 bp, Artificial Sequence
  Synthetic oligonucleotide; CAG chr11 5309853 5309872 5309869 +
aaagcaaaaaaaactttact

SEQ ID NO: 18525 - DNA, 20 bp, Artificial Sequence
  Synthetic oligonucleotide; AAG chr11 5309858 5309877 5309874 +
aaaaaaaactttactcagtg

SEQ ID NO: 18526 - DNA, 20 bp, Artificial Sequence
  Synthetic oligonucleotide; CAG chr11 5309863 5309882 5309879 +
aaactttactcagtgaagtc

SEQ ID NO: 18527 - DNA, 20 bp, Artificial Sequence
  Synthetic oligonucleotide; GAG chr11 5309865 5309884 5309881 +
actttactcagtgaagtcca

SEQ ID NO: 18528 - DNA, 20 bp, Artificial Sequence
  Synthetic oligonucleotide; AAG chr11 5309870 5309889 5309886 +
actcagtgaagtccagagca

SEQ ID NO: 18529 - DNA, 20 bp, Artificial Sequence
  Synthetic oligonucleotide; CAG chr11 5309893 5309912 5309909 +
atttgttgcaaacaaatcac

SEQ ID NO: 18530 - DNA, 20 bp, Artificial Sequence
  Synthetic oligonucleotide; TGG chr11 5309933 5309952 5309949 +
gaaaatgtacctgtaaaatg

SEQ ID NO: 18531 - DNA, 20 bp, Artificial Sequence
  Synthetic oligonucleotide; TAG chr11 5309950 5309969 5309966 +
atgtggatgccacatatttt

SEQ ID NO: 18532 - DNA, 20 bp, Artificial Sequence
  Synthetic oligonucleotide; AGG chr11 5309951 5309970 5309967 +
tgtggatgccacatattttt

SEQ ID NO: 18533 - DNA, 20 bp, Artificial Sequence
  Synthetic oligonucleotide; TGG chr11 5309956 5309975 5309972 +
atgccacatatttttaggtc

SEQ ID NO: 18534 - DNA, 20 bp, Artificial Sequence
  Synthetic oligonucleotide; AAG chr11 5309959 5309978 5309975 +
ccacatatttttaggtctgg

SEQ ID NO: 18535 - DNA, 20 bp, Artificial Sequence
  Synthetic oligonucleotide; AGG chr11 5309960 5309979 5309976 +
cacatatttttaggtctgga

SEQ ID NO: 18536 - DNA, 20 bp, Artificial Sequence
  Synthetic oligonucleotide; TAG chr11 5310005 5310024 5310021 +
ttgcattatcataaaatctc

SEQ ID NO: 18537 - DNA, 20 bp, Artificial Sequence
  Synthetic oligonucleotide; GAG chr11 5310010 5310029 5310026 +
ttatcataaaatctctagtt

SEQ ID NO: 18538 - DNA, 20 bp, Artificial Sequence
  Synthetic oligonucleotide; CAG chr11 5310056 5310075 5310072 +
ctttaactgaaaactgaacc

SEQ ID NO: 18539 - DNA, 20 bp, Artificial Sequence
  Synthetic oligonucleotide; AGG chr11 5310057 5310076 5310073 +
tttaactgaaaactgaaccc

SEQ ID NO: 18540 - DNA, 20 bp, Artificial Sequence
  Synthetic oligonucleotide; GAG chr11 5310059 5310078 5310075 +
taactgaaaactgaacccag

SEQ ID NO: 18541 - DNA, 20 bp, Artificial Sequence
  Synthetic oligonucleotide; AGG chr11 5310060 5310079 5310076 +
aactgaaaactgaacccagg

SEQ ID NO: 18542 - DNA, 20 bp, Artificial Sequence
  Synthetic oligonucleotide; CAG chr11 5310063 5310082 5310079 +
tgaaaactgaacccaggagg

SEQ ID NO: 18543 - DNA, 20 bp, Artificial Sequence
  Synthetic oligonucleotide; GAG chr11 5310065 5310084 5310081 +
aaaactgaacccaggaggca

SEQ ID NO: 18544 - DNA, 20 bp, Artificial Sequence
  Synthetic oligonucleotide; AGG chr11 5310066 5310085 5310082 +
aaactgaacccaggaggcag

SEQ ID NO: 18545 - DNA, 20 bp, Artificial Sequence
  Synthetic oligonucleotide; CAG chr11 5310072 5310091 5310088 +
aacccaggaggcagaggttg

SEQ ID NO: 18546 - DNA, 20 bp, Artificial Sequence
  Synthetic oligonucleotide; CAG chr11 5310076 5310095 5310092 +
caggaggcagaggttgcagt

SEQ ID NO: 18547 - DNA, 20 bp, Artificial Sequence
  Synthetic oligonucleotide; GAG chr11 5310081 5310100 5310097 +
ggcagaggttgcagtcagcc

SEQ ID NO: 18548 - DNA, 20 bp, Artificial Sequence
  Synthetic oligonucleotide; AAG chr11 5310087 5310106 5310103 +
ggttgcagtcagccgagatc

SEQ ID NO: 18549 - DNA, 20 bp, Artificial Sequence
  Synthetic oligonucleotide; AGG chr11 5310088 5310107 5310104 +
gttgcagtcagccgagatca

SEQ ID NO: 18550 - DNA, 20 bp, Artificial Sequence
  Synthetic oligonucleotide; CAG chr11 5310111 5310130 5310127 +
cactgaaaacttcctttctc

SEQ ID NO: 18551 - DNA, 20 bp, Artificial Sequence
  Synthetic oligonucleotide; AAG chr11 5310115 5310134 5310131 +
gaaaacttcctttctccaga

SEQ ID NO: 18552 - DNA, 20 bp, Artificial Sequence
  Synthetic oligonucleotide; TGG chr11 5310140 5310159 5310156 +
tgtctcattttcttcttcca

SEQ ID NO: 18553 - DNA, 20 bp, Artificial Sequence
  Synthetic oligonucleotide; AAG chr11 5310151 5310170 5310167 +
cttcttccatggaatattcc

SEQ ID NO: 18554 - DNA, 20 bp, Artificial Sequence
  Synthetic oligonucleotide; AGG chr11 5310152 5310171 5310168 +
ttcttccatggaatattcca

SEQ ID NO: 18555 - DNA, 20 bp, Artificial Sequence
  Synthetic oligonucleotide; AAG chr11 5310168 5310187 5310184 +
tccaaggaatattctttgaa

SEQ ID NO: 18556 - DNA, 20 bp, Artificial Sequence
  Synthetic oligonucleotide; CAG chr11 5310171 5310190 5310187 +
aaggaatattctttgaaaag

SEQ ID NO: 18557 - DNA, 20 bp, Artificial Sequence
  Synthetic oligonucleotide; CAG chr11 5310180 5310199 5310196 +
tctttgaaaagcagaatatt

SEQ ID NO: 18558 - DNA, 20 bp, Artificial Sequence
  Synthetic oligonucleotide; GAG chr11 5310182 5310201 5310198 +
tttgaaaagcagaatattca

SEQ ID NO: 18559 - DNA, 20 bp, Artificial Sequence
  Synthetic oligonucleotide; GAG chr11 5310186 5310205 5310202 +
aaaagcagaatattcagagt

SEQ ID NO: 18560 - DNA, 20 bp, Artificial Sequence
  Synthetic oligonucleotide; GAG chr11 5310188 5310207 5310204 +
aagcagaatattcagagtga

SEQ ID NO: 18561 - DNA, 20 bp, Artificial Sequence
  Synthetic oligonucleotide; AGG chr11 5310189 5310208 5310205 +
agcagaatattcagagtgag

SEQ ID NO: 18562 - DNA, 20 bp, Artificial Sequence
  Synthetic oligonucleotide; AAG chr11 5310192 5310211 5310208 +
agaatattcagagtgagagg

SEQ ID NO: 18563 - DNA, 20 bp, Artificial Sequence
  Synthetic oligonucleotide; TAG chr11 5310195 5310214 5310211 +
atattcagagtgagaggaag

SEQ ID NO: 18564 - DNA, 20 bp, Artificial Sequence
  Synthetic oligonucleotide; GAG chr11 5310197 5310216 5310213 +
attcagagtgagaggaagta

SEQ ID NO: 18565 - DNA, 20 bp, Artificial Sequence
  Synthetic oligonucleotide; GAG chr11 5310199 5310218 5310215 +
tcagagtgagaggaagtaga

SEQ ID NO: 18566 - DNA, 20 bp, Artificial Sequence
  Synthetic oligonucleotide; TAG chr11 5310209 5310228 5310225 +
aggaagtagagagatatatt

SEQ ID NO: 18567 - DNA, 20 bp, Artificial Sequence
  Synthetic oligonucleotide; AGG chr11 5310210 5310229 5310226 +
ggaagtagagagatatattt

SEQ ID NO: 18568 - DNA, 20 bp, Artificial Sequence
  Synthetic oligonucleotide; TAG chr11 5310213 5310232 5310229 +
agtagagagatatatttagg

SEQ ID NO: 18569 - DNA, 20 bp, Artificial Sequence
  Synthetic oligonucleotide; TGG chr11 5310220 5310239 5310236 +
agatatatttaggtagaatc

SEQ ID NO: 18570 - DNA, 20 bp, Artificial Sequence
  Synthetic oligonucleotide; GGG chr11 5310221 5310240 5310237 +
gatatatttaggtagaatct

SEQ ID NO: 18571 - DNA, 20 bp, Artificial Sequence
  Synthetic oligonucleotide; AAG chr11 5310231 5310250 5310247 +
ggtagaatctgggcatattg

SEQ ID NO: 18572 - DNA, 20 bp, Artificial Sequence
  Synthetic oligonucleotide; AGG chr11 5310232 5310251 5310248 +
gtagaatctgggcatattga

SEQ ID NO: 18573 - DNA, 20 bp, Artificial Sequence
  Synthetic oligonucleotide; GGG chr11 5310233 5310252 5310249 +
tagaatctgggcatattgaa

SEQ ID NO: 18574 - DNA, 20 bp, Artificial Sequence
  Synthetic oligonucleotide; AAG chr11 5310236 5310255 5310252 +
aatctgggcatattgaaggg

SEQ ID NO: 18575 - DNA, 20 bp, Artificial Sequence
  Synthetic oligonucleotide; CAG chr11 5310253 5310272 5310269 +
gggaagacatcaataattca

SEQ ID NO: 18576 - DNA, 20 bp, Artificial Sequence
  Synthetic oligonucleotide; TAG chr11 5310256 5310275 5310272 +
aagacatcaataattcacag

SEQ ID NO: 18577 - DNA, 20 bp, Artificial Sequence
  Synthetic oligonucleotide; AAG chr11 5310261 5310280 5310277 +
atcaataattcacagtagcc

SEQ ID NO: 18578 - DNA, 20 bp, Artificial Sequence
  Synthetic oligonucleotide; AGG chr11 5310262 5310281 5310278 +
tcaataattcacagtagcca

SEQ ID NO: 18579 - DNA, 20 bp, Artificial Sequence
  Synthetic oligonucleotide; TAG chr11 5310267 5310286 5310283 +
aattcacagtagccaaggaa

SEQ ID NO: 18580 - DNA, 20 bp, Artificial Sequence
  Synthetic oligonucleotide; AAG chr11 5310279 5310298 5310295 +
ccaaggaatagaaacaatac

SEQ ID NO: 18581 - DNA, 20 bp, Artificial Sequence
  Synthetic oligonucleotide; CAG chr11 5310292 5310311 5310308 +
acaatacaagtatctatcaa

SEQ ID NO: 18582 - DNA, 20 bp, Artificial Sequence
  Synthetic oligonucleotide; TAG chr11 5310329 5310348 5310345 +
aaaatgtcttatatatgtga

SEQ ID NO: 18583 - DNA, 20 bp, Artificial Sequence
  Synthetic oligonucleotide; AAG chr11 5310351 5310370 5310367 +
gaatattatttatctataaa

SEQ ID NO: 18584 - DNA, 20 bp, Artificial Sequence
  Synthetic oligonucleotide; TAG chr11 5310354 5310373 5310370 +
tattatttatctataaaaag

SEQ ID NO: 18585 - DNA, 20 bp, Artificial Sequence
  Synthetic oligonucleotide; AGG chr11 5310355 5310374 5310371 +
attatttatctataaaaagt

SEQ ID NO: 18586 - DNA, 20 bp, Artificial Sequence
  Synthetic oligonucleotide; AAG chr11 5310402 5310421 5310418 +
aaaccttaaaaaactatcct

SEQ ID NO: 18587 - DNA, 20 bp, Artificial Sequence
  Synthetic oligonucleotide; AAG chr11 5310411 5310430 5310427 +
aaaactatcctaagtgcaat

SEQ ID NO: 18588 - DNA, 20 bp, Artificial Sequence
  Synthetic oligonucleotide; AAG chr11 5310424 5310443 5310440 +
gtgcaataagtcatacgcaa

SEQ ID NO: 18589 - DNA, 20 bp, Artificial Sequence
  Synthetic oligonucleotide; GAG chr11 5310451 5310470 5310467 +
ttgtctgatttcacttacat

SEQ ID NO: 18590 - DNA, 20 bp, Artificial Sequence
  Synthetic oligonucleotide; TAG chr11 5310459 5310478 5310475 +
tttcacttacatgagctatc

SEQ ID NO: 18591 - DNA, 20 bp, Artificial Sequence
  Synthetic oligonucleotide; TAG chr11 5310464 5310483 5310480 +
cttacatgagctatctagaa

SEQ ID NO: 18592 - DNA, 20 bp, Artificial Sequence
  Synthetic oligonucleotide; AGG chr11 5310465 5310484 5310481 +
ttacatgagctatctagaat

SEQ ID NO: 18593 - DNA, 20 bp, Artificial Sequence
  Synthetic oligonucleotide; TAG chr11 5310476 5310495 5310492 +
atctagaataggcaaattca

SEQ ID NO: 18594 - DNA, 20 bp, Artificial Sequence
  Synthetic oligonucleotide; GAG chr11 5310478 5310497 5310494 +
ctagaataggcaaattcata

SEQ ID NO: 18595 - DNA, 20 bp, Artificial Sequence
  Synthetic oligonucleotide; AAG chr11 5310486 5310505 5310502 +
ggcaaattcatagagacaaa

SEQ ID NO: 18596 - DNA, 20 bp, Artificial Sequence
  Synthetic oligonucleotide; TAG chr11 5310489 5310508 5310505 +
aaattcatagagacaaaaag

SEQ ID NO: 18597 - DNA, 20 bp, Artificial Sequence
  Synthetic oligonucleotide; TAG chr11 5310494 5310513 5310510 +
catagagacaaaaagtagat

SEQ ID NO: 18598 - DNA, 20 bp, Artificial Sequence
  Synthetic oligonucleotide; AAG chr11 5310497 5310516 5310513 +
agagacaaaaagtagattag

SEQ ID NO: 18599 - DNA, 20 bp, Artificial Sequence
  Synthetic oligonucleotide; CAG chr11 5310504 5310523 5310520 +
aaaagtagattagaagttac

SEQ ID NO: 18600 - DNA, 20 bp, Artificial Sequence
  Synthetic oligonucleotide; GAG chr11 5310506 5310525 5310522 +
aagtagattagaagttacca

SEQ ID NO: 18601 - DNA, 20 bp, Artificial Sequence
  Synthetic oligonucleotide; TAG chr11 5310511 5310530 5310527 +
gattagaagttaccagagtg

SEQ ID NO: 18602 - DNA, 20 bp, Artificial Sequence
  Synthetic oligonucleotide; AGG chr11 5310512 5310531 5310528 +
attagaagttaccagagtgt

SEQ ID NO: 18603 - DNA, 20 bp, Artificial Sequence
  Synthetic oligonucleotide; AAG chr11 5310515 5310534 5310531 +
agaagttaccagagtgtagg

SEQ ID NO: 18604 - DNA, 20 bp, Artificial Sequence
  Synthetic oligonucleotide; TGG chr11 5310522 5310541 5310538 +
accagagtgtaggaagaaca

SEQ ID NO: 18605 - DNA, 20 bp, Artificial Sequence
  Synthetic oligonucleotide; TGG chr11 5310527 5310546 5310543 +
agtgtaggaagaacatggat

SEQ ID NO: 18606 - DNA, 20 bp, Artificial Sequence
  Synthetic oligonucleotide; GGG chr11 5310528 5310547 5310544 +
gtgtaggaagaacatggatt

SEQ ID NO: 18607 - DNA, 20 bp, Artificial Sequence
  Synthetic oligonucleotide; GGG chr11 5310529 5310548 5310545 +
tgtaggaagaacatggattg

SEQ ID NO: 18608 - DNA, 20 bp, Artificial Sequence
  Synthetic oligonucleotide; GAG chr11 5310531 5310550 5310547 +
taggaagaacatggattggg

SEQ ID NO: 18609 - DNA, 20 bp, Artificial Sequence
  Synthetic oligonucleotide; TAG chr11 5310551 5310570 5310567 +
gagtaactgattaatcaata

SEQ ID NO: 18610 - DNA, 20 bp, Artificial Sequence
  Synthetic oligonucleotide; GAG chr11 5310553 5310572 5310569 +
gtaactgattaatcaatata

SEQ ID NO: 18611 - DNA, 20 bp, Artificial Sequence
  Synthetic oligonucleotide; TGG chr11 5310564 5310583 5310580 +
atcaatatagagtttttatt

SEQ ID NO: 18612 - DNA, 20 bp, Artificial Sequence
  Synthetic oligonucleotide; TAG chr11 5310582 5310601 5310598 +
tttggtgtaatacaaaattt

SEQ ID NO: 18613 - DNA, 20 bp, Artificial Sequence
  Synthetic oligonucleotide; TAG chr11 5310588 5310607 5310604 +
gtaatacaaaattttagaaa

SEQ ID NO: 18614 - DNA, 20 bp, Artificial Sequence
  Synthetic oligonucleotide; TGG chr11 5310591 5310610 5310607 +
atacaaaattttagaaatag

SEQ ID NO: 18615 - DNA, 20 bp, Artificial Sequence
  Synthetic oligonucleotide; TGG chr11 5310594 5310613 5310610 +
caaaattttagaaatagtgg

SEQ ID NO: 18616 - DNA, 20 bp, Artificial Sequence
  Synthetic oligonucleotide; TGG chr11 5310610 5310629 5310626 +
gtggtggtgattgcacaaca

SEQ ID NO: 18617 - DNA, 20 bp, Artificial Sequence
  Synthetic oligonucleotide; AAG chr11 5310623 5310642 5310639 +
cacaacatggcaaatgtaat

SEQ ID NO: 18618 - DNA, 20 bp, Artificial Sequence
  Synthetic oligonucleotide; AAG chr11 5310650 5310669 5310666 +
actgcattatacattataaa

SEQ ID NO: 18619 - DNA, 20 bp, Artificial Sequence
  Synthetic oligonucleotide; AGG chr11 5310651 5310670 5310667 +
ctgcattatacattataaaa

SEQ ID NO: 18620 - DNA, 20 bp, Artificial Sequence
  Synthetic oligonucleotide; AAG chr11 5310657 5310676 5310673 +
tatacattataaaaaggcta

SEQ ID NO: 18621 - DNA, 20 bp, Artificial Sequence
  Synthetic oligonucleotide; TGG chr11 5310660 5310679 5310676 +
acattataaaaaggctaaag

SEQ ID NO: 18622 - DNA, 20 bp, Artificial Sequence
  Synthetic oligonucleotide; AAG chr11 5310732 5310751 5310748 +
attcattaaatttattgtga

SEQ ID NO: 18623 - DNA, 20 bp, Artificial Sequence
  Synthetic oligonucleotide; AGG chr11 5310733 5310752 5310749 +
ttcattaaatttattgtgaa

SEQ ID NO: 18624 - DNA, 20 bp, Artificial Sequence
  Synthetic oligonucleotide; AAG chr11 5310745 5310764 5310761 +
attgtgaaaggtttaaaaac

SEQ ID NO: 18625 - DNA, 20 bp, Artificial Sequence
  Synthetic oligonucleotide; GAG chr11 5310747 5310766 5310763 +
tgtgaaaggtttaaaaacaa

SEQ ID NO: 18626 - DNA, 20 bp, Artificial Sequence
  Synthetic oligonucleotide; GAG chr11 5310753 5310772 5310769 +
aggtttaaaaacaagagttt

SEQ ID NO: 18627 - DNA, 20 bp, Artificial Sequence
  Synthetic oligonucleotide; AGG chr11 5310754 5310773 5310770 +
ggtttaaaaacaagagtttg

SEQ ID NO: 18628 - DNA, 20 bp, Artificial Sequence
  Synthetic oligonucleotide; AAG chr11 5310772 5310791 5310788 +
tgaggttaaaaattatgtct

SEQ ID NO: 18629 - DNA, 20 bp, Artificial Sequence
  Synthetic oligonucleotide; AAG chr11 5310787 5310806 5310803 +
tgtctaagataaaatattaa

SEQ ID NO: 18630 - DNA, 20 bp, Artificial Sequence
  Synthetic oligonucleotide; CAG chr11 5310806 5310825 5310822 +
aaagatttattccacatgtg

SEQ ID NO: 18631 - DNA, 20 bp, Artificial Sequence
  Synthetic oligonucleotide; AGG chr11 5310807 5310826 5310823 +
aagatttattccacatgtgc

SEQ ID NO: 18632 - DNA, 20 bp, Artificial Sequence
  Synthetic oligonucleotide; TAG chr11 5310851 5310870 5310867 +
acaactatatatatacatac

SEQ ID NO: 18633 - DNA, 20 bp, Artificial Sequence
  Synthetic oligonucleotide; AGG chr11 5310852 5310871 5310868 +
caactatatatatacatact

SEQ ID NO: 18634 - DNA, 20 bp, Artificial Sequence
  Synthetic oligonucleotide; AAG chr11 5310858 5310877 5310874 +
tatatatacatactaggata

SEQ ID NO: 18635 - DNA, 20 bp, Artificial Sequence
  Synthetic oligonucleotide; AAG chr11 5310875 5310894 5310891 +
ataaagtctcttatatctta

SEQ ID NO: 18636 - DNA, 20 bp, Artificial Sequence
  Synthetic oligonucleotide; TAG chr11 5310901 5310920 5310917 +
atttatttgattttaataaa

SEQ ID NO: 18637 - DNA, 20 bp, Artificial Sequence
  Synthetic oligonucleotide; TAG chr11 5310906 5310925 5310922 +
tttgattttaataaatagaa

SEQ ID NO: 18638 - DNA, 20 bp, Artificial Sequence
  Synthetic oligonucleotide; AGG chr11 5310907 5310926 5310923 +
ttgattttaataaatagaat

SEQ ID NO: 18639 - DNA, 20 bp, Artificial Sequence
  Synthetic oligonucleotide; TGG chr11 5310911 5310930 5310927 +
ttttaataaatagaatagga

SEQ ID NO: 18640 - DNA, 20 bp, Artificial Sequence
  Synthetic oligonucleotide; GAG chr11 5310934 5310953 5310950 +
ttgactcaacaatttcactt

SEQ ID NO: 18641 - DNA, 20 bp, Artificial Sequence
  Synthetic oligonucleotide; GAG chr11 5310936 5310955 5310952 +
gactcaacaatttcacttga

SEQ ID NO: 18642 - DNA, 20 bp, Artificial Sequence
  Synthetic oligonucleotide; AAG chr11 5310940 5310959 5310956 +
caacaatttcacttgagaga

SEQ ID NO: 18643 - DNA, 20 bp, Artificial Sequence
  Synthetic oligonucleotide; AAG chr11 5310947 5310966 5310963 +
ttcacttgagagaaagaatc

SEQ ID NO: 18644 - DNA, 20 bp, Artificial Sequence
  Synthetic oligonucleotide; TAG chr11 5310952 5310971 5310968 +
ttgagagaaagaatcaagca

SEQ ID NO: 18645 - DNA, 20 bp, Artificial Sequence
  Synthetic oligonucleotide; CAG chr11 5310963 5310982 5310979 +
aatcaagcatagattatttt

SEQ ID NO: 18646 - DNA, 20 bp, Artificial Sequence
  Synthetic oligonucleotide; TGG chr11 5310973 5310992 5310989 +
agattattttcagttccata

SEQ ID NO: 18647 - DNA, 20 bp, Artificial Sequence
  Synthetic oligonucleotide; TGG chr11 5310997 5311016 5311013 +
cctcctcaaatatctatgat

SEQ ID NO: 18648 - DNA, 20 bp, Artificial Sequence
  Synthetic oligonucleotide; AAG chr11 5311009 5311028 5311025 +
tctatgattggacatctgtg

SEQ ID NO: 18649 - DNA, 20 bp, Artificial Sequence
  Synthetic oligonucleotide; AGG chr11 5311010 5311029 5311026 +
ctatgattggacatctgtga

SEQ ID NO: 18650 - DNA, 20 bp, Artificial Sequence
  Synthetic oligonucleotide; TAG chr11 5311026 5311045 5311042 +
gtgaaggcatgccgcaaatc

SEQ ID NO: 18651 - DNA, 20 bp, Artificial Sequence
  Synthetic oligonucleotide; AGG chr11 5311027 5311046 5311043 +
tgaaggcatgccgcaaatct

SEQ ID NO: 18652 - DNA, 20 bp, Artificial Sequence
  Synthetic oligonucleotide; GGG chr11 5311028 5311047 5311044 +
gaaggcatgccgcaaatcta

SEQ ID NO: 18653 - DNA, 20 bp, Artificial Sequence
  Synthetic oligonucleotide; AAG chr11 5311041 5311060 5311057 +
aaatctagggtaactaacat

SEQ ID NO: 18654 - DNA, 20 bp, Artificial Sequence
  Synthetic oligonucleotide; TGG chr11 5311094 5311113 5311110 +
attcttgttatttactcatc

SEQ ID NO: 18655 - DNA, 20 bp, Artificial Sequence
  Synthetic oligonucleotide; CAG chr11 5311102 5311121 5311118 +
tatttactcatctggtaatt

SEQ ID NO: 18656 - DNA, 20 bp, Artificial Sequence
  Synthetic oligonucleotide; TAG chr11 5311109 5311128 5311125 +
tcatctggtaattcagaatt

SEQ ID NO: 18657 - DNA, 20 bp, Artificial Sequence
  Synthetic oligonucleotide; CAG chr11 5311141 5311160 5311157 +
cttcctatttatgtttgtat

SEQ ID NO: 18658 - DNA, 20 bp, Artificial Sequence
  Synthetic oligonucleotide; TGG chr11 5311150 5311169 5311166 +
tatgtttgtatcagattatc

SEQ ID NO: 18659 - DNA, 20 bp, Artificial Sequence
  Synthetic oligonucleotide; CAG chr11 5311160 5311179 5311176 +
tcagattatctggctctaac

SEQ ID NO: 18660 - DNA, 20 bp, Artificial Sequence
  Synthetic oligonucleotide; TGG chr11 5311196 5311215 5311212 +
ttgatatattatctcacgtt

SEQ ID NO: 18661 - DNA, 20 bp, Artificial Sequence
  Synthetic oligonucleotide; CAG chr11 5311199 5311218 5311215 +
atatattatctcacgtttgg

SEQ ID NO: 18662 - DNA, 20 bp, Artificial Sequence
  Synthetic oligonucleotide; TGG chr11 5311209 5311228 5311225 +
tcacgtttggcagtattttt

SEQ ID NO: 18663 - DNA, 20 bp, Artificial Sequence
  Synthetic oligonucleotide; TGG chr11 5311228 5311247 5311244 +
ttggactgctattttaaaac

SEQ ID NO: 18664 - DNA, 20 bp, Artificial Sequence
  Synthetic oligonucleotide; GGG chr11 5311229 5311248 5311245 +
tggactgctattttaaaact

SEQ ID NO: 18665 - DNA, 20 bp, Artificial Sequence
  Synthetic oligonucleotide; CAG chr11 5311239 5311258 5311255 +
ttttaaaactgggtctactt

SEQ ID NO: 18666 - DNA, 20 bp, Artificial Sequence
  Synthetic oligonucleotide; AAG chr11 5311254 5311273 5311270 +
tacttcagtgaatgacaccc

SEQ ID NO: 18667 - DNA, 20 bp, Artificial Sequence
  Synthetic oligonucleotide; CGG chr11 5311264 5311283 5311280 +
aatgacacccaagaaaaacc

SEQ ID NO: 18668 - DNA, 20 bp, Artificial Sequence
  Synthetic oligonucleotide; TAG chr11 5311285 5311304 5311301 +
ggatctatcctgctttctcc

SEQ ID NO: 18669 - DNA, 20 bp, Artificial Sequence
  Synthetic oligonucleotide; AGG chr11 5311286 5311305 5311302 +
gatctatcctgctttctcct

SEQ ID NO: 18670 - DNA, 20 bp, Artificial Sequence
  Synthetic oligonucleotide; TAG chr11 5311290 5311309 5311306 +
tatcctgctttctcctagga

SEQ ID NO: 18671 - DNA, 20 bp, Artificial Sequence
  Synthetic oligonucleotide; GAG chr11 5311294 5311313 5311310 +
ctgctttctcctaggatagt

SEQ ID NO: 18672 - DNA, 20 bp, Artificial Sequence
  Synthetic oligonucleotide; TGG chr11 5311327 5311346 5311343 +
acttattctctgaccttctt

SEQ ID NO: 18673 - DNA, 20 bp, Artificial Sequence
  Synthetic oligonucleotide; GGG chr11 5311328 5311347 5311344 +
cttattctctgaccttcttt

SEQ ID NO: 18674 - DNA, 20 bp, Artificial Sequence
  Synthetic oligonucleotide; CAG chr11 5311343 5311362 5311359 +
tctttgggtgtcatctgctt

SEQ ID NO: 18675 - DNA, 20 bp, Artificial Sequence
  Synthetic oligonucleotide; CAG chr11 5311425 5311444 5311441 +
ttactatgactcttcatgat

SEQ ID NO: 18676 - DNA, 20 bp, Artificial Sequence
  Synthetic oligonucleotide; AGG chr11 5311426 5311445 5311442 +
tactatgactcttcatgatc

SEQ ID NO: 18677 - DNA, 20 bp, Artificial Sequence
  Synthetic oligonucleotide; AAG chr11 5311433 5311452 5311449 +
actcttcatgatcaggcaaa

SEQ ID NO: 18678 - DNA, 20 bp, Artificial Sequence
  Synthetic oligonucleotide; AAG chr11 5311481 5311500 5311497 +
gaatgatttttttaattatt

SEQ ID NO: 18679 - DNA, 20 bp, Artificial Sequence
  Synthetic oligonucleotide; AAG chr11 5311502 5311521 5311518 +
agctaatattttgtttttaa

SEQ ID NO: 18680 - DNA, 20 bp, Artificial Sequence
  Synthetic oligonucleotide; TAG chr11 5311507 5311526 5311523 +
atattttgtttttaaaagtc

SEQ ID NO: 18681 - DNA, 20 bp, Artificial Sequence
  Synthetic oligonucleotide; CAG chr11 5311515 5311534 5311531 +
tttttaaaagtctagttcta

SEQ ID NO: 18682 - DNA, 20 bp, Artificial Sequence
  Synthetic oligonucleotide; CAG chr11 5311578 5311597 5311594 +
ttattattttgactcattct

SEQ ID NO: 18683 - DNA, 20 bp, Artificial Sequence
  Synthetic oligonucleotide; TAG chr11 5311622 5311641 5311638 +
ataatgattcttcttattta

SEQ ID NO: 18684 - DNA, 20 bp, Artificial Sequence
  Synthetic oligonucleotide; CAG chr11 5311637 5311656 5311653 +
atttatagacaatacataat

SEQ ID NO: 18685 - DNA, 20 bp, Artificial Sequence
  Synthetic oligonucleotide; TGG chr11 5311655 5311674 5311671 +
atcagtgactgcctttcttt

SEQ ID NO: 18686 - DNA, 20 bp, Artificial Sequence
  Synthetic oligonucleotide; AAG chr11 5311673 5311692 5311689 +
tttggcactgcctttcttcc

SEQ ID NO: 18687 - DNA, 20 bp, Artificial Sequence
  Synthetic oligonucleotide; CAG chr11 5311683 5311702 5311699 +
cctttcttccaagaacatgt

SEQ ID NO: 18688 - DNA, 20 bp, Artificial Sequence
  Synthetic oligonucleotide; TGG chr11 5311693 5311712 5311709 +
aagaacatgtcagaaattga

SEQ ID NO: 18689 - DNA, 20 bp, Artificial Sequence
  Synthetic oligonucleotide; TAG chr11 5311765 5311784 5311781 +
cctgtaaaccttattatatt

SEQ ID NO: 18690 - DNA, 20 bp, Artificial Sequence
  Synthetic oligonucleotide; GAG chr11 5311819 5311838 5311835 +
catttccactttcctaaatt

SEQ ID NO: 18691 - DNA, 20 bp, Artificial Sequence
  Synthetic oligonucleotide; AAG chr11 5311902 5311921 5311918 +
ccattttataaataatattg

SEQ ID NO: 18692 - DNA, 20 bp, Artificial Sequence
  Synthetic oligonucleotide; CAG chr11 5311931 5311950 5311947 +
taaaacatcaatgaattatg

SEQ ID NO: 18693 - DNA, 20 bp, Artificial Sequence
  Synthetic oligonucleotide; CAG chr11 5311941 5311960 5311957 +
atgaattatgcagcttcttt

SEQ ID NO: 18694 - DNA, 20 bp, Artificial Sequence
  Synthetic oligonucleotide; TAG chr11 5311944 5311963 5311960 +
aattatgcagcttctttcag

SEQ ID NO: 18695 - DNA, 20 bp, Artificial Sequence
  Synthetic oligonucleotide; GAG chr11 5311961 5311980 5311977 +
cagtagctttccatgactcc

SEQ ID NO: 18696 - DNA, 20 bp, Artificial Sequence
  Synthetic oligonucleotide; TAG chr11 5311964 5311983 5311980 +
tagctttccatgactccgag

SEQ ID NO: 18697 - DNA, 20 bp, Artificial Sequence
  Synthetic oligonucleotide; GAG chr11 5311966 5311985 5311982 +
gctttccatgactccgagta

SEQ ID NO: 18698 - DNA, 20 bp, Artificial Sequence
  Synthetic oligonucleotide; AAG chr11 5311993 5312012 5312009 +
aaactcttatgatgaccaat

SEQ ID NO: 18699 - DNA, 20 bp, Artificial Sequence
  Synthetic oligonucleotide; AGG chr11 5311994 5312013 5312010 +
aactcttatgatgaccaata

SEQ ID NO: 18700 - DNA, 20 bp, Artificial Sequence
  Synthetic oligonucleotide; CAG chr11 5312013 5312032 5312029 +
aaggccattccttccctctt

SEQ ID NO: 18701 - DNA, 20 bp, Artificial Sequence
  Synthetic oligonucleotide; AAG chr11 5312026 5312045 5312042 +
ccctcttcagcctcttctca

SEQ ID NO: 18702 - DNA, 20 bp, Artificial Sequence
  Synthetic oligonucleotide; CAG chr11 5312043 5312062 5312059 +
tcaaagcaaacaccctcttc

SEQ ID NO: 18703 - DNA, 20 bp, Artificial Sequence
  Synthetic oligonucleotide; TAG chr11 5312046 5312065 5312062 +
aagcaaacaccctcttccag

SEQ ID NO: 18704 - DNA, 20 bp, Artificial Sequence
  Synthetic oligonucleotide; TAG chr11 5312074 5312093 5312090 +
ttccctaatataaaccaacc

SEQ ID NO: 18705 - DNA, 20 bp, Artificial Sequence
  Synthetic oligonucleotide; GAG chr11 5312079 5312098 5312095 +
taatataaaccaacctagct

SEQ ID NO: 18706 - DNA, 20 bp, Artificial Sequence
  Synthetic oligonucleotide; AGG chr11 5312080 5312099 5312096 +
aatataaaccaacctagctg

SEQ ID NO: 18707 - DNA, 20 bp, Artificial Sequence
  Synthetic oligonucleotide; CAG chr11 5312101 5312120 5312117 +
ggtctccacacacactcctt

SEQ ID NO: 18708 - DNA, 20 bp, Artificial Sequence
  Synthetic oligonucleotide; TAG chr11 5312107 5312126 5312123 +
cacacacactccttcagtct

SEQ ID NO: 18709 - DNA, 20 bp, Artificial Sequence
  Synthetic oligonucleotide; CAG chr11 5312133 5312152 5312149 +
attcttgtctgtattttcac

SEQ ID NO: 18710 - DNA, 20 bp, Artificial Sequence
  Synthetic oligonucleotide; TAG chr11 5312137 5312156 5312153 +
ttgtctgtattttcaccagt

SEQ ID NO: 18711 - DNA, 20 bp, Artificial Sequence
  Synthetic oligonucleotide; CAG chr11 5312155 5312174 5312171 +
gttagtttctaatccatttt

SEQ ID NO: 18712 - DNA, 20 bp, Artificial Sequence
  Synthetic oligonucleotide; AGG chr11 5312156 5312175 5312172 +
ttagtttctaatccattttc

SEQ ID NO: 18713 - DNA, 20 bp, Artificial Sequence
  Synthetic oligonucleotide; CAG chr11 5312162 5312181 5312178 +
tctaatccattttcaggtct

SEQ ID NO: 18714 - DNA, 20 bp, Artificial Sequence
  Synthetic oligonucleotide; AAG chr11 5312168 5312187 5312184 +
ccattttcaggtctcagctg

SEQ ID NO: 18715 - DNA, 20 bp, Artificial Sequence
  Synthetic oligonucleotide; AGG chr11 5312169 5312188 5312185 +
cattttcaggtctcagctga

SEQ ID NO: 18716 - DNA, 20 bp, Artificial Sequence
  Synthetic oligonucleotide; GGG chr11 5312170 5312189 5312186 +
attttcaggtctcagctgaa

SEQ ID NO: 18717 - DNA, 20 bp, Artificial Sequence
  Synthetic oligonucleotide; CAG chr11 5312182 5312201 5312198 +
cagctgaagggacactttct

SEQ ID NO: 18718 - DNA, 20 bp, Artificial Sequence
  Synthetic oligonucleotide; AGG chr11 5312183 5312202 5312199 +
agctgaagggacactttctc

SEQ ID NO: 18719 - DNA, 20 bp, Artificial Sequence
  Synthetic oligonucleotide; GGG chr11 5312184 5312203 5312200 +
gctgaagggacactttctca

SEQ ID NO: 18720 - DNA, 20 bp, Artificial Sequence
  Synthetic oligonucleotide; AAG chr11 5312204 5312223 5312220 +
gggaatcttacccttatttc

SEQ ID NO: 18721 - DNA, 20 bp, Artificial Sequence
  Synthetic oligonucleotide; AAG chr11 5312217 5312236 5312233 +
ttatttcaagccataacctc

SEQ ID NO: 18722 - DNA, 20 bp, Artificial Sequence
  Synthetic oligonucleotide; GAG chr11 5312228 5312247 5312244 +
cataacctcaagcctttttt

SEQ ID NO: 18723 - DNA, 20 bp, Artificial Sequence
  Synthetic oligonucleotide; CAG chr11 5312247 5312266 5312263 +
tgagacccacactctccatt

SEQ ID NO: 18724 - DNA, 20 bp, Artificial Sequence
  Synthetic oligonucleotide; CAG chr11 5312278 5312297 5312294 +
ttctgctttatgattaatca

SEQ ID NO: 18725 - DNA, 20 bp, Artificial Sequence
  Synthetic oligonucleotide; TGG chr11 5312296 5312315 5312312 +
cacagcacttgttttaaatt

SEQ ID NO: 18726 - DNA, 20 bp, Artificial Sequence
  Synthetic oligonucleotide; GAG chr11 5312315 5312334 5312331 +
ttggatttcttttattcttt

SEQ ID NO: 18727 - DNA, 20 bp, Artificial Sequence
  Synthetic oligonucleotide; AAG chr11 5312332 5312351 5312348 +
tttgagtccccacttatttg

SEQ ID NO: 18728 - DNA, 20 bp, Artificial Sequence
  Synthetic oligonucleotide; AAG chr11 5312340 5312359 5312356 +
cccacttatttgaagacttt

SEQ ID NO: 18729 - DNA, 20 bp, Artificial Sequence
  Synthetic oligonucleotide; AAG chr11 5312343 5312362 5312359 +
acttatttgaagactttaag

SEQ ID NO: 18730 - DNA, 20 bp, Artificial Sequence
  Synthetic oligonucleotide; AAG chr11 5312348 5312367 5312364 +
tttgaagactttaagaagaa

SEQ ID NO: 18731 - DNA, 20 bp, Artificial Sequence
  Synthetic oligonucleotide; TAG chr11 5312384 5312403 5312400 +
tctcttatatcatttttgct

SEQ ID NO: 18732 - DNA, 20 bp, Artificial Sequence
  Synthetic oligonucleotide; AAG chr11 5312388 5312407 5312404 +
ttatatcatttttgcttagc

SEQ ID NO: 18733 - DNA, 20 bp, Artificial Sequence
  Synthetic oligonucleotide; AGG chr11 5312389 5312408 5312405 +
tatatcatttttgcttagca

SEQ ID NO: 18734 - DNA, 20 bp, Artificial Sequence
  Synthetic oligonucleotide; TAG chr11 5312402 5312421 5312418 +
cttagcaaggtgacccataa

SEQ ID NO: 18735 - DNA, 20 bp, Artificial Sequence
  Synthetic oligonucleotide; AAG chr11 5312425 5312444 5312441 +
tgcccttaaaaaattaacca

SEQ ID NO: 18736 - DNA, 20 bp, Artificial Sequence
  Synthetic oligonucleotide; AGG chr11 5312426 5312445 5312442 +
gcccttaaaaaattaaccaa

SEQ ID NO: 18737 - DNA, 20 bp, Artificial Sequence
  Synthetic oligonucleotide; TAG chr11 5312442 5312461 5312458 +
ccaaaggaatgattaaatat

SEQ ID NO: 18738 - DNA, 20 bp, Artificial Sequence
  Synthetic oligonucleotide; TGG chr11 5312445 5312464 5312461 +
aaggaatgattaaatattag

SEQ ID NO: 18739 - DNA, 20 bp, Artificial Sequence
  Synthetic oligonucleotide; TAG chr11 5312462 5312481 5312478 +
tagtggtgtttccacgaaaa

SEQ ID NO: 18740 - DNA, 20 bp, Artificial Sequence
  Synthetic oligonucleotide; AGG chr11 5312463 5312482 5312479 +
agtggtgtttccacgaaaat

SEQ ID NO: 18741 - DNA, 20 bp, Artificial Sequence
  Synthetic oligonucleotide; GAG chr11 5312471 5312490 5312487 +
ttccacgaaaataggcacat

SEQ ID NO: 18742 - DNA, 20 bp, Artificial Sequence
  Synthetic oligonucleotide; AGG chr11 5312472 5312491 5312488 +
tccacgaaaataggcacatg

SEQ ID NO: 18743 - DNA, 20 bp, Artificial Sequence
  Synthetic oligonucleotide; AAG chr11 5312484 5312503 5312500 +
ggcacatgaggaatgattta

SEQ ID NO: 18744 - DNA, 20 bp, Artificial Sequence
  Synthetic oligonucleotide; TAG chr11 5312522 5312541 5312538 +
aacacaaacccttttaaaca

SEQ ID NO: 18745 - DNA, 20 bp, Artificial Sequence
  Synthetic oligonucleotide; AGG chr11 5312523 5312542 5312539 +
acacaaacccttttaaacat

SEQ ID NO: 18746 - DNA, 20 bp, Artificial Sequence
  Synthetic oligonucleotide; TAG chr11 5312542 5312561 5312558 +
taggatatgtacaaataaat

SEQ ID NO: 18747 - DNA, 20 bp, Artificial Sequence
  Synthetic oligonucleotide; AGG chr11 5312543 5312562 5312559 +
aggatatgtacaaataaatt

SEQ ID NO: 18748 - DNA, 20 bp, Artificial Sequence
  Synthetic oligonucleotide; AAG chr11 5312549 5312568 5312565 +
tgtacaaataaattaggcaa

SEQ ID NO: 18749 - DNA, 20 bp, Artificial Sequence
  Synthetic oligonucleotide; AAG chr11 5312555 5312574 5312571 +
aataaattaggcaaaagtat

SEQ ID NO: 18750 - DNA, 20 bp, Artificial Sequence
  Synthetic oligonucleotide; AAG chr11 5312561 5312580 5312577 +
ttaggcaaaagtataagaaa

SEQ ID NO: 18751 - DNA, 20 bp, Artificial Sequence
  Synthetic oligonucleotide; AAG chr11 5312579 5312598 5312595 +
aaaagatataaataaacctg

SEQ ID NO: 18752 - DNA, 20 bp, Artificial Sequence
  Synthetic oligonucleotide; CAG chr11 5312583 5312602 5312599 +
gatataaataaacctgaagt

SEQ ID NO: 18753 - DNA, 20 bp, Artificial Sequence
  Synthetic oligonucleotide; AAG chr11 5312587 5312606 5312603 +
taaataaacctgaagtcagc

SEQ ID NO: 18754 - DNA, 20 bp, Artificial Sequence
  Synthetic oligonucleotide; AGG chr11 5312588 5312607 5312604 +
aaataaacctgaagtcagca

SEQ ID NO: 18755 - DNA, 20 bp, Artificial Sequence
  Synthetic oligonucleotide; GGG chr11 5312589 5312608 5312605 +
aataaacctgaagtcagcaa

SEQ ID NO: 18756 - DNA, 20 bp, Artificial Sequence
  Synthetic oligonucleotide; TAG chr11 5312598 5312617 5312614 +
gaagtcagcaagggctttga

SEQ ID NO: 18757 - DNA, 20 bp, Artificial Sequence
  Synthetic oligonucleotide; TGG chr11 5312603 5312622 5312619 +
cagcaagggctttgatagta

SEQ ID NO: 18758 - DNA, 20 bp, Artificial Sequence
  Synthetic oligonucleotide; CAG chr11 5312617 5312636 5312633 +
atagtatggctccaatactt

SEQ ID NO: 18759 - DNA, 20 bp, Artificial Sequence
  Synthetic oligonucleotide; TAG chr11 5312620 5312639 5312636 +
gtatggctccaatacttcag

SEQ ID NO: 18760 - DNA, 20 bp, Artificial Sequence
  Synthetic oligonucleotide; AAG chr11 5312626 5312645 5312642 +
ctccaatacttcagtagata

SEQ ID NO: 18761 - DNA, 20 bp, Artificial Sequence
  Synthetic oligonucleotide; AAG chr11 5312653 5312672 5312669 +
taataaaataatgtatatgt

SEQ ID NO: 18762 - DNA, 20 bp, Artificial Sequence
  Synthetic oligonucleotide; TAG chr11 5312673 5312692 5312689 +
aagcttttaaattgtgtata

SEQ ID NO: 18763 - DNA, 20 bp, Artificial Sequence
  Synthetic oligonucleotide; AAG chr11 5312677 5312696 5312693 +
ttttaaattgtgtatatagc

SEQ ID NO: 18764 - DNA, 20 bp, Artificial Sequence
  Synthetic oligonucleotide; CAG chr11 5312685 5312704 5312701 +
tgtgtatatagcaagacaaa

SEQ ID NO: 18765 - DNA, 20 bp, Artificial Sequence
  Synthetic oligonucleotide; TGG chr11 5312693 5312712 5312709 +
tagcaagacaaacagaaaac

SEQ ID NO: 18766 - DNA, 20 bp, Artificial Sequence
  Synthetic oligonucleotide; GGG chr11 5312694 5312713 5312710 +
agcaagacaaacagaaaact

SEQ ID NO: 18767 - DNA, 20 bp, Artificial Sequence
  Synthetic oligonucleotide; TAG chr11 5312724 5312743 5312740 +
gtacactaaaaataaaacac

SEQ ID NO: 18768 - DNA, 20 bp, Artificial Sequence
  Synthetic oligonucleotide; GAG chr11 5312726 5312745 5312742 +
acactaaaaataaaacacta

SEQ ID NO: 18769 - DNA, 20 bp, Artificial Sequence
  Synthetic oligonucleotide; AAG chr11 5312764 5312783 5312780 +
cttcttaaaatcaattataa

SEQ ID NO: 18770 - DNA, 20 bp, Artificial Sequence
  Synthetic oligonucleotide; AGG chr11 5312765 5312784 5312781 +
ttcttaaaatcaattataaa

SEQ ID NO: 18771 - DNA, 20 bp, Artificial Sequence
  Synthetic oligonucleotide; TAG chr11 5312776 5312795 5312792 +
aattataaaaggatgaaaat

SEQ ID NO: 18772 - DNA, 20 bp, Artificial Sequence
  Synthetic oligonucleotide; TAG chr11 5312803 5312822 5312819 +
atatatgatcaaataaatcc

SEQ ID NO: 18773 - DNA, 20 bp, Artificial Sequence
  Synthetic oligonucleotide; GAG chr11 5312807 5312826 5312823 +
atgatcaaataaatcctagt

SEQ ID NO: 18774 - DNA, 20 bp, Artificial Sequence
  Synthetic oligonucleotide; AAG chr11 5312816 5312835 5312832 +
taaatcctagtgagatttcc

SEQ ID NO: 18775 - DNA, 20 bp, Artificial Sequence
  Synthetic oligonucleotide; GAG chr11 5312834 5312853 5312850 +
ccaagttgctgcaacaaatt

SEQ ID NO: 18776 - DNA, 20 bp, Artificial Sequence
  Synthetic oligonucleotide; TAG chr11 5312853 5312872 5312869 +
tgagatcacttgtgatttat

SEQ ID NO: 18777 - DNA, 20 bp, Artificial Sequence
  Synthetic oligonucleotide; AAG chr11 5312882 5312901 5312898 +
aaataaattgaatatacaaa

SEQ ID NO: 18778 - DNA, 20 bp, Artificial Sequence
  Synthetic oligonucleotide; AGG chr11 5312883 5312902 5312899 +
aataaattgaatatacaaaa

SEQ ID NO: 18779 - DNA, 20 bp, Artificial Sequence
  Synthetic oligonucleotide; CAG chr11 5312893 5312912 5312909 +
atatacaaaaaggaaaatat

SEQ ID NO: 18780 - DNA, 20 bp, Artificial Sequence
  Synthetic oligonucleotide; TGG chr11 5312912 5312931 5312928 +
tcagattatatttcatctat

SEQ ID NO: 18781 - DNA, 20 bp, Artificial Sequence
  Synthetic oligonucleotide; CAG chr11 5312921 5312940 5312937 +
atttcatctattggacatat

SEQ ID NO: 18782 - DNA, 20 bp, Artificial Sequence
  Synthetic oligonucleotide; CAG chr11 5312937 5312956 5312953 +
atatcagaaatgtttctatc

SEQ ID NO: 18783 - DNA, 20 bp, Artificial Sequence
  Synthetic oligonucleotide; TAG chr11 5312944 5312963 5312960 +
aaatgtttctatccagcatt

SEQ ID NO: 18784 - DNA, 20 bp, Artificial Sequence
  Synthetic oligonucleotide; GAG chr11 5312946 5312965 5312962 +
atgtttctatccagcattta

SEQ ID NO: 18785 - DNA, 20 bp, Artificial Sequence
  Synthetic oligonucleotide; GAG chr11 5312948 5312967 5312964 +
gtttctatccagcatttaga

SEQ ID NO: 18786 - DNA, 20 bp, Artificial Sequence
  Synthetic oligonucleotide; AAG chr11 5312956 5312975 5312972 +
ccagcatttagagagaacac

SEQ ID NO: 18787 - DNA, 20 bp, Artificial Sequence
  Synthetic oligonucleotide; AAG chr11 5312964 5312983 5312980 +
tagagagaacacaagatcaa

SEQ ID NO: 18788 - DNA, 20 bp, Artificial Sequence
  Synthetic oligonucleotide; GAG chr11 5312988 5313007 5313004 +
aatacattaactcatgaaat

SEQ ID NO: 18789 - DNA, 20 bp, Artificial Sequence
  Synthetic oligonucleotide; TAG chr11 5312995 5313014 5313011 +
taactcatgaaatgagcaac

SEQ ID NO: 18790 - DNA, 20 bp, Artificial Sequence
  Synthetic oligonucleotide; AGG chr11 5312996 5313015 5313012 +
aactcatgaaatgagcaact

SEQ ID NO: 18791 - DNA, 20 bp, Artificial Sequence
  Synthetic oligonucleotide; TAG chr11 5313012 5313031 5313028 +
aactaggaaatttatgaatt

SEQ ID NO: 18792 - DNA, 20 bp, Artificial Sequence
  Synthetic oligonucleotide; GAG chr11 5313014 5313033 5313030 +
ctaggaaatttatgaattta

SEQ ID NO: 18793 - DNA, 20 bp, Artificial Sequence
  Synthetic oligonucleotide; GAG chr11 5313016 5313035 5313032 +
aggaaatttatgaatttaga

SEQ ID NO: 18794 - DNA, 20 bp, Artificial Sequence
  Synthetic oligonucleotide; TAG chr11 5313038 5313057 5313054 +
gtctctactgtaaaacttta

SEQ ID NO: 18795 - DNA, 20 bp, Artificial Sequence
  Synthetic oligonucleotide; AAG chr11 5313061 5313080 5313077 +
atgacattgtatcattttga

SEQ ID NO: 18796 - DNA, 20 bp, Artificial Sequence
  Synthetic oligonucleotide; AAG chr11 5313071 5313090 5313087 +
atcattttgaaagaaaactc

SEQ ID NO: 18797 - DNA, 20 bp, Artificial Sequence
  Synthetic oligonucleotide; AAG chr11 5313081 5313100 5313097 +
aagaaaactcaagacaccaa

SEQ ID NO: 18798 - DNA, 20 bp, Artificial Sequence
  Synthetic oligonucleotide; TGG chr11 5313108 5313127 5313124 +
tgcaaaaaaaaattgacaaa

SEQ ID NO: 18799 - DNA, 20 bp, Artificial Sequence
  Synthetic oligonucleotide; GGG chr11 5313109 5313128 5313125 +
gcaaaaaaaaattgacaaat

SEQ ID NO: 18800 - DNA, 20 bp, Artificial Sequence
  Synthetic oligonucleotide; AAG chr11 5313126 5313145 5313142 +
aatgggatctaattaaatta

SEQ ID NO: 18801 - DNA, 20 bp, Artificial Sequence
  Synthetic oligonucleotide; GAG chr11 5313128 5313147 5313144 +
tgggatctaattaaattaaa

SEQ ID NO: 18802 - DNA, 20 bp, Artificial Sequence
  Synthetic oligonucleotide; CAG chr11 5313139 5313158 5313155 +
taaattaaagagcttctgca

SEQ ID NO: 18803 - DNA, 20 bp, Artificial Sequence
  Synthetic oligonucleotide; AAG chr11 5313145 5313164 5313161 +
aaagagcttctgcacagcaa

SEQ ID NO: 18804 - DNA, 20 bp, Artificial Sequence
  Synthetic oligonucleotide; CAG chr11 5313158 5313177 5313174 +
acagcaaaagaaactatcat

SEQ ID NO: 18805 - DNA, 20 bp, Artificial Sequence
  Synthetic oligonucleotide; GAG chr11 5313160 5313179 5313176 +
agcaaaagaaactatcatca

SEQ ID NO: 18806 - DNA, 20 bp, Artificial Sequence
  Synthetic oligonucleotide; CAG chr11 5313167 5313186 5313183 +
gaaactatcatcagagataa

SEQ ID NO: 18807 - DNA, 20 bp, Artificial Sequence
  Synthetic oligonucleotide; CAG chr11 5313178 5313197 5313194 +
cagagataacagacaaccta

SEQ ID NO: 18808 - DNA, 20 bp, Artificial Sequence
  Synthetic oligonucleotide; TAG chr11 5313183 5313202 5313199 +
ataacagacaacctacagaa

SEQ ID NO: 18809 - DNA, 20 bp, Artificial Sequence
  Synthetic oligonucleotide; AAG chr11 5313186 5313205 5313202 +
acagacaacctacagaatag

SEQ ID NO: 18810 - DNA, 20 bp, Artificial Sequence
  Synthetic oligonucleotide; AAG chr11 5313218 5313237 5313234 +
gcaatttctccatctgacaa

SEQ ID NO: 18811 - DNA, 20 bp, Artificial Sequence
  Synthetic oligonucleotide; TGG chr11 5313230 5313249 5313246 +
tctgacaaaagtctaatatc

SEQ ID NO: 18812 - DNA, 20 bp, Artificial Sequence
  Synthetic oligonucleotide; GAG chr11 5313232 5313251 5313248 +
tgacaaaagtctaatatctg

SEQ ID NO: 18813 - DNA, 20 bp, Artificial Sequence
  Synthetic oligonucleotide; GAG chr11 5313240 5313259 5313256 +
gtctaatatctggagtctat

SEQ ID NO: 18814 - DNA, 20 bp, Artificial Sequence
  Synthetic oligonucleotide; AGG chr11 5313241 5313260 5313257 +
tctaatatctggagtctatg

SEQ ID NO: 18815 - DNA, 20 bp, Artificial Sequence
  Synthetic oligonucleotide; AAG chr11 5313261 5313280 5313277 +
aggaactaaaacaaatttac

SEQ ID NO: 18816 - DNA, 20 bp, Artificial Sequence
  Synthetic oligonucleotide; AAG chr11 5313284 5313303 5313300 +
aaaaaaacaaccccattaaa

SEQ ID NO: 18817 - DNA, 20 bp, Artificial Sequence
  Synthetic oligonucleotide; TGG chr11 5313287 5313306 5313303 +
aaaacaaccccattaaaaag

SEQ ID NO: 18818 - DNA, 20 bp, Artificial Sequence
  Synthetic oligonucleotide; GGG chr11 5313288 5313307 5313304 +
aaacaaccccattaaaaagt

SEQ ID NO: 18819 - DNA, 20 bp, Artificial Sequence
  Synthetic oligonucleotide; GGG chr11 5313289 5313308 5313305 +
aacaaccccattaaaaagtg

SEQ ID NO: 18820 - DNA, 20 bp, Artificial Sequence
  Synthetic oligonucleotide; TAG chr11 5313303 5313322 5313319 +
aaagtggggaatgacatgaa

SEQ ID NO: 18821 - DNA, 20 bp, Artificial Sequence
  Synthetic oligonucleotide; AAG chr11 5313317 5313336 5313333 +
catgaatagacacttctcta

SEQ ID NO: 18822 - DNA, 20 bp, Artificial Sequence
  Synthetic oligonucleotide; AAG chr11 5313320 5313339 5313336 +
gaatagacacttctctaaag

SEQ ID NO: 18823 - DNA, 20 bp, Artificial Sequence
  Synthetic oligonucleotide; AAG chr11 5313358 5313377 5313374 +
ataaacatatgaaaaaaaaa

SEQ ID NO: 18824 - DNA, 20 bp, Artificial Sequence
  Synthetic oligonucleotide; TGG chr11 5313372 5313391 5313388 +
aaaaaaaagctcaaccttac

SEQ ID NO: 18825 - DNA, 20 bp, Artificial Sequence
  Synthetic oligonucleotide; TAG chr11 5313379 5313398 5313395 +
agctcaaccttactggtcat

SEQ ID NO: 18826 - DNA, 20 bp, Artificial Sequence
  Synthetic oligonucleotide; TGG chr11 5313405 5313424 5313421 +
aatgcaaatcaaaaccacaa

SEQ ID NO: 18827 - DNA, 20 bp, Artificial Sequence
  Synthetic oligonucleotide; GGG chr11 5313406 5313425 5313422 +
atgcaaatcaaaaccacaat

SEQ ID NO: 18828 - DNA, 20 bp, Artificial Sequence
  Synthetic oligonucleotide; CAG chr11 5313423 5313442 5313439 +
aatgggataccatctcacac

SEQ ID NO: 18829 - DNA, 20 bp, Artificial Sequence
  Synthetic oligonucleotide; CAG chr11 5313427 5313446 5313443 +
ggataccatctcacaccagt

SEQ ID NO: 18830 - DNA, 20 bp, Artificial Sequence
  Synthetic oligonucleotide; TGG chr11 5313432 5313451 5313448 +
ccatctcacaccagtcagaa

SEQ ID NO: 18831 - DNA, 20 bp, Artificial Sequence
  Synthetic oligonucleotide; AAG chr11 5313446 5313465 5313462 +
tcagaatggcaattattaaa

SEQ ID NO: 18832 - DNA, 20 bp, Artificial Sequence
  Synthetic oligonucleotide; AAG chr11 5313451 5313470 5313467 +
atggcaattattaaaaagtc

SEQ ID NO: 18833 - DNA, 20 bp, Artificial Sequence
  Synthetic oligonucleotide; CAG chr11 5313460 5313479 5313476 +
attaaaaagtcaagaaacaa

SEQ ID NO: 18834 - DNA, 20 bp, Artificial Sequence
  Synthetic oligonucleotide; TGG chr11 5313467 5313486 5313483 +
agtcaagaaacaacagttgc

SEQ ID NO: 18835 - DNA, 20 bp, Artificial Sequence
  Synthetic oligonucleotide; AAG chr11 5313471 5313490 5313487 +
aagaaacaacagttgctggc

SEQ ID NO: 18836 - DNA, 20 bp, Artificial Sequence
  Synthetic oligonucleotide; AGG chr11 5313472 5313491 5313488 +
agaaacaacagttgctggca

SEQ ID NO: 18837 - DNA, 20 bp, Artificial Sequence
  Synthetic oligonucleotide; CAG chr11 5313478 5313497 5313494 +
aacagttgctggcaaggttg

SEQ ID NO: 18838 - DNA, 20 bp, Artificial Sequence
  Synthetic oligonucleotide; GAG chr11 5313480 5313499 5313496 +
cagttgctggcaaggttgca

SEQ ID NO: 18839 - DNA, 20 bp, Artificial Sequence
  Synthetic oligonucleotide; GAG chr11 5313482 5313501 5313498 +
gttgctggcaaggttgcaga

SEQ ID NO: 18840 - DNA, 20 bp, Artificial Sequence
  Synthetic oligonucleotide; AAG chr11 5313486 5313505 5313502 +
ctggcaaggttgcagagaga

SEQ ID NO: 18841 - DNA, 20 bp, Artificial Sequence
  Synthetic oligonucleotide; AGG chr11 5313487 5313506 5313503 +
tggcaaggttgcagagagaa

SEQ ID NO: 18842 - DNA, 20 bp, Artificial Sequence
  Synthetic oligonucleotide; TGG chr11 5313492 5313511 5313508 +
aggttgcagagagaaaggaa

SEQ ID NO: 18843 - DNA, 20 bp, Artificial Sequence
  Synthetic oligonucleotide; CGG chr11 5313514 5313533 5313530 +
gaatgcttttacactgttaa

SEQ ID NO: 18844 - DNA, 20 bp, Artificial Sequence
  Synthetic oligonucleotide; GGG chr11 5313515 5313534 5313531 +
aatgcttttacactgttaac

SEQ ID NO: 18845 - DNA, 20 bp, Artificial Sequence
  Synthetic oligonucleotide; GAG chr11 5313517 5313536 5313533 +
tgcttttacactgttaacgg

SEQ ID NO: 18846 - DNA, 20 bp, Artificial Sequence
  Synthetic oligonucleotide; GAG chr11 5313519 5313538 5313535 +
cttttacactgttaacggga

SEQ ID NO: 18847 - DNA, 20 bp, Artificial Sequence
  Synthetic oligonucleotide; TAG chr11 5313527 5313546 5313543 +
ctgttaacgggagagtaaat

SEQ ID NO: 18848 - DNA, 20 bp, Artificial Sequence
  Synthetic oligonucleotide; TGG chr11 5313541 5313560 5313557 +
gtaaattagttcaaacattg

SEQ ID NO: 18849 - DNA, 20 bp, Artificial Sequence
  Synthetic oligonucleotide; AAG chr11 5313544 5313563 5313560 +
aattagttcaaacattgtgg

SEQ ID NO: 18850 - DNA, 20 bp, Artificial Sequence
  Synthetic oligonucleotide; GAG chr11 5313546 5313565 5313562 +
ttagttcaaacattgtggaa

SEQ ID NO: 18851 - DNA, 20 bp, Artificial Sequence
  Synthetic oligonucleotide; GAG chr11 5313548 5313567 5313564 +
agttcaaacattgtggaaga

SEQ ID NO: 18852 - DNA, 20 bp, Artificial Sequence
  Synthetic oligonucleotide; TAG chr11 5313553 5313572 5313569 +
aaacattgtggaagagagtg

SEQ ID NO: 18853 - DNA, 20 bp, Artificial Sequence
  Synthetic oligonucleotide; AAG chr11 5313566 5313585 5313582 +
gagagtgtagcctttcctca

SEQ ID NO: 18854 - DNA, 20 bp, Artificial Sequence
  Synthetic oligonucleotide; TAG chr11 5313572 5313591 5313588 +
gtagcctttcctcaaagatg

SEQ ID NO: 18855 - DNA, 20 bp, Artificial Sequence
  Synthetic oligonucleotide; AAG chr11 5313575 5313594 5313591 +
gcctttcctcaaagatgtag

SEQ ID NO: 18856 - DNA, 20 bp, Artificial Sequence
  Synthetic oligonucleotide; CAG chr11 5313578 5313597 5313594 +
tttcctcaaagatgtagaag

SEQ ID NO: 18857 - DNA, 20 bp, Artificial Sequence
  Synthetic oligonucleotide; CAG chr11 5313596 5313615 5313612 +
agcagaaataccacttgact

SEQ ID NO: 18858 - DNA, 20 bp, Artificial Sequence
  Synthetic oligonucleotide; TGG chr11 5313611 5313630 5313627 +
tgactcagcaatctcattac

SEQ ID NO: 18859 - DNA, 20 bp, Artificial Sequence
  Synthetic oligonucleotide; GGG chr11 5313612 5313631 5313628 +
gactcagcaatctcattact

SEQ ID NO: 18860 - DNA, 20 bp, Artificial Sequence
  Synthetic oligonucleotide; AAG chr11 5313625 5313644 5313641 +
cattactgggtatataccca

SEQ ID NO: 18861 - DNA, 20 bp, Artificial Sequence
  Synthetic oligonucleotide; AGG chr11 5313626 5313645 5313642 +
attactgggtatatacccaa

SEQ ID NO: 18862 - DNA, 20 bp, Artificial Sequence
  Synthetic oligonucleotide; CAG chr11 5313656 5313675 5313672 +
atcaatctattataaaaata

SEQ ID NO: 18863 - DNA, 20 bp, Artificial Sequence
  Synthetic oligonucleotide; AGG chr11 5313657 5313676 5313673 +
tcaatctattataaaaatac

SEQ ID NO: 18864 - DNA, 20 bp, Artificial Sequence
  Synthetic oligonucleotide; CAG chr11 5313677 5313696 5313693 +
aggcatgcttatgttcattg

SEQ ID NO: 18865 - DNA, 20 bp, Artificial Sequence
  Synthetic oligonucleotide; TAG chr11 5313692 5313711 5313708 +
cattgcagcattattcataa

SEQ ID NO: 18866 - DNA, 20 bp, Artificial Sequence
  Synthetic oligonucleotide; AAG chr11 5313697 5313716 5313713 +
cagcattattcataatagcc

SEQ ID NO: 18867 - DNA, 20 bp, Artificial Sequence
  Synthetic oligonucleotide; TGG chr11 5313703 5313722 5313719 +
tattcataatagccaagatg

SEQ ID NO: 18868 - DNA, 20 bp, Artificial Sequence
  Synthetic oligonucleotide; TAG chr11 5313731 5313750 5313747 +
acccaaatgtccatcaatga

SEQ ID NO: 18869 - DNA, 20 bp, Artificial Sequence
  Synthetic oligonucleotide; GAG chr11 5313733 5313752 5313749 +
ccaaatgtccatcaatgata

SEQ ID NO: 18870 - DNA, 20 bp, Artificial Sequence
  Synthetic oligonucleotide; TGG chr11 5313736 5313755 5313752 +
aatgtccatcaatgatagag

SEQ ID NO: 18871 - DNA, 20 bp, Artificial Sequence
  Synthetic oligonucleotide; AAG chr11 5313742 5313761 5313758 +
catcaatgatagagtggata

SEQ ID NO: 18872 - DNA, 20 bp, Artificial Sequence
  Synthetic oligonucleotide; TGG chr11 5313751 5313770 5313767 +
tagagtggataaagaaaacg

SEQ ID NO: 18873 - DNA, 20 bp, Artificial Sequence
  Synthetic oligonucleotide; TGG chr11 5313767 5313786 5313783 +
aacgtggtacatatatacca

SEQ ID NO: 18874 - DNA, 20 bp, Artificial Sequence
  Synthetic oligonucleotide; CAG chr11 5313779 5313798 5313795 +
atataccatggaatactata

SEQ ID NO: 18875 - DNA, 20 bp, Artificial Sequence
  Synthetic oligonucleotide; AAG chr11 5313789 5313808 5313805 +
gaatactatacagccataaa

SEQ ID NO: 18876 - DNA, 20 bp, Artificial Sequence
  Synthetic oligonucleotide; AGG chr11 5313790 5313809 5313806 +
aatactatacagccataaaa

SEQ ID NO: 18877 - DNA, 20 bp, Artificial Sequence
  Synthetic oligonucleotide; AAG chr11 5313795 5313814 5313811 +
tatacagccataaaaaggaa

SEQ ID NO: 18878 - DNA, 20 bp, Artificial Sequence
  Synthetic oligonucleotide; AGG chr11 5313796 5313815 5313812 +
atacagccataaaaaggaaa

SEQ ID NO: 18879 - DNA, 20 bp, Artificial Sequence
  Synthetic oligonucleotide; CAG chr11 5313812 5313831 5313828 +
gaaaaggattgtgttccttg

SEQ ID NO: 18880 - DNA, 20 bp, Artificial Sequence
  Synthetic oligonucleotide; AGG chr11 5313813 5313832 5313829 +
aaaaggattgtgttccttgc

SEQ ID NO: 18881 - DNA, 20 bp, Artificial Sequence
  Synthetic oligonucleotide; GGG chr11 5313814 5313833 5313830 +
aaaggattgtgttccttgca

SEQ ID NO: 18882 - DNA, 20 bp, Artificial Sequence
  Synthetic oligonucleotide; TGG chr11 5313824 5313843 5313840 +
gttccttgcagggacatgaa

SEQ ID NO: 18883 - DNA, 20 bp, Artificial Sequence
  Synthetic oligonucleotide; GAG chr11 5313826 5313845 5313842 +
tccttgcagggacatgaatg

SEQ ID NO: 18884 - DNA, 20 bp, Artificial Sequence
  Synthetic oligonucleotide; TGG chr11 5313830 5313849 5313846 +
tgcagggacatgaatggagc

SEQ ID NO: 18885 - DNA, 20 bp, Artificial Sequence
  Synthetic oligonucleotide; AAG chr11 5313833 5313852 5313849 +
agggacatgaatggagctgg

SEQ ID NO: 18886 - DNA, 20 bp, Artificial Sequence
  Synthetic oligonucleotide; CAG chr11 5313859 5313878 5313875 +
ttatcctcatcaaactaaca

SEQ ID NO: 18887 - DNA, 20 bp, Artificial Sequence
  Synthetic oligonucleotide; AGG chr11 5313860 5313879 5313876 +
tatcctcatcaaactaacac

SEQ ID NO: 18888 - DNA, 20 bp, Artificial Sequence
  Synthetic oligonucleotide; CAG chr11 5313865 5313884 5313881 +
tcatcaaactaacacaggaa

SEQ ID NO: 18889 - DNA, 20 bp, Artificial Sequence
  Synthetic oligonucleotide; CAG chr11 5313893 5313912 5313909 +
caaacacacatgttctcaca

SEQ ID NO: 18890 - DNA, 20 bp, Artificial Sequence
  Synthetic oligonucleotide; TGG chr11 5313899 5313918 5313915 +
cacatgttctcacacagaaa

SEQ ID NO: 18891 - DNA, 20 bp, Artificial Sequence
  Synthetic oligonucleotide; GGG chr11 5313900 5313919 5313916 +
acatgttctcacacagaaat

SEQ ID NO: 18892 - DNA, 20 bp, Artificial Sequence
  Synthetic oligonucleotide; GAG chr11 5313902 5313921 5313918 +
atgttctcacacagaaatgg

SEQ ID NO: 18893 - DNA, 20 bp, Artificial Sequence
  Synthetic oligonucleotide; CAG chr11 5313910 5313929 5313926 +
acacagaaatgggagctgaa

SEQ ID NO: 18894 - DNA, 20 bp, Artificial Sequence
  Synthetic oligonucleotide; GAG chr11 5313914 5313933 5313930 +
agaaatgggagctgaacagt

SEQ ID NO: 18895 - DNA, 20 bp, Artificial Sequence
  Synthetic oligonucleotide; TGG chr11 5313923 5313942 5313939 +
agctgaacagtgagaacaca

SEQ ID NO: 18896 - DNA, 20 bp, Artificial Sequence
  Synthetic oligonucleotide; TGG chr11 5313933 5313952 5313949 +
tgagaacacatggacacttg

SEQ ID NO: 18897 - DNA, 20 bp, Artificial Sequence
  Synthetic oligonucleotide; GGG chr11 5313934 5313953 5313950 +
gagaacacatggacacttgt

SEQ ID NO: 18898 - DNA, 20 bp, Artificial Sequence
  Synthetic oligonucleotide; GGG chr11 5313935 5313954 5313951 +
agaacacatggacacttgtg

SEQ ID NO: 18899 - DNA, 20 bp, Artificial Sequence
  Synthetic oligonucleotide; CAG chr11 5313949 5313968 5313965 +
cttgtggggaacaacacaca

SEQ ID NO: 18900 - DNA, 20 bp, Artificial Sequence
  Synthetic oligonucleotide; AGG chr11 5313950 5313969 5313966 +
ttgtggggaacaacacacac

SEQ ID NO: 18901 - DNA, 20 bp, Artificial Sequence
  Synthetic oligonucleotide; GGG chr11 5313951 5313970 5313967 +
tgtggggaacaacacacaca

SEQ ID NO: 18902 - DNA, 20 bp, Artificial Sequence
  Synthetic oligonucleotide; GGG chr11 5313952 5313971 5313968 +
gtggggaacaacacacacag

SEQ ID NO: 18903 - DNA, 20 bp, Artificial Sequence
  Synthetic oligonucleotide; CGG chr11 5313961 5313980 5313977 +
aacacacacaggggcctgtc

SEQ ID NO: 18904 - DNA, 20 bp, Artificial Sequence
  Synthetic oligonucleotide; TAG chr11 5313964 5313983 5313980 +
acacacaggggcctgtccgg

SEQ ID NO: 18905 - DNA, 20 bp, Artificial Sequence
  Synthetic oligonucleotide; TGG chr11 5313967 5313986 5313983 +
cacaggggcctgtccggtag

SEQ ID NO: 18906 - DNA, 20 bp, Artificial Sequence
  Synthetic oligonucleotide; GGG chr11 5313968 5313987 5313984 +
acaggggcctgtccggtagt

SEQ ID NO: 18907 - DNA, 20 bp, Artificial Sequence
  Synthetic oligonucleotide; TGG chr11 5313971 5313990 5313987 +
ggggcctgtccggtagtggg

SEQ ID NO: 18908 - DNA, 20 bp, Artificial Sequence
  Synthetic oligonucleotide; GGG chr11 5313972 5313991 5313988 +
gggcctgtccggtagtgggt

SEQ ID NO: 18909 - DNA, 20 bp, Artificial Sequence
  Synthetic oligonucleotide; GGG chr11 5313973 5313992 5313989 +
ggcctgtccggtagtgggtg

SEQ ID NO: 18910 - DNA, 20 bp, Artificial Sequence
  Synthetic oligonucleotide; GAG chr11 5313975 5313994 5313991 +
cctgtccggtagtgggtggg

SEQ ID NO: 18911 - DNA, 20 bp, Artificial Sequence
  Synthetic oligonucleotide; AGG chr11 5313976 5313995 5313992 +
ctgtccggtagtgggtgggg

SEQ ID NO: 18912 - DNA, 20 bp, Artificial Sequence
  Synthetic oligonucleotide; GAG chr11 5313978 5313997 5313994 +
gtccggtagtgggtggggag

SEQ ID NO: 18913 - DNA, 20 bp, Artificial Sequence
  Synthetic oligonucleotide; GAG chr11 5313980 5313999 5313996 +
ccggtagtgggtggggagga

SEQ ID NO: 18914 - DNA, 20 bp, Artificial Sequence
  Synthetic oligonucleotide; AGG chr11 5313981 5314000 5313997 +
cggtagtgggtggggaggag

SEQ ID NO: 18915 - DNA, 20 bp, Artificial Sequence
  Synthetic oligonucleotide; GGG chr11 5313982 5314001 5313998 +
ggtagtgggtggggaggaga

SEQ ID NO: 18916 - DNA, 20 bp, Artificial Sequence
  Synthetic oligonucleotide; GAG chr11 5313984 5314003 5314000 +
tagtgggtggggaggagagg

SEQ ID NO: 18917 - DNA, 20 bp, Artificial Sequence
  Synthetic oligonucleotide; GAG chr11 5313986 5314005 5314002 +
gtgggtggggaggagaggga

SEQ ID NO: 18918 - DNA, 20 bp, Artificial Sequence
  Synthetic oligonucleotide; CAG chr11 5313992 5314011 5314008 +
ggggaggagagggagagcac

SEQ ID NO: 18919 - DNA, 20 bp, Artificial Sequence
  Synthetic oligonucleotide; AGG chr11 5313993 5314012 5314009 +
gggaggagagggagagcacc

SEQ ID NO: 18920 - DNA, 20 bp, Artificial Sequence
  Synthetic oligonucleotide; AAG chr11 5313996 5314015 5314012 +
aggagagggagagcaccagg

SEQ ID NO: 18921 - DNA, 20 bp, Artificial Sequence
  Synthetic oligonucleotide; TAG chr11 5314001 5314020 5314017 +
agggagagcaccaggaagaa

SEQ ID NO: 18922 - DNA, 20 bp, Artificial Sequence
  Synthetic oligonucleotide; CAG chr11 5314014 5314033 5314030 +
ggaagaatagctaacgaatg

SEQ ID NO: 18923 - DNA, 20 bp, Artificial Sequence
  Synthetic oligonucleotide; TGG chr11 5314027 5314046 5314043 +
acgaatgcagcaaacctgca

SEQ ID NO: 18924 - DNA, 20 bp, Artificial Sequence
  Synthetic oligonucleotide; TGG chr11 5314077 5314096 5314093 +
cacatcctgcacatgtgccc

SEQ ID NO: 18925 - DNA, 20 bp, Artificial Sequence
  Synthetic oligonucleotide; TGG chr11 5314099 5314118 5314115 +
gaacttaaaatatattatgt

SEQ ID NO: 18926 - DNA, 20 bp, Artificial Sequence
  Synthetic oligonucleotide; AAG chr11 5314107 5314126 5314123 +
aatatattatgttggtacaa

SEQ ID NO: 18927 - DNA, 20 bp, Artificial Sequence
  Synthetic oligonucleotide; AAG chr11 5314150 5314169 5314166 +
tacctttgcacctacctaat

SEQ ID NO: 18928 - DNA, 20 bp, Artificial Sequence
  Synthetic oligonucleotide; AAG chr11 5314156 5314175 5314172 +
tgcacctacctaataagttg

SEQ ID NO: 18929 - DNA, 20 bp, Artificial Sequence
  Synthetic oligonucleotide; AGG chr11 5314157 5314176 5314173 +
gcacctacctaataagttga

SEQ ID NO: 18930 - DNA, 20 bp, Artificial Sequence
  Synthetic oligonucleotide; AAG chr11 5314193 5314212 5314209 +
ttttaaaaaaaaaaaaaaaa

SEQ ID NO: 18931 - DNA, 20 bp, Artificial Sequence
  Synthetic oligonucleotide; AGG chr11 5314194 5314213 5314210 +
tttaaaaaaaaaaaaaaaaa

SEQ ID NO: 18932 - DNA, 20 bp, Artificial Sequence
  Synthetic oligonucleotide; TAG chr11 5314213 5314232 5314229 +
aaggaaaatctaccctgaaa

SEQ ID NO: 18933 - DNA, 20 bp, Artificial Sequence
  Synthetic oligonucleotide; GAG chr11 5314215 5314234 5314231 +
ggaaaatctaccctgaaata

SEQ ID NO: 18934 - DNA, 20 bp, Artificial Sequence
  Synthetic oligonucleotide; TAG chr11 5314218 5314237 5314234 +
aaatctaccctgaaatagag

SEQ ID NO: 18935 - DNA, 20 bp, Artificial Sequence
  Synthetic oligonucleotide; GAG chr11 5314225 5314244 5314241 +
ccctgaaatagagtagtttt

SEQ ID NO: 18936 - DNA, 20 bp, Artificial Sequence
  Synthetic oligonucleotide; TAG chr11 5314232 5314251 5314248 +
atagagtagttttgagatta

SEQ ID NO: 18937 - DNA, 20 bp, Artificial Sequence
  Synthetic oligonucleotide; TAG chr11 5314235 5314254 5314251 +
gagtagttttgagattatag

SEQ ID NO: 18938 - DNA, 20 bp, Artificial Sequence
  Synthetic oligonucleotide; GAG chr11 5314237 5314256 5314253 +
gtagttttgagattatagta

SEQ ID NO: 18939 - DNA, 20 bp, Artificial Sequence
  Synthetic oligonucleotide; TGG chr11 5314280 5314299 5314296 +
tgctataattcatctttata

SEQ ID NO: 18940 - DNA, 20 bp, Artificial Sequence
  Synthetic oligonucleotide; TAG chr11 5314290 5314309 5314306 +
catctttatatggccaaaac

SEQ ID NO: 18941 - DNA, 20 bp, Artificial Sequence
  Synthetic oligonucleotide; TAG chr11 5314320 5314339 5314336 +
attgcacatttttccttctg

SEQ ID NO: 18942 - DNA, 20 bp, Artificial Sequence
  Synthetic oligonucleotide; AGG chr11 5314321 5314340 5314337 +
ttgcacatttttccttctgt

SEQ ID NO: 18943 - DNA, 20 bp, Artificial Sequence
  Synthetic oligonucleotide; TGG chr11 5314327 5314346 5314343 +
atttttccttctgtaggctt

SEQ ID NO: 18944 - DNA, 20 bp, Artificial Sequence
  Synthetic oligonucleotide; TAG chr11 5314336 5314355 5314352 +
tctgtaggctttggttgaac

SEQ ID NO: 18945 - DNA, 20 bp, Artificial Sequence
  Synthetic oligonucleotide; TGG chr11 5314341 5314360 5314357 +
aggctttggttgaactagac

SEQ ID NO: 18946 - DNA, 20 bp, Artificial Sequence
  Synthetic oligonucleotide; TGG chr11 5314364 5314383 5314380 +
ccacttgactcttcctaaaa

SEQ ID NO: 18947 - DNA, 20 bp, Artificial Sequence
  Synthetic oligonucleotide; CAG chr11 5314373 5314392 5314389 +
tcttcctaaaatggtacttt

SEQ ID NO: 18948 - DNA, 20 bp, Artificial Sequence
  Synthetic oligonucleotide; CAG chr11 5314388 5314407 5314404 +
actttcagttcttatgaata

SEQ ID NO: 18949 - DNA, 20 bp, Artificial Sequence
  Synthetic oligonucleotide; AGG chr11 5314389 5314408 5314405 +
ctttcagttcttatgaatac

SEQ ID NO: 18950 - DNA, 20 bp, Artificial Sequence
  Synthetic oligonucleotide; TAG chr11 5314421 5314440 5314437 +
accatattttccctgattat

SEQ ID NO: 18951 - DNA, 20 bp, Artificial Sequence
  Synthetic oligonucleotide; AGG chr11 5314422 5314441 5314438 +
ccatattttccctgattatt

SEQ ID NO: 18952 - DNA, 20 bp, Artificial Sequence
  Synthetic oligonucleotide; GGG chr11 5314423 5314442 5314439 +
catattttccctgattatta

SEQ ID NO: 18953 - DNA, 20 bp, Artificial Sequence
  Synthetic oligonucleotide; TAG chr11 5314458 5314477 5314474 +
tgttttatctccatattcaa

SEQ ID NO: 18954 - DNA, 20 bp, Artificial Sequence
  Synthetic oligonucleotide; TAG chr11 5314474 5314493 5314490 +
tcaatagtattccactttcc

SEQ ID NO: 18955 - DNA, 20 bp, Artificial Sequence
  Synthetic oligonucleotide; TAG chr11 5314487 5314506 5314503 +
actttcctagtatctctcaa

SEQ ID NO: 18956 - DNA, 20 bp, Artificial Sequence
  Synthetic oligonucleotide; TAG chr11 5314491 5314510 5314507 +
tcctagtatctctcaataga

SEQ ID NO: 18957 - DNA, 20 bp, Artificial Sequence
  Synthetic oligonucleotide; AGG chr11 5314492 5314511 5314508 +
cctagtatctctcaatagat

SEQ ID NO: 18958 - DNA, 20 bp, Artificial Sequence
  Synthetic oligonucleotide; TAG chr11 5314502 5314521 5314518 +
ctcaatagataggtaaatta

SEQ ID NO: 18959 - DNA, 20 bp, Artificial Sequence
  Synthetic oligonucleotide; AAG chr11 5314522 5314541 5314538 +
tagatatatctccctcgata

SEQ ID NO: 18960 - DNA, 20 bp, Artificial Sequence
  Synthetic oligonucleotide; TGG chr11 5314588 5314607 5314604 +
tttatcaattgatcaattga

SEQ ID NO: 18961 - DNA, 20 bp, Artificial Sequence
  Synthetic oligonucleotide; TAG chr11 5314618 5314637 5314634 +
cattgtattattgttccatg

SEQ ID NO: 18962 - DNA, 20 bp, Artificial Sequence
  Synthetic oligonucleotide; TAG chr11 5314631 5314650 5314647 +
ttccatgtagcttttcactt

SEQ ID NO: 18963 - DNA, 20 bp, Artificial Sequence
  Synthetic oligonucleotide; TAG chr11 5314638 5314657 5314654 +
tagcttttcactttagataa

SEQ ID NO: 18964 - DNA, 20 bp, Artificial Sequence
  Synthetic oligonucleotide; AAG chr11 5314644 5314663 5314660 +
ttcactttagataatagtta

SEQ ID NO: 18965 - DNA, 20 bp, Artificial Sequence
  Synthetic oligonucleotide; AAG chr11 5314665 5314684 5314681 +
agcctatctaacactgatac

SEQ ID NO: 18966 - DNA, 20 bp, Artificial Sequence
  Synthetic oligonucleotide; GAG chr11 5314667 5314686 5314683 +
cctatctaacactgatacaa

SEQ ID NO: 18967 - DNA, 20 bp, Artificial Sequence
  Synthetic oligonucleotide; TGG chr11 5314674 5314693 5314690 +
aacactgatacaagagatat

SEQ ID NO: 18968 - DNA, 20 bp, Artificial Sequence
  Synthetic oligonucleotide; GGG chr11 5314675 5314694 5314691 +
acactgatacaagagatatt

SEQ ID NO: 18969 - DNA, 20 bp, Artificial Sequence
  Synthetic oligonucleotide; AAG chr11 5314686 5314705 5314702 +
agagatattgggtataaaat

SEQ ID NO: 18970 - DNA, 20 bp, Artificial Sequence
  Synthetic oligonucleotide; AAG chr11 5314708 5314727 5314724 +
gctcctttccaattactcaa

SEQ ID NO: 18971 - DNA, 20 bp, Artificial Sequence
  Synthetic oligonucleotide; AGG chr11 5314709 5314728 5314725 +
ctcctttccaattactcaaa

SEQ ID NO: 18972 - DNA, 20 bp, Artificial Sequence
  Synthetic oligonucleotide; CAG chr11 5314714 5314733 5314730 +
ttccaattactcaaaaggcc

SEQ ID NO: 18973 - DNA, 20 bp, Artificial Sequence
  Synthetic oligonucleotide; AAG chr11 5314725 5314744 5314741 +
caaaaggcccagaaatcatg

SEQ ID NO: 18974 - DNA, 20 bp, Artificial Sequence
  Synthetic oligonucleotide; AAG chr11 5314746 5314765 5314762 +
agatcacaaaattctgaaaa

SEQ ID NO: 18975 - DNA, 20 bp, Artificial Sequence
  Synthetic oligonucleotide; AGG chr11 5314747 5314766 5314763 +
gatcacaaaattctgaaaaa

SEQ ID NO: 18976 - DNA, 20 bp, Artificial Sequence
  Synthetic oligonucleotide; GGG chr11 5314748 5314767 5314764 +
atcacaaaattctgaaaaaa

SEQ ID NO: 18977 - DNA, 20 bp, Artificial Sequence
  Synthetic oligonucleotide; AAG chr11 5314754 5314773 5314770 +
aaattctgaaaaaagggctc

SEQ ID NO: 18978 - DNA, 20 bp, Artificial Sequence
  Synthetic oligonucleotide; CAG chr11 5314769 5314788 5314785 +
ggctcaagccattctgtgcc

SEQ ID NO: 18979 - DNA, 20 bp, Artificial Sequence
  Synthetic oligonucleotide; TAG chr11 5314776 5314795 5314792 +
gccattctgtgcccagaaaa

SEQ ID NO: 18980 - DNA, 20 bp, Artificial Sequence
  Synthetic oligonucleotide; AGG chr11 5314777 5314796 5314793 +
ccattctgtgcccagaaaat

SEQ ID NO: 18981 - DNA, 20 bp, Artificial Sequence
  Synthetic oligonucleotide; TGG chr11 5314795 5314814 5314811 +
ataggcgaacaatgcttctt

SEQ ID NO: 18982 - DNA, 20 bp, Artificial Sequence
  Synthetic oligonucleotide; TGG chr11 5314805 5314824 5314821 +
aatgcttctttggatctgct

SEQ ID NO: 18983 - DNA, 20 bp, Artificial Sequence
  Synthetic oligonucleotide; TAG chr11 5314825 5314844 5314841 +
tggtttgatgctgtatataa

SEQ ID NO: 18984 - DNA, 20 bp, Artificial Sequence
  Synthetic oligonucleotide; AGG chr11 5314826 5314845 5314842 +
ggtttgatgctgtatataat

SEQ ID NO: 18985 - DNA, 20 bp, Artificial Sequence
  Synthetic oligonucleotide; GGG chr11 5314827 5314846 5314843 +
gtttgatgctgtatataata

SEQ ID NO: 18986 - DNA, 20 bp, Artificial Sequence
  Synthetic oligonucleotide; TGG chr11 5314838 5314857 5314854 +
tatataatagggttcatgaa

SEQ ID NO: 18987 - DNA, 20 bp, Artificial Sequence
  Synthetic oligonucleotide; GAG chr11 5314840 5314859 5314856 +
tataatagggttcatgaatg

SEQ ID NO: 18988 - DNA, 20 bp, Artificial Sequence
  Synthetic oligonucleotide; AGG chr11 5314841 5314860 5314857 +
ataatagggttcatgaatgg

SEQ ID NO: 18989 - DNA, 20 bp, Artificial Sequence
  Synthetic oligonucleotide; AAG chr11 5314847 5314866 5314863 +
gggttcatgaatggaggaaa

SEQ ID NO: 18990 - DNA, 20 bp, Artificial Sequence
  Synthetic oligonucleotide; GAG chr11 5314854 5314873 5314870 +
tgaatggaggaaaaagaaat

SEQ ID NO: 18991 - DNA, 20 bp, Artificial Sequence
  Synthetic oligonucleotide; TAG chr11 5314861 5314880 5314877 +
aggaaaaagaaatgagtcat

SEQ ID NO: 18992 - DNA, 20 bp, Artificial Sequence
  Synthetic oligonucleotide; CGG chr11 5314868 5314887 5314884 +
agaaatgagtcattagctca

SEQ ID NO: 18993 - DNA, 20 bp, Artificial Sequence
  Synthetic oligonucleotide; TGG chr11 5314887 5314906 5314903 +
acggtaatgtgcaccacatg

SEQ ID NO: 18994 - DNA, 20 bp, Artificial Sequence
  Synthetic oligonucleotide; AAG chr11 5314916 5314935 5314932 +
tttcccaaacctgtgaatga

SEQ ID NO: 18995 - DNA, 20 bp, Artificial Sequence
  Synthetic oligonucleotide; CGG chr11 5314931 5314950 5314947 +
aatgaaagtctcactgatca

SEQ ID NO: 18996 - DNA, 20 bp, Artificial Sequence
  Synthetic oligonucleotide; AAG chr11 5314948 5314967 5314964 +
tcacggtgatgtgaaatacc

SEQ ID NO: 18997 - DNA, 20 bp, Artificial Sequence
  Synthetic oligonucleotide; CAG chr11 5314954 5314973 5314970 +
tgatgtgaaataccaagaca

SEQ ID NO: 18998 - DNA, 20 bp, Artificial Sequence
  Synthetic oligonucleotide; TGG chr11 5314963 5314982 5314979 +
ataccaagacacagctgata

SEQ ID NO: 18999 - DNA, 20 bp, Artificial Sequence
  Synthetic oligonucleotide; GGG chr11 5314964 5314983 5314980 +
taccaagacacagctgatat

SEQ ID NO: 19000 - DNA, 20 bp, Artificial Sequence
  Synthetic oligonucleotide; GAG chr11 5314966 5314985 5314982 +
ccaagacacagctgatatgg

SEQ ID NO: 19001 - DNA, 20 bp, Artificial Sequence
  Synthetic oligonucleotide; GAG chr11 5314980 5314999 5314996 +
atatgggagacacacatgtt

SEQ ID NO: 19002 - DNA, 20 bp, Artificial Sequence
  Synthetic oligonucleotide; GAG chr11 5314982 5315001 5314998 +
atgggagacacacatgttga

SEQ ID NO: 19003 - DNA, 20 bp, Artificial Sequence
  Synthetic oligonucleotide; TGG chr11 5314988 5315007 5315004 +
gacacacatgttgagagctt

SEQ ID NO: 19004 - DNA, 20 bp, Artificial Sequence
  Synthetic oligonucleotide; TGG chr11 5315003 5315022 5315019 +
agctttggcttgctcttttc

SEQ ID NO: 19005 - DNA, 20 bp, Artificial Sequence
  Synthetic oligonucleotide; GAG chr11 5315005 5315024 5315021 +
ctttggcttgctcttttctg

SEQ ID NO: 19006 - DNA, 20 bp, Artificial Sequence
  Synthetic oligonucleotide; AGG chr11 5315006 5315025 5315022 +
tttggcttgctcttttctgg

SEQ ID NO: 19007 - DNA, 20 bp, Artificial Sequence
  Synthetic oligonucleotide; AAG chr11 5315028 5315047 5315044 +
gcaatacctttaactgtttt

SEQ ID NO: 19008 - DNA, 20 bp, Artificial Sequence
  Synthetic oligonucleotide; AGG chr11 5315029 5315048 5315045 +
caatacctttaactgtttta

SEQ ID NO: 19009 - DNA, 20 bp, Artificial Sequence
  Synthetic oligonucleotide; CAG chr11 5315034 5315053 5315050 +
cctttaactgttttaaggat

SEQ ID NO: 19010 - DNA, 20 bp, Artificial Sequence
  Synthetic oligonucleotide; AGG chr11 5315035 5315054 5315051 +
ctttaactgttttaaggatc

SEQ ID NO: 19011 - DNA, 20 bp, Artificial Sequence
  Synthetic oligonucleotide; AAG chr11 5315042 5315061 5315058 +
tgttttaaggatcaggatat

SEQ ID NO: 19012 - DNA, 20 bp, Artificial Sequence
  Synthetic oligonucleotide; AAG chr11 5315047 5315066 5315063 +
taaggatcaggatataagaa

SEQ ID NO: 19013 - DNA, 20 bp, Artificial Sequence
  Synthetic oligonucleotide; CAG chr11 5315058 5315077 5315074 +
atataagaaaagacaatgat

SEQ ID NO: 19014 - DNA, 20 bp, Artificial Sequence
  Synthetic oligonucleotide; GAG chr11 5315060 5315079 5315076 +
ataagaaaagacaatgatca

SEQ ID NO: 19015 - DNA, 20 bp, Artificial Sequence
  Synthetic oligonucleotide; TAG chr11 5315067 5315086 5315083 +
aagacaatgatcagagcgtc

SEQ ID NO: 19016 - DNA, 20 bp, Artificial Sequence
  Synthetic oligonucleotide; AGG chr11 5315068 5315087 5315084 +
agacaatgatcagagcgtct

SEQ ID NO: 19017 - DNA, 20 bp, Artificial Sequence
  Synthetic oligonucleotide; AAG chr11 5315071 5315090 5315087 +
caatgatcagagcgtctagg

SEQ ID NO: 19018 - DNA, 20 bp, Artificial Sequence
  Synthetic oligonucleotide; AAG chr11 5315081 5315100 5315097 +
agcgtctaggaagaaaatca

SEQ ID NO: 19019 - DNA, 20 bp, Artificial Sequence
  Synthetic oligonucleotide; CAG chr11 5315088 5315107 5315104 +
aggaagaaaatcaaagcaac

SEQ ID NO: 19020 - DNA, 20 bp, Artificial Sequence
  Synthetic oligonucleotide; TAG chr11 5315093 5315112 5315109 +
gaaaatcaaagcaaccagaa

SEQ ID NO: 19021 - DNA, 20 bp, Artificial Sequence
  Synthetic oligonucleotide; TGG chr11 5315097 5315116 5315113 +
atcaaagcaaccagaatagc

SEQ ID NO: 19022 - DNA, 20 bp, Artificial Sequence
  Synthetic oligonucleotide; GGG chr11 5315098 5315117 5315114 +
tcaaagcaaccagaatagct

SEQ ID NO: 19023 - DNA, 20 bp, Artificial Sequence
  Synthetic oligonucleotide; AAG chr11 5315104 5315123 5315120 +
caaccagaatagctgggtat

SEQ ID NO: 19024 - DNA, 20 bp, Artificial Sequence
  Synthetic oligonucleotide; CAG chr11 5315123 5315142 5315139 +
taagtgattgaatgtaatat

SEQ ID NO: 19025 - DNA, 20 bp, Artificial Sequence
  Synthetic oligonucleotide; CAG chr11 5315128 5315147 5315144 +
gattgaatgtaatatcagca

SEQ ID NO: 19026 - DNA, 20 bp, Artificial Sequence
  Synthetic oligonucleotide; AGG chr11 5315129 5315148 5315145 +
attgaatgtaatatcagcac

SEQ ID NO: 19027 - DNA, 20 bp, Artificial Sequence
  Synthetic oligonucleotide; AAG chr11 5315133 5315152 5315149 +
aatgtaatatcagcacaggc

SEQ ID NO: 19028 - DNA, 20 bp, Artificial Sequence
  Synthetic oligonucleotide; CAG chr11 5315139 5315158 5315155 +
atatcagcacaggcaagttt

SEQ ID NO: 19029 - DNA, 20 bp, Artificial Sequence
  Synthetic oligonucleotide; AGG chr11 5315140 5315159 5315156 +
tatcagcacaggcaagtttc

SEQ ID NO: 19030 - DNA, 20 bp, Artificial Sequence
  Synthetic oligonucleotide; TGG chr11 5315152 5315171 5315168 +
caagtttcaggacatcttga

SEQ ID NO: 19031 - DNA, 20 bp, Artificial Sequence
  Synthetic oligonucleotide; GAG chr11 5315154 5315173 5315170 +
agtttcaggacatcttgatg

SEQ ID NO: 19032 - DNA, 20 bp, Artificial Sequence
  Synthetic oligonucleotide; AAG chr11 5315161 5315180 5315177 +
ggacatcttgatggagaaaa

SEQ ID NO: 19033 - DNA, 20 bp, Artificial Sequence
  Synthetic oligonucleotide; AGG chr11 5315162 5315181 5315178 +
gacatcttgatggagaaaaa

SEQ ID NO: 19034 - DNA, 20 bp, Artificial Sequence
  Synthetic oligonucleotide; TGG chr11 5315167 5315186 5315183 +
cttgatggagaaaaaaggtg

SEQ ID NO: 19035 - DNA, 20 bp, Artificial Sequence
  Synthetic oligonucleotide; AAG chr11 5315170 5315189 5315186 +
gatggagaaaaaaggtgtgg

SEQ ID NO: 19036 - DNA, 20 bp, Artificial Sequence
  Synthetic oligonucleotide; GAG chr11 5315172 5315191 5315188 +
tggagaaaaaaggtgtggaa

SEQ ID NO: 19037 - DNA, 20 bp, Artificial Sequence
  Synthetic oligonucleotide; TGG chr11 5315179 5315198 5315195 +
aaaaggtgtggaagagaaca

SEQ ID NO: 19038 - DNA, 20 bp, Artificial Sequence
  Synthetic oligonucleotide; GGG chr11 5315180 5315199 5315196 +
aaaggtgtggaagagaacat

SEQ ID NO: 19039 - DNA, 20 bp, Artificial Sequence
  Synthetic oligonucleotide; TGG chr11 5315193 5315212 5315209 +
agaacatgggaatgacaata

SEQ ID NO: 19040 - DNA, 20 bp, Artificial Sequence
  Synthetic oligonucleotide; GGG chr11 5315194 5315213 5315210 +
gaacatgggaatgacaatat

SEQ ID NO: 19041 - DNA, 20 bp, Artificial Sequence
  Synthetic oligonucleotide; AAG chr11 5315197 5315216 5315213 +
catgggaatgacaatatggg

SEQ ID NO: 19042 - DNA, 20 bp, Artificial Sequence
  Synthetic oligonucleotide; TGG chr11 5315203 5315222 5315219 +
aatgacaatatgggaagcaa

SEQ ID NO: 19043 - DNA, 20 bp, Artificial Sequence
  Synthetic oligonucleotide; GAG chr11 5315205 5315224 5315221 +
tgacaatatgggaagcaatg

SEQ ID NO: 19044 - DNA, 20 bp, Artificial Sequence
  Synthetic oligonucleotide; TGG chr11 5315208 5315227 5315224 +
caatatgggaagcaatggag

SEQ ID NO: 19045 - DNA, 20 bp, Artificial Sequence
  Synthetic oligonucleotide; CAG chr11 5315211 5315230 5315227 +
tatgggaagcaatggagtgg

SEQ ID NO: 19046 - DNA, 20 bp, Artificial Sequence
  Synthetic oligonucleotide; TGG chr11 5315217 5315236 5315233 +
aagcaatggagtggcagaat

SEQ ID NO: 19047 - DNA, 20 bp, Artificial Sequence
  Synthetic oligonucleotide; GAG chr11 5315219 5315238 5315235 +
gcaatggagtggcagaattg

SEQ ID NO: 19048 - DNA, 20 bp, Artificial Sequence
  Synthetic oligonucleotide; AGG chr11 5315220 5315239 5315236 +
caatggagtggcagaattgg

SEQ ID NO: 19049 - DNA, 20 bp, Artificial Sequence
  Synthetic oligonucleotide; GAG chr11 5315226 5315245 5315242 +
agtggcagaattggaggcac

SEQ ID NO: 19050 - DNA, 20 bp, Artificial Sequence
  Synthetic oligonucleotide; AGG chr11 5315227 5315246 5315243 +
gtggcagaattggaggcacg

SEQ ID NO: 19051 - DNA, 20 bp, Artificial Sequence
  Synthetic oligonucleotide; GGG chr11 5315228 5315247 5315244 +
tggcagaattggaggcacga

SEQ ID NO: 19052 - DNA, 20 bp, Artificial Sequence
  Synthetic oligonucleotide; AAG chr11 5315236 5315255 5315252 +
ttggaggcacgagggataaa

SEQ ID NO: 19053 - DNA, 20 bp, Artificial Sequence
  Synthetic oligonucleotide; TAG chr11 5315250 5315269 5315266 +
gataaaaagtccctcataaa

SEQ ID NO: 19054 - DNA, 20 bp, Artificial Sequence
  Synthetic oligonucleotide; CAG chr11 5315256 5315275 5315272 +
aagtccctcataaatagcca

SEQ ID NO: 19055 - DNA, 20 bp, Artificial Sequence
  Synthetic oligonucleotide; AAG chr11 5315273 5315292 5315289 +
ccacagttctatcttcaccc

SEQ ID NO: 19056 - DNA, 20 bp, Artificial Sequence
  Synthetic oligonucleotide; TAG chr11 5315279 5315298 5315295 +
ttctatcttcacccaagatt

SEQ ID NO: 19057 - DNA, 20 bp, Artificial Sequence
  Synthetic oligonucleotide; TAG chr11 5315282 5315301 5315298 +
tatcttcacccaagatttag

SEQ ID NO: 19058 - DNA, 20 bp, Artificial Sequence
  Synthetic oligonucleotide; TAG chr11 5315288 5315307 5315304 +
cacccaagatttagtagaaa

SEQ ID NO: 19059 - DNA, 20 bp, Artificial Sequence
  Synthetic oligonucleotide; GAG chr11 5315299 5315318 5315315 +
tagtagaaatagttatacct

SEQ ID NO: 19060 - DNA, 20 bp, Artificial Sequence
  Synthetic oligonucleotide; AAG chr11 5315302 5315321 5315318 +
tagaaatagttatacctgag

SEQ ID NO: 19061 - DNA, 20 bp, Artificial Sequence
  Synthetic oligonucleotide; TGG chr11 5315309 5315328 5315325 +
agttatacctgagaagcatg

SEQ ID NO: 19062 - DNA, 20 bp, Artificial Sequence
  Synthetic oligonucleotide; CGG chr11 5315324 5315343 5315340 +
gcatgtggatgataatgaaa

SEQ ID NO: 19063 - DNA, 20 bp, Artificial Sequence
  Synthetic oligonucleotide; TAG chr11 5315330 5315349 5315346 +
ggatgataatgaaacggtca

SEQ ID NO: 19064 - DNA, 20 bp, Artificial Sequence
  Synthetic oligonucleotide; AGG chr11 5315331 5315350 5315347 +
gatgataatgaaacggtcat

SEQ ID NO: 19065 - DNA, 20 bp, Artificial Sequence
  Synthetic oligonucleotide; CAG chr11 5315341 5315360 5315357 +
aaacggtcataggccattga

SEQ ID NO: 19066 - DNA, 20 bp, Artificial Sequence
  Synthetic oligonucleotide; AGG chr11 5315342 5315361 5315358 +
aacggtcataggccattgac

SEQ ID NO: 19067 - DNA, 20 bp, Artificial Sequence
  Synthetic oligonucleotide; GAG chr11 5315344 5315363 5315360 +
cggtcataggccattgacag

SEQ ID NO: 19068 - DNA, 20 bp, Artificial Sequence
  Synthetic oligonucleotide; AAG chr11 5315362 5315381 5315378 +
aggagaatacctgattctgc

SEQ ID NO: 19069 - DNA, 20 bp, Artificial Sequence
  Synthetic oligonucleotide; TGG chr11 5315365 5315384 5315381 +
agaatacctgattctgcaag

SEQ ID NO: 19070 - DNA, 20 bp, Artificial Sequence
  Synthetic oligonucleotide; TGG chr11 5315372 5315391 5315388 +
ctgattctgcaagtggataa

SEQ ID NO: 19071 - DNA, 20 bp, Artificial Sequence
  Synthetic oligonucleotide; GGG chr11 5315373 5315392 5315389 +
tgattctgcaagtggataat

SEQ ID NO: 19072 - DNA, 20 bp, Artificial Sequence
  Synthetic oligonucleotide; GAG chr11 5315375 5315394 5315391 +
attctgcaagtggataatgg

SEQ ID NO: 19073 - DNA, 20 bp, Artificial Sequence
  Synthetic oligonucleotide; TGG chr11 5315378 5315397 5315394 +
ctgcaagtggataatgggag

SEQ ID NO: 19074 - DNA, 20 bp, Artificial Sequence
  Synthetic oligonucleotide; AAG chr11 5315396 5315415 5315412 +
agtggataatgtaaacctgc

SEQ ID NO: 19075 - DNA, 20 bp, Artificial Sequence
  Synthetic oligonucleotide; AAG chr11 5315399 5315418 5315415 +
ggataatgtaaacctgcaag

SEQ ID NO: 19076 - DNA, 20 bp, Artificial Sequence
  Synthetic oligonucleotide; CAG chr11 5315402 5315421 5315418 +
taatgtaaacctgcaagaag

SEQ ID NO: 19077 - DNA, 20 bp, Artificial Sequence
  Synthetic oligonucleotide; AGG chr11 5315403 5315422 5315419 +
aatgtaaacctgcaagaagc

SEQ ID NO: 19078 - DNA, 20 bp, Artificial Sequence
  Synthetic oligonucleotide; TGG chr11 5315411 5315430 5315427 +
cctgcaagaagcaggcccca

SEQ ID NO: 19079 - DNA, 20 bp, Artificial Sequence
  Synthetic oligonucleotide; AAG chr11 5315438 5315457 5315454 +
cctctttgtgattcatccac

SEQ ID NO: 19080 - DNA, 20 bp, Artificial Sequence
  Synthetic oligonucleotide; CAG chr11 5315451 5315470 5315467 +
catccacaagacgcccatta

SEQ ID NO: 19081 - DNA, 20 bp, Artificial Sequence
  Synthetic oligonucleotide; TGG chr11 5315454 5315473 5315470 +
ccacaagacgcccattacag

SEQ ID NO: 19082 - DNA, 20 bp, Artificial Sequence
  Synthetic oligonucleotide; GGG chr11 5315455 5315474 5315471 +
cacaagacgcccattacagt

SEQ ID NO: 19083 - DNA, 20 bp, Artificial Sequence
  Synthetic oligonucleotide; TGG chr11 5315463 5315482 5315479 +
gcccattacagtgggcatca

SEQ ID NO: 19084 - DNA, 20 bp, Artificial Sequence
  Synthetic oligonucleotide; GAG chr11 5315479 5315498 5315495 +
atcatggtcaatttcaccat

SEQ ID NO: 19085 - DNA, 20 bp, Artificial Sequence
  Synthetic oligonucleotide; AGG chr11 5315480 5315499 5315496 +
tcatggtcaatttcaccatg

SEQ ID NO: 19086 - DNA, 20 bp, Artificial Sequence
  Synthetic oligonucleotide; CAG chr11 5315491 5315510 5315507 +
ttcaccatgaggtcttgcct

SEQ ID NO: 19087 - DNA, 20 bp, Artificial Sequence
  Synthetic oligonucleotide; TGG chr11 5315496 5315515 5315512 +
catgaggtcttgcctcagtg

SEQ ID NO: 19088 - DNA, 20 bp, Artificial Sequence
  Synthetic oligonucleotide; AAG chr11 5315500 5315519 5315516 +
aggtcttgcctcagtgtggc

SEQ ID NO: 19089 - DNA, 20 bp, Artificial Sequence
  Synthetic oligonucleotide; AGG chr11 5315501 5315520 5315517 +
ggtcttgcctcagtgtggca

SEQ ID NO: 19090 - DNA, 20 bp, Artificial Sequence
  Synthetic oligonucleotide; CAG chr11 5315507 5315526 5315523 +
gcctcagtgtggcaaggaaa

SEQ ID NO: 19091 - DNA, 20 bp, Artificial Sequence
  Synthetic oligonucleotide; TGG chr11 5315514 5315533 5315530 +
tgtggcaaggaaacagtaca

SEQ ID NO: 19092 - DNA, 20 bp, Artificial Sequence
  Synthetic oligonucleotide; GGG chr11 5315515 5315534 5315531 +
gtggcaaggaaacagtacat

SEQ ID NO: 19093 - DNA, 20 bp, Artificial Sequence
  Synthetic oligonucleotide; AAG chr11 5315524 5315543 5315540 +
aaacagtacatgggttcgtg

SEQ ID NO: 19094 - DNA, 20 bp, Artificial Sequence
  Synthetic oligonucleotide; TGG chr11 5315531 5315550 5315547 +
acatgggttcgtgaagactg

SEQ ID NO: 19095 - DNA, 20 bp, Artificial Sequence
  Synthetic oligonucleotide; GAG chr11 5315545 5315564 5315561 +
agactgtggtcatgcttgat

SEQ ID NO: 19096 - DNA, 20 bp, Artificial Sequence
  Synthetic oligonucleotide; AGG chr11 5315546 5315565 5315562 +
gactgtggtcatgcttgatg

SEQ ID NO: 19097 - DNA, 20 bp, Artificial Sequence
  Synthetic oligonucleotide; TAG chr11 5315549 5315568 5315565 +
tgtggtcatgcttgatgagg

SEQ ID NO: 19098 - DNA, 20 bp, Artificial Sequence
  Synthetic oligonucleotide; GAG chr11 5315551 5315570 5315567 +
tggtcatgcttgatgaggta

SEQ ID NO: 19099 - DNA, 20 bp, Artificial Sequence
  Synthetic oligonucleotide; AGG chr11 5315552 5315571 5315568 +
ggtcatgcttgatgaggtag

SEQ ID NO: 19100 - DNA, 20 bp, Artificial Sequence
  Synthetic oligonucleotide; GAG chr11 5315554 5315573 5315570 +
tcatgcttgatgaggtagag

SEQ ID NO: 19101 - DNA, 20 bp, Artificial Sequence
  Synthetic oligonucleotide; AAG chr11 5315569 5315588 5315585 +
tagaggagcttgccattgcc

SEQ ID NO: 19102 - DNA, 20 bp, Artificial Sequence
  Synthetic oligonucleotide; AAG chr11 5315572 5315591 5315588 +
aggagcttgccattgccaag

SEQ ID NO: 19103 - DNA, 20 bp, Artificial Sequence
  Synthetic oligonucleotide; AGG chr11 5315573 5315592 5315589 +
ggagcttgccattgccaaga

SEQ ID NO: 19104 - DNA, 20 bp, Artificial Sequence
  Synthetic oligonucleotide; CAG chr11 5315589 5315608 5315605 +
aagaaggacgcacacataaa

SEQ ID NO: 19105 - DNA, 20 bp, Artificial Sequence
  Synthetic oligonucleotide; AAG chr11 5315594 5315613 5315610 +
ggacgcacacataaacagca

SEQ ID NO: 19106 - DNA, 20 bp, Artificial Sequence
  Synthetic oligonucleotide; AAG chr11 5315597 5315616 5315613 +
cgcacacataaacagcaaag

SEQ ID NO: 19107 - DNA, 20 bp, Artificial Sequence
  Synthetic oligonucleotide; AGG chr11 5315598 5315617 5315614 +
gcacacataaacagcaaaga

SEQ ID NO: 19108 - DNA, 20 bp, Artificial Sequence
  Synthetic oligonucleotide; GGG chr11 5315599 5315618 5315615 +
cacacataaacagcaaagaa

SEQ ID NO: 19109 - DNA, 20 bp, Artificial Sequence
  Synthetic oligonucleotide; GGG chr11 5315600 5315619 5315616 +
acacataaacagcaaagaag

SEQ ID NO: 19110 - DNA, 20 bp, Artificial Sequence
  Synthetic oligonucleotide; TGG chr11 5315604 5315623 5315620 +
ataaacagcaaagaagggga

SEQ ID NO: 19111 - DNA, 20 bp, Artificial Sequence
  Synthetic oligonucleotide; GAG chr11 5315606 5315625 5315622 +
aaacagcaaagaaggggatg

SEQ ID NO: 19112 - DNA, 20 bp, Artificial Sequence
  Synthetic oligonucleotide; GAG chr11 5315612 5315631 5315628 +
caaagaaggggatggagatc

SEQ ID NO: 19113 - DNA, 20 bp, Artificial Sequence
  Synthetic oligonucleotide; AAG chr11 5315619 5315638 5315635 +
ggggatggagatcgagtgat

SEQ ID NO: 19114 - DNA, 20 bp, Artificial Sequence
  Synthetic oligonucleotide; CAG chr11 5315629 5315648 5315645 +
atcgagtgataagttgcctc

SEQ ID NO: 19115 - DNA, 20 bp, Artificial Sequence
  Synthetic oligonucleotide; AAG chr11 5315639 5315658 5315655 +
aagttgcctccagtactgaa

SEQ ID NO: 19116 - DNA, 20 bp, Artificial Sequence
  Synthetic oligonucleotide; CAG chr11 5315643 5315662 5315659 +
tgcctccagtactgaaaagc

SEQ ID NO: 19117 - DNA, 20 bp, Artificial Sequence
  Synthetic oligonucleotide; AGG chr11 5315644 5315663 5315660 +
gcctccagtactgaaaagcc

SEQ ID NO: 19118 - DNA, 20 bp, Artificial Sequence
  Synthetic oligonucleotide; CAG chr11 5315647 5315666 5315663 +
tccagtactgaaaagccagg

SEQ ID NO: 19119 - DNA, 20 bp, Artificial Sequence
  Synthetic oligonucleotide; AAG chr11 5315655 5315674 5315671 +
tgaaaagccaggcagcaaaa

SEQ ID NO: 19120 - DNA, 20 bp, Artificial Sequence
  Synthetic oligonucleotide; AGG chr11 5315656 5315675 5315672 +
gaaaagccaggcagcaaaaa

SEQ ID NO: 19121 - DNA, 20 bp, Artificial Sequence
  Synthetic oligonucleotide; GAG chr11 5315658 5315677 5315674 +
aaagccaggcagcaaaaaag

SEQ ID NO: 19122 - DNA, 20 bp, Artificial Sequence
  Synthetic oligonucleotide; AAG chr11 5315678 5315697 5315694 +
gagccgcattgtgtgttcac

SEQ ID NO: 19123 - DNA, 20 bp, Artificial Sequence
  Synthetic oligonucleotide; TGG chr11 5315681 5315700 5315697 +
ccgcattgtgtgttcacaag

SEQ ID NO: 19124 - DNA, 20 bp, Artificial Sequence
  Synthetic oligonucleotide; AAG chr11 5315685 5315704 5315701 +
attgtgtgttcacaagtggc

SEQ ID NO: 19125 - DNA, 20 bp, Artificial Sequence
  Synthetic oligonucleotide; TAG chr11 5315688 5315707 5315704 +
gtgtgttcacaagtggcaag

SEQ ID NO: 19126 - DNA, 20 bp, Artificial Sequence
  Synthetic oligonucleotide; TAG chr11 5315696 5315715 5315712 +
acaagtggcaagtagcttta

SEQ ID NO: 19127 - DNA, 20 bp, Artificial Sequence
  Synthetic oligonucleotide; CAG chr11 5315728 5315747 5315744 +
cactgaaatccctgccttat

SEQ ID NO: 19128 - DNA, 20 bp, Artificial Sequence
  Synthetic oligonucleotide; CAG chr11 5315764 5315783 5315780 +
cttgtgaaactgtatttctg

SEQ ID NO: 19129 - DNA, 20 bp, Artificial Sequence
  Synthetic oligonucleotide; TAG chr11 5315789 5315808 5315805 +
tcaatcctaatattcatatt

SEQ ID NO: 19130 - DNA, 20 bp, Artificial Sequence
  Synthetic oligonucleotide; TGG chr11 5315803 5315822 5315819 +
catatttagcaataatttat

SEQ ID NO: 19131 - DNA, 20 bp, Artificial Sequence
  Synthetic oligonucleotide; TAG chr11 5315836 5315855 5315852 +
aatgtgcaacaattttctta

SEQ ID NO: 19132 - DNA, 20 bp, Artificial Sequence
  Synthetic oligonucleotide; AAG chr11 5315839 5315858 5315855 +
gtgcaacaattttcttatag

SEQ ID NO: 19133 - DNA, 20 bp, Artificial Sequence
  Synthetic oligonucleotide; GAG chr11 5315841 5315860 5315857 +
gcaacaattttcttatagaa

SEQ ID NO: 19134 - DNA, 20 bp, Artificial Sequence
  Synthetic oligonucleotide; TAG chr11 5315855 5315874 5315871 +
atagaagagcaatacattta

SEQ ID NO: 19135 - DNA, 20 bp, Artificial Sequence
  Synthetic oligonucleotide; TAG chr11 5315865 5315884 5315881 +
aatacatttatagactgtgc

SEQ ID NO: 19136 - DNA, 20 bp, Artificial Sequence
  Synthetic oligonucleotide; GAG chr11 5315867 5315886 5315883 +
tacatttatagactgtgcta

SEQ ID NO: 19137 - DNA, 20 bp, Artificial Sequence
  Synthetic oligonucleotide; AAG chr11 5315872 5315891 5315888 +
ttatagactgtgctagagat

SEQ ID NO: 19138 - DNA, 20 bp, Artificial Sequence
  Synthetic oligonucleotide; AGG chr11 5315873 5315892 5315889 +
tatagactgtgctagagata

SEQ ID NO: 19139 - DNA, 20 bp, Artificial Sequence
  Synthetic oligonucleotide; CAG chr11 5315893 5315912 5315909 +
aggaatgatgatcatttctt

SEQ ID NO: 19140 - DNA, 20 bp, Artificial Sequence
  Synthetic oligonucleotide; AAG chr11 5315908 5315927 5315924 +
ttcttcagttatgaataatt

SEQ ID NO: 19141 - DNA, 20 bp, Artificial Sequence
  Synthetic oligonucleotide; TAG chr11 5315911 5315930 5315927 +
ttcagttatgaataattaag

SEQ ID NO: 19142 - DNA, 20 bp, Artificial Sequence
  Synthetic oligonucleotide; AAG chr11 5315916 5315935 5315932 +
ttatgaataattaagtagtt

SEQ ID NO: 19143 - DNA, 20 bp, Artificial Sequence
  Synthetic oligonucleotide; TGG chr11 5315968 5315987 5315984 +
aaatgcatcatgcccctctg

SEQ ID NO: 19144 - DNA, 20 bp, Artificial Sequence
  Synthetic oligonucleotide; TAG chr11 5315999 5316018 5316015 +
ctgcacaatgtttgaaccaa

SEQ ID NO: 19145 - DNA, 20 bp, Artificial Sequence
  Synthetic oligonucleotide; AAG chr11 5316010 5316029 5316026 +
ttgaaccaatagtaacaaaa

SEQ ID NO: 19146 - DNA, 20 bp, Artificial Sequence
  Synthetic oligonucleotide; AAG chr11 5316013 5316032 5316029 +
aaccaatagtaacaaaaaag

SEQ ID NO: 19147 - DNA, 20 bp, Artificial Sequence
  Synthetic oligonucleotide; AGG chr11 5316014 5316033 5316030 +
accaatagtaacaaaaaaga

SEQ ID NO: 19148 - DNA, 20 bp, Artificial Sequence
  Synthetic oligonucleotide; TAG chr11 5316031 5316050 5316047 +
agaaggcaaatatatgcaat

SEQ ID NO: 19149 - DNA, 20 bp, Artificial Sequence
  Synthetic oligonucleotide; TAG chr11 5316048 5316067 5316064 +
aattagataataattgtaca

SEQ ID NO: 19150 - DNA, 20 bp, Artificial Sequence
  Synthetic oligonucleotide; TAG chr11 5316064 5316083 5316080 +
tacatagttaacctgctgct

SEQ ID NO: 19151 - DNA, 20 bp, Artificial Sequence
  Synthetic oligonucleotide; TGG chr11 5316081 5316100 5316097 +
gcttagcttaattgcatatt

SEQ ID NO: 19152 - DNA, 20 bp, Artificial Sequence
  Synthetic oligonucleotide; TAG chr11 5316129 5316148 5316145 +
tatgtttcacaatcatgata

SEQ ID NO: 19153 - DNA, 20 bp, Artificial Sequence
  Synthetic oligonucleotide; TAG chr11 5316135 5316154 5316151 +
tcacaatcatgatatagaca

SEQ ID NO: 19154 - DNA, 20 bp, Artificial Sequence
  Synthetic oligonucleotide; TAG chr11 5316146 5316165 5316162 +
atatagacatagtgttttgt

SEQ ID NO: 19155 - DNA, 20 bp, Artificial Sequence
  Synthetic oligonucleotide; TAG chr11 5316165 5316184 5316181 +
ttagaaaacttttctttgtt

SEQ ID NO: 19156 - DNA, 20 bp, Artificial Sequence
  Synthetic oligonucleotide; TAG chr11 5316176 5316195 5316192 +
ttctttgtttagttttgaaa

SEQ ID NO: 19157 - DNA, 20 bp, Artificial Sequence
  Synthetic oligonucleotide; TGG chr11 5316194 5316213 5316210 +
aatagaatgttaatgtttta

SEQ ID NO: 19158 - DNA, 20 bp, Artificial Sequence
  Synthetic oligonucleotide; AAG chr11 5316208 5316227 5316224 +
gttttatggaattctaacaa

SEQ ID NO: 19159 - DNA, 20 bp, Artificial Sequence
  Synthetic oligonucleotide; GAG chr11 5316215 5316234 5316231 +
ggaattctaacaaaagccat

SEQ ID NO: 19160 - DNA, 20 bp, Artificial Sequence
  Synthetic oligonucleotide; TGG chr11 5316225 5316244 5316241 +
caaaagccatgagccctctg

SEQ ID NO: 19161 - DNA, 20 bp, Artificial Sequence
  Synthetic oligonucleotide; GAG chr11 5316227 5316246 5316243 +
aaagccatgagccctctgtg

SEQ ID NO: 19162 - DNA, 20 bp, Artificial Sequence
  Synthetic oligonucleotide; TGG chr11 5316235 5316254 5316251 +
gagccctctgtggagaaaaa

SEQ ID NO: 19163 - DNA, 20 bp, Artificial Sequence
  Synthetic oligonucleotide; AAG chr11 5316242 5316261 5316258 +
ctgtggagaaaaatggacaa

SEQ ID NO: 19164 - DNA, 20 bp, Artificial Sequence
  Synthetic oligonucleotide; CAG chr11 5316245 5316264 5316261 +
tggagaaaaatggacaaaag

SEQ ID NO: 19165 - DNA, 20 bp, Artificial Sequence
  Synthetic oligonucleotide; AGG chr11 5316246 5316265 5316262 +
ggagaaaaatggacaaaagc

SEQ ID NO: 19166 - DNA, 20 bp, Artificial Sequence
  Synthetic oligonucleotide; TAG chr11 5316261 5316280 5316277 +
aaagcaggtgacgtcacatt

SEQ ID NO: 19167 - DNA, 20 bp, Artificial Sequence
  Synthetic oligonucleotide; AAG chr11 5316290 5316309 5316306 +
aatattcacacgttttcctg

SEQ ID NO: 19168 - DNA, 20 bp, Artificial Sequence
  Synthetic oligonucleotide; GAG chr11 5316302 5316321 5316318 +
ttttcctgaagctaatccat

SEQ ID NO: 19169 - DNA, 20 bp, Artificial Sequence
  Synthetic oligonucleotide; AAG chr11 5316323 5316342 5316339 +
agcaccacatttgaaacttc

SEQ ID NO: 19170 - DNA, 20 bp, Artificial Sequence
  Synthetic oligonucleotide; GAG chr11 5316346 5316365 5316362 +
cctgccttgaaacatgtgtt

SEQ ID NO: 19171 - DNA, 20 bp, Artificial Sequence
  Synthetic oligonucleotide; AAG chr11 5316355 5316374 5316371 +
aaacatgtgttgagatgaaa

SEQ ID NO: 19172 - DNA, 20 bp, Artificial Sequence
  Synthetic oligonucleotide; TAG chr11 5316367 5316386 5316383 +
agatgaaaaagtctgtgctt

SEQ ID NO: 19173 - DNA, 20 bp, Artificial Sequence
  Synthetic oligonucleotide; AGG chr11 5316368 5316387 5316384 +
gatgaaaaagtctgtgcttt

SEQ ID NO: 19174 - DNA, 20 bp, Artificial Sequence
  Synthetic oligonucleotide; TGG chr11 5316374 5316393 5316390 +
aaagtctgtgctttaggtgt

SEQ ID NO: 19175 - DNA, 20 bp, Artificial Sequence
  Synthetic oligonucleotide; CAG chr11 5316383 5316402 5316399 +
gctttaggtgttggtcatcc

SEQ ID NO: 19176 - DNA, 20 bp, Artificial Sequence
  Synthetic oligonucleotide; TGG chr11 5316387 5316406 5316403 +
taggtgttggtcatcccaga

SEQ ID NO: 19177 - DNA, 20 bp, Artificial Sequence
  Synthetic oligonucleotide; GAG chr11 5316389 5316408 5316405 +
ggtgttggtcatcccagatg

SEQ ID NO: 19178 - DNA, 20 bp, Artificial Sequence
  Synthetic oligonucleotide; CAG chr11 5316406 5316425 5316422 +
atggagtatgttctcctatg

SEQ ID NO: 19179 - DNA, 20 bp, Artificial Sequence
  Synthetic oligonucleotide; AAG chr11 5316452 5316471 5316468 +
ctcttcgctgcatctaacat

SEQ ID NO: 19180 - DNA, 20 bp, Artificial Sequence
  Synthetic oligonucleotide; AAG chr11 5316455 5316474 5316471 +
ttcgctgcatctaacataag

SEQ ID NO: 19181 - DNA, 20 bp, Artificial Sequence
  Synthetic oligonucleotide; AGG chr11 5316456 5316475 5316472 +
tcgctgcatctaacataaga

SEQ ID NO: 19182 - DNA, 20 bp, Artificial Sequence
  Synthetic oligonucleotide; AAG chr11 5316459 5316478 5316475 +
ctgcatctaacataagaagg

SEQ ID NO: 19183 - DNA, 20 bp, Artificial Sequence
  Synthetic oligonucleotide; GAG chr11 5316461 5316480 5316477 +
gcatctaacataagaaggaa

SEQ ID NO: 19184 - DNA, 20 bp, Artificial Sequence
  Synthetic oligonucleotide; AGG chr11 5316462 5316481 5316478 +
catctaacataagaaggaag

SEQ ID NO: 19185 - DNA, 20 bp, Artificial Sequence
  Synthetic oligonucleotide; TGG chr11 5316487 5316506 5316503 +
tcattccttattcctgttcc

SEQ ID NO: 19186 - DNA, 20 bp, Artificial Sequence
  Synthetic oligonucleotide; TGG chr11 5316517 5316536 5316533 +
ctatgctgtcattttcttgc

SEQ ID NO: 19187 - DNA, 20 bp, Artificial Sequence
  Synthetic oligonucleotide; AAG chr11 5316523 5316542 5316539 +
tgtcattttcttgctggaat

SEQ ID NO: 19188 - DNA, 20 bp, Artificial Sequence
  Synthetic oligonucleotide; AGG chr11 5316524 5316543 5316540 +
gtcattttcttgctggaata

SEQ ID NO: 19189 - DNA, 20 bp, Artificial Sequence
  Synthetic oligonucleotide; AAG chr11 5316547 5316566 5316563 +
acccattcctgctctatttg

SEQ ID NO: 19190 - DNA, 20 bp, Artificial Sequence
  Synthetic oligonucleotide; CAG chr11 5316553 5316572 5316569 +
tcctgctctatttgaagact

SEQ ID NO: 19191 - DNA, 20 bp, Artificial Sequence
  Synthetic oligonucleotide; CAG chr11 5316558 5316577 5316574 +
ctctatttgaagactcagtt

SEQ ID NO: 19192 - DNA, 20 bp, Artificial Sequence
  Synthetic oligonucleotide; AAG chr11 5316575 5316594 5316591 +
gttcagacactcacttctca

SEQ ID NO: 19193 - DNA, 20 bp, Artificial Sequence
  Synthetic oligonucleotide; AAG chr11 5316585 5316604 5316601 +
tcacttctcaaagactattc

SEQ ID NO: 19194 - DNA, 20 bp, Artificial Sequence
  Synthetic oligonucleotide; GAG chr11 5316587 5316606 5316603 +
acttctcaaagactattcaa

SEQ ID NO: 19195 - DNA, 20 bp, Artificial Sequence
  Synthetic oligonucleotide; AGG chr11 5316588 5316607 5316604 +
cttctcaaagactattcaag

SEQ ID NO: 19196 - DNA, 20 bp, Artificial Sequence
  Synthetic oligonucleotide; TAG chr11 5316597 5316616 5316613 +
gactattcaagaggccaaat

SEQ ID NO: 19197 - DNA, 20 bp, Artificial Sequence
  Synthetic oligonucleotide; GAG chr11 5316599 5316618 5316615 +
ctattcaagaggccaaatta

SEQ ID NO: 19198 - DNA, 20 bp, Artificial Sequence
  Synthetic oligonucleotide; GAG chr11 5316601 5316620 5316617 +
attcaagaggccaaattaga

SEQ ID NO: 19199 - DNA, 20 bp, Artificial Sequence
  Synthetic oligonucleotide; TGG chr11 5316614 5316633 5316630 +
aattagagagtttatgtatg

SEQ ID NO: 19200 - DNA, 20 bp, Artificial Sequence
  Synthetic oligonucleotide; CAG chr11 5316629 5316648 5316645 +
gtatgtggaaatcacttccc

SEQ ID NO: 19201 - DNA, 20 bp, Artificial Sequence
  Synthetic oligonucleotide; GAG chr11 5316631 5316650 5316647 +
atgtggaaatcacttcccca

SEQ ID NO: 19202 - DNA, 20 bp, Artificial Sequence
  Synthetic oligonucleotide; CAG chr11 5316653 5316672 5316669 +
gtttcctctttccaaatact

SEQ ID NO: 19203 - DNA, 20 bp, Artificial Sequence
  Synthetic oligonucleotide; AAG chr11 5316656 5316675 5316672 +
tcctctttccaaatactcag

SEQ ID NO: 19204 - DNA, 20 bp, Artificial Sequence
  Synthetic oligonucleotide; TGG chr11 5316688 5316707 5316704 +
tctcccctccctcctctgtc

SEQ ID NO: 19205 - DNA, 20 bp, Artificial Sequence
  Synthetic oligonucleotide; GGG chr11 5316689 5316708 5316705 +
ctcccctccctcctctgtct

SEQ ID NO: 19206 - DNA, 20 bp, Artificial Sequence
  Synthetic oligonucleotide; GAG chr11 5316691 5316710 5316707 +
cccctccctcctctgtctgg

SEQ ID NO: 19207 - DNA, 20 bp, Artificial Sequence
  Synthetic oligonucleotide; AAG chr11 5316694 5316713 5316710 +
ctccctcctctgtctgggag

SEQ ID NO: 19208 - DNA, 20 bp, Artificial Sequence
  Synthetic oligonucleotide; CAG chr11 5316697 5316716 5316713 +
cctcctctgtctgggagaag

SEQ ID NO: 19209 - DNA, 20 bp, Artificial Sequence
  Synthetic oligonucleotide; AGG chr11 5316698 5316717 5316714 +
ctcctctgtctgggagaagc

SEQ ID NO: 19210 - DNA, 20 bp, Artificial Sequence
  Synthetic oligonucleotide; GGG chr11 5316699 5316718 5316715 +
tcctctgtctgggagaagca

SEQ ID NO: 19211 - DNA, 20 bp, Artificial Sequence
  Synthetic oligonucleotide; CGG chr11 5316720 5316739 5316736 +
ggacgctcaaccaatgtcct

SEQ ID NO: 19212 - DNA, 20 bp, Artificial Sequence
  Synthetic oligonucleotide; CAG chr11 5316729 5316748 5316745 +
accaatgtcctcggaacttt

SEQ ID NO: 19213 - DNA, 20 bp, Artificial Sequence
  Synthetic oligonucleotide; AGG chr11 5316730 5316749 5316746 +
ccaatgtcctcggaactttc

SEQ ID NO: 19214 - DNA, 20 bp, Artificial Sequence
  Synthetic oligonucleotide; AAG chr11 5316742 5316761 5316758 +
gaactttcaggtatttctcc

SEQ ID NO: 19215 - DNA, 20 bp, Artificial Sequence
  Synthetic oligonucleotide; AGG chr11 5316743 5316762 5316759 +
aactttcaggtatttctcca

SEQ ID NO: 19216 - DNA, 20 bp, Artificial Sequence
  Synthetic oligonucleotide; TGG chr11 5316747 5316766 5316763 +
ttcaggtatttctccaagga

SEQ ID NO: 19217 - DNA, 20 bp, Artificial Sequence
  Synthetic oligonucleotide; GAG chr11 5316752 5316771 5316768 +
gtatttctccaaggatggat

SEQ ID NO: 19218 - DNA, 20 bp, Artificial Sequence
  Synthetic oligonucleotide; AAG chr11 5316757 5316776 5316773 +
tctccaaggatggatgagaa

SEQ ID NO: 19219 - DNA, 20 bp, Artificial Sequence
  Synthetic oligonucleotide; TGG chr11 5316787 5316806 5316803 +
ctccaatgccacctctacat

SEQ ID NO: 19220 - DNA, 20 bp, Artificial Sequence
  Synthetic oligonucleotide; GGG chr11 5316788 5316807 5316804 +
tccaatgccacctctacatt

SEQ ID NO: 19221 - DNA, 20 bp, Artificial Sequence
  Synthetic oligonucleotide; CAG chr11 5316795 5316814 5316811 +
ccacctctacattgggatgc

SEQ ID NO: 19222 - DNA, 20 bp, Artificial Sequence
  Synthetic oligonucleotide; AGG chr11 5316796 5316815 5316812 +
cacctctacattgggatgcc

SEQ ID NO: 19223 - DNA, 20 bp, Artificial Sequence
  Synthetic oligonucleotide; CAG chr11 5316818 5316837 5316834 +
gacttaattatgtgaccctt

SEQ ID NO: 19224 - DNA, 20 bp, Artificial Sequence
  Synthetic oligonucleotide; AGG chr11 5316819 5316838 5316835 +
acttaattatgtgacccttc

SEQ ID NO: 19225 - DNA, 20 bp, Artificial Sequence
  Synthetic oligonucleotide; AAG chr11 5316827 5316846 5316843 +
atgtgacccttcaggaccct

SEQ ID NO: 19226 - DNA, 20 bp, Artificial Sequence
  Synthetic oligonucleotide; CAG chr11 5316833 5316852 5316849 +
cccttcaggaccctaagcat

SEQ ID NO: 19227 - DNA, 20 bp, Artificial Sequence
  Synthetic oligonucleotide; CAG chr11 5316840 5316859 5316856 +
ggaccctaagcatcagtaca

SEQ ID NO: 19228 - DNA, 20 bp, Artificial Sequence
  Synthetic oligonucleotide; AAG chr11 5316888 5316907 5316904 +
gtctgtctcaatacaatgca

SEQ ID NO: 19229 - DNA, 20 bp, Artificial Sequence
  Synthetic oligonucleotide; GAG chr11 5316895 5316914 5316911 +
tcaatacaatgcaaagtatt

SEQ ID NO: 19230 - DNA, 20 bp, Artificial Sequence
  Synthetic oligonucleotide; GAG chr11 5316897 5316916 5316913 +
aatacaatgcaaagtattga

SEQ ID NO: 19231 - DNA, 20 bp, Artificial Sequence
  Synthetic oligonucleotide; TAG chr11 5316904 5316923 5316920 +
tgcaaagtattgagagatac

SEQ ID NO: 19232 - DNA, 20 bp, Artificial Sequence
  Synthetic oligonucleotide; CAG chr11 5316914 5316933 5316930 +
tgagagatactagttgaatg

SEQ ID NO: 19233 - DNA, 20 bp, Artificial Sequence
  Synthetic oligonucleotide; AGG chr11 5316915 5316934 5316931 +
gagagatactagttgaatgc

SEQ ID NO: 19234 - DNA, 20 bp, Artificial Sequence
  Synthetic oligonucleotide; GGG chr11 5316916 5316935 5316932 +
agagatactagttgaatgca

SEQ ID NO: 19235 - DNA, 20 bp, Artificial Sequence
  Synthetic oligonucleotide; TGG chr11 5316937 5316956 5316953 +
ggtcacatgtgtctttgtcc

SEQ ID NO: 19236 - DNA, 20 bp, Artificial Sequence
  Synthetic oligonucleotide; GAG chr11 5316939 5316958 5316955 +
tcacatgtgtctttgtcctg

SEQ ID NO: 19237 - DNA, 20 bp, Artificial Sequence
  Synthetic oligonucleotide; TGG chr11 5316982 5317001 5316998 +
tgttgtcttttctgatactt

SEQ ID NO: 19238 - DNA, 20 bp, Artificial Sequence
  Synthetic oligonucleotide; GGG chr11 5316983 5317002 5316999 +
gttgtcttttctgatacttt

SEQ ID NO: 19239 - DNA, 20 bp, Artificial Sequence
  Synthetic oligonucleotide; CAG chr11 5316991 5317010 5317007 +
ttctgatactttgggaaaat

SEQ ID NO: 19240 - DNA, 20 bp, Artificial Sequence
  Synthetic oligonucleotide; CAG chr11 5317004 5317023 5317020 +
ggaaaatcagttctgatcca

SEQ ID NO: 19241 - DNA, 20 bp, Artificial Sequence
  Synthetic oligonucleotide; AGG chr11 5317005 5317024 5317021 +
gaaaatcagttctgatccac

SEQ ID NO: 19242 - DNA, 20 bp, Artificial Sequence
  Synthetic oligonucleotide; TGG chr11 5317016 5317035 5317032 +
ctgatccacaggaacctcaa

SEQ ID NO: 19243 - DNA, 20 bp, Artificial Sequence
  Synthetic oligonucleotide; TAG chr11 5317028 5317047 5317044 +
aacctcaatggatctattaa

SEQ ID NO: 19244 - DNA, 20 bp, Artificial Sequence
  Synthetic oligonucleotide; AAG chr11 5317033 5317052 5317049 +
caatggatctattaatagcc

SEQ ID NO: 19245 - DNA, 20 bp, Artificial Sequence
  Synthetic oligonucleotide; AAG chr11 5317042 5317061 5317058 +
tattaatagccaagtaaatg

SEQ ID NO: 19246 - DNA, 20 bp, Artificial Sequence
  Synthetic oligonucleotide; AGG chr11 5317043 5317062 5317059 +
attaatagccaagtaaatga

SEQ ID NO: 19247 - DNA, 20 bp, Artificial Sequence
  Synthetic oligonucleotide; GGG chr11 5317044 5317063 5317060 +
ttaatagccaagtaaatgaa

SEQ ID NO: 19248 - DNA, 20 bp, Artificial Sequence
  Synthetic oligonucleotide; CAG chr11 5317107 5317126 5317123 +
aatcactgcccatttcatac

SEQ ID NO: 19249 - DNA, 20 bp, Artificial Sequence
  Synthetic oligonucleotide; AGG chr11 5317108 5317127 5317124 +
atcactgcccatttcatacc

SEQ ID NO: 19250 - DNA, 20 bp, Artificial Sequence
  Synthetic oligonucleotide; CAG chr11 5317113 5317132 5317129 +
tgcccatttcataccaggtt

SEQ ID NO: 19251 - DNA, 20 bp, Artificial Sequence
  Synthetic oligonucleotide; AGG chr11 5317114 5317133 5317130 +
gcccatttcataccaggttc

SEQ ID NO: 19252 - DNA, 20 bp, Artificial Sequence
  Synthetic oligonucleotide; TAG chr11 5317118 5317137 5317134 +
atttcataccaggttcagga

SEQ ID NO: 19253 - DNA, 20 bp, Artificial Sequence
  Synthetic oligonucleotide; TAG chr11 5317170 5317189 5317186 +
taaattttcaacatttactt

SEQ ID NO: 19254 - DNA, 20 bp, Artificial Sequence
  Synthetic oligonucleotide; CAG chr11 5317176 5317195 5317192 +
ttcaacatttactttagata

SEQ ID NO: 19255 - DNA, 20 bp, Artificial Sequence
  Synthetic oligonucleotide; TGG chr11 5317179 5317198 5317195 +
aacatttactttagatacag

SEQ ID NO: 19256 - DNA, 20 bp, Artificial Sequence
  Synthetic oligonucleotide; GGG chr11 5317180 5317199 5317196 +
acatttactttagatacagt

SEQ ID NO: 19257 - DNA, 20 bp, Artificial Sequence
  Synthetic oligonucleotide; CAG chr11 5317191 5317210 5317207 +
agatacagtgggtacttgtg

SEQ ID NO: 19258 - DNA, 20 bp, Artificial Sequence
  Synthetic oligonucleotide; AGG chr11 5317192 5317211 5317208 +
gatacagtgggtacttgtgc

SEQ ID NO: 19259 - DNA, 20 bp, Artificial Sequence
  Synthetic oligonucleotide; TGG chr11 5317204 5317223 5317220 +
acttgtgcaggttttttaca

SEQ ID NO: 19260 - DNA, 20 bp, Artificial Sequence
  Synthetic oligonucleotide; CAG chr11 5317219 5317238 5317235 +
ttacatggatatattgcatg

SEQ ID NO: 19261 - DNA, 20 bp, Artificial Sequence
  Synthetic oligonucleotide; TGG chr11 5317222 5317241 5317238 +
catggatatattgcatgcag

SEQ ID NO: 19262 - DNA, 20 bp, Artificial Sequence
  Synthetic oligonucleotide; GAG chr11 5317226 5317245 5317242 +
gatatattgcatgcagtggt

SEQ ID NO: 19263 - DNA, 20 bp, Artificial Sequence
  Synthetic oligonucleotide; TAG chr11 5317241 5317260 5317257 +
gtggtgagcatactatccaa

SEQ ID NO: 19264 - DNA, 20 bp, Artificial Sequence
  Synthetic oligonucleotide; TAG chr11 5317282 5317301 5317298 +
gcatctctccctgccccttg

SEQ ID NO: 19265 - DNA, 20 bp, Artificial Sequence
  Synthetic oligonucleotide; TAG chr11 5317285 5317304 5317301 +
tctctccctgccccttgtag

SEQ ID NO: 19266 - DNA, 20 bp, Artificial Sequence
  Synthetic oligonucleotide; AAG chr11 5317292 5317311 5317308 +
ctgccccttgtagtagtttc

SEQ ID NO: 19267 - DNA, 20 bp, Artificial Sequence
  Synthetic oligonucleotide; TGG chr11 5317295 5317314 5317311 +
ccccttgtagtagtttcaag

SEQ ID NO: 19268 - DNA, 20 bp, Artificial Sequence
  Synthetic oligonucleotide; TAG chr11 5317337 5317356 5317353 +
atccacgtgtactcaatgtt

SEQ ID NO: 19269 - DNA, 20 bp, Artificial Sequence
  Synthetic oligonucleotide; GAG chr11 5317355 5317374 5317371 +
tttagcttccacttataaat

SEQ ID NO: 19270 - DNA, 20 bp, Artificial Sequence
  Synthetic oligonucleotide; TGG chr11 5317364 5317383 5317380 +
cacttataaatgagaatata

SEQ ID NO: 19271 - DNA, 20 bp, Artificial Sequence
  Synthetic oligonucleotide; TAG chr11 5317399 5317418 5317415 +
tgttcttgcgttaatttgct

SEQ ID NO: 19272 - DNA, 20 bp, Artificial Sequence
  Synthetic oligonucleotide; AGG chr11 5317400 5317419 5317416 +
gttcttgcgttaatttgctt

SEQ ID NO: 19273 - DNA, 20 bp, Artificial Sequence
  Synthetic oligonucleotide; TAG chr11 5317407 5317426 5317423 +
cgttaatttgcttaggatta

SEQ ID NO: 19274 - DNA, 20 bp, Artificial Sequence
  Synthetic oligonucleotide; CAG chr11 5317414 5317433 5317430 +
ttgcttaggattatagcctc

SEQ ID NO: 19275 - DNA, 20 bp, Artificial Sequence
  Synthetic oligonucleotide; AAG chr11 5317436 5317455 5317452 +
gctccacccatgttgctgaa

SEQ ID NO: 19276 - DNA, 20 bp, Artificial Sequence
  Synthetic oligonucleotide; AGG chr11 5317437 5317456 5317453 +
ctccacccatgttgctgaaa

SEQ ID NO: 19277 - DNA, 20 bp, Artificial Sequence
  Synthetic oligonucleotide; TAG chr11 5317469 5317488 5317485 +
catttgttcttattgccaca

SEQ ID NO: 19278 - DNA, 20 bp, Artificial Sequence
  Synthetic oligonucleotide; TGG chr11 5317472 5317491 5317488 +
ttgttcttattgccacatag

SEQ ID NO: 19279 - DNA, 20 bp, Artificial Sequence
  Synthetic oligonucleotide; TGG chr11 5317475 5317494 5317491 +
ttcttattgccacatagtgg

SEQ ID NO: 19280 - DNA, 20 bp, Artificial Sequence
  Synthetic oligonucleotide; CAG chr11 5317491 5317510 5317507 +
gtggtggtgtatatgtacca

SEQ ID NO: 19281 - DNA, 20 bp, Artificial Sequence
  Synthetic oligonucleotide; TAG chr11 5317518 5317537 5317534 +
tttatcccgtccgcctttga

SEQ ID NO: 19282 - DNA, 20 bp, Artificial Sequence
  Synthetic oligonucleotide; TAG chr11 5317526 5317545 5317542 +
gtccgcctttgatagacacc

SEQ ID NO: 19283 - DNA, 20 bp, Artificial Sequence
  Synthetic oligonucleotide; AGG chr11 5317527 5317546 5317543 +
tccgcctttgatagacacct

SEQ ID NO: 19284 - DNA, 20 bp, Artificial Sequence
  Synthetic oligonucleotide; CAG chr11 5317531 5317550 5317547 +
cctttgatagacacctaggc

SEQ ID NO: 19285 - DNA, 20 bp, Artificial Sequence
  Synthetic oligonucleotide; CAG chr11 5317557 5317576 5317573 +
tttgtatttgctattctaaa

SEQ ID NO: 19286 - DNA, 20 bp, Artificial Sequence
  Synthetic oligonucleotide; CAG chr11 5317565 5317584 5317581 +
tgctattctaaacagcatta

SEQ ID NO: 19287 - DNA, 20 bp, Artificial Sequence
  Synthetic oligonucleotide; AAG chr11 5317577 5317596 5317593 +
cagcattacagtgaacatgc

SEQ ID NO: 19288 - DNA, 20 bp, Artificial Sequence
  Synthetic oligonucleotide; TAG chr11 5317590 5317609 5317606 +
aacatgcaagtgcatgtgtc

SEQ ID NO: 19289 - DNA, 20 bp, Artificial Sequence
  Synthetic oligonucleotide; TGG chr11 5317594 5317613 5317610 +
tgcaagtgcatgtgtctagt

SEQ ID NO: 19290 - DNA, 20 bp, Artificial Sequence
  Synthetic oligonucleotide; TGG chr11 5317617 5317636 5317633 +
tctaatgctctgttttccta

SEQ ID NO: 19291 - DNA, 20 bp, Artificial Sequence
  Synthetic oligonucleotide; CAG chr11 5317629 5317648 5317645 +
ttttcctatggatatatacc

SEQ ID NO: 19292 - DNA, 20 bp, Artificial Sequence
  Synthetic oligonucleotide; TAG chr11 5317632 5317651 5317648 +
tcctatggatatatacccag

SEQ ID NO: 19293 - DNA, 20 bp, Artificial Sequence
  Synthetic oligonucleotide; CGG chr11 5317635 5317654 5317651 +
tatggatatatacccagtag

SEQ ID NO: 19294 - DNA, 20 bp, Artificial Sequence
  Synthetic oligonucleotide; GGG chr11 5317636 5317655 5317652 +
atggatatatacccagtagc

SEQ ID NO: 19295 - DNA, 20 bp, Artificial Sequence
  Synthetic oligonucleotide; TAG chr11 5317656 5317675 5317672 +
gggattgctgtgtcaaattg

SEQ ID NO: 19296 - DNA, 20 bp, Artificial Sequence
  Synthetic oligonucleotide; AAG chr11 5317668 5317687 5317684 +
tcaaattgtagctctgctta

SEQ ID NO: 19297 - DNA, 20 bp, Artificial Sequence
  Synthetic oligonucleotide; AAG chr11 5317678 5317697 5317694 +
gctctgcttaaagttctttg

SEQ ID NO: 19298 - DNA, 20 bp, Artificial Sequence
  Synthetic oligonucleotide; CAG chr11 5317701 5317720 5317717 +
actctccaaactgttttctg

SEQ ID NO: 19299 - DNA, 20 bp, Artificial Sequence
  Synthetic oligonucleotide; TGG chr11 5317704 5317723 5317720 +
ctccaaactgttttctgcag

SEQ ID NO: 19300 - DNA, 20 bp, Artificial Sequence
  Synthetic oligonucleotide; AAG chr11 5317740 5317759 5317756 +
catccccatcatcattgtat

SEQ ID NO: 19301 - DNA, 20 bp, Artificial Sequence
  Synthetic oligonucleotide; TAG chr11 5317759 5317778 5317775 +
taagtgttcccttttctcca

SEQ ID NO: 19302 - DNA, 20 bp, Artificial Sequence
  Synthetic oligonucleotide; GAG chr11 5317768 5317787 5317784 +
ccttttctccatagcctcat

SEQ ID NO: 19303 - DNA, 20 bp, Artificial Sequence
  Synthetic oligonucleotide; TGG chr11 5317782 5317801 5317798 +
cctcatgagaatctgttttt

SEQ ID NO: 19304 - DNA, 20 bp, Artificial Sequence
  Synthetic oligonucleotide; TAG chr11 5317796 5317815 5317812 +
gttttttggctttttaaaaa

SEQ ID NO: 19305 - DNA, 20 bp, Artificial Sequence
  Synthetic oligonucleotide; TGG chr11 5317809 5317828 5317825 +
ttaaaaatagctattctgac

SEQ ID NO: 19306 - DNA, 20 bp, Artificial Sequence
  Synthetic oligonucleotide; GAG chr11 5317815 5317834 5317831 +
atagctattctgactggtat

SEQ ID NO: 19307 - DNA, 20 bp, Artificial Sequence
  Synthetic oligonucleotide; TAG chr11 5317819 5317838 5317835 +
ctattctgactggtatgaga

SEQ ID NO: 19308 - DNA, 20 bp, Artificial Sequence
  Synthetic oligonucleotide; TGG chr11 5317831 5317850 5317847 +
gtatgagatagtatctcttg

SEQ ID NO: 19309 - DNA, 20 bp, Artificial Sequence
  Synthetic oligonucleotide; TAG chr11 5317856 5317875 5317872 +
ttgatttgcatttctctcat

SEQ ID NO: 19310 - DNA, 20 bp, Artificial Sequence
  Synthetic oligonucleotide; TGG chr11 5317888 5317907 5317904 +
tcatttttgtatatatttgt

SEQ ID NO: 19311 - DNA, 20 bp, Artificial Sequence
  Synthetic oligonucleotide; GAG chr11 5317911 5317930 5317927 +
ctgcctgtatgtcttctctt

SEQ ID NO: 19312 - DNA, 20 bp, Artificial Sequence
  Synthetic oligonucleotide; AAG chr11 5317914 5317933 5317930 +
cctgtatgtcttctcttgag

SEQ ID NO: 19313 - DNA, 20 bp, Artificial Sequence
  Synthetic oligonucleotide; GAG chr11 5317916 5317935 5317932 +
tgtatgtcttctcttgagaa

SEQ ID NO: 19314 - DNA, 20 bp, Artificial Sequence
  Synthetic oligonucleotide; TGG chr11 5317927 5317946 5317943 +
tcttgagaagagtctgttcg

SEQ ID NO: 19315 - DNA, 20 bp, Artificial Sequence
  Synthetic oligonucleotide; TGG chr11 5317948 5317967 5317964 +
ggattttgcccatttttaaa

SEQ ID NO: 19316 - DNA, 20 bp, Artificial Sequence
  Synthetic oligonucleotide; TAG chr11 5317992 5318011 5318008 +
tgatatgttcgaattcctta

SEQ ID NO: 19317 - DNA, 20 bp, Artificial Sequence
  Synthetic oligonucleotide; TAG chr11 5318006 5318025 5318022 +
tccttatagattctgaatat

SEQ ID NO: 19318 - DNA, 20 bp, Artificial Sequence
  Synthetic oligonucleotide; CAG chr11 5318017 5318036 5318033 +
tctgaatattagaccttttc

SEQ ID NO: 19319 - DNA, 20 bp, Artificial Sequence
  Synthetic oligonucleotide; CAG chr11 5318025 5318044 5318041 +
ttagaccttttccagatgca

SEQ ID NO: 19320 - DNA, 20 bp, Artificial Sequence
  Synthetic oligonucleotide; TAG chr11 5318036 5318055 5318052 +
ccagatgcacagtttgtgaa

SEQ ID NO: 19321 - DNA, 20 bp, Artificial Sequence
  Synthetic oligonucleotide; TAG chr11 5318053 5318072 5318069 +
gaatagtttctcctatcctg

SEQ ID NO: 19322 - DNA, 20 bp, Artificial Sequence
  Synthetic oligonucleotide; CAG chr11 5318061 5318080 5318077 +
tctcctatcctgtagattgt

SEQ ID NO: 19323 - DNA, 20 bp, Artificial Sequence
  Synthetic oligonucleotide; TAG chr11 5318077 5318096 5318093 +
ttgtcagtttactctgttga

SEQ ID NO: 19324 - DNA, 20 bp, Artificial Sequence
  Synthetic oligonucleotide; CAG chr11 5318094 5318113 5318110 +
tgatagtttcttctgctgca

SEQ ID NO: 19325 - DNA, 20 bp, Artificial Sequence
  Synthetic oligonucleotide; AAG chr11 5318097 5318116 5318113 +
tagtttcttctgctgcacag

SEQ ID NO: 19326 - DNA, 20 bp, Artificial Sequence
  Synthetic oligonucleotide; AAG chr11 5318127 5318146 5318143 +
tattattattattatacttt

SEQ ID NO: 19327 - DNA, 20 bp, Artificial Sequence
  Synthetic oligonucleotide; TAG chr11 5318133 5318152 5318149 +
tattattatactttaagttc

SEQ ID NO: 19328 - DNA, 20 bp, Artificial Sequence
  Synthetic oligonucleotide; AGG chr11 5318134 5318153 5318150 +
attattatactttaagttct

SEQ ID NO: 19329 - DNA, 20 bp, Artificial Sequence
  Synthetic oligonucleotide; GGG chr11 5318135 5318154 5318151 +
ttattatactttaagttcta

SEQ ID NO: 19330 - DNA, 20 bp, Artificial Sequence
  Synthetic oligonucleotide; CAG chr11 5318155 5318174 5318171 +
gggtacatgtgcgcaacgtg

SEQ ID NO: 19331 - DNA, 20 bp, Artificial Sequence
  Synthetic oligonucleotide; AGG chr11 5318156 5318175 5318172 +
ggtacatgtgcgcaacgtgc

SEQ ID NO: 19332 - DNA, 20 bp, Artificial Sequence
  Synthetic oligonucleotide; TGG chr11 5318188 5318207 5318204 +
tatgtatacatgtgccatgt

SEQ ID NO: 19333 - DNA, 20 bp, Artificial Sequence
  Synthetic oligonucleotide; TAG chr11 5318222 5318241 5318238 +
cattaactcatcatttacat

SEQ ID NO: 19334 - DNA, 20 bp, Artificial Sequence
  Synthetic oligonucleotide; AGG chr11 5318223 5318242 5318239 +
attaactcatcatttacatt

SEQ ID NO: 19335 - DNA, 20 bp, Artificial Sequence
  Synthetic oligonucleotide; CAG chr11 5318274 5318293 5318290 +
cccccacccccaccccacaa

SEQ ID NO: 19336 - DNA, 20 bp, Artificial Sequence
  Synthetic oligonucleotide; AGG chr11 5318275 5318294 5318291 +
ccccacccccaccccacaac

SEQ ID NO: 19337 - DNA, 20 bp, Artificial Sequence
  Synthetic oligonucleotide; TGG chr11 5318281 5318300 5318297 +
ccccaccccacaacaggccc

SEQ ID NO: 19338 - DNA, 20 bp, Artificial Sequence
  Synthetic oligonucleotide; AAG chr11 5318310 5318329 5318326 +
atgttccccttcctctgtcc

SEQ ID NO: 19339 - DNA, 20 bp, Artificial Sequence
  Synthetic oligonucleotide; AAG chr11 5318340 5318359 5318356 +
attgttcaattcccacctat

SEQ ID NO: 19340 - DNA, 20 bp, Artificial Sequence
  Synthetic oligonucleotide; GAG chr11 5318344 5318363 5318360 +
ttcaattcccacctataagt

SEQ ID NO: 19341 - DNA, 20 bp, Artificial Sequence
  Synthetic oligonucleotide; TGG chr11 5318353 5318372 5318369 +
cacctataagtgagaacatg

SEQ ID NO: 19342 - DNA, 20 bp, Artificial Sequence
  Synthetic oligonucleotide; TGG chr11 5318360 5318379 5318376 +
aagtgagaacatgtggtatt

SEQ ID NO: 19343 - DNA, 20 bp, Artificial Sequence
  Synthetic oligonucleotide; TAG chr11 5318379 5318398 5318395 +
ttggttttttgtccttgtga

SEQ ID NO: 19344 - DNA, 20 bp, Artificial Sequence
  Synthetic oligonucleotide; GAG chr11 5318388 5318407 5318404 +
tgtccttgtgatagtttgct

SEQ ID NO: 19345 - DNA, 20 bp, Artificial Sequence
  Synthetic oligonucleotide; TGG chr11 5318396 5318415 5318412 +
tgatagtttgctgagaatga

SEQ ID NO: 19346 - DNA, 20 bp, Artificial Sequence
  Synthetic oligonucleotide; CAG chr11 5318403 5318422 5318419 +
ttgctgagaatgatggtttc

SEQ ID NO: 19347 - DNA, 20 bp, Artificial Sequence
  Synthetic oligonucleotide; AAG chr11 5318425 5318444 5318441 +
gcttcatccatgtccctaca

SEQ ID NO: 19348 - DNA, 20 bp, Artificial Sequence
  Synthetic oligonucleotide; AGG chr11 5318426 5318445 5318442 +
cttcatccatgtccctacaa

SEQ ID NO: 19349 - DNA, 20 bp, Artificial Sequence
  Synthetic oligonucleotide; TGG chr11 5318450 5318469 5318466 +
catgaactcatcatttttta

SEQ ID NO: 19350 - DNA, 20 bp, Artificial Sequence
  Synthetic oligonucleotide; TAG chr11 5318458 5318477 5318474 +
catcattttttatggctgca

SEQ ID NO: 19351 - DNA, 20 bp, Artificial Sequence
  Synthetic oligonucleotide; TGG chr11 5318468 5318487 5318484 +
tatggctgcatagtattcca

SEQ ID NO: 19352 - DNA, 20 bp, Artificial Sequence
  Synthetic oligonucleotide; TGG chr11 5318511 5318530 5318527 +
ttaatccattctatcattgt

SEQ ID NO: 19353 - DNA, 20 bp, Artificial Sequence
  Synthetic oligonucleotide; TGG chr11 5318519 5318538 5318535 +
ttctatcattgttggacatt

SEQ ID NO: 19354 - DNA, 20 bp, Artificial Sequence
  Synthetic oligonucleotide; GGG chr11 5318520 5318539 5318536 +
tctatcattgttggacattt

SEQ ID NO: 19355 - DNA, 20 bp, Artificial Sequence
  Synthetic oligonucleotide; TGG chr11 5318524 5318543 5318540 +
tcattgttggacatttgggt

SEQ ID NO: 19356 - DNA, 20 bp, Artificial Sequence
  Synthetic oligonucleotide; AAG chr11 5318531 5318550 5318547 +
tggacatttgggttggttcc

SEQ ID NO: 19357 - DNA, 20 bp, Artificial Sequence
  Synthetic oligonucleotide; TAG chr11 5318550 5318569 5318566 +
caagtctttgttattgtgaa

SEQ ID NO: 19358 - DNA, 20 bp, Artificial Sequence
  Synthetic oligonucleotide; AAG chr11 5318555 5318574 5318571 +
ctttgttattgtgaatagtg

SEQ ID NO: 19359 - DNA, 20 bp, Artificial Sequence
  Synthetic oligonucleotide; TAG chr11 5318563 5318582 5318579 +
ttgtgaatagtgaagctctt

SEQ ID NO: 19360 - DNA, 20 bp, Artificial Sequence
  Synthetic oligonucleotide; TAG chr11 5318572 5318591 5318588 +
gtgaagctctttagtttaat

SEQ ID NO: 19361 - DNA, 20 bp, Artificial Sequence
  Synthetic oligonucleotide; AGG chr11 5318573 5318592 5318589 +
tgaagctctttagtttaatt

SEQ ID NO: 19362 - DNA, 20 bp, Artificial Sequence
  Synthetic oligonucleotide; TGG chr11 5318614 5318633 5318630 +
ctttgcattgcaattgcttt

SEQ ID NO: 19363 - DNA, 20 bp, Artificial Sequence
  Synthetic oligonucleotide; GGG chr11 5318615 5318634 5318631 +
tttgcattgcaattgctttt

SEQ ID NO: 19364 - DNA, 20 bp, Artificial Sequence
  Synthetic oligonucleotide; GGG chr11 5318616 5318635 5318632 +
ttgcattgcaattgcttttg

SEQ ID NO: 19365 - DNA, 20 bp, Artificial Sequence
  Synthetic oligonucleotide; GGG chr11 5318617 5318636 5318633 +
tgcattgcaattgcttttgg

SEQ ID NO: 19366 - DNA, 20 bp, Artificial Sequence
  Synthetic oligonucleotide; TAG chr11 5318622 5318641 5318638 +
tgcaattgcttttgggggct

SEQ ID NO: 19367 - DNA, 20 bp, Artificial Sequence
  Synthetic oligonucleotide; CAG chr11 5318640 5318659 5318656 +
cttagccaaaaatgcactgc

SEQ ID NO: 19368 - DNA, 20 bp, Artificial Sequence
  Synthetic oligonucleotide; CAG chr11 5318645 5318664 5318661 +
ccaaaaatgcactgccagtg

SEQ ID NO: 19369 - DNA, 20 bp, Artificial Sequence
  Synthetic oligonucleotide; AGG chr11 5318646 5318665 5318662 +
caaaaatgcactgccagtgc

SEQ ID NO: 19370 - DNA, 20 bp, Artificial Sequence
  Synthetic oligonucleotide; AAG chr11 5318650 5318669 5318666 +
aatgcactgccagtgcaggt

SEQ ID NO: 19371 - DNA, 20 bp, Artificial Sequence
  Synthetic oligonucleotide; GAG chr11 5318657 5318676 5318673 +
tgccagtgcaggtaagattt

SEQ ID NO: 19372 - DNA, 20 bp, Artificial Sequence
  Synthetic oligonucleotide; AAG chr11 5318671 5318690 5318687 +
agatttgagatcttacattt

SEQ ID NO: 19373 - DNA, 20 bp, Artificial Sequence
  Synthetic oligonucleotide; CAG chr11 5318689 5318708 5318705 +
ttaagttttgaattcatttt

SEQ ID NO: 19374 - DNA, 20 bp, Artificial Sequence
  Synthetic oligonucleotide; TGG chr11 5318706 5318725 5318722 +
tttcagttgatttctctaaa

SEQ ID NO: 19375 - DNA, 20 bp, Artificial Sequence
  Synthetic oligonucleotide; AAG chr11 5318712 5318731 5318728 +
ttgatttctctaaatggtgt

SEQ ID NO: 19376 - DNA, 20 bp, Artificial Sequence
  Synthetic oligonucleotide; AGG chr11 5318713 5318732 5318729 +
tgatttctctaaatggtgta

SEQ ID NO: 19377 - DNA, 20 bp, Artificial Sequence
  Synthetic oligonucleotide; AAG chr11 5318717 5318736 5318733 +
ttctctaaatggtgtaaggt

SEQ ID NO: 19378 - DNA, 20 bp, Artificial Sequence
  Synthetic oligonucleotide; AGG chr11 5318718 5318737 5318734 +
tctctaaatggtgtaaggta

SEQ ID NO: 19379 - DNA, 20 bp, Artificial Sequence
  Synthetic oligonucleotide; GGG chr11 5318719 5318738 5318735 +
ctctaaatggtgtaaggtaa

SEQ ID NO: 19380 - DNA, 20 bp, Artificial Sequence
  Synthetic oligonucleotide; TAG chr11 5318724 5318743 5318740 +
aatggtgtaaggtaagggtc

SEQ ID NO: 19381 - DNA, 20 bp, Artificial Sequence
  Synthetic oligonucleotide; TGG chr11 5318744 5318763 5318760 +
tagtttcattcttctgcata

SEQ ID NO: 19382 - DNA, 20 bp, Artificial Sequence
  Synthetic oligonucleotide; TAG chr11 5318748 5318767 5318764 +
ttcattcttctgcatatggc

SEQ ID NO: 19383 - DNA, 20 bp, Artificial Sequence
  Synthetic oligonucleotide; CAG chr11 5318761 5318780 5318777 +
atatggctagccacgtattc

SEQ ID NO: 19384 - DNA, 20 bp, Artificial Sequence
  Synthetic oligonucleotide; CAG chr11 5318766 5318785 5318782 +
gctagccacgtattccagca

SEQ ID NO: 19385 - DNA, 20 bp, Artificial Sequence
  Synthetic oligonucleotide; TGG chr11 5318774 5318793 5318790 +
cgtattccagcacagtttat

SEQ ID NO: 19386 - DNA, 20 bp, Artificial Sequence
  Synthetic oligonucleotide; TAG chr11 5318778 5318797 5318794 +
ttccagcacagtttattgga

SEQ ID NO: 19387 - DNA, 20 bp, Artificial Sequence
  Synthetic oligonucleotide; AGG chr11 5318779 5318798 5318795 +
tccagcacagtttattggat

SEQ ID NO: 19388 - DNA, 20 bp, Artificial Sequence
  Synthetic oligonucleotide; TAG chr11 5318782 5318801 5318798 +
agcacagtttattggatagg

SEQ ID NO: 19389 - DNA, 20 bp, Artificial Sequence
  Synthetic oligonucleotide; CAG chr11 5318810 5318829 5318826 +
ttcccgctgcttgtttttgt

SEQ ID NO: 19390 - DNA, 20 bp, Artificial Sequence
  Synthetic oligonucleotide; AAG chr11 5318821 5318840 5318837 +
tgtttttgtcagtgttgttg

SEQ ID NO: 19391 - DNA, 20 bp, Artificial Sequence
  Synthetic oligonucleotide; CAG chr11 5318826 5318845 5318842 +
ttgtcagtgttgttgaagat

SEQ ID NO: 19392 - DNA, 20 bp, Artificial Sequence
  Synthetic oligonucleotide; TGG chr11 5318830 5318849 5318846 +
cagtgttgttgaagatcaga

SEQ ID NO: 19393 - DNA, 20 bp, Artificial Sequence
  Synthetic oligonucleotide; TAG chr11 5318844 5318863 5318860 +
atcagatggttgtaactatg

SEQ ID NO: 19394 - DNA, 20 bp, Artificial Sequence
  Synthetic oligonucleotide; GAG chr11 5318857 5318876 5318873 +
aactatgtagctttattttt

SEQ ID NO: 19395 - DNA, 20 bp, Artificial Sequence
  Synthetic oligonucleotide; TAG chr11 5318878 5318897 5318894 +
agttttctattgtgtttcct

SEQ ID NO: 19396 - DNA, 20 bp, Artificial Sequence
  Synthetic oligonucleotide; TGG chr11 5318917 5318936 5318933 +
tgtaacaatatcatgctgtt

SEQ ID NO: 19397 - DNA, 20 bp, Artificial Sequence
  Synthetic oligonucleotide; GGG chr11 5318918 5318937 5318934 +
gtaacaatatcatgctgttt

SEQ ID NO: 19398 - DNA, 20 bp, Artificial Sequence
  Synthetic oligonucleotide; GGG chr11 5318919 5318938 5318935 +
taacaatatcatgctgtttg

SEQ ID NO: 19399 - DNA, 20 bp, Artificial Sequence
  Synthetic oligonucleotide; TGG chr11 5318927 5318946 5318943 +
tcatgctgtttggggtactg

SEQ ID NO: 19400 - DNA, 20 bp, Artificial Sequence
  Synthetic oligonucleotide; TAG chr11 5318940 5318959 5318956 +
ggtactgtggccttataatg

SEQ ID NO: 19401 - DNA, 20 bp, Artificial Sequence
  Synthetic oligonucleotide; CAG chr11 5318996 5319015 5319012 +
tctttctttttttatttttt

SEQ ID NO: 19402 - DNA, 20 bp, Artificial Sequence
  Synthetic oligonucleotide; GAG chr11 5318998 5319017 5319014 +
tttctttttttattttttca

SEQ ID NO: 19403 - DNA, 20 bp, Artificial Sequence
  Synthetic oligonucleotide; CAG chr11 5319016 5319035 5319032 +
cagagtttcactctgtcacc

SEQ ID NO: 19404 - DNA, 20 bp, Artificial Sequence
  Synthetic oligonucleotide; AGG chr11 5319017 5319036 5319033 +
agagtttcactctgtcaccc

SEQ ID NO: 19405 - DNA, 20 bp, Artificial Sequence
  Synthetic oligonucleotide; TGG chr11 5319021 5319040 5319037 +
tttcactctgtcacccaggc

SEQ ID NO: 19406 - DNA, 20 bp, Artificial Sequence
  Synthetic oligonucleotide; GAG chr11 5319023 5319042 5319039 +
tcactctgtcacccaggctg

SEQ ID NO: 19407 - DNA, 20 bp, Artificial Sequence
  Synthetic oligonucleotide; CAG chr11 5319028 5319047 5319044 +
ctgtcacccaggctggagtg

SEQ ID NO: 19408 - DNA, 20 bp, Artificial Sequence
  Synthetic oligonucleotide; TGG chr11 5319031 5319050 5319047 +
tcacccaggctggagtgcag

SEQ ID NO: 19409 - DNA, 20 bp, Artificial Sequence
  Synthetic oligonucleotide; TGG chr11 5319042 5319061 5319058 +
ggagtgcagtggtgcgatct

SEQ ID NO: 19410 - DNA, 20 bp, Artificial Sequence
  Synthetic oligonucleotide; CAG chr11 5319065 5319084 5319081 +
ctcactgcaccgtctgcctc

SEQ ID NO: 19411 - DNA, 20 bp, Artificial Sequence
  Synthetic oligonucleotide; GAG chr11 5319067 5319086 5319083 +
cactgcaccgtctgcctcca

SEQ ID NO: 19412 - DNA, 20 bp, Artificial Sequence
  Synthetic oligonucleotide; AAG chr11 5319073 5319092 5319089 +
accgtctgcctccagagttc

SEQ ID NO: 19413 - DNA, 20 bp, Artificial Sequence
  Synthetic oligonucleotide; CAG chr11 5319090 5319109 5319106 +
ttcaagcaattctcctgcct

SEQ ID NO: 19414 - DNA, 20 bp, Artificial Sequence
  Synthetic oligonucleotide; GAG chr11 5319099 5319118 5319115 +
ttctcctgcctcagccttcc

SEQ ID NO: 19415 - DNA, 20 bp, Artificial Sequence
  Synthetic oligonucleotide; TAG chr11 5319102 5319121 5319118 +
tcctgcctcagccttccgag

SEQ ID NO: 19416 - DNA, 20 bp, Artificial Sequence
  Synthetic oligonucleotide; TGG chr11 5319106 5319125 5319122 +
gcctcagccttccgagtagc

SEQ ID NO: 19417 - DNA, 20 bp, Artificial Sequence
  Synthetic oligonucleotide; GGG chr11 5319107 5319126 5319123 +
cctcagccttccgagtagct

SEQ ID NO: 19418 - DNA, 20 bp, Artificial Sequence
  Synthetic oligonucleotide; CAG chr11 5319114 5319133 5319130 +
cttccgagtagctgggatta

SEQ ID NO: 19419 - DNA, 20 bp, Artificial Sequence
  Synthetic oligonucleotide; CAG chr11 5319129 5319148 5319145 +
gattacagcccccaccacca

SEQ ID NO: 19420 - DNA, 20 bp, Artificial Sequence
  Synthetic oligonucleotide; CGG chr11 5319133 5319152 5319149 +
acagcccccaccaccacagc

SEQ ID NO: 19421 - DNA, 20 bp, Artificial Sequence
  Synthetic oligonucleotide; TAG chr11 5319151 5319170 5319167 +
gccggctaattttgtatttt

SEQ ID NO: 19422 - DNA, 20 bp, Artificial Sequence
  Synthetic oligonucleotide; TAG chr11 5319154 5319173 5319170 +
ggctaattttgtatttttag

SEQ ID NO: 19423 - DNA, 20 bp, Artificial Sequence
  Synthetic oligonucleotide; GAG chr11 5319156 5319175 5319172 +
ctaattttgtatttttagta

SEQ ID NO: 19424 - DNA, 20 bp, Artificial Sequence
  Synthetic oligonucleotide; CAG chr11 5319160 5319179 5319176 +
ttttgtatttttagtagaga

SEQ ID NO: 19425 - DNA, 20 bp, Artificial Sequence
  Synthetic oligonucleotide; CAG chr11 5319180 5319199 5319196 +
cagtgtttcaccatgttgac

SEQ ID NO: 19426 - DNA, 20 bp, Artificial Sequence
  Synthetic oligonucleotide; AGG chr11 5319181 5319200 5319197 +
agtgtttcaccatgttgacc

SEQ ID NO: 19427 - DNA, 20 bp, Artificial Sequence
  Synthetic oligonucleotide; TGG chr11 5319185 5319204 5319201 +
tttcaccatgttgaccaggc

SEQ ID NO: 19428 - DNA, 20 bp, Artificial Sequence
  Synthetic oligonucleotide; CAG chr11 5319205 5319224 5319221 +
tggtcttgaactcctgacct

SEQ ID NO: 19429 - DNA, 20 bp, Artificial Sequence
  Synthetic oligonucleotide; AGG chr11 5319206 5319225 5319222 +
ggtcttgaactcctgacctc

SEQ ID NO: 19430 - DNA, 20 bp, Artificial Sequence
  Synthetic oligonucleotide; CAG chr11 5319223 5319242 5319239 +
ctcaggtgatacacccacct

SEQ ID NO: 19431 - DNA, 20 bp, Artificial Sequence
  Synthetic oligonucleotide; AAG chr11 5319233 5319252 5319249 +
acacccacctcagcccccta

SEQ ID NO: 19432 - DNA, 20 bp, Artificial Sequence
  Synthetic oligonucleotide; TAG chr11 5319239 5319258 5319255 +
acctcagccccctaaagtgc

SEQ ID NO: 19433 - DNA, 20 bp, Artificial Sequence
  Synthetic oligonucleotide; GAG chr11 5319241 5319260 5319257 +
ctcagccccctaaagtgcta

SEQ ID NO: 19434 - DNA, 20 bp, Artificial Sequence
  Synthetic oligonucleotide; CAG chr11 5319247 5319266 5319263 +
cccctaaagtgctagagtta

SEQ ID NO: 19435 - DNA, 20 bp, Artificial Sequence
  Synthetic oligonucleotide; AGG chr11 5319248 5319267 5319264 +
ccctaaagtgctagagttac

SEQ ID NO: 19436 - DNA, 20 bp, Artificial Sequence
  Synthetic oligonucleotide; GAG chr11 5319254 5319273 5319270 +
agtgctagagttacaggcgt

SEQ ID NO: 19437 - DNA, 20 bp, Artificial Sequence
  Synthetic oligonucleotide; TGG chr11 5319267 5319286 5319283 +
caggcgtgagccaccgtgcc

SEQ ID NO: 19438 - DNA, 20 bp, Artificial Sequence
  Synthetic oligonucleotide; TAG chr11 5319274 5319293 5319290 +
gagccaccgtgcctggcctg

SEQ ID NO: 19439 - DNA, 20 bp, Artificial Sequence
  Synthetic oligonucleotide; AAG chr11 5319281 5319300 5319297 +
cgtgcctggcctgtagtttc

SEQ ID NO: 19440 - DNA, 20 bp, Artificial Sequence
  Synthetic oligonucleotide; CAG chr11 5319285 5319304 5319301 +
cctggcctgtagtttcaagt

SEQ ID NO: 19441 - DNA, 20 bp, Artificial Sequence
  Synthetic oligonucleotide; AGG chr11 5319286 5319305 5319302 +
ctggcctgtagtttcaagtc

SEQ ID NO: 19442 - DNA, 20 bp, Artificial Sequence
  Synthetic oligonucleotide; TGG chr11 5319289 5319308 5319305 +
gcctgtagtttcaagtcagg

SEQ ID NO: 19443 - DNA, 20 bp, Artificial Sequence
  Synthetic oligonucleotide; TGG chr11 5319294 5319313 5319310 +
tagtttcaagtcaggtggtg

SEQ ID NO: 19444 - DNA, 20 bp, Artificial Sequence
  Synthetic oligonucleotide; AAG chr11 5319323 5319342 5319339 +
caattttgttctttctgctt

SEQ ID NO: 19445 - DNA, 20 bp, Artificial Sequence
  Synthetic oligonucleotide; CAG chr11 5319341 5319360 5319357 +
ttaagattgctttgcctgtt

SEQ ID NO: 19446 - DNA, 20 bp, Artificial Sequence
  Synthetic oligonucleotide; AGG chr11 5319342 5319361 5319358 +
taagattgctttgcctgttc

SEQ ID NO: 19447 - DNA, 20 bp, Artificial Sequence
  Synthetic oligonucleotide; TGG chr11 5319352 5319371 5319368 +
ttgcctgttcaggctctttt

SEQ ID NO: 19448 - DNA, 20 bp, Artificial Sequence
  Synthetic oligonucleotide; TAG chr11 5319374 5319393 5319390 +
gttccatatgaattttaaac

SEQ ID NO: 19449 - DNA, 20 bp, Artificial Sequence
  Synthetic oligonucleotide; AAG chr11 5319393 5319412 5319409 +
ctagtttttctaatactgtg

SEQ ID NO: 19450 - DNA, 20 bp, Artificial Sequence
  Synthetic oligonucleotide; TGG chr11 5319404 5319423 5319420 +
aatactgtgaagaatgacat

SEQ ID NO: 19451 - DNA, 20 bp, Artificial Sequence
  Synthetic oligonucleotide; TGG chr11 5319411 5319430 5319427 +
tgaagaatgacattggtaat

SEQ ID NO: 19452 - DNA, 20 bp, Artificial Sequence
  Synthetic oligonucleotide; TAG chr11 5319415 5319434 5319431 +
gaatgacattggtaattgga

SEQ ID NO: 19453 - DNA, 20 bp, Artificial Sequence
  Synthetic oligonucleotide; GAG chr11 5319446 5319465 5319462 +
atgaatgtctaaattgcttt

SEQ ID NO: 19454 - DNA, 20 bp, Artificial Sequence
  Synthetic oligonucleotide; CAG chr11 5319449 5319468 5319465 +
aatgtctaaattgctttgag

SEQ ID NO: 19455 - DNA, 20 bp, Artificial Sequence
  Synthetic oligonucleotide; TGG chr11 5319454 5319473 5319470 +
ctaaattgctttgagcagta

SEQ ID NO: 19456 - DNA, 20 bp, Artificial Sequence
  Synthetic oligonucleotide; GAG chr11 5319490 5319509 5319506 +
tattgattcttccaatccat

SEQ ID NO: 19457 - DNA, 20 bp, Artificial Sequence
  Synthetic oligonucleotide; TGG chr11 5319495 5319514 5319511 +
attcttccaatccatgagcc

SEQ ID NO: 19458 - DNA, 20 bp, Artificial Sequence
  Synthetic oligonucleotide; AAG chr11 5319499 5319518 5319515 +
ttccaatccatgagcctgga

SEQ ID NO: 19459 - DNA, 20 bp, Artificial Sequence
  Synthetic oligonucleotide; CAG chr11 5319539 5319558 5319555 +
gtgttgtttctgatttcttt

SEQ ID NO: 19460 - DNA, 20 bp, Artificial Sequence
  Synthetic oligonucleotide; CAG chr11 5319542 5319561 5319558 +
ttgtttctgatttctttcag

SEQ ID NO: 19461 - DNA, 20 bp, Artificial Sequence
  Synthetic oligonucleotide; TAG chr11 5319552 5319571 5319568 +
tttctttcagcagtgttttg

SEQ ID NO: 19462 - DNA, 20 bp, Artificial Sequence
  Synthetic oligonucleotide; TAG chr11 5319564 5319583 5319580 +
gtgttttgtagttctccttg

SEQ ID NO: 19463 - DNA, 20 bp, Artificial Sequence
  Synthetic oligonucleotide; GAG chr11 5319566 5319585 5319582 +
gttttgtagttctccttgta

SEQ ID NO: 19464 - DNA, 20 bp, Artificial Sequence
  Synthetic oligonucleotide; TAG chr11 5319605 5319624 5319621 +
aaaccatatgatcatctcaa

SEQ ID NO: 19465 - DNA, 20 bp, Artificial Sequence
  Synthetic oligonucleotide; GAG chr11 5319611 5319630 5319627 +
tatgatcatctcaatagact

SEQ ID NO: 19466 - DNA, 20 bp, Artificial Sequence
  Synthetic oligonucleotide; CAG chr11 5319663 5319682 5319679 +
ttcatgataaaaacctccaa

SEQ ID NO: 19467 - DNA, 20 bp, Artificial Sequence
  Synthetic oligonucleotide; TAG chr11 5319668 5319687 5319684 +
gataaaaacctccaacagac

SEQ ID NO: 19468 - DNA, 20 bp, Artificial Sequence
  Synthetic oligonucleotide; AGG chr11 5319669 5319688 5319685 +
ataaaaacctccaacagact

SEQ ID NO: 19469 - DNA, 20 bp, Artificial Sequence
  Synthetic oligonucleotide; AAG chr11 5319677 5319696 5319693 +
ctccaacagactaggcatca

SEQ ID NO: 19470 - DNA, 20 bp, Artificial Sequence
  Synthetic oligonucleotide; AGG chr11 5319678 5319697 5319694 +
tccaacagactaggcatcaa

SEQ ID NO: 19471 - DNA, 20 bp, Artificial Sequence
  Synthetic oligonucleotide; AAG chr11 5319693 5319712 5319709 +
atcaaaggaacatacctcaa

SEQ ID NO: 19472 - DNA, 20 bp, Artificial Sequence
  Synthetic oligonucleotide; AAG chr11 5319701 5319720 5319717 +
aacatacctcaaaagaataa

SEQ ID NO: 19473 - DNA, 20 bp, Artificial Sequence
  Synthetic oligonucleotide; TGG chr11 5319741 5319760 5319757 +
ataaccaaaaccatactgaa

SEQ ID NO: 19474 - DNA, 20 bp, Artificial Sequence
  Synthetic oligonucleotide; GGG chr11 5319742 5319761 5319758 +
taaccaaaaccatactgaat

SEQ ID NO: 19475 - DNA, 20 bp, Artificial Sequence
  Synthetic oligonucleotide; AAG chr11 5319748 5319767 5319764 +
aaaccatactgaatgggcaa

SEQ ID NO: 19476 - DNA, 20 bp, Artificial Sequence
  Synthetic oligonucleotide; TGG chr11 5319752 5319771 5319768 +
catactgaatgggcaaaagc

SEQ ID NO: 19477 - DNA, 20 bp, Artificial Sequence
  Synthetic oligonucleotide; AAG chr11 5319780 5319799 5319796 +
ttctcctcgaaaactgcaac

SEQ ID NO: 19478 - DNA, 20 bp, Artificial Sequence
  Synthetic oligonucleotide; AAG chr11 5319785 5319804 5319801 +
ctcgaaaactgcaacaagac

SEQ ID NO: 19479 - DNA, 20 bp, Artificial Sequence
  Synthetic oligonucleotide; AGG chr11 5319786 5319805 5319802 +
tcgaaaactgcaacaagaca

SEQ ID NO: 19480 - DNA, 20 bp, Artificial Sequence
  Synthetic oligonucleotide; TAG chr11 5319809 5319828 5319825 +
attcccattctcaccactcc

SEQ ID NO: 19481 - DNA, 20 bp, Artificial Sequence
  Synthetic oligonucleotide; TGG chr11 5319824 5319843 5319840 +
actcctagtgaacataaaat

SEQ ID NO: 19482 - DNA, 20 bp, Artificial Sequence
  Synthetic oligonucleotide; AAG chr11 5319827 5319846 5319843 +
cctagtgaacataaaattgg

SEQ ID NO: 19483 - DNA, 20 bp, Artificial Sequence
  Synthetic oligonucleotide; CAG chr11 5319837 5319856 5319853 +
ataaaattggaagtcctaac

SEQ ID NO: 19484 - DNA, 20 bp, Artificial Sequence
  Synthetic oligonucleotide; AGG chr11 5319838 5319857 5319854 +
taaaattggaagtcctaacc

SEQ ID NO: 19485 - DNA, 20 bp, Artificial Sequence
  Synthetic oligonucleotide; GGG chr11 5319839 5319858 5319855 +
aaaattggaagtcctaacca

SEQ ID NO: 19486 - DNA, 20 bp, Artificial Sequence
  Synthetic oligonucleotide; CAG chr11 5319846 5319865 5319862 +
gaagtcctaaccagggcaat

SEQ ID NO: 19487 - DNA, 20 bp, Artificial Sequence
  Synthetic oligonucleotide; AGG chr11 5319847 5319866 5319863 +
aagtcctaaccagggcaatc

SEQ ID NO: 19488 - DNA, 20 bp, Artificial Sequence
  Synthetic oligonucleotide; GAG chr11 5319851 5319870 5319867 +
cctaaccagggcaatcaggc

SEQ ID NO: 19489 - DNA, 20 bp, Artificial Sequence
  Synthetic oligonucleotide; GAG chr11 5319853 5319872 5319869 +
taaccagggcaatcaggcga

SEQ ID NO: 19490 - DNA, 20 bp, Artificial Sequence
  Synthetic oligonucleotide; AAG chr11 5319857 5319876 5319873 +
cagggcaatcaggcgagaga

SEQ ID NO: 19491 - DNA, 20 bp, Artificial Sequence
  Synthetic oligonucleotide; AAG chr11 5319861 5319880 5319877 +
gcaatcaggcgagagaaaga

SEQ ID NO: 19492 - DNA, 20 bp, Artificial Sequence
  Synthetic oligonucleotide; TGG chr11 5319867 5319886 5319883 +
aggcgagagaaagaaagaaa

SEQ ID NO: 19493 - DNA, 20 bp, Artificial Sequence
  Synthetic oligonucleotide; TAG chr11 5319878 5319897 5319894 +
agaaagaaatggcatcaaaa

SEQ ID NO: 19494 - DNA, 20 bp, Artificial Sequence
  Synthetic oligonucleotide; AGG chr11 5319879 5319898 5319895 +
gaaagaaatggcatcaaaat

SEQ ID NO: 19495 - DNA, 20 bp, Artificial Sequence
  Synthetic oligonucleotide; AAG chr11 5319887 5319906 5319903 +
tggcatcaaaataggacaat

SEQ ID NO: 19496 - DNA, 20 bp, Artificial Sequence
  Synthetic oligonucleotide; TAG chr11 5319929 5319948 5319945 +
tgatgatatgactctatact

SEQ ID NO: 19497 - DNA, 20 bp, Artificial Sequence
  Synthetic oligonucleotide; CAG chr11 5319941 5319960 5319957 +
tctatacttagaaaatccta

SEQ ID NO: 19498 - DNA, 20 bp, Artificial Sequence
  Synthetic oligonucleotide; AAG chr11 5319954 5319973 5319970 +
aatcctacagattcttccaa

SEQ ID NO: 19499 - DNA, 20 bp, Artificial Sequence
  Synthetic oligonucleotide; AGG chr11 5319955 5319974 5319971 +
atcctacagattcttccaaa

SEQ ID NO: 19500 - DNA, 20 bp, Artificial Sequence
  Synthetic oligonucleotide; TAG chr11 5319962 5319981 5319978 +
agattcttccaaaaggctgc

SEQ ID NO: 19501 - DNA, 20 bp, Artificial Sequence
  Synthetic oligonucleotide; TAG chr11 5319981 5320000 5319997 +
ctagaactgataaacaattt

SEQ ID NO: 19502 - DNA, 20 bp, Artificial Sequence
  Synthetic oligonucleotide; AAG chr11 5319985 5320004 5320001 +
aactgataaacaattttagc

SEQ ID NO: 19503 - DNA, 20 bp, Artificial Sequence
  Synthetic oligonucleotide; AGG chr11 5319986 5320005 5320002 +
actgataaacaattttagca

SEQ ID NO: 19504 - DNA, 20 bp, Artificial Sequence
  Synthetic oligonucleotide; CAG chr11 5319992 5320011 5320008 +
aaacaattttagcaaggttt

SEQ ID NO: 19505 - DNA, 20 bp, Artificial Sequence
  Synthetic oligonucleotide; AGG chr11 5319993 5320012 5320009 +
aacaattttagcaaggtttc

SEQ ID NO: 19506 - DNA, 20 bp, Artificial Sequence
  Synthetic oligonucleotide; CAG chr11 5320018 5320037 5320034 +
acaaaatcacatacaaaaat

SEQ ID NO: 19507 - DNA, 20 bp, Artificial Sequence
  Synthetic oligonucleotide; TAG chr11 5320021 5320040 5320037 +
aaatcacatacaaaaatcag

SEQ ID NO: 19508 - DNA, 20 bp, Artificial Sequence
  Synthetic oligonucleotide; AAG chr11 5320041 5320060 5320057 +
tagcatttccatacaccaat

SEQ ID NO: 19509 - DNA, 20 bp, Artificial Sequence
  Synthetic oligonucleotide; AGG chr11 5320042 5320061 5320058 +
agcatttccatacaccaata

SEQ ID NO: 19510 - DNA, 20 bp, Artificial Sequence
  Synthetic oligonucleotide; CAG chr11 5320047 5320066 5320063 +
ttccatacaccaataaggcc

SEQ ID NO: 19511 - DNA, 20 bp, Artificial Sequence
  Synthetic oligonucleotide; AGG chr11 5320048 5320067 5320064 +
tccatacaccaataaggccc

SEQ ID NO: 19512 - DNA, 20 bp, Artificial Sequence
  Synthetic oligonucleotide; GAG chr11 5320053 5320072 5320069 +
acaccaataaggcccaggct

SEQ ID NO: 19513 - DNA, 20 bp, Artificial Sequence
  Synthetic oligonucleotide; GAG chr11 5320055 5320074 5320071 +
accaataaggcccaggctga

SEQ ID NO: 19514 - DNA, 20 bp, Artificial Sequence
  Synthetic oligonucleotide; GAG chr11 5320065 5320084 5320081 +
cccaggctgagagtcaaatc

SEQ ID NO: 19515 - DNA, 20 bp, Artificial Sequence
  Synthetic oligonucleotide; AAG chr11 5320082 5320101 5320098 +
atcgagaacacaatcccatt

SEQ ID NO: 19516 - DNA, 20 bp, Artificial Sequence
  Synthetic oligonucleotide; CAG chr11 5320087 5320106 5320103 +
gaacacaatcccattaagaa

SEQ ID NO: 19517 - DNA, 20 bp, Artificial Sequence
  Synthetic oligonucleotide; AAG chr11 5320095 5320114 5320111 +
tcccattaagaacagccaca

SEQ ID NO: 19518 - DNA, 20 bp, Artificial Sequence
  Synthetic oligonucleotide; TAG chr11 5320111 5320130 5320127 +
cacaaagaaaatgaaatacc

SEQ ID NO: 19519 - DNA, 20 bp, Artificial Sequence
  Synthetic oligonucleotide; AGG chr11 5320112 5320131 5320128 +
acaaagaaaatgaaatacct

SEQ ID NO: 19520 - DNA, 20 bp, Artificial Sequence
  Synthetic oligonucleotide; AAG chr11 5320145 5320164 5320161 +
tttattgaaatttaaaaccc

SEQ ID NO: 19521 - DNA, 20 bp, Artificial Sequence
  Synthetic oligonucleotide; CAG chr11 5320148 5320167 5320164 +
attgaaatttaaaacccaag

SEQ ID NO: 19522 - DNA, 20 bp, Artificial Sequence
  Synthetic oligonucleotide; AGG chr11 5320149 5320168 5320165 +
ttgaaatttaaaacccaagc

SEQ ID NO: 19523 - DNA, 20 bp, Artificial Sequence
  Synthetic oligonucleotide; TAG chr11 5320155 5320174 5320171 +
tttaaaacccaagcaggcac

SEQ ID NO: 19524 - DNA, 20 bp, Artificial Sequence
  Synthetic oligonucleotide; AAG chr11 5320159 5320178 5320175 +
aaacccaagcaggcactaga

SEQ ID NO: 19525 - DNA, 20 bp, Artificial Sequence
  Synthetic oligonucleotide; TAG chr11 5320211 5320230 5320227 +
tatcattactacgtgaatat

SEQ ID NO: 19526 - DNA, 20 bp, Artificial Sequence
  Synthetic oligonucleotide; GAG chr11 5320222 5320241 5320238 +
cgtgaatattagtgtgctat

SEQ ID NO: 19527 - DNA, 20 bp, Artificial Sequence
  Synthetic oligonucleotide; GAG chr11 5320224 5320243 5320240 +
tgaatattagtgtgctatga

SEQ ID NO: 19528 - DNA, 20 bp, Artificial Sequence
  Synthetic oligonucleotide; TGG chr11 5320245 5320264 5320261 +
agacacatcaaataaatttc

SEQ ID NO: 19529 - DNA, 20 bp, Artificial Sequence
  Synthetic oligonucleotide; GGG chr11 5320246 5320265 5320262 +
gacacatcaaataaatttct

SEQ ID NO: 19530 - DNA, 20 bp, Artificial Sequence
  Synthetic oligonucleotide; CAG chr11 5320251 5320270 5320267 +
atcaaataaatttctgggat

SEQ ID NO: 19531 - DNA, 20 bp, Artificial Sequence
  Synthetic oligonucleotide; AGG chr11 5320252 5320271 5320268 +
tcaaataaatttctgggatc

SEQ ID NO: 19532 - DNA, 20 bp, Artificial Sequence
  Synthetic oligonucleotide; GGG chr11 5320253 5320272 5320269 +
caaataaatttctgggatca

SEQ ID NO: 19533 - DNA, 20 bp, Artificial Sequence
  Synthetic oligonucleotide; CAG chr11 5320265 5320284 5320281 +
tgggatcagggaacattttc

SEQ ID NO: 19534 - DNA, 20 bp, Artificial Sequence
  Synthetic oligonucleotide; AAG chr11 5320268 5320287 5320284 +
gatcagggaacattttccag

SEQ ID NO: 19535 - DNA, 20 bp, Artificial Sequence
  Synthetic oligonucleotide; AAG chr11 5320282 5320301 5320298 +
ttccagaagaaatgctactt

SEQ ID NO: 19536 - DNA, 20 bp, Artificial Sequence
  Synthetic oligonucleotide; GAG chr11 5320287 5320306 5320303 +
gaagaaatgctacttaagct

SEQ ID NO: 19537 - DNA, 20 bp, Artificial Sequence
  Synthetic oligonucleotide; TAG chr11 5320308 5320327 5320324 +
agaattaaatgctactatat

SEQ ID NO: 19538 - DNA, 20 bp, Artificial Sequence
  Synthetic oligonucleotide; TAG chr11 5320311 5320330 5320327 +
attaaatgctactatattag

SEQ ID NO: 19539 - DNA, 20 bp, Artificial Sequence
  Synthetic oligonucleotide; TAG chr11 5320316 5320335 5320332 +
atgctactatattagtagtg

SEQ ID NO: 19540 - DNA, 20 bp, Artificial Sequence
  Synthetic oligonucleotide; TAG chr11 5320319 5320338 5320335 +
ctactatattagtagtgtag

SEQ ID NO: 19541 - DNA, 20 bp, Artificial Sequence
  Synthetic oligonucleotide; TGG chr11 5320326 5320345 5320342 +
attagtagtgtagtagtatt

SEQ ID NO: 19542 - DNA, 20 bp, Artificial Sequence
  Synthetic oligonucleotide; TGG chr11 5320329 5320348 5320345 +
agtagtgtagtagtatttgg

SEQ ID NO: 19543 - DNA, 20 bp, Artificial Sequence
  Synthetic oligonucleotide; GGG chr11 5320330 5320349 5320346 +
gtagtgtagtagtatttggt

SEQ ID NO: 19544 - DNA, 20 bp, Artificial Sequence
  Synthetic oligonucleotide; GGG chr11 5320331 5320350 5320347 +
tagtgtagtagtatttggtg

SEQ ID NO: 19545 - DNA, 20 bp, Artificial Sequence
  Synthetic oligonucleotide; TAG chr11 5320334 5320353 5320350 +
tgtagtagtatttggtgggg

SEQ ID NO: 19546 - DNA, 20 bp, Artificial Sequence
  Synthetic oligonucleotide; CAG chr11 5320352 5320371 5320368 +
ggtagtgcaatcattgcgta

SEQ ID NO: 19547 - DNA, 20 bp, Artificial Sequence
  Synthetic oligonucleotide; AGG chr11 5320353 5320372 5320369 +
gtagtgcaatcattgcgtac

SEQ ID NO: 19548 - DNA, 20 bp, Artificial Sequence
  Synthetic oligonucleotide; AAG chr11 5320360 5320379 5320376 +
aatcattgcgtacaggtgaa

SEQ ID NO: 19549 - DNA, 20 bp, Artificial Sequence
  Synthetic oligonucleotide; AAG chr11 5320382 5320401 5320398 +
gaacaaacacaaaacgaaac

SEQ ID NO: 19550 - DNA, 20 bp, Artificial Sequence
  Synthetic oligonucleotide; AAG chr11 5320396 5320415 5320412 +
cgaaacaagtaaacaaatta

SEQ ID NO: 19551 - DNA, 20 bp, Artificial Sequence
  Synthetic oligonucleotide; TGG chr11 5320415 5320434 5320431 +
aaagtttgtaaaatgtacat

SEQ ID NO: 19552 - DNA, 20 bp, Artificial Sequence
  Synthetic oligonucleotide; TGG chr11 5320421 5320440 5320437 +
tgtaaaatgtacattggtaa

SEQ ID NO: 19553 - DNA, 20 bp, Artificial Sequence
  Synthetic oligonucleotide; GGG chr11 5320422 5320441 5320438 +
gtaaaatgtacattggtaat

SEQ ID NO: 19554 - DNA, 20 bp, Artificial Sequence
  Synthetic oligonucleotide; GGG chr11 5320423 5320442 5320439 +
taaaatgtacattggtaatg

SEQ ID NO: 19555 - DNA, 20 bp, Artificial Sequence
  Synthetic oligonucleotide; AAG chr11 5320427 5320446 5320443 +
atgtacattggtaatggggc

SEQ ID NO: 19556 - DNA, 20 bp, Artificial Sequence
  Synthetic oligonucleotide; AAG chr11 5320480 5320499 5320496 +
ttttattcaaaatatacatt

SEQ ID NO: 19557 - DNA, 20 bp, Artificial Sequence
  Synthetic oligonucleotide; AGG chr11 5320481 5320500 5320497 +
tttattcaaaatatacatta

SEQ ID NO: 19558 - DNA, 20 bp, Artificial Sequence
  Synthetic oligonucleotide; AAG chr11 5320484 5320503 5320500 +
attcaaaatatacattaagg

SEQ ID NO: 19559 - DNA, 20 bp, Artificial Sequence
  Synthetic oligonucleotide; AAG chr11 5320520 5320539 5320536 +
gaacaacaatacatgaaaaa

SEQ ID NO: 19560 - DNA, 20 bp, Artificial Sequence
  Synthetic oligonucleotide; GAG chr11 5320526 5320545 5320542 +
caatacatgaaaaaaagctt

SEQ ID NO: 19561 - DNA, 20 bp, Artificial Sequence
  Synthetic oligonucleotide; GAG chr11 5320528 5320547 5320544 +
atacatgaaaaaaagcttga

SEQ ID NO: 19562 - DNA, 20 bp, Artificial Sequence
  Synthetic oligonucleotide; TAG chr11 5320543 5320562 5320559 +
cttgagagaaaatgaatctg

SEQ ID NO: 19563 - DNA, 20 bp, Artificial Sequence
  Synthetic oligonucleotide; TAG chr11 5320546 5320565 5320562 +
gagagaaaatgaatctgtag

SEQ ID NO: 19564 - DNA, 20 bp, Artificial Sequence
  Synthetic oligonucleotide; TAG chr11 5320549 5320568 5320565 +
agaaaatgaatctgtagtag

SEQ ID NO: 19565 - DNA, 20 bp, Artificial Sequence
  Synthetic oligonucleotide; CAG chr11 5320552 5320571 5320568 +
aaatgaatctgtagtagtag

SEQ ID NO: 19566 - DNA, 20 bp, Artificial Sequence
  Synthetic oligonucleotide; AGG chr11 5320553 5320572 5320569 +
aatgaatctgtagtagtagc

SEQ ID NO: 19567 - DNA, 20 bp, Artificial Sequence
  Synthetic oligonucleotide; AAG chr11 5320608 5320627 5320624 +
aaacattttgacattaccat

SEQ ID NO: 19568 - DNA, 20 bp, Artificial Sequence
  Synthetic oligonucleotide; AGG chr11 5320609 5320628 5320625 +
aacattttgacattaccata

SEQ ID NO: 19569 - DNA, 20 bp, Artificial Sequence
  Synthetic oligonucleotide; GGG chr11 5320610 5320629 5320626 +
acattttgacattaccataa

SEQ ID NO: 19570 - DNA, 20 bp, Artificial Sequence
  Synthetic oligonucleotide; AAG chr11 5320627 5320646 5320643 +
taagggaatgaatataaaac

SEQ ID NO: 19571 - DNA, 20 bp, Artificial Sequence
  Synthetic oligonucleotide; GAG chr11 5320629 5320648 5320645 +
agggaatgaatataaaacaa

SEQ ID NO: 19572 - DNA, 20 bp, Artificial Sequence
  Synthetic oligonucleotide; AGG chr11 5320630 5320649 5320646 +
gggaatgaatataaaacaag

SEQ ID NO: 19573 - DNA, 20 bp, Artificial Sequence
  Synthetic oligonucleotide; GAG chr11 5320639 5320658 5320655 +
tataaaacaagaggtatgat

SEQ ID NO: 19574 - DNA, 20 bp, Artificial Sequence
  Synthetic oligonucleotide; AAG chr11 5320653 5320672 5320669 +
tatgatgagtacttataatc

SEQ ID NO: 19575 - DNA, 20 bp, Artificial Sequence
  Synthetic oligonucleotide; TAG chr11 5320656 5320675 5320672 +
gatgagtacttataatcaag

SEQ ID NO: 19576 - DNA, 20 bp, Artificial Sequence
  Synthetic oligonucleotide; AAG chr11 5320669 5320688 5320685 +
aatcaagtagttattgttta

SEQ ID NO: 19577 - DNA, 20 bp, Artificial Sequence
  Synthetic oligonucleotide; TGG chr11 5320678 5320697 5320694 +
gttattgtttaaagttacta

SEQ ID NO: 19578 - DNA, 20 bp, Artificial Sequence
  Synthetic oligonucleotide; CAG chr11 5320684 5320703 5320700 +
gtttaaagttactatggcta

SEQ ID NO: 19579 - DNA, 20 bp, Artificial Sequence
  Synthetic oligonucleotide; GAG chr11 5320690 5320709 5320706 +
agttactatggctacagtat

SEQ ID NO: 19580 - DNA, 20 bp, Artificial Sequence
  Synthetic oligonucleotide; TGG chr11 5320701 5320720 5320717 +
ctacagtatgagaaacatgt

SEQ ID NO: 19581 - DNA, 20 bp, Artificial Sequence
  Synthetic oligonucleotide; AAG chr11 5320706 5320725 5320722 +
gtatgagaaacatgttggaa

SEQ ID NO: 19582 - DNA, 20 bp, Artificial Sequence
  Synthetic oligonucleotide; AGG chr11 5320707 5320726 5320723 +
tatgagaaacatgttggaaa

SEQ ID NO: 19583 - DNA, 20 bp, Artificial Sequence
  Synthetic oligonucleotide; GGG chr11 5320708 5320727 5320724 +
atgagaaacatgttggaaaa

SEQ ID NO: 19584 - DNA, 20 bp, Artificial Sequence
  Synthetic oligonucleotide; GGG chr11 5320709 5320728 5320725 +
tgagaaacatgttggaaaag

SEQ ID NO: 19585 - DNA, 20 bp, Artificial Sequence
  Synthetic oligonucleotide; GGG chr11 5320710 5320729 5320726 +
gagaaacatgttggaaaagg

SEQ ID NO: 19586 - DNA, 20 bp, Artificial Sequence
  Synthetic oligonucleotide; GAG chr11 5320712 5320731 5320728 +
gaaacatgttggaaaagggg

SEQ ID NO: 19587 - DNA, 20 bp, Artificial Sequence
  Synthetic oligonucleotide; CAG chr11 5320717 5320736 5320733 +
atgttggaaaagggggagaa

SEQ ID NO: 19588 - DNA, 20 bp, Artificial Sequence
  Synthetic oligonucleotide; AGG chr11 5320718 5320737 5320734 +
tgttggaaaagggggagaac

SEQ ID NO: 19589 - DNA, 20 bp, Artificial Sequence
  Synthetic oligonucleotide; AAG chr11 5320724 5320743 5320740 +
aaaagggggagaacaggtaa

SEQ ID NO: 19590 - DNA, 20 bp, Artificial Sequence
  Synthetic oligonucleotide; AAG chr11 5320727 5320746 5320743 +
agggggagaacaggtaaaag

SEQ ID NO: 19591 - DNA, 20 bp, Artificial Sequence
  Synthetic oligonucleotide; CAG chr11 5320733 5320752 5320749 +
agaacaggtaaaagaagtat

SEQ ID NO: 19592 - DNA, 20 bp, Artificial Sequence
  Synthetic oligonucleotide; AGG chr11 5320734 5320753 5320750 +
gaacaggtaaaagaagtatc

SEQ ID NO: 19593 - DNA, 20 bp, Artificial Sequence
  Synthetic oligonucleotide; TGG chr11 5320765 5320784 5320781 +
atacacgtgtcaaattgtgt

SEQ ID NO: 19594 - DNA, 20 bp, Artificial Sequence
  Synthetic oligonucleotide; TGG chr11 5320770 5320789 5320786 +
cgtgtcaaattgtgttggtg

SEQ ID NO: 19595 - DNA, 20 bp, Artificial Sequence
  Synthetic oligonucleotide; TAG chr11 5320780 5320799 5320796 +
tgtgttggtgtggttttgac

SEQ ID NO: 19596 - DNA, 20 bp, Artificial Sequence
  Synthetic oligonucleotide; CAG chr11 5320790 5320809 5320806 +
tggttttgactagttgttat

SEQ ID NO: 19597 - DNA, 20 bp, Artificial Sequence
  Synthetic oligonucleotide; TAG chr11 5320793 5320812 5320809 +
ttttgactagttgttatcag

SEQ ID NO: 19598 - DNA, 20 bp, Artificial Sequence
  Synthetic oligonucleotide; TAG chr11 5320799 5320818 5320815 +
ctagttgttatcagtagcat

SEQ ID NO: 19599 - DNA, 20 bp, Artificial Sequence
  Synthetic oligonucleotide; AAG chr11 5320803 5320822 5320819 +
ttgttatcagtagcattaga

SEQ ID NO: 19600 - DNA, 20 bp, Artificial Sequence
  Synthetic oligonucleotide; AGG chr11 5320804 5320823 5320820 +
tgttatcagtagcattagaa

SEQ ID NO: 19601 - DNA, 20 bp, Artificial Sequence
  Synthetic oligonucleotide; TAG chr11 5320813 5320832 5320829 +
tagcattagaaaggcttgaa

SEQ ID NO: 19602 - DNA, 20 bp, Artificial Sequence
  Synthetic oligonucleotide; AAG chr11 5320816 5320835 5320832 +
cattagaaaggcttgaatag

SEQ ID NO: 19603 - DNA, 20 bp, Artificial Sequence
  Synthetic oligonucleotide; GAG chr11 5320818 5320837 5320834 +
ttagaaaggcttgaatagaa

SEQ ID NO: 19604 - DNA, 20 bp, Artificial Sequence
  Synthetic oligonucleotide; GAG chr11 5320820 5320839 5320836 +
agaaaggcttgaatagaaga

SEQ ID NO: 19605 - DNA, 20 bp, Artificial Sequence
  Synthetic oligonucleotide; TAG chr11 5320834 5320853 5320850 +
agaagagagattctatgact

SEQ ID NO: 19606 - DNA, 20 bp, Artificial Sequence
  Synthetic oligonucleotide; TAG chr11 5320839 5320858 5320855 +
agagattctatgacttagaa

SEQ ID NO: 19607 - DNA, 20 bp, Artificial Sequence
  Synthetic oligonucleotide; GAG chr11 5320846 5320865 5320862 +
ctatgacttagaatagaact

SEQ ID NO: 19608 - DNA, 20 bp, Artificial Sequence
  Synthetic oligonucleotide; AAG chr11 5320855 5320874 5320871 +
agaatagaactgagtgattg

SEQ ID NO: 19609 - DNA, 20 bp, Artificial Sequence
  Synthetic oligonucleotide; AGG chr11 5320856 5320875 5320872 +
gaatagaactgagtgattga

SEQ ID NO: 19610 - DNA, 20 bp, Artificial Sequence
  Synthetic oligonucleotide; TAG chr11 5320859 5320878 5320875 +
tagaactgagtgattgaagg

SEQ ID NO: 19611 - DNA, 20 bp, Artificial Sequence
  Synthetic oligonucleotide; TAG chr11 5320862 5320881 5320878 +
aactgagtgattgaaggtag

SEQ ID NO: 19612 - DNA, 20 bp, Artificial Sequence
  Synthetic oligonucleotide; AAG chr11 5320869 5320888 5320885 +
tgattgaaggtagtagatta

SEQ ID NO: 19613 - DNA, 20 bp, Artificial Sequence
  Synthetic oligonucleotide; GAG chr11 5320871 5320890 5320887 +
attgaaggtagtagattaaa

SEQ ID NO: 19614 - DNA, 20 bp, Artificial Sequence
  Synthetic oligonucleotide; AAG chr11 5320875 5320894 5320891 +
aaggtagtagattaaagaga

SEQ ID NO: 19615 - DNA, 20 bp, Artificial Sequence
  Synthetic oligonucleotide; AAG chr11 5320878 5320897 5320894 +
gtagtagattaaagagaaag

SEQ ID NO: 19616 - DNA, 20 bp, Artificial Sequence
  Synthetic oligonucleotide; AAG chr11 5320884 5320903 5320900 +
gattaaagagaaagaagcgt

SEQ ID NO: 19617 - DNA, 20 bp, Artificial Sequence
  Synthetic oligonucleotide; GAG chr11 5320906 5320925 5320922 +
gtaatgccacctgaatttct

SEQ ID NO: 19618 - DNA, 20 bp, Artificial Sequence
  Synthetic oligonucleotide; TGG chr11 5320919 5320938 5320935 +
aatttctgagttttgctgaa

SEQ ID NO: 19619 - DNA, 20 bp, Artificial Sequence
  Synthetic oligonucleotide; GAG chr11 5320921 5320940 5320937 +
tttctgagttttgctgaatg

SEQ ID NO: 19620 - DNA, 20 bp, Artificial Sequence
  Synthetic oligonucleotide; GAG chr11 5320923 5320942 5320939 +
tctgagttttgctgaatgga

SEQ ID NO: 19621 - DNA, 20 bp, Artificial Sequence
  Synthetic oligonucleotide; TAG chr11 5320926 5320945 5320942 +
gagttttgctgaatggagag

SEQ ID NO: 19622 - DNA, 20 bp, Artificial Sequence
  Synthetic oligonucleotide; TAG chr11 5320944 5320963 5320960 +
agtagttccattgacttcca

SEQ ID NO: 19623 - DNA, 20 bp, Artificial Sequence
  Synthetic oligonucleotide; AAG chr11 5320954 5320973 5320970 +
ttgacttccatagttatcac

SEQ ID NO: 19624 - DNA, 20 bp, Artificial Sequence
  Synthetic oligonucleotide; AAG chr11 5320957 5320976 5320973 +
acttccatagttatcacaag

SEQ ID NO: 19625 - DNA, 20 bp, Artificial Sequence
  Synthetic oligonucleotide; CAG chr11 5320984 5321003 5321000 +
tgactttattcactaatcaa

SEQ ID NO: 19626 - DNA, 20 bp, Artificial Sequence
  Synthetic oligonucleotide; TGG chr11 5320999 5321018 5321015 +
atcaacagttatttattgat

SEQ ID NO: 19627 - DNA, 20 bp, Artificial Sequence
  Synthetic oligonucleotide; GAG chr11 5321017 5321036 5321033 +
attggtcattgtacattaat

SEQ ID NO: 19628 - DNA, 20 bp, Artificial Sequence
  Synthetic oligonucleotide; TAG chr11 5321040 5321059 5321056 +
tgttttacatgctgactttg

SEQ ID NO: 19629 - DNA, 20 bp, Artificial Sequence
  Synthetic oligonucleotide; AAG chr11 5321045 5321064 5321061 +
tacatgctgactttgtagaa

SEQ ID NO: 19630 - DNA, 20 bp, Artificial Sequence
  Synthetic oligonucleotide; AAG chr11 5321051 5321070 5321067 +
ctgactttgtagaaaagatg

SEQ ID NO: 19631 - DNA, 20 bp, Artificial Sequence
  Synthetic oligonucleotide; GAG chr11 5321053 5321072 5321069 +
gactttgtagaaaagatgaa

SEQ ID NO: 19632 - DNA, 20 bp, Artificial Sequence
  Synthetic oligonucleotide; CAG chr11 5321059 5321078 5321075 +
gtagaaaagatgaagagaat

SEQ ID NO: 19633 - DNA, 20 bp, Artificial Sequence
  Synthetic oligonucleotide; AAG chr11 5321070 5321089 5321086 +
gaagagaatcagtttcaatg

SEQ ID NO: 19634 - DNA, 20 bp, Artificial Sequence
  Synthetic oligonucleotide; AAG chr11 5321084 5321103 5321100 +
tcaatgaagtgctttgcaca

SEQ ID NO: 19635 - DNA, 20 bp, Artificial Sequence
  Synthetic oligonucleotide; AGG chr11 5321085 5321104 5321101 +
caatgaagtgctttgcacaa

SEQ ID NO: 19636 - DNA, 20 bp, Artificial Sequence
  Synthetic oligonucleotide; TGG chr11 5321094 5321113 5321110 +
gctttgcacaaaggataccc

SEQ ID NO: 19637 - DNA, 20 bp, Artificial Sequence
  Synthetic oligonucleotide; GAG chr11 5321096 5321115 5321112 +
tttgcacaaaggataccctg

SEQ ID NO: 19638 - DNA, 20 bp, Artificial Sequence
  Synthetic oligonucleotide; CAG chr11 5321128 5321147 5321144 +
catatcattttcttttctaa

SEQ ID NO: 19639 - DNA, 20 bp, Artificial Sequence
  Synthetic oligonucleotide; TAG chr11 5321144 5321163 5321160 +
ctaacagtttcattaacata

SEQ ID NO: 19640 - DNA, 20 bp, Artificial Sequence
  Synthetic oligonucleotide; AGG chr11 5321145 5321164 5321161 +
taacagtttcattaacatat

SEQ ID NO: 19641 - DNA, 20 bp, Artificial Sequence
  Synthetic oligonucleotide; AAG chr11 5321150 5321169 5321166 +
gtttcattaacatataggta

SEQ ID NO: 19642 - DNA, 20 bp, Artificial Sequence
  Synthetic oligonucleotide; CAG chr11 5321154 5321173 5321170 +
cattaacatataggtaaaga

SEQ ID NO: 19643 - DNA, 20 bp, Artificial Sequence
  Synthetic oligonucleotide; AGG chr11 5321155 5321174 5321171 +
attaacatataggtaaagac

SEQ ID NO: 19644 - DNA, 20 bp, Artificial Sequence
  Synthetic oligonucleotide; TAG chr11 5321173 5321192 5321189 +
acaggatatcataattgaca

SEQ ID NO: 19645 - DNA, 20 bp, Artificial Sequence
  Synthetic oligonucleotide; CAG chr11 5321178 5321197 5321194 +
atatcataattgacatagta

SEQ ID NO: 19646 - DNA, 20 bp, Artificial Sequence
  Synthetic oligonucleotide; TAG chr11 5321190 5321209 5321206 +
acatagtacagtgtcattaa

SEQ ID NO: 19647 - DNA, 20 bp, Artificial Sequence
  Synthetic oligonucleotide; AGG chr11 5321191 5321210 5321207 +
catagtacagtgtcattaat

SEQ ID NO: 19648 - DNA, 20 bp, Artificial Sequence
  Synthetic oligonucleotide; CAG chr11 5321199 5321218 5321215 +
agtgtcattaataggttaat

SEQ ID NO: 19649 - DNA, 20 bp, Artificial Sequence
  Synthetic oligonucleotide; AGG chr11 5321200 5321219 5321216 +
gtgtcattaataggttaatc

SEQ ID NO: 19650 - DNA, 20 bp, Artificial Sequence
  Synthetic oligonucleotide; TGG chr11 5321208 5321227 5321224 +
aataggttaatcaggtcatg

SEQ ID NO: 19651 - DNA, 20 bp, Artificial Sequence
  Synthetic oligonucleotide; AAG chr11 5321213 5321232 5321229 +
gttaatcaggtcatgtggta

SEQ ID NO: 19652 - DNA, 20 bp, Artificial Sequence
  Synthetic oligonucleotide; TGG chr11 5321216 5321235 5321232 +
aatcaggtcatgtggtaaag

SEQ ID NO: 19653 - DNA, 20 bp, Artificial Sequence
  Synthetic oligonucleotide; GGG chr11 5321217 5321236 5321233 +
atcaggtcatgtggtaaagt

SEQ ID NO: 19654 - DNA, 20 bp, Artificial Sequence
  Synthetic oligonucleotide; AAG chr11 5321220 5321239 5321236 +
aggtcatgtggtaaagtggg

SEQ ID NO: 19655 - DNA, 20 bp, Artificial Sequence
  Synthetic oligonucleotide; AGG chr11 5321221 5321240 5321237 +
ggtcatgtggtaaagtggga

SEQ ID NO: 19656 - DNA, 20 bp, Artificial Sequence
  Synthetic oligonucleotide; AAG chr11 5321230 5321249 5321246 +
gtaaagtgggaaggctgaat

SEQ ID NO: 19657 - DNA, 20 bp, Artificial Sequence
  Synthetic oligonucleotide; AGG chr11 5321231 5321250 5321247 +
taaagtgggaaggctgaata

SEQ ID NO: 19658 - DNA, 20 bp, Artificial Sequence
  Synthetic oligonucleotide; TAG chr11 5321249 5321268 5321265 +
taaggatattattttgtttt

SEQ ID NO: 19659 - DNA, 20 bp, Artificial Sequence
  Synthetic oligonucleotide; GAG chr11 5321251 5321270 5321267 +
aggatattattttgttttta

SEQ ID NO: 19660 - DNA, 20 bp, Artificial Sequence
  Synthetic oligonucleotide; AAG chr11 5321260 5321279 5321276 +
ttttgtttttagagaattta

SEQ ID NO: 19661 - DNA, 20 bp, Artificial Sequence
  Synthetic oligonucleotide; AGG chr11 5321261 5321280 5321277 +
tttgtttttagagaatttaa

SEQ ID NO: 19662 - DNA, 20 bp, Artificial Sequence
  Synthetic oligonucleotide; AAG chr11 5321264 5321283 5321280 +
gtttttagagaatttaaagg

SEQ ID NO: 19663 - DNA, 20 bp, Artificial Sequence
  Synthetic oligonucleotide; CAG chr11 5321291 5321310 5321307 +
cctccttattaaaaatatga

SEQ ID NO: 19664 - DNA, 20 bp, Artificial Sequence
  Synthetic oligonucleotide; AAG chr11 5321294 5321313 5321310 +
ccttattaaaaatatgacag

SEQ ID NO: 19665 - DNA, 20 bp, Artificial Sequence
  Synthetic oligonucleotide; GAG chr11 5321296 5321315 5321312 +
ttattaaaaatatgacagaa

SEQ ID NO: 19666 - DNA, 20 bp, Artificial Sequence
  Synthetic oligonucleotide; TAG chr11 5321302 5321321 5321318 +
aaaatatgacagaagagtga

SEQ ID NO: 19667 - DNA, 20 bp, Artificial Sequence
  Synthetic oligonucleotide; TGG chr11 5321306 5321325 5321322 +
tatgacagaagagtgatagc

SEQ ID NO: 19668 - DNA, 20 bp, Artificial Sequence
  Synthetic oligonucleotide; TGG chr11 5321311 5321330 5321327 +
cagaagagtgatagctggtt

SEQ ID NO: 19669 - DNA, 20 bp, Artificial Sequence
  Synthetic oligonucleotide; AAG chr11 5321321 5321340 5321337 +
atagctggtttggtttaatg

SEQ ID NO: 19670 - DNA, 20 bp, Artificial Sequence
  Synthetic oligonucleotide; TGG chr11 5321327 5321346 5321343 +
ggtttggtttaatgaagtat

SEQ ID NO: 19671 - DNA, 20 bp, Artificial Sequence
  Synthetic oligonucleotide; CAG chr11 5321340 5321359 5321356 +
gaagtattggcttgtgccct

SEQ ID NO: 19672 - DNA, 20 bp, Artificial Sequence
  Synthetic oligonucleotide; AAG chr11 5321343 5321362 5321359 +
gtattggcttgtgccctcag

SEQ ID NO: 19673 - DNA, 20 bp, Artificial Sequence
  Synthetic oligonucleotide; AGG chr11 5321344 5321363 5321360 +
tattggcttgtgccctcaga

SEQ ID NO: 19674 - DNA, 20 bp, Artificial Sequence
  Synthetic oligonucleotide; GGG chr11 5321345 5321364 5321361 +
attggcttgtgccctcagaa

SEQ ID NO: 19675 - DNA, 20 bp, Artificial Sequence
  Synthetic oligonucleotide; AAG chr11 5321369 5321388 5321385 +
ctgtgtatcttttatcatga

SEQ ID NO: 19676 - DNA, 20 bp, Artificial Sequence
  Synthetic oligonucleotide; CAG chr11 5321381 5321400 5321397 +
tatcatgaaagttgatattt

SEQ ID NO: 19677 - DNA, 20 bp, Artificial Sequence
  Synthetic oligonucleotide; GAG chr11 5321383 5321402 5321399 +
tcatgaaagttgatatttca

SEQ ID NO: 19678 - DNA, 20 bp, Artificial Sequence
  Synthetic oligonucleotide; TAG chr11 5321397 5321416 5321413 +
atttcagagcactaataact

SEQ ID NO: 19679 - DNA, 20 bp, Artificial Sequence
  Synthetic oligonucleotide; AAG chr11 5321415 5321434 5321431 +
cttagtttccttctatgtaa

SEQ ID NO: 19680 - DNA, 20 bp, Artificial Sequence
  Synthetic oligonucleotide; AAG chr11 5321423 5321442 5321439 +
ccttctatgtaaaagatgaa

SEQ ID NO: 19681 - DNA, 20 bp, Artificial Sequence
  Synthetic oligonucleotide; TAG chr11 5321445 5321464 5321461 +
gtctcaatgaaataaaatgc

SEQ ID NO: 19682 - DNA, 20 bp, Artificial Sequence
  Synthetic oligonucleotide; TGG chr11 5321448 5321467 5321464 +
tcaatgaaataaaatgctag

SEQ ID NO: 19683 - DNA, 20 bp, Artificial Sequence
  Synthetic oligonucleotide; CAG chr11 5321454 5321473 5321470 +
aaataaaatgctagtggatt

SEQ ID NO: 19684 - DNA, 20 bp, Artificial Sequence
  Synthetic oligonucleotide; TAG chr11 5321467 5321486 5321483 +
gtggattcagatcaccctct

SEQ ID NO: 19685 - DNA, 20 bp, Artificial Sequence
  Synthetic oligonucleotide; AAG chr11 5321506 5321525 5321522 +
attttctttaaacaaccatg

SEQ ID NO: 19686 - DNA, 20 bp, Artificial Sequence
  Synthetic oligonucleotide; AGG chr11 5321507 5321526 5321523 +
ttttctttaaacaaccatga

SEQ ID NO: 19687 - DNA, 20 bp, Artificial Sequence
  Synthetic oligonucleotide; AAG chr11 5321514 5321533 5321530 +
taaacaaccatgaaggcacc

SEQ ID NO: 19688 - DNA, 20 bp, Artificial Sequence
  Synthetic oligonucleotide; CAG chr11 5321519 5321538 5321535 +
aaccatgaaggcaccaagaa

SEQ ID NO: 19689 - DNA, 20 bp, Artificial Sequence
  Synthetic oligonucleotide; GAG chr11 5321521 5321540 5321537 +
ccatgaaggcaccaagaaca

SEQ ID NO: 19690 - DNA, 20 bp, Artificial Sequence
  Synthetic oligonucleotide; CAG chr11 5321540 5321559 5321556 +
agagaattcaacgtctaaac

SEQ ID NO: 19691 - DNA, 20 bp, Artificial Sequence
  Synthetic oligonucleotide; AAG chr11 5321546 5321565 5321562 +
ttcaacgtctaaaccagttt

SEQ ID NO: 19692 - DNA, 20 bp, Artificial Sequence
  Synthetic oligonucleotide; AGG chr11 5321547 5321566 5321563 +
tcaacgtctaaaccagttta

SEQ ID NO: 19693 - DNA, 20 bp, Artificial Sequence
  Synthetic oligonucleotide; TGG chr11 5321587 5321606 5321603 +
aaacatatttcccaataatt

SEQ ID NO: 19694 - DNA, 20 bp, Artificial Sequence
  Synthetic oligonucleotide; GGG chr11 5321588 5321607 5321604 +
aacatatttcccaataattt

SEQ ID NO: 19695 - DNA, 20 bp, Artificial Sequence
  Synthetic oligonucleotide; TGG chr11 5321603 5321622 5321619 +
aatttgggcttctttcatct

SEQ ID NO: 19696 - DNA, 20 bp, Artificial Sequence
  Synthetic oligonucleotide; AAG chr11 5321625 5321644 5321641 +
gaaacaacactgcttatcca

SEQ ID NO: 19697 - DNA, 20 bp, Artificial Sequence
  Synthetic oligonucleotide; AAG chr11 5321629 5321648 5321645 +
caacactgcttatccaaagt

SEQ ID NO: 19698 - DNA, 20 bp, Artificial Sequence
  Synthetic oligonucleotide; CAG chr11 5321650 5321669 5321666 +
agcacctccttatacctatt

SEQ ID NO: 19699 - DNA, 20 bp, Artificial Sequence
  Synthetic oligonucleotide; GAG chr11 5321654 5321673 5321670 +
cctccttatacctattcagt

SEQ ID NO: 19700 - DNA, 20 bp, Artificial Sequence
  Synthetic oligonucleotide; AGG chr11 5321655 5321674 5321671 +
ctccttatacctattcagtg

SEQ ID NO: 19701 - DNA, 20 bp, Artificial Sequence
  Synthetic oligonucleotide; AAG chr11 5321697 5321716 5321713 +
tcaacccaccatatacacaa

SEQ ID NO: 19702 - DNA, 20 bp, Artificial Sequence
  Synthetic oligonucleotide; AGG chr11 5321698 5321717 5321714 +
caacccaccatatacacaaa

SEQ ID NO: 19703 - DNA, 20 bp, Artificial Sequence
  Synthetic oligonucleotide; CAG chr11 5321706 5321725 5321722 +
catatacacaaaaggcatgc

SEQ ID NO: 19704 - DNA, 20 bp, Artificial Sequence
  Synthetic oligonucleotide; TGG chr11 5321725 5321744 5321741 +
ccagtgatgctgctccatca

SEQ ID NO: 19705 - DNA, 20 bp, Artificial Sequence
  Synthetic oligonucleotide; TGG chr11 5321756 5321775 5321772 +
ttccttatttctcacacatg

SEQ ID NO: 19706 - DNA, 20 bp, Artificial Sequence
  Synthetic oligonucleotide; CAG chr11 5321759 5321778 5321775 +
cttatttctcacacatgtgg

SEQ ID NO: 19707 - DNA, 20 bp, Artificial Sequence
  Synthetic oligonucleotide; AGG chr11 5321760 5321779 5321776 +
ttatttctcacacatgtggc

SEQ ID NO: 19708 - DNA, 20 bp, Artificial Sequence
  Synthetic oligonucleotide; TGG chr11 5321774 5321793 5321790 +
tgtggcaggtaattaaacta

SEQ ID NO: 19709 - DNA, 20 bp, Artificial Sequence
  Synthetic oligonucleotide; AAG chr11 5321781 5321800 5321797 +
ggtaattaaactatggcttg

SEQ ID NO: 19710 - DNA, 20 bp, Artificial Sequence
  Synthetic oligonucleotide; TGG chr11 5321787 5321806 5321803 +
taaactatggcttgaagtcc

SEQ ID NO: 19711 - DNA, 20 bp, Artificial Sequence
  Synthetic oligonucleotide; TGG chr11 5321793 5321812 5321809 +
atggcttgaagtcctggcct

SEQ ID NO: 19712 - DNA, 20 bp, Artificial Sequence
  Synthetic oligonucleotide; CAG chr11 5321797 5321816 5321813 +
cttgaagtcctggccttggc

SEQ ID NO: 19713 - DNA, 20 bp, Artificial Sequence
  Synthetic oligonucleotide; AAG chr11 5321807 5321826 5321823 +
tggccttggccagttaaact

SEQ ID NO: 19714 - DNA, 20 bp, Artificial Sequence
  Synthetic oligonucleotide; GAG chr11 5321809 5321828 5321825 +
gccttggccagttaaactaa

SEQ ID NO: 19715 - DNA, 20 bp, Artificial Sequence
  Synthetic oligonucleotide; CAG chr11 5321840 5321859 5321856 +
tcaaatgtatcactgtaaaa

SEQ ID NO: 19716 - DNA, 20 bp, Artificial Sequence
  Synthetic oligonucleotide; TAG chr11 5321844 5321863 5321860 +
atgtatcactgtaaaacaga

SEQ ID NO: 19717 - DNA, 20 bp, Artificial Sequence
  Synthetic oligonucleotide; TAG chr11 5321862 5321881 5321878 +
gatagcctatcctcaaaatt

SEQ ID NO: 19718 - DNA, 20 bp, Artificial Sequence
  Synthetic oligonucleotide; CAG chr11 5321869 5321888 5321885 +
tatcctcaaaatttagatat

SEQ ID NO: 19719 - DNA, 20 bp, Artificial Sequence
  Synthetic oligonucleotide; TGG chr11 5321873 5321892 5321889 +
ctcaaaatttagatatcaga

SEQ ID NO: 19720 - DNA, 20 bp, Artificial Sequence
  Synthetic oligonucleotide; GGG chr11 5321874 5321893 5321890 +
tcaaaatttagatatcagat

SEQ ID NO: 19721 - DNA, 20 bp, Artificial Sequence
  Synthetic oligonucleotide; GGG chr11 5321875 5321894 5321891 +
caaaatttagatatcagatg

SEQ ID NO: 19722 - DNA, 20 bp, Artificial Sequence
  Synthetic oligonucleotide; CAG chr11 5321889 5321908 5321905 +
cagatggggatataatatcg

SEQ ID NO: 19723 - DNA, 20 bp, Artificial Sequence
  Synthetic oligonucleotide; CAG chr11 5321908 5321927 5321924 +
gcagtaacttgtgattacca

SEQ ID NO: 19724 - DNA, 20 bp, Artificial Sequence
  Synthetic oligonucleotide; CAG chr11 5321928 5321947 5321944 +
cagcaacttgtgatgtccca

SEQ ID NO: 19725 - DNA, 20 bp, Artificial Sequence
  Synthetic oligonucleotide; AAG chr11 5321944 5321963 5321960 +
cccacagcttctgttctaca

SEQ ID NO: 19726 - DNA, 20 bp, Artificial Sequence
  Synthetic oligonucleotide; TGG chr11 5321948 5321967 5321964 +
cagcttctgttctacaaaga

SEQ ID NO: 19727 - DNA, 20 bp, Artificial Sequence
  Synthetic oligonucleotide; GGG chr11 5321949 5321968 5321965 +
agcttctgttctacaaagat

SEQ ID NO: 19728 - DNA, 20 bp, Artificial Sequence
  Synthetic oligonucleotide; AAG chr11 5321957 5321976 5321973 +
ttctacaaagatgggaaaca

SEQ ID NO: 19729 - DNA, 20 bp, Artificial Sequence
  Synthetic oligonucleotide; AGG chr11 5321958 5321977 5321974 +
tctacaaagatgggaaacaa

SEQ ID NO: 19730 - DNA, 20 bp, Artificial Sequence
  Synthetic oligonucleotide; CAG chr11 5321961 5321980 5321977 +
acaaagatgggaaacaaagg

SEQ ID NO: 19731 - DNA, 20 bp, Artificial Sequence
  Synthetic oligonucleotide; AGG chr11 5321962 5321981 5321978 +
caaagatgggaaacaaaggc

SEQ ID NO: 19732 - DNA, 20 bp, Artificial Sequence
  Synthetic oligonucleotide; CAG chr11 5321972 5321991 5321988 +
aaacaaaggcaggctttcct

SEQ ID NO: 19733 - DNA, 20 bp, Artificial Sequence
  Synthetic oligonucleotide; AAG chr11 5321979 5321998 5321995 +
ggcaggctttcctcagctac

SEQ ID NO: 19734 - DNA, 20 bp, Artificial Sequence
  Synthetic oligonucleotide; GAG chr11 5321981 5322000 5321997 +
caggctttcctcagctacaa

SEQ ID NO: 19735 - DNA, 20 bp, Artificial Sequence
  Synthetic oligonucleotide; AGG chr11 5321982 5322001 5321998 +
aggctttcctcagctacaag

SEQ ID NO: 19736 - DNA, 20 bp, Artificial Sequence
  Synthetic oligonucleotide; AAG chr11 5321994 5322013 5322010 +
gctacaagaggttctgcatc

SEQ ID NO: 19737 - DNA, 20 bp, Artificial Sequence
  Synthetic oligonucleotide; TAG chr11 5321998 5322017 5322014 +
caagaggttctgcatcaaga

SEQ ID NO: 19738 - DNA, 20 bp, Artificial Sequence
  Synthetic oligonucleotide; AAG chr11 5322007 5322026 5322023 +
ctgcatcaagatagcaaatc

SEQ ID NO: 19739 - DNA, 20 bp, Artificial Sequence
  Synthetic oligonucleotide; TGG chr11 5322011 5322030 5322027 +
atcaagatagcaaatcaaga

SEQ ID NO: 19740 - DNA, 20 bp, Artificial Sequence
  Synthetic oligonucleotide; GGG chr11 5322012 5322031 5322028 +
tcaagatagcaaatcaagat

SEQ ID NO: 19741 - DNA, 20 bp, Artificial Sequence
  Synthetic oligonucleotide; GAG chr11 5322028 5322047 5322044 +
agatgggaattatccgaaat

SEQ ID NO: 19742 - DNA, 20 bp, Artificial Sequence
  Synthetic oligonucleotide; AAG chr11 5322042 5322061 5322058 +
cgaaatgagatttttccatt

SEQ ID NO: 19743 - DNA, 20 bp, Artificial Sequence
  Synthetic oligonucleotide; TAG chr11 5322050 5322069 5322066 +
gatttttccattaagatgcc

SEQ ID NO: 19744 - DNA, 20 bp, Artificial Sequence
  Synthetic oligonucleotide; TAG chr11 5322061 5322080 5322077 +
taagatgcctagatgtatta

SEQ ID NO: 19745 - DNA, 20 bp, Artificial Sequence
  Synthetic oligonucleotide; TGG chr11 5322070 5322089 5322086 +
tagatgtattatagacctca

SEQ ID NO: 19746 - DNA, 20 bp, Artificial Sequence
  Synthetic oligonucleotide; AAG chr11 5322081 5322100 5322097 +
tagacctcatggtcacatat

SEQ ID NO: 19747 - DNA, 20 bp, Artificial Sequence
  Synthetic oligonucleotide; AGG chr11 5322082 5322101 5322098 +
agacctcatggtcacatata

SEQ ID NO: 19748 - DNA, 20 bp, Artificial Sequence
  Synthetic oligonucleotide; CAG chr11 5322087 5322106 5322103 +
tcatggtcacatataaggaa

SEQ ID NO: 19749 - DNA, 20 bp, Artificial Sequence
  Synthetic oligonucleotide; GAG chr11 5322089 5322108 5322105 +
atggtcacatataaggaaca

SEQ ID NO: 19750 - DNA, 20 bp, Artificial Sequence
  Synthetic oligonucleotide; AAG chr11 5322093 5322112 5322109 +
tcacatataaggaacagaga

SEQ ID NO: 19751 - DNA, 20 bp, Artificial Sequence
  Synthetic oligonucleotide; TGG chr11 5322100 5322119 5322116 +
taaggaacagagaaagtctt

SEQ ID NO: 19752 - DNA, 20 bp, Artificial Sequence
  Synthetic oligonucleotide; TAG chr11 5322103 5322122 5322119 +
ggaacagagaaagtctttgg

SEQ ID NO: 19753 - DNA, 20 bp, Artificial Sequence
  Synthetic oligonucleotide; TAG chr11 5322118 5322137 5322134 +
tttggtagataactgacttt

SEQ ID NO: 19754 - DNA, 20 bp, Artificial Sequence
  Synthetic oligonucleotide; AGG chr11 5322119 5322138 5322135 +
ttggtagataactgactttt

SEQ ID NO: 19755 - DNA, 20 bp, Artificial Sequence
  Synthetic oligonucleotide; GAG chr11 5322126 5322145 5322142 +
ataactgacttttaggattt

SEQ ID NO: 19756 - DNA, 20 bp, Artificial Sequence
  Synthetic oligonucleotide; CAG chr11 5322137 5322156 5322153 +
ttaggatttgagtttatatt

SEQ ID NO: 19757 - DNA, 20 bp, Artificial Sequence
  Synthetic oligonucleotide; GAG chr11 5322166 5322185 5322182 +
taacttgaacattatactct

SEQ ID NO: 19758 - DNA, 20 bp, Artificial Sequence
  Synthetic oligonucleotide; TAG chr11 5322170 5322189 5322186 +
ttgaacattatactctgaga

SEQ ID NO: 19759 - DNA, 20 bp, Artificial Sequence
  Synthetic oligonucleotide; AGG chr11 5322171 5322190 5322187 +
tgaacattatactctgagat

SEQ ID NO: 19760 - DNA, 20 bp, Artificial Sequence
  Synthetic oligonucleotide; TGG chr11 5322194 5322213 5322210 +
ttttccccttttgaaatttg

SEQ ID NO: 19761 - DNA, 20 bp, Artificial Sequence
  Synthetic oligonucleotide; CAG chr11 5322223 5322242 5322239 +
atcctgtttcacaattaaat

SEQ ID NO: 19762 - DNA, 20 bp, Artificial Sequence
  Synthetic oligonucleotide; AAG chr11 5322231 5322250 5322247 +
tcacaattaaatcagtctaa

SEQ ID NO: 19763 - DNA, 20 bp, Artificial Sequence
  Synthetic oligonucleotide; AAG chr11 5322234 5322253 5322250 +
caattaaatcagtctaaaag

SEQ ID NO: 19764 - DNA, 20 bp, Artificial Sequence
  Synthetic oligonucleotide; TAG chr11 5322241 5322260 5322257 +
atcagtctaaaagaagcttt

SEQ ID NO: 19765 - DNA, 20 bp, Artificial Sequence
  Synthetic oligonucleotide; CAG chr11 5322248 5322267 5322264 +
taaaagaagcttttagtaca

SEQ ID NO: 19766 - DNA, 20 bp, Artificial Sequence
  Synthetic oligonucleotide; TAG chr11 5322282 5322301 5322298 +
ctcctcccaccacaattttt

SEQ ID NO: 19767 - DNA, 20 bp, Artificial Sequence
  Synthetic oligonucleotide; TGG chr11 5322289 5322308 5322305 +
caccacaattttttagtcat

SEQ ID NO: 19768 - DNA, 20 bp, Artificial Sequence
  Synthetic oligonucleotide; TGG chr11 5322323 5322342 5322339 +
tccatttctctcaacattgt

SEQ ID NO: 19769 - DNA, 20 bp, Artificial Sequence
  Synthetic oligonucleotide; TAG chr11 5322337 5322356 5322353 +
cattgttggtcttcctaata

SEQ ID NO: 19770 - DNA, 20 bp, Artificial Sequence
  Synthetic oligonucleotide; GAG chr11 5322339 5322358 5322355 +
ttgttggtcttcctaatata

SEQ ID NO: 19771 - DNA, 20 bp, Artificial Sequence
  Synthetic oligonucleotide; GAG chr11 5322341 5322360 5322357 +
gttggtcttcctaatataga

SEQ ID NO: 19772 - DNA, 20 bp, Artificial Sequence
  Synthetic oligonucleotide; CAG chr11 5322348 5322367 5322364 +
ttcctaatatagagagttta

SEQ ID NO: 19773 - DNA, 20 bp, Artificial Sequence
  Synthetic oligonucleotide; TAG chr11 5322351 5322370 5322367 +
ctaatatagagagtttacag

SEQ ID NO: 19774 - DNA, 20 bp, Artificial Sequence
  Synthetic oligonucleotide; CAG chr11 5322358 5322377 5322374 +
agagagtttacagtagatgt

SEQ ID NO: 19775 - DNA, 20 bp, Artificial Sequence
  Synthetic oligonucleotide; GAG chr11 5322360 5322379 5322376 +
agagtttacagtagatgtca

SEQ ID NO: 19776 - DNA, 20 bp, Artificial Sequence
  Synthetic oligonucleotide; AAG chr11 5322364 5322383 5322380 +
tttacagtagatgtcagaga

SEQ ID NO: 19777 - DNA, 20 bp, Artificial Sequence
  Synthetic oligonucleotide; TGG chr11 5322373 5322392 5322389 +
gatgtcagagaaagtattta

SEQ ID NO: 19778 - DNA, 20 bp, Artificial Sequence
  Synthetic oligonucleotide; AAG chr11 5322379 5322398 5322395 +
agagaaagtatttatggcaa

SEQ ID NO: 19779 - DNA, 20 bp, Artificial Sequence
  Synthetic oligonucleotide; AAG chr11 5322419 5322438 5322435 +
tttccctctgaacatatata

SEQ ID NO: 19780 - DNA, 20 bp, Artificial Sequence
  Synthetic oligonucleotide; AAG chr11 5322437 5322456 5322453 +
taaagtatatataacttgtg

SEQ ID NO: 19781 - DNA, 20 bp, Artificial Sequence
  Synthetic oligonucleotide; TAG chr11 5322465 5322484 5322481 +
atgtctcatatttttcattc

SEQ ID NO: 19782 - DNA, 20 bp, Artificial Sequence
  Synthetic oligonucleotide; TGG chr11 5322470 5322489 5322486 +
tcatatttttcattctagaa

SEQ ID NO: 19783 - DNA, 20 bp, Artificial Sequence
  Synthetic oligonucleotide; TAG chr11 5322493 5322512 5322509 +
ctatattttctatttttgaa

SEQ ID NO: 19784 - DNA, 20 bp, Artificial Sequence
  Synthetic oligonucleotide; GAG chr11 5322495 5322514 5322511 +
atattttctatttttgaata

SEQ ID NO: 19785 - DNA, 20 bp, Artificial Sequence
  Synthetic oligonucleotide; TAG chr11 5322517 5322536 5322533 +
gccttgacccttcctattat

SEQ ID NO: 19786 - DNA, 20 bp, Artificial Sequence
  Synthetic oligonucleotide; AGG chr11 5322518 5322537 5322534 +
ccttgacccttcctattatt

SEQ ID NO: 19787 - DNA, 20 bp, Artificial Sequence
  Synthetic oligonucleotide; AAG chr11 5322523 5322542 5322539 +
acccttcctattattaggcc

SEQ ID NO: 19788 - DNA, 20 bp, Artificial Sequence
  Synthetic oligonucleotide; AGG chr11 5322524 5322543 5322540 +
cccttcctattattaggcca

SEQ ID NO: 19789 - DNA, 20 bp, Artificial Sequence
  Synthetic oligonucleotide; GGG chr11 5322525 5322544 5322541 +
ccttcctattattaggccaa

SEQ ID NO: 19790 - DNA, 20 bp, Artificial Sequence
  Synthetic oligonucleotide; AAG chr11 5322530 5322549 5322546 +
ctattattaggccaagggaa

SEQ ID NO: 19791 - DNA, 20 bp, Artificial Sequence
  Synthetic oligonucleotide; AAG chr11 5322550 5322569 5322566 +
aagtatgttaaaatcatctg

SEQ ID NO: 19792 - DNA, 20 bp, Artificial Sequence
  Synthetic oligonucleotide; GAG chr11 5322552 5322571 5322568 +
gtatgttaaaatcatctgaa

SEQ ID NO: 19793 - DNA, 20 bp, Artificial Sequence
  Synthetic oligonucleotide; GAG chr11 5322593 5322612 5322609 +
ctcactttttacttttttac

SEQ ID NO: 19794 - DNA, 20 bp, Artificial Sequence
  Synthetic oligonucleotide; AAG chr11 5322601 5322620 5322617 +
ttacttttttacgagctgac

SEQ ID NO: 19795 - DNA, 20 bp, Artificial Sequence
  Synthetic oligonucleotide; AAG chr11 5322604 5322623 5322620 +
cttttttacgagctgacaag

SEQ ID NO: 19796 - DNA, 20 bp, Artificial Sequence
  Synthetic oligonucleotide; TAG chr11 5322613 5322632 5322629 +
gagctgacaagaagcttgtc

SEQ ID NO: 19797 - DNA, 20 bp, Artificial Sequence
  Synthetic oligonucleotide; AGG chr11 5322614 5322633 5322630 +
agctgacaagaagcttgtct

SEQ ID NO: 19798 - DNA, 20 bp, Artificial Sequence
  Synthetic oligonucleotide; AAG chr11 5322628 5322647 5322644 +
ttgtctaggtttttccttct

SEQ ID NO: 19799 - DNA, 20 bp, Artificial Sequence
  Synthetic oligonucleotide; TGG chr11 5322638 5322657 5322654 +
ttttccttctaagatttttt

SEQ ID NO: 19800 - DNA, 20 bp, Artificial Sequence
  Synthetic oligonucleotide; GGG chr11 5322639 5322658 5322655 +
tttccttctaagattttttt

SEQ ID NO: 19801 - DNA, 20 bp, Artificial Sequence
  Synthetic oligonucleotide; AAG chr11 5322645 5322664 5322661 +
tctaagatttttttgggcaa

SEQ ID NO: 19802 - DNA, 20 bp, Artificial Sequence
  Synthetic oligonucleotide; TAG chr11 5322656 5322675 5322672 +
tttgggcaaaagaatattta

SEQ ID NO: 19803 - DNA, 20 bp, Artificial Sequence
  Synthetic oligonucleotide; AAG chr11 5322659 5322678 5322675 +
gggcaaaagaatatttatag

SEQ ID NO: 19804 - DNA, 20 bp, Artificial Sequence
  Synthetic oligonucleotide; GAG chr11 5322665 5322684 5322681 +
aagaatatttatagaagaat

SEQ ID NO: 19805 - DNA, 20 bp, Artificial Sequence
  Synthetic oligonucleotide; AGG chr11 5322666 5322685 5322682 +
agaatatttatagaagaatg

SEQ ID NO: 19806 - DNA, 20 bp, Artificial Sequence
  Synthetic oligonucleotide; AAG chr11 5322671 5322690 5322687 +
atttatagaagaatgaggta

SEQ ID NO: 19807 - DNA, 20 bp, Artificial Sequence
  Synthetic oligonucleotide; CAG chr11 5322694 5322713 5322710 +
aaatacacttttataaaatc

SEQ ID NO: 19808 - DNA, 20 bp, Artificial Sequence
  Synthetic oligonucleotide; AAG chr11 5322706 5322725 5322722 +
ataaaatccagacatcctgc

SEQ ID NO: 19809 - DNA, 20 bp, Artificial Sequence
  Synthetic oligonucleotide; AGG chr11 5322707 5322726 5322723 +
taaaatccagacatcctgca

SEQ ID NO: 19810 - DNA, 20 bp, Artificial Sequence
  Synthetic oligonucleotide; AAG chr11 5322728 5322747 5322744 +
ggaatgtattgaaaattaaa

SEQ ID NO: 19811 - DNA, 20 bp, Artificial Sequence
  Synthetic oligonucleotide; AAG chr11 5322751 5322770 5322767 +
ctcttattgaaatactctgt

SEQ ID NO: 19812 - DNA, 20 bp, Artificial Sequence
  Synthetic oligonucleotide; TAG chr11 5322771 5322790 5322787 +
aagtgacttacgactgtatt

SEQ ID NO: 19813 - DNA, 20 bp, Artificial Sequence
  Synthetic oligonucleotide; TGG chr11 5322794 5322813 5322810 +
aaaatattaaatgcaaatca

SEQ ID NO: 19814 - DNA, 20 bp, Artificial Sequence
  Synthetic oligonucleotide; TAG chr11 5322800 5322819 5322816 +
ttaaatgcaaatcatggccc

SEQ ID NO: 19815 - DNA, 20 bp, Artificial Sequence
  Synthetic oligonucleotide; GAG chr11 5322802 5322821 5322818 +
aaatgcaaatcatggcccta

SEQ ID NO: 19816 - DNA, 20 bp, Artificial Sequence
  Synthetic oligonucleotide; GAG chr11 5322804 5322823 5322820 +
atgcaaatcatggccctaga

SEQ ID NO: 19817 - DNA, 20 bp, Artificial Sequence
  Synthetic oligonucleotide; CAG chr11 5322817 5322836 5322833 +
ccctagagagtaccctaact

SEQ ID NO: 19818 - DNA, 20 bp, Artificial Sequence
  Synthetic oligonucleotide; AGG chr11 5322818 5322837 5322834 +
cctagagagtaccctaactc

SEQ ID NO: 19819 - DNA, 20 bp, Artificial Sequence
  Synthetic oligonucleotide; GGG chr11 5322819 5322838 5322835 +
ctagagagtaccctaactca

SEQ ID NO: 19820 - DNA, 20 bp, Artificial Sequence
  Synthetic oligonucleotide; TAG chr11 5322822 5322841 5322838 +
gagagtaccctaactcaggg

SEQ ID NO: 19821 - DNA, 20 bp, Artificial Sequence
  Synthetic oligonucleotide; GAG chr11 5322824 5322843 5322840 +
gagtaccctaactcagggta

SEQ ID NO: 19822 - DNA, 20 bp, Artificial Sequence
  Synthetic oligonucleotide; AGG chr11 5322825 5322844 5322841 +
agtaccctaactcagggtag

SEQ ID NO: 19823 - DNA, 20 bp, Artificial Sequence
  Synthetic oligonucleotide; CAG chr11 5322829 5322848 5322845 +
ccctaactcagggtagagga

SEQ ID NO: 19824 - DNA, 20 bp, Artificial Sequence
  Synthetic oligonucleotide; AAG chr11 5322836 5322855 5322852 +
tcagggtagaggacagttaa

SEQ ID NO: 19825 - DNA, 20 bp, Artificial Sequence
  Synthetic oligonucleotide; AAG chr11 5322862 5322881 5322878 +
accaacacttacttatttaa

SEQ ID NO: 19826 - DNA, 20 bp, Artificial Sequence
  Synthetic oligonucleotide; TAG chr11 5322879 5322898 5322895 +
taaaagtaaatttaaaatgt

SEQ ID NO: 19827 - DNA, 20 bp, Artificial Sequence
  Synthetic oligonucleotide; GAG chr11 5322905 5322924 5322921 +
cttatcactatatttgccat

SEQ ID NO: 19828 - DNA, 20 bp, Artificial Sequence
  Synthetic oligonucleotide; AAG chr11 5322927 5322946 5322943 +
gaataatgaaaattttaaat

SEQ ID NO: 19829 - DNA, 20 bp, Artificial Sequence
  Synthetic oligonucleotide; TAG chr11 5322940 5322959 5322956 +
tttaaataagaatttatttc

SEQ ID NO: 19830 - DNA, 20 bp, Artificial Sequence
  Synthetic oligonucleotide; GAG chr11 5322942 5322961 5322958 +
taaataagaatttatttcta

SEQ ID NO: 19831 - DNA, 20 bp, Artificial Sequence
  Synthetic oligonucleotide; TAG chr11 5322982 5323001 5322998 +
ttttttacacttgtgtgcat

SEQ ID NO: 19832 - DNA, 20 bp, Artificial Sequence
  Synthetic oligonucleotide; GAG chr11 5323027 5323046 5323043 +
tatgcacaaatgtgcacact

SEQ ID NO: 19833 - DNA, 20 bp, Artificial Sequence
  Synthetic oligonucleotide; AGG chr11 5323028 5323047 5323044 +
atgcacaaatgtgcacactg

SEQ ID NO: 19834 - DNA, 20 bp, Artificial Sequence
  Synthetic oligonucleotide; AAG chr11 5323034 5323053 5323050 +
aaatgtgcacactgaggcaa

SEQ ID NO: 19835 - DNA, 20 bp, Artificial Sequence
  Synthetic oligonucleotide; TAG chr11 5323044 5323063 5323060 +
actgaggcaaaagtttttca

SEQ ID NO: 19836 - DNA, 20 bp, Artificial Sequence
  Synthetic oligonucleotide; GAG chr11 5323046 5323065 5323062 +
tgaggcaaaagtttttcata

SEQ ID NO: 19837 - DNA, 20 bp, Artificial Sequence
  Synthetic oligonucleotide; GAG chr11 5323082 5323101 5323098 +
ccttttcctcaaatttcact

SEQ ID NO: 19838 - DNA, 20 bp, Artificial Sequence
  Synthetic oligonucleotide; AGG chr11 5323083 5323102 5323099 +
cttttcctcaaatttcactg

SEQ ID NO: 19839 - DNA, 20 bp, Artificial Sequence
  Synthetic oligonucleotide; TGG chr11 5323086 5323105 5323102 +
ttcctcaaatttcactgagg

SEQ ID NO: 19840 - DNA, 20 bp, Artificial Sequence
  Synthetic oligonucleotide; CAG chr11 5323096 5323115 5323112 +
ttcactgaggtggctaattt

SEQ ID NO: 19841 - DNA, 20 bp, Artificial Sequence
  Synthetic oligonucleotide; AGG chr11 5323097 5323116 5323113 +
tcactgaggtggctaatttc

SEQ ID NO: 19842 - DNA, 20 bp, Artificial Sequence
  Synthetic oligonucleotide; AAG chr11 5323109 5323128 5323125 +
ctaatttcaggtgcatttga

SEQ ID NO: 19843 - DNA, 20 bp, Artificial Sequence
  Synthetic oligonucleotide; AAG chr11 5323112 5323131 5323128 +
atttcaggtgcatttgaaag

SEQ ID NO: 19844 - DNA, 20 bp, Artificial Sequence
  Synthetic oligonucleotide; TAG chr11 5323125 5323144 5323141 +
ttgaaagaagaatttaaata

SEQ ID NO: 19845 - DNA, 20 bp, Artificial Sequence
  Synthetic oligonucleotide; CAG chr11 5323135 5323154 5323151 +
aatttaaatatagacttttt

SEQ ID NO: 19846 - DNA, 20 bp, Artificial Sequence
  Synthetic oligonucleotide; TGG chr11 5323145 5323164 5323161 +
tagactttttcagttccata

SEQ ID NO: 19847 - DNA, 20 bp, Artificial Sequence
  Synthetic oligonucleotide; CAG chr11 5323154 5323173 5323170 +
tcagttccatatggtctatt

SEQ ID NO: 19848 - DNA, 20 bp, Artificial Sequence
  Synthetic oligonucleotide; CAG chr11 5323168 5323187 5323184 +
tctattcagtgttctgtcac

SEQ ID NO: 19849 - DNA, 20 bp, Artificial Sequence
  Synthetic oligonucleotide; AAG chr11 5323180 5323199 5323196 +
tctgtcaccagacttctcct

SEQ ID NO: 19850 - DNA, 20 bp, Artificial Sequence
  Synthetic oligonucleotide; TGG chr11 5323200 5323219 5323216 +
aagatatgcccccaacccta

SEQ ID NO: 19851 - DNA, 20 bp, Artificial Sequence
  Synthetic oligonucleotide; AAG chr11 5323205 5323224 5323221 +
atgcccccaaccctatggta

SEQ ID NO: 19852 - DNA, 20 bp, Artificial Sequence
  Synthetic oligonucleotide; AAG chr11 5323213 5323232 5323229 +
aaccctatggtaaagtactt

SEQ ID NO: 19853 - DNA, 20 bp, Artificial Sequence
  Synthetic oligonucleotide; GAG chr11 5323223 5323242 5323239 +
taaagtacttaagtccttgt

SEQ ID NO: 19854 - DNA, 20 bp, Artificial Sequence
  Synthetic oligonucleotide; CAG chr11 5323242 5323261 5323258 +
tgagtgacaacattgtcttc

SEQ ID NO: 19855 - DNA, 20 bp, Artificial Sequence
  Synthetic oligonucleotide; AAG chr11 5323264 5323283 5323280 +
gtatacccttgctctttgct

SEQ ID NO: 19856 - DNA, 20 bp, Artificial Sequence
  Synthetic oligonucleotide; AAG chr11 5323268 5323287 5323284 +
acccttgctctttgctaaga

SEQ ID NO: 19857 - DNA, 20 bp, Artificial Sequence
  Synthetic oligonucleotide; CAG chr11 5323276 5323295 5323292 +
tctttgctaagaaagaactc

SEQ ID NO: 19858 - DNA, 20 bp, Artificial Sequence
  Synthetic oligonucleotide; AGG chr11 5323277 5323296 5323293 +
ctttgctaagaaagaactcc

SEQ ID NO: 19859 - DNA, 20 bp, Artificial Sequence
  Synthetic oligonucleotide; TGG chr11 5323296 5323315 5323312 +
caggctttcatttttcattc

SEQ ID NO: 19860 - DNA, 20 bp, Artificial Sequence
  Synthetic oligonucleotide; CAG chr11 5323328 5323347 5323344 +
tatgtctgtgtctgattctc

SEQ ID NO: 19861 - DNA, 20 bp, Artificial Sequence
  Synthetic oligonucleotide; GAG chr11 5323335 5323354 5323351 +
gtgtctgattctccagatcc

SEQ ID NO: 19862 - DNA, 20 bp, Artificial Sequence
  Synthetic oligonucleotide; TAG chr11 5323359 5323378 5323375 +
ttaactactaaacctatgtt

SEQ ID NO: 19863 - DNA, 20 bp, Artificial Sequence
  Synthetic oligonucleotide; AAG chr11 5323366 5323385 5323382 +
ctaaacctatgtttagataa

SEQ ID NO: 19864 - DNA, 20 bp, Artificial Sequence
  Synthetic oligonucleotide; AGG chr11 5323367 5323386 5323383 +
taaacctatgtttagataaa

SEQ ID NO: 19865 - DNA, 20 bp, Artificial Sequence
  Synthetic oligonucleotide; CGG chr11 5323370 5323389 5323386 +
acctatgtttagataaaagg

SEQ ID NO: 19866 - DNA, 20 bp, Artificial Sequence
  Synthetic oligonucleotide; TGG chr11 5323395 5323414 5323411 +
aatgccatattgtatttgct

SEQ ID NO: 19867 - DNA, 20 bp, Artificial Sequence
  Synthetic oligonucleotide; TAG chr11 5323409 5323428 5323425 +
tttgcttggttttgatgctg

SEQ ID NO: 19868 - DNA, 20 bp, Artificial Sequence
  Synthetic oligonucleotide; CAG chr11 5323416 5323435 5323432 +
ggttttgatgctgtagatga

SEQ ID NO: 19869 - DNA, 20 bp, Artificial Sequence
  Synthetic oligonucleotide; AGG chr11 5323417 5323436 5323433 +
gttttgatgctgtagatgac

SEQ ID NO: 19870 - DNA, 20 bp, Artificial Sequence
  Synthetic oligonucleotide; GGG chr11 5323418 5323437 5323434 +
ttttgatgctgtagatgaca

SEQ ID NO: 19871 - DNA, 20 bp, Artificial Sequence
  Synthetic oligonucleotide; AAG chr11 5323428 5323447 5323444 +
gtagatgacagggttcatta

SEQ ID NO: 19872 - DNA, 20 bp, Artificial Sequence
  Synthetic oligonucleotide; AGG chr11 5323429 5323448 5323445 +
tagatgacagggttcattaa

SEQ ID NO: 19873 - DNA, 20 bp, Artificial Sequence
  Synthetic oligonucleotide; GAG chr11 5323431 5323450 5323447 +
gatgacagggttcattaaag

SEQ ID NO: 19874 - DNA, 20 bp, Artificial Sequence
  Synthetic oligonucleotide; AGG chr11 5323432 5323451 5323448 +
atgacagggttcattaaagg

SEQ ID NO: 19875 - DNA, 20 bp, Artificial Sequence
  Synthetic oligonucleotide; AAG chr11 5323436 5323455 5323452 +
cagggttcattaaaggagga

SEQ ID NO: 19876 - DNA, 20 bp, Artificial Sequence
  Synthetic oligonucleotide; GAG chr11 5323438 5323457 5323454 +
gggttcattaaaggaggaaa

SEQ ID NO: 19877 - DNA, 20 bp, Artificial Sequence
  Synthetic oligonucleotide; AGG chr11 5323439 5323458 5323455 +
ggttcattaaaggaggaaag

SEQ ID NO: 19878 - DNA, 20 bp, Artificial Sequence
  Synthetic oligonucleotide; AAG chr11 5323442 5323461 5323458 +
tcattaaaggaggaaagagg

SEQ ID NO: 19879 - DNA, 20 bp, Artificial Sequence
  Synthetic oligonucleotide; TAG chr11 5323445 5323464 5323461 +
ttaaaggaggaaagaggaag

SEQ ID NO: 19880 - DNA, 20 bp, Artificial Sequence
  Synthetic oligonucleotide; TGG chr11 5323466 5323485 5323482 +
agatgtaactcatgataatg

SEQ ID NO: 19881 - DNA, 20 bp, Artificial Sequence
  Synthetic oligonucleotide; TGG chr11 5323477 5323496 5323493 +
atgataatgtggacaacctc

SEQ ID NO: 19882 - DNA, 20 bp, Artificial Sequence
  Synthetic oligonucleotide; TAG chr11 5323529 5323548 5323545 +
tcaaacccatcactgtaaca

SEQ ID NO: 19883 - DNA, 20 bp, Artificial Sequence
  Synthetic oligonucleotide; AAG chr11 5323532 5323551 5323548 +
aacccatcactgtaacatag

SEQ ID NO: 19884 - DNA, 20 bp, Artificial Sequence
  Synthetic oligonucleotide; AAG chr11 5323537 5323556 5323553 +
atcactgtaacatagaagat

SEQ ID NO: 19885 - DNA, 20 bp, Artificial Sequence
  Synthetic oligonucleotide; TGG chr11 5323553 5323572 5323569 +
agataagaacacaactaatg

SEQ ID NO: 19886 - DNA, 20 bp, Artificial Sequence
  Synthetic oligonucleotide; GGG chr11 5323554 5323573 5323570 +
gataagaacacaactaatgt

SEQ ID NO: 19887 - DNA, 20 bp, Artificial Sequence
  Synthetic oligonucleotide; GAG chr11 5323556 5323575 5323572 +
taagaacacaactaatgtgg

SEQ ID NO: 19888 - DNA, 20 bp, Artificial Sequence
  Synthetic oligonucleotide; CAG chr11 5323562 5323581 5323578 +
cacaactaatgtgggagata

SEQ ID NO: 19889 - DNA, 20 bp, Artificial Sequence
  Synthetic oligonucleotide; AGG chr11 5323563 5323582 5323579 +
acaactaatgtgggagatac

SEQ ID NO: 19890 - DNA, 20 bp, Artificial Sequence
  Synthetic oligonucleotide; GAG chr11 5323570 5323589 5323586 +
atgtgggagatacaggtatt

SEQ ID NO: 19891 - DNA, 20 bp, Artificial Sequence
  Synthetic oligonucleotide; AGG chr11 5323571 5323590 5323587 +
tgtgggagatacaggtattg

SEQ ID NO: 19892 - DNA, 20 bp, Artificial Sequence
  Synthetic oligonucleotide; GGG chr11 5323572 5323591 5323588 +
gtgggagatacaggtattga

SEQ ID NO: 19893 - DNA, 20 bp, Artificial Sequence
  Synthetic oligonucleotide; TGG chr11 5323578 5323597 5323594 +
gatacaggtattgagggctt

SEQ ID NO: 19894 - DNA, 20 bp, Artificial Sequence
  Synthetic oligonucleotide; CAG chr11 5323593 5323612 5323609 +
ggctttggctctctcttcac

SEQ ID NO: 19895 - DNA, 20 bp, Artificial Sequence
  Synthetic oligonucleotide; AAG chr11 5323596 5323615 5323612 +
tttggctctctcttcaccag

SEQ ID NO: 19896 - DNA, 20 bp, Artificial Sequence
  Synthetic oligonucleotide; CAG chr11 5323611 5323630 5323627 +
accagaagcaatgcctatga

SEQ ID NO: 19897 - DNA, 20 bp, Artificial Sequence
  Synthetic oligonucleotide; AAG chr11 5323618 5323637 5323634 +
gcaatgcctatgacagtatt

SEQ ID NO: 19898 - DNA, 20 bp, Artificial Sequence
  Synthetic oligonucleotide; TAG chr11 5323624 5323643 5323640 +
cctatgacagtattaagaat

SEQ ID NO: 19899 - DNA, 20 bp, Artificial Sequence
  Synthetic oligonucleotide; TAG chr11 5323631 5323650 5323647 +
cagtattaagaattagaata

SEQ ID NO: 19900 - DNA, 20 bp, Artificial Sequence
  Synthetic oligonucleotide; AGG chr11 5323632 5323651 5323648 +
agtattaagaattagaatat

SEQ ID NO: 19901 - DNA, 20 bp, Artificial Sequence
  Synthetic oligonucleotide; GAG chr11 5323634 5323653 5323650 +
tattaagaattagaatatag

SEQ ID NO: 19902 - DNA, 20 bp, Artificial Sequence
  Synthetic oligonucleotide; AAG chr11 5323637 5323656 5323653 +
taagaattagaatataggag

SEQ ID NO: 19903 - DNA, 20 bp, Artificial Sequence
  Synthetic oligonucleotide; GAG chr11 5323639 5323658 5323655 +
agaattagaatataggagaa

SEQ ID NO: 19904 - DNA, 20 bp, Artificial Sequence
  Synthetic oligonucleotide; AGG chr11 5323640 5323659 5323656 +
gaattagaatataggagaag

SEQ ID NO: 19905 - DNA, 20 bp, Artificial Sequence
  Synthetic oligonucleotide; CAG chr11 5323648 5323667 5323664 +
atataggagaagaggatgat

SEQ ID NO: 19906 - DNA, 20 bp, Artificial Sequence
  Synthetic oligonucleotide; CAG chr11 5323652 5323671 5323668 +
aggagaagaggatgatcaga

SEQ ID NO: 19907 - DNA, 20 bp, Artificial Sequence
  Synthetic oligonucleotide; TAG chr11 5323657 5323676 5323673 +
aagaggatgatcagacagtc

SEQ ID NO: 19908 - DNA, 20 bp, Artificial Sequence
  Synthetic oligonucleotide; AGG chr11 5323658 5323677 5323674 +
agaggatgatcagacagtct

SEQ ID NO: 19909 - DNA, 20 bp, Artificial Sequence
  Synthetic oligonucleotide; AAG chr11 5323661 5323680 5323677 +
ggatgatcagacagtctagg

SEQ ID NO: 19910 - DNA, 20 bp, Artificial Sequence
  Synthetic oligonucleotide; AAG chr11 5323671 5323690 5323687 +
acagtctaggaagattgtta

SEQ ID NO: 19911 - DNA, 20 bp, Artificial Sequence
  Synthetic oligonucleotide; GAG chr11 5323673 5323692 5323689 +
agtctaggaagattgttaaa

SEQ ID NO: 19912 - DNA, 20 bp, Artificial Sequence
  Synthetic oligonucleotide; CAG chr11 5323686 5323705 5323702 +
tgttaaagagatcaaaatta

SEQ ID NO: 19913 - DNA, 20 bp, Artificial Sequence
  Synthetic oligonucleotide; AGG chr11 5323687 5323706 5323703 +
gttaaagagatcaaaattac

SEQ ID NO: 19914 - DNA, 20 bp, Artificial Sequence
  Synthetic oligonucleotide; GGG chr11 5323688 5323707 5323704 +
ttaaagagatcaaaattaca

SEQ ID NO: 19915 - DNA, 20 bp, Artificial Sequence
  Synthetic oligonucleotide; AAG chr11 5323693 5323712 5323709 +
gagatcaaaattacagggta

SEQ ID NO: 19916 - DNA, 20 bp, Artificial Sequence
  Synthetic oligonucleotide; AAG chr11 5323704 5323723 5323720 +
tacagggtaaagtctattga

SEQ ID NO: 19917 - DNA, 20 bp, Artificial Sequence
  Synthetic oligonucleotide; CAG chr11 5323713 5323732 5323729 +
aagtctattgaaagttatgt

SEQ ID NO: 19918 - DNA, 20 bp, Artificial Sequence
  Synthetic oligonucleotide; AAG chr11 5323719 5323738 5323735 +
attgaaagttatgtcagcac

SEQ ID NO: 19919 - DNA, 20 bp, Artificial Sequence
  Synthetic oligonucleotide; CAG chr11 5323723 5323742 5323739 +
aaagttatgtcagcacaagc

SEQ ID NO: 19920 - DNA, 20 bp, Artificial Sequence
  Synthetic oligonucleotide; TGG chr11 5323739 5323758 5323755 +
aagccagtctcatgatttct

SEQ ID NO: 19921 - DNA, 20 bp, Artificial Sequence
  Synthetic oligonucleotide; TGG chr11 5323742 5323761 5323758 +
ccagtctcatgatttcttgg

SEQ ID NO: 19922 - DNA, 20 bp, Artificial Sequence
  Synthetic oligonucleotide; GAG chr11 5323744 5323763 5323760 +
agtctcatgatttcttggtg

SEQ ID NO: 19923 - DNA, 20 bp, Artificial Sequence
  Synthetic oligonucleotide; AGG chr11 5323745 5323764 5323761 +
gtctcatgatttcttggtgg

SEQ ID NO: 19924 - DNA, 20 bp, Artificial Sequence
  Synthetic oligonucleotide; CAG chr11 5323748 5323767 5323764 +
tcatgatttcttggtggagg

SEQ ID NO: 19925 - DNA, 20 bp, Artificial Sequence
  Synthetic oligonucleotide; AAG chr11 5323752 5323771 5323768 +
gatttcttggtggaggcaga

SEQ ID NO: 19926 - DNA, 20 bp, Artificial Sequence
  Synthetic oligonucleotide; GAG chr11 5323770 5323789 5323786 +
gaaagcacgtgtgataacat

SEQ ID NO: 19927 - DNA, 20 bp, Artificial Sequence
  Synthetic oligonucleotide; AAG chr11 5323795 5323814 5323811 +
ttgcaatatgaaaatgaaaa

SEQ ID NO: 19928 - DNA, 20 bp, Artificial Sequence
  Synthetic oligonucleotide; CAG chr11 5323809 5323828 5323825 +
tgaaaaaagacgcaaaatta

SEQ ID NO: 19929 - DNA, 20 bp, Artificial Sequence
  Synthetic oligonucleotide; AGG chr11 5323810 5323829 5323826 +
gaaaaaagacgcaaaattac

SEQ ID NO: 19930 - DNA, 20 bp, Artificial Sequence
  Synthetic oligonucleotide; CAG chr11 5323813 5323832 5323829 +
aaaagacgcaaaattacagg

SEQ ID NO: 19931 - DNA, 20 bp, Artificial Sequence
  Synthetic oligonucleotide; AGG chr11 5323814 5323833 5323830 +
aaagacgcaaaattacaggc

SEQ ID NO: 19932 - DNA, 20 bp, Artificial Sequence
  Synthetic oligonucleotide; TGG chr11 5323818 5323837 5323834 +
acgcaaaattacaggcagga

SEQ ID NO: 19933 - DNA, 20 bp, Artificial Sequence
  Synthetic oligonucleotide; TAG chr11 5323834 5323853 5323850 +
aggatggatacaaaacccct

SEQ ID NO: 19934 - DNA, 20 bp, Artificial Sequence
  Synthetic oligonucleotide; TAG chr11 5323866 5323885 5323882 +
cactcctaacgctatgactc

SEQ ID NO: 19935 - DNA, 20 bp, Artificial Sequence
  Synthetic oligonucleotide; TGG chr11 5323872 5323891 5323888 +
taacgctatgactctagtat

SEQ ID NO: 19936 - DNA, 20 bp, Artificial Sequence
  Synthetic oligonucleotide; GAG chr11 5323876 5323895 5323892 +
gctatgactctagtattggt

(The sequence listing continues in the following parts.)

---

What is claimed is:

1. An ex vivo or in vitro method of genome editing in a human cell comprising: introducing into the human cell one or more deoxyribonucleic acid (DNA) endonuclease and two or more guide ribonucleic acids (gRNAs) to effect (i) a first single-strand break (SSB) or double-strand break (DSB) within a human beta globin locus on chromosome 11; and (ii) a second SSB or DSB within a BCL11A gene on chromosome 2 or a DNA sequence that encodes a transcriptional control region of the BCL11A gene on chromosome 2;

wherein the first SSB or DSB results in a permanent deletion or inversion within the human beta globin locus on chromosome 11 or a mutation within the human beta globin locus on chromosome 11;

wherein the second SSB or DSB results in a permanent deletion or inversion within the BCL11A gene on chromosome 2, a mutation within the BCL11A gene on chromosome 2, a permanent deletion or inversion within the DNA sequence that encodes a transcriptional control region of the BCL11A gene on chromosome 2, or a mutation within the DNA sequence that encodes a transcriptional control region of the BCL11A gene on chromosome 2; and wherein the two or more gRNAs comprise at least two of the nucleic acid sequences of SEQ ID NOs: 228,428-228,436.

2. The method of claim 1, wherein the permanent deletion within the human beta globin locus on chromosome 11 is a hereditary persistence of fetal hemoglobin (HPFH) deletion selected from the group consisting of a HPFH-4 deletion, a HPFH-5 deletion, a HPFH-Kenya deletion, a HPFH-Black deletion, a large Corfu deletion, a small Corfu deletion, a small deletion, and combinations thereof.

3. The method of claim 1, wherein the one or more DNA endonuclease is Cas9 (also known as Csn1 and Csx12) or a homolog thereof.

4. The method of claim 1, wherein the two or more gRNAs comprises:
    (i) a concatenated gRNA comprising a first gRNA and a second gRNA, wherein the first gRNA and the second gRNA are attached via a linker, optionally wherein the linker is a chemical linker or one or more nucleotides; or
    (ii) one or more single-molecule guide RNA (sgRNA).

5. The method of claim 1 wherein the two or more gRNAs are delivered to the cell by successive electroporation.

6. The method of claim 5 comprising:
    introducing a first guide RNA into the human cell using a first electroporation wherein the first guide RNA targets a human beta globin locus on chromosome 11; and
    introducing a second guide RNA into the human cell using a second electroporation wherein the second guide RNA targets a BCL11A gene on chromosome 2 or a DNA sequence that encodes a transcriptional control region of the BCL11A gene on chromosome 2.

7. The method of claim 5 comprising:
    introducing a first guide RNA into the human cell using a first electroporation wherein the first guide RNA targets a human beta globin locus on chromosome 11; and
    introducing a second guide RNA into the human cell using a second electroporation wherein the second guide RNA targets the human beta globin locus on chromosome 11.

8. The method of claim 5 comprising:
    introducing a first guide RNA into the human cell using a first electroporation wherein the first guide RNA targets a BCL11A gene on chromosome 2 or a DNA sequence that encodes a transcriptional control region of the BCL11A gene on chromosome 2; and
    introducing a second guide RNA into the human cell using a second electroporation wherein the second guide RNA targets a BCL11A gene on chromosome 2 or a DNA sequence that encodes a transcriptional control region of the BCL11A gene on chromosome 2.

9. The method of claim 5, wherein each electroporation step occurs 12-72, 12-48, or 36-72 hours apart from one another.

10. The method of claim 1, wherein the two or more gRNAs comprise:
    (a) the nucleic acid sequence of SEQ ID NO: 228,429; and
    (b) the nucleic acid sequence of any one of the nucleic acid sequences of SEQ ID NOs: 228,431-228,436.

11. The method of claim 1, wherein the two or more gRNAs comprise:
    (a) the nucleic acid sequence of SEQ ID NO: 228,430; and (b) the nucleic acid sequence of any one of the nucleic acid sequences of SEQ ID NOs: 228,431-228,436.

12. The method of claim 1, wherein the two or more gRNAs comprise:
    (a) the nucleic acid sequence of SEQ ID NO: 228,429; and
    (b) the nucleic acid sequence of SEQ ID NO: 228,428.

13. The method of claim 1, wherein the two or more gRNAs comprise:
    (a) the nucleic acid sequence of SEQ ID NO: 228,430; and
    (b) the nucleic acid sequence of SEQ ID NO: 228,428.

14. The method of claim 1, wherein the two or more gRNAs comprise at least two of the nucleic acid sequence of any one of the nucleic acid sequences of SEQ ID NOs: 228,431-228,436.

15. An ex vivo method for treating a patient with a hemoglobinopathy, the method comprising:
    isolating a hematopoietic progenitor cell from the patient;
    genome editing the hematopoietic progenitor cell by the method of claim 1; and
    implanting the genome-edited hematopoietic progenitor cell into the patient, wherein the genome-edited hematopoietic progenitor cell has reduced expression of human beta-globin and/or BCL11A.

16. A method of treating a patient with a hemoglobinopathy by administering an edited autologous cell to the patient, wherein the edited cell has
    (i) a permanent deletion or inversion within the human beta globin locus on chromosome 11 or a mutation within the human beta globin locus on chromosome 11, and
    (ii) a permanent deletion or inversion within the BCL11A gene on chromosome 2,
    a mutation within the BCL11A gene on chromosome 2, a permanent deletion or inversion within the DNA sequence that encodes a transcriptional control region of the BCL11A gene on chromosome 2, or a mutation within the DNA sequence that encodes a transcriptional control region of the BCL11A gene on chromosome 2,
    wherein the deletions, inversions or mutations are made by two or more gRNAs, wherein the two or more gRNAs comprise at least two of the nucleic acid sequences of SEQ ID NOs: 228,428-228,436, wherein the deletions, inversions or mutations result in reduced expression of human beta globin and/or BCL11A in the edited cell.

17. The method of claim 16, wherein the two or more gRNAs comprise:
    (a) the nucleic acid sequence of SEQ ID NO: 228,429; and
    (b) the nucleic acid sequence of any one of the nucleic acid sequences of SEQ ID NOs: 228,428 and 228,431-228,436.

18. The method of claim 16, wherein the two or more gRNAs comprise:
    (a) the nucleic acid sequence of SEQ ID NO: 228,430; and
    (b) the nucleic acid sequence of any one of the nucleic acid sequences of SEQ ID NOs: 228,428 and 228,431-228,436.

* * * * *